United States Patent 9,328,346 (POLYCOMB-ASSOCIATED NON-CODING RNAS) - sequence listing, part 34

SEQ ID NO: 5718 - RNA, 111740 nt, Mus musculus
cgcggaggcgcgagucgcccgccccgcacuacaggccacccuuuccacaccgcgcgcugcaaguucugauccccgccgccucaccccaccccgggcgcgcgcucgccaggcggggccgcgcucgccggauccuccccuuaaacgcccucuccgggaagcgccagucccgguccgagcggcgcuaccuccgcucgugcgcgcgcgcgcgcccgcccgcccgcccucaggcuccccgcgggccgcgucacgugaccgcgcccagccaaggcggcagcggcggccgcgcgagcauccgcagcgguggcagaggcagcgggagcagcugcgcugccagcguggagcgggaggcguggagguguggagaagaagggagcgucggaccggaacgggugagcgcccuccuccccccuugccugcucgggcggucucgcgggucacccggugcacaccgggccccugccccggagcuggccguugccccuugagcuccgcgucugcggaccgguguccccggaccccgccccggguugcaccccgcccguugcugcugcuguugcugcugcugcggacgccggcgcggggccgguugagcugcugugccgagcgcggcgcgcccugagcgcggcuuugcggagcggaggaggcggguccugcggggacgcgagcggccacucggcggccgccgggcucugggcgggggccggccgggcgccgccuccuccuccuccgccgccgccuccucgcggugcagcgugaguagggagccccggcugguggacgccgagucucugggcuccgccgccgccgccuccuucccgaggugcagccgcaccuccgcguggcgccccgaacccagcgagccggcugcgggcacgucccgcgaccccucgccgccaucccccggacccacccgccuagcuuuccuugauucuuccccucggaaaaaaugguucccgcugcgggcgaggugaguggcggccgguggcugcccgcggcgggggcggccaccugcgggggaggccggguggggcgcgcagggcgcggcggggguccugacagcugggcgcgggguggagcgcggcggguccccgcgaaguuggcggcgccgccgggguucgcuccugcuaggagaccguaaaggugaggaggcuuccucuccgcgcgccucggcgccggguccagcucggagucgccgucccgguggcuucucgucuacacccgagggcucucggacuucgcggggcugccccugcugccgccacagcccaucugaacaccggucgccccuaccccggcauguggugaccuugagggcagcggugccccggcacucccucuuccugcgacccgggagggucacccauuuaaucccuggcuugggcccccgggagguacugcccgugcaaggugaagguuugucgucggccccccggagaggauggugugauagaugccugucagacaggacggugacucccggggaguugaagagccgccuggacgcucucuucaggucuugagucuggccccccaggauguucacgggugcuuccgauucauguuuauguacuuaguuuaaaagggggaaaaucugcucuguccucggaaagggucaguaagaaaggaggguggcauuccuauugcggggguggggggggcggagguggcgggggcuucuucucuauuucaucuugcaggagaauuuugugucuuagcuaguuagcgaccccugggucugcgccucggucuuugcccagguuggucucugcacauuucagucaccaguuuacugcgggacucuagcauugggaaugcuuuugcuguugcggugaucggacccgcaaggggaagcuggggcuggucugcguggguaaaagggucugcaggaccuugguaaggacgcgaaccuccucgguaggcuguuuuuuuuacccuuccuagggguuagagcgcugcagacagccaccuuuggcugcuaugcaugcuacuuuucuggguuuauuaauaaucuaaugacuccugucgguaucgauugcuguuccugauaaauuaguuauauggauuuuuuuuuucauacgaguggagguauaugcaugucuggacugucugccuuucaacauggaaggcuuuguugugcuucaccucccccaccugaggacagucuuacuuuaaaauaagguucuugauccucagcguagguguauuuuauaauaauaaguacuuguaaggaccugguuuguacaaagcgcgcauagggcaucccuuuggauaguggcccauuugagugaauggagagccuucacuugcccugccaccagcuuucccuagggagacucccuguccuuguguguggcagagccggauugggggaauuaaaagagggauuggaagggggagaaucugcuuuuuguacuuguauguuucauuuagcacccaucccuuuuuuuccccuuccuggucaguucaaauuugaaguaaauagaaauuuuuuuuuuuuuuucuuguugagagcuuuugaaagcugguguaggaaauugggccuuuuaagccauguuuucagggagauguuuuacuuucuaccgugcuuuggauaaaacaguuaaauggcugucauaaaggguggaucucugucccgauuuuggcuuggguguaacugcaaagaucuucgaaaaguaacuguuauuuccuaccauauacucugcaaaagugagucacauucgggugagcugaggacagagcgccaccuuugaucuaaaauuuuguuauccccccucccacccccgaucaaaugaugaaaauuaagaguacgccuucauaaugcugucguccucagccgugugcccccuuagaaguaagggagaauaugucuucauuuuucuauaauuucaagaccuugagaggaauuucagccacuguaugggaaacuacgguguuuuguuuuuuuaguugaagcuugagaccuuacuugccauucugagaugaggggaggaacaaauuuugacucguguuguuaauaaaauaagaggauauugauggucuggaucaacggagggguggaagguagugcggcaguguugucaacguuguuuagccauucuagcaaauuccagugccuaccagcaugguaguacuuagacuuuuuuuuuuuuuaacugcugagcuaugaacagguuccacaauaaacacugaaaauuuaguaaaauuauuuuucuggccugaauaugauauaguaacucauuuuuuuuuucauuagcugucuuccauuuaaccugccuuucauggucucacugagggcauaucauaccgugcuuuaagaucaucucuaaugagcacuuugagcagggauaccuagacucaaaguugaauggaaaccauguuggaaaaugaggcuucugcacacgguuccccucagaugcaucucauauuaaaaauaaaugggauuuuucaggcuugggagggagggagagggagauggagaugccguaguggcagcuaagcaggugagauuucccugcucucucugccucaccguccucccucuucucacauccaaauuuuagguacacuaucucuuuaggcagaggauaauuucuuauuaucaucuauaaaacacaaaagaaaaagauguagcuuuuaaguaauggguaaauuaacauggauguuaccuaauacagguuuuaauuacagaccacaagcuguuauugcuguuguaucugcauuuaaauuuuaauucaacauuugaguucuucugacuacuguaaagcauuagauguugagcuguagauaaguaguaagcuauaauuaaacaaaaaauccguuugagaugauagauuauuuauacucucacugcuacagagccuccuuaaagccauggaaaugguccuagguuaaaggacauuugaagccauuaaguugaugcaugcagaauaauuaauauauuguuaaacauauuuugguaaaauccucuauuugggguuucaguugacugauuuccuugggcaaaccucuuaaguuaguuuuaaaugaaacagucuuuuaugugaaacaaguguuaaaaggauuugucacuuaguaagacuuuuuauaauauugaagaucagaaaacauuugacaauuuuccuuguaguuuauacauaugugguuucagcugauauuuucaugaauuuuguaauuaauaugggaaacagaauaaggaucaggaagcagaggcuuaaaacuugaguuuuugcaucucauguaagaauauuuucuugaucaacuggaauggaaaauuauguucugauaaauaucuuacagaaagaugguauuaauaacuuauuuggagauauacagacucugagguaacauuacaaggaaaacuguauacaaggagcauuuucaaaaagaaguaacaauuucuuagcuuuuagagauggugcuuaggcacacacaccaaacacacuguuuuauuaaaauuuuuauuauaaaaauuaccaaugaaaauaggacaaacuuaacugaucauuuuaacaacucacagccuaucucuuguucauaucaccguacuagaaauaagucuuauaaauggacacauuagguaagugaauggaaucuuuuuuuuuuuaauuauuaauuuuuuaauguuggauucuuacuauguagcccuggcuggucuggaagucacuauguuagaccaggcuagcccugaacucauaaagacccaccugcucccuccuuuugaguguuaaauugaauucuuauguuuaauauuuguaucauaggagauacucagcccuacccaauauuuaacaggaucugaaaaauuugacccugguuguguauguggcaugggauuuuuauuuuccuccuaauacucuguuguauagcaaauaccuaguaauagcuuuucagguuguacucuuguuaauacuuuaucacagugacuuagaaaugcucucgauuccucaguguaguuuucaacauaaccauguggcuugauucucauaacaagucgauuuucaaagugaguuccggugacaguuguaccuuucuccuucugguagucaaggagaucuaucucaguccagugucacauagcuggcagauaaaucagccagaccuggacucuagguuauccagaggucccuugcuucugcucaucggugagcucacucacucuguguguuuaaguuuauggaccucagugccaggucagcuucugaucaguguaaauuucauaauauaauaaaagcaaguuugcuuaggcuuugcuuuguaguuuaauuauugcuuaugcucagaguaauaucagcaauucacaaauucacaccugcccugauuugcuucacagcaagggagcgacauaaacauuugcaaaauacuaguaaaaaacauaguuaaaauuuauaauuuuucaaaucuuguuuuuagugaggguuuuuuuuugcaauaauuuauuuaaaaauaaaauuaaugcuagcgcaaaaaaaguuccuucuuucaacuccuguaaucaagcgcuuguuuagcugccacagguaugucaucuaaaauuuucuccaauguucauuuguuaagcaguggaauuuagacauuuaaauaguuccccagugaggagauuuuuaauucauaaaauucaaaacguuguuauaaaucucucacaaaaaaggugguaauucucuacuguuagugcaguuaccuggggcaguugcucuaagcacaggucucuuggccuuaccccugcaauucugauucaacacauuugggguggggccggcgagucugcauuugaaaaagaaugcuacugacuuuauaaacuggaugaaauuguaaacauuauuaaaaacccuuuuuaugauccaggaggaaaucauuggguuuauuuugaacauagucgaauuuguguuccuaaaugguuuugacugguguagaaaaguuugacuuguuggguuggauaguccucuuucuucugugggugcugagucgucucucagaagccugucucugguaacuugguaagcacuauagauucucagacauguucuuucuuaguucugugucuaaauguccacugucuucaaaggaauugaacacuggcuucuucuccuaagaguaauucauguuauuuuguuuucuuuuucuuucuuucucuuucucuucucuuucucucucucuccuuuuuuuuuuuuuuuuuuuuugguuagagggaaaggucuuucuaauaaauggccauaaacuaguagguaaauagugacccuuuuaaauuucauuuagcaaacagcuacuacaaaacaaacagcauguuagugcugaugaaucucagaagaauauuaaugaugccauauugauaacuuaccagcugcacaccaaaacaagucagugcugccucccuugccuguuaauaauuuguguagguagguaaugugcuguaagguccguuugaucugacuguuaguguagucuuaacuguugcguacuacauaugagcuaacugccuugaaugcauuuccuguuuaaaaucagccuuauaaugcaguuguuuuguuucauauauaucaaugucacaguuuguacauacauuaaaaugacaguaguuucaaagcccaucucaggacuacugagcuuuuuuuuuuuuuuuuuacuuugaagacucaggcuuauuggcugagccuuagggaacaguuaagaauugugggguauaauuuacuaaugaucauggaaaucuaauuuauuauuuuuggcaaagugggaagacuuuucccuauauucucuuaaagcuuuugucuuuuaauuuuccaaaacaauguuaacuaaauaauguaugauguuuuaaauuacuucuuugguaagaaaauuauuugcuauuuguaaggauaguaacuuguagcauugugguuucuaacagucggguuuuguauuaauguaacugucaccugggccuccagagacacagagcagacuucugaauagaccacugcuugcucugcuugcuuacacugugaaaugugagauuauucucuucacugaaaauugguacgaccugauagauugaagaacgaaauggauguuuucugaaaaguagauccuagaaaggauuugauucuuuaccucaaaaggagcuuuuacaauaauuguauuguuagcaguccagaucugcccugcuuauuaacccagaguguucucuugugagaacuuuuaacauaaucacguucuucaaaugcucaggcucugugcgucgauuuaccuuuccucuuugugcugagauuuaucagguuuuuggggguuuguuguuaauguuuguuuucuucaaccuuaccugaugucauauuuuccacuaaaacaguuagugcuccccccuuuuuuuuaauccuauauaucuagguucuggaggauuuguaucaaaugcguaacccaguguucucuaaaguguguuggaaaacacuggcucuuaggaucacuaaggguuugaugugaggaagagggcagaacagaaaucuaagacguacuguugaggcaguuuuuccauuugggauuucuucacaccuguaaugugggaauauggauagaaucuauucagauguguucauuguuuugccuuuauuucagaccaccuuaguggagcaucugucucaucugccagcccuaguauguuccccaccagggucacugcuuuguacuuuuagagaagguguuguucacacauacagccucacacgaaugguguuuucuggagcugagagccaugcuguauagaaagcacuguugaccacccacuggagacagaguauagccuggcuguugcccuguucccuuuguugugauuucauacauguauccucuaaccugagaaaacucuaggucuccuggucuaaguaugccucuuauucaaagcucagcaacuggacaaccuuucuagucauuuuuuuauuucauuacuuugccugucugaauuccucuaugucucuauucuugccuauacgcuucuuguauuuguuugcaagauagauuuauuuauuuauucauuuauuuaaauguguauguguguucuugcauaaguuugugugcucaggugcccauggagaccaggggugggguuugggggguuggggggacaguuggaucccuuugaacuguaguuuuaacaggcauugugagcccccuaauauggguacugggaacagaacacagguccuuugggagaacagcaagcucucuugacuacagagccagucucugcagcccaagucacacacuucuuagguucuguauccccuuucuguagcagacacaacguggagacguguucauggaagaugcuacaucagggcacucugcauauugguuuaagaguuaggcauuguauaucuuucguuaagguauuaauaacagagaagcuuagaaccugggagaauuucuaaagcuugucuugucugacuucuuaacccugcgccuguugcuucacaggcuagucugucuuacuaguggaccagugauucccuuucauugacuaagacagucgaauucagcuucuauauggggaguauuuuccacuugcaaacaguguagcauauucauccuuauuagacuuuauucugauucuaaaaauaauugcuguuuaacuuuauauuuuuaaugaaaauacguaugagacucaacucccaaagaaugaauaaaaaguuuaaaaagagaaagaacaagucauugggggaaaguaugucuuuuuuuaaauaacuaauuucauuugggacauaugccaucuuagccuuucauuugaauuaauauugagaugugcuuccugggucucuauauaauucauugauaaauugcaugguguacaaggucauaacuuggagggaguauuauggguuauaguuuaauugucgucuugccguuccuugcguuggugggaaugcuuguggagcuggaaugggaauaggucacaggcccuaauguuugggggcagggcguuugagggugaacucucagucugugaccuauugcuuagucacugcaggcaucaggaagaaguacaaggaugcagucuguuaaaggugaaaaguaugguacuauggucauucuuuuacccgccuucaggucaagaaagaccacauuucccaugucuaccgaaugcucauuucauacacaccauguucauuucaaacuauauaaauuuaccauuguaaaaaucaucacucucaaaauaccuggcggggggaacuucuagaaaugaacccauuuuccaguaauuagcauacggugcuauuguuuuguuuagcuguuucaaauuuuauacguauauuuuugaacaguuuuuaagggcucauaauuuaaguguuuauuuuuuuaaauuuaaaaccuuuucuuuugggacauuauuuuaugaggauccaauuuaucauaauuauauuuaugccacuccccucuuccucucuguuccccacuuccuuuccuucugauucucuucuuagucugccaguggcuacaccauuaaagcaagccuuuagcaacugugaacagccaguagcuucccaggaaggaaugguaccucagagauaccucuuuugaagggccaaccaaaucuugugcccguuuucaugauuguagugcuuuauggaauuuguucccacucugcagcucaaguuguuucuuucugaaacguacgugcgugcgagugggugugcgcgugcaugcgugcuuacaucacagacagacacuuuucuaggguucaacacuaacagcuguucauucucagcauuucacuagauagaaacugcauuagccaucaugcuuugcgacaaagagccccucugcugcaggccgagcaccacacugguucacagauagaacaaacauuaaacaucuagggaaccagcaguagcauauucccuucaugggccuaucacuccucagccgggcuuuggggguuuuauaguaccagguaugccuucauauggggcaggucucccuccaguuccaucacacaacaguuauccccaaagaguucugccacuagugcaccagcaggcuuauccugcuuggcuagucaguauuguagcacacauugucuauagcuaagugagacuagaccaaugauguguuuccugaccaggguauauaaauagaauuucauaaaguccuauagaaaauacugggacuugguccugcuuuaacuuuguaucauuguaauuauagugcaacuguuggucagagagaugcacaggcgugguuuugccaguggaaaauaaaaggaauuugaagaggaggauuagcaaaaguaaaacggauuaaagcaguaagucuugaucuuccuguaccagaaugcacacagguaguaggugcacacauacaugaugcagccugccaaugccuauagauagaaaauauagaucuauagaauucuacccuucucagcacauauccaaagucaauugagucaugcuauauuugcuuuuuugauguuguuuuucuguuaaaaagugacucauagccgggcagugguggcgcaugccuuuaaucccagcacuugggaggcagaggcaggcggaucucuugaguucaaggccagcccggucuacagagugaguuccaggacagccagagcuacacagaguaacccuguccggugugugugugugugugugugugugugugugugugugugugugugugugugugugugugugugagagagagagacucaugagcaucggguacuuuguauacugaaaacaacuaaagccaugagagggaaaucccgaggggaagggucccaguguauacagacagggcaguaaacaaggauggucaguuagaccacaaagaugcuggacauacugaggagaaggaggcuugccagcaccauguucaggaguuagaaacagagcagccaguccccucuacacacuggggauauacacacauacagcaaccuuugggcugugcugccuuggaauuugaacagcagucuuuuauaugcccggaacacguggcccucccuccugacuucccugucacugugguccucucaugcugaagcacugaauucugucagugauacuuaagcuuagcuuucagaaaccuuuauuaaauuuagcauaacccuuauucuuuucaaccuuucauuuuuaaguuucacuaacucuugucuucuaacuuugguguuuuguuuuguuuuguuuaaauuuaauuuuuucaaucgagacaagugcuguuugguuccucaagauagauauauucauugaaaaccuaaguugucuuaaguuuuucaucggaaggaguuuuguguaaccaguguuaacccugcucccugucagguguacacuaaaauuguaaauagcaaauuccuuacaaauucagagaaaagaaauccauaccaaaaugucgggaagagcggugguagccacacggcagaacccaggauugucacuuguagcaugauucuuacugcacaguauuauaccguaauaaagcaguaaggaaacuuuuacaucgugauuacaaaaauccuacaaacaaguuaaucaaagguguggacaucaggguguggcuuucuaacuauggauuucacuggugcugacagaugaaugagagguggucccucgggcacucaaaaagcugaauucuagccagugauggagaagccugggagcugcucaguuauuguuucagagguccucaagggcucugugaccauccuccucaucucuccagguuccagaagccugucuuuugucuucuggggaauacauugagacccacagcagcaaaccaagauaccauagucccagugcagaucccggccaccccuuguuaaucugugcuggccagcaauggagaguucucugacucaaggagaaugacuugagaauccugauuugugugaagaaagaaaaaaagagagagggagggagggagggagggagggagggaaggagagagagagagagagagagagacuuugucagaucuucuacagugaacucuguaguuagaaaaccacacauugauguccauaccguugauuuuucucuauuugucuuacuuuuuuuaaucauaagauuuuuuucuuauuacuuuauuaagguaucauauguacaauaaacaucauguuaucuaaagugacaauccuagguucugauuuauggcuaucucaguaaaaccacagucuguuauuaagcauauuaagcguagacacucccauuagagugucuuuucgucucuaucccaccacccuuuccaacagcccgcugcugcucuccucgguuaaucacugaccuguccugauuaacuugacaugucucuaagcauaugaucuuaaaaacguacaauagaugcucuuuuguagucuggcguuggagcuaaguaucuuaagauucaucugugucguaucuauaaauaguuguuuuuguugcugaugacaaugucacuguauagcugugacacuguuuguuaaugggaaauuguggacauuuugguucauguaaagcacaguuuguuguuuuuugaguuauauuagcucuuuauugcuuagaucaaagaacuuugggaaucauuuguguuugcacugggagguggcggcaaguguugaugaaaggaauccaugaaaccucaaacuggcaaagcagggaggcucacccugucagaaguaucugugaagaugaguguggguucugugccagucaccccagauaaggcaacuugaaggaggaaaagcugaucugggcccaugauuucagauuugaguccauugguugccuugccucauuguucugggccugugguaaggcacugaguggcagaagcaugugguagauaggggacuugauaaccucagggcagcucagaagcagggaaugggcagccuccagugucuccuucaagggcaccccucagugaccuauuuccuuccaggauguuguccacuaucacaugcuagcaguccagguugguaaccagccuuuaauacaugcaguuugggggacagggaaaguggagggcaggguaccucagaucggaaagcaaguuccaaaaugaauagcuaguagauuagaaaguguaguuuuuaggucccucagaguagggaacaacagaggaaaacuaaggggauuauugauauuccagaggaaaaguaucguggaucuuugcccuaaagaaacuuaggcauguagaauuucaucagauggauauauuucaauguauuuacaccucagauauguuaccuguuuauucuguuugcaauuucugguggcuuagauacacacauccugcuacuucuggcaaaauagcuugcuucuacggaagcaccaaggagaaaagcagaucuaacuaacgugucuucuguagagguguucuguuaacagcgcauaggucuuucuucauccugaauuucuccuucaagcccaugguacuucaaguucauaaguccuuuauggcgaggaacagugguuugucauccccaacauuuguagcaguguuuuagggcuuuuguuguuguuguuguuuuuuuuuuuuuuuaugacaccugaguagucccaguuacuuugaccuugugaaggaaaauacggauugacuaaaaugaauugucauauaccagcuuucuaccuguaacauccuggucucagacaguggcuucuguggaguuugugggucagauaacucucuaucgaaaaugaugaguaggguuugcagcuguucgccaagacuacucuuaggacugggcuggggagaugggugaguacagugguaggcacauaaguguaaggacaggaguucagaucuggaacauccacucaaugccaggcgagcauggaggcucacuuccggccccaaccuugagagcuagagacagggagcaagcuggcuagcuagcggagccgaguuagggagcugugagagagccugcccacaauuaaaguagagagcacgaggagggcaccuugauggcacccccuggucucuaccagcucacucaugcacacagguuuguguaugccucuacauauaugaaaaugcacacccaucacaggcaauuauccgcaaauacagugacuuuuaaaccuuacauacccagaaauguaagagcacugauuauaaaaugcuuggaagacacagaaugguguaaccguuaaagagaaucaggcuugggagaugacagcucagugguuaagagcacggagagccuggcuugauucccaguggccacagggugguucagaacccgcugcaacuccaguucuaggggauuugacgcccucuucugcccuccacagucaccaggcaugcacaugguccgcagacuacaugcaaacaaagucauccagaaauauaagaccaaauuuugaauaagaaaaucacgcgcuauaugugauaguuagcuuuaacauuuaauuauucugauauuuggauuguguaugcuuuaacauccuugaaguaguaaagugugauuaagaaacuguauaugguuuucuaaauuuccuucuuaaugugaucuaaauuaguaugaucuguuuaugacuagccccacguacggaauguuuugguuuuccucuuuguuaaauaaucccucauugugcauccuuauuucugaaugcuuaucucuacuuaugaccgugcacuuuuauaauuauuaaauuuaaaaguaaugugcugguuugugugacccguuacaauuucuuccagcuuccuggagucagguuuuugggauggucuuuucuucuucuguauaauaguguuuccugucuauuuacaugucuuuccacuacuuucucaaacucccauagcaccuuuaaaaauuguauucuuguuugacacuuucaggaccuguucagccugagaguagaggaugcuaauuuuucugucacuugcccuuggcauggugccuauuuauaccugugugguucuucaugauguuaagugagcaucuugucucuagcaaugagcuuguauccauugccuucucauucauguaaaauccuugcuugggccuggagagauggcucugccccacugugaaaagcacuggcuucucuuccagaggaccuggguuucaacccaaggaucuagauggugucucacaaauaccaguaacuccaauucgagggguuuucucuucugggcuuuucagauaccagccauacacgugcugcacagacauacaugcaggcacucguacacauaaaacaaaaauaaaauacuuguuacauucuuagaagcaagaguaugcuuggaaugaggauuuaucagccccuccuguuuucucuuuuaaacuucaagaagacugaugugcuagccggacggcacagaugaaaagugccuuguuacagcuguucugugcuuuauacauuuuauucuuucuguaaggagaauuuacuaccugugcaaauagaaaaauaaugcaguggagacuaggaagggaagacuuacagaugcccaaguaaccgaauucggaaugccagccuuuugacaaaaugcuccaaaacagaauguggcuugcuuuuuguucuuuaggacagaaaacuacagauguucuagcaucuaaacucuuauggaaaagucgaugugcaaauaauaauacagacuccauuguaggucaaaauaaaaucguggaggcuggucaagguauuuuaguaaauuuucauaugguguuuucuggaauuuuuuuuuaacuucagauuuugaguggaagacagaauuauuuuaaauuaaauaucuguauuuuguuuuuuaauggggagacagauagaucaggaguucaaaaccagacugggcuauauaacacagccaucuaaaaaaaaaaaaaaagcaaaagaaaugaaagagggggacagauggggcagagggagagguguguguguguguguucccgcgugugugcgugggugugcucaagccuguuguuuugcugggaaggcggggugggaagagacugcacgcuugcugcuccccucucuuuccuuuucugugagggugcuuaucagaugcugccugcuugaguacugaguaccgguaccugugugugcagcugaccccuuccuugauuguucucuaugggaaagggcuguggcauuucucacugcuucuuuuucccuacaaaggagagcccccgcccccgcccccgcccccucgugcucucgaaccucaggacuuuugcugcccuuguuuucguucugcccuuguuacugcugaggauuuuccugaguggcagccguguuuccacauaggaccuagggccggcgacuuaggcuguccauucagcugucaucuuggacuuucuccugccuuccuucuugguacauauuaaaucauguagccauagauucaaauguaguccccaggagagaugcugucuggugacgguauuugucuugcaaugagggaaaaugguuggugagauucuuuggccgugcucccacaguauauuugguaucagcugcuggccucaggaaguauauaccccagaguuaaagaaauuuagauugguuuuaggguucuuaagagauguuuauuuaacugaaaacugcaaauaauauacaagaagcgggaggccaucacugaaagccacagguaauauuggaauugugagccuuugaguuuaaaugacagcuauagaaguacaaugugcuggaugugugcgugugcuugggaguucagaacaagcagaguacuuucuuacuuguuuucuuuuguuuuguuuuuuucuuuuucuuuucuuucuucuuuuuuuuucuuuuuucuuuuucuuuuuuuuuuuuuuuuucuguuuugauuuuuuuaggacacgguuucucuguauagcccuggcugcccuagaacucacucuguagaccaggcuggccuugaacuuagaaauucgccugccucugccccccaagugcugggacuaaaggcgugggcccccagucuguuuguuuuuuuauuuuuucuauuguaaucgaggucacuuuaagagaaaaauagagguauaaaagauguguagaaaagugugcuuuguacguuaaagucaauacauaccaggcuucgcugaguauggugugacacucuuuaugaguuugaggccagccuggucuacauagcaaguugcaggccaccacuacuacacagagaacccuuucucaacagucacaagccauucuguuaguggacuggcugccuccuggaaugggacagaaaggcugcaaggggcuaaaggaaagguuaagggcuguuggguaucuucugggcuagccuggggcuguuguucauccaacuuccugaacuguguaaaacaaagaagagaaccaggaaauuggcagaaaagcauuuuaagaagccaaaaguuacugugucaaacucccuucaguuuagguguuuccuugguguguucacuuguacuuuagauucaguccuguacaacuuuuacaacuaguuuucuaauacauugccaaugacagaacagauaugagaagcaaaauuguuuggaggcaagcacaaggauuguguuuuuucagaaucagaaauuugacaucuuuuuuuuuuuaagauuuauauauuuauuauauguaaguacacuguagcugucuucagacacaccagaagagggagucagaucuuguuacggaugguugugagccaugugguugcugggauuugaacucaggaccuucggaagagcagucgggugcucuuaccugcugagccaucucaccagccccaaaauuugacaucuugauggugguguaagaugauguuuuuugaauugaucagauuuaacagucguggacaguugguugaaaaacauuggcucuuugccauuuuccguaucuggaaaaccuucauguggaauuaacgucaucuagggcccugaaaguccuccuucacaaaacccacaccccucaaagaguaggugcuucuugauaauugguggucauccaguuggacccugcuguguggucccagcucugguggcagucaccaccucgucauaccugaagaccuugcugauuccagagguccacagcagcugcucacuguccccugccuuuguaugucacucuccuugucacuaaaucgucauguuccagaguacugcuccuguucaaggccugcucuuaaagaccaggcuuugcuuagccaccacuccagccacccugcacagaaaccuuccuguggcuguguagcagucauuuucuaugguuaguuuccuugucucugaacuaucaggaaauaaaggauuaguuuaguaguagcuguaggcgagugagaaguacgcgcacagaugaucucggccugacugcuacagacaguucuugucucauaaaaauuauaauuacuacuggaauaucauccuuuuuuuuuuucuuuuuuauauagugagaaauccaaguucaagcccuuuuucaguuugaaguccugugagucauugcugcuggucuuggauugagaauggcaucagaacagcauguuacuuuguauaaccugugcucuguggucuuagcuuccuccacagugggcauauaacuuugcagcuuggcagauuuguuuguaguguguacuucaauauuuacuuaauuuuuaauguauucaaguguaugagagaguuccuaugcaugcaaggaggucagaggacagcauguucuggaagucgguucucaacaccccauuccaccccguuguugaggcugugucucuugggauacuccaggcgagcuggccugagagucuguucucccgucucucccucucaucuugucucagggaggcuaguguuacugauguugcacagcaucugccuuuugcuugggucuuggggguugccuacagguugucaggcuggcgcaccacacgccagucauucuccucagccccaaacuucauauucuaaaacugugguuuucuuauucuuauuucugucguuaauguaauaacgauccagugugcuaauguauaaaauggaaacacacugcccuuccuuaauuugaaaauccuuuucugagaauaaggcaaacccccuucccuauaauugccugccugacgggugacaggcaaucugugugaacuagauuuuugguuucaguguuguuucuuaauuacagacuucugaaagaugcuuuaagcagaaaugagggauucaaauugccauggucucaacgaugacaaaaggauggaauuuccuauuugggaagcuaauagugcugagaucugaaggaaugacucugucucucuacuucugugucucugugggggggggggauugauugauugauuauggaggggaccaggugccuuccuauaugacucuacauuuauuaauguuuuucacugaaccucugccuggccagcaagccccagggcucugccuauucucagugcuggaaguucaccugccacaccuggaguuuccagugugcugaauguguggggaggauacaaacucacacccucgugcuuccucaccaaaugccucaccagucagccaucucuuuagucucgagcaucuguaacagaucauuuccucucuuagagucauuugcugguaagucgauugcuuuuggauagagugggaguucgcuaggaguuaguuggugacaguguaaccccuagaccuagcagaauuccugggguaccgcaggucugaagcagaauaguaaucaugaguuucgccugcaggcuuccuucugcugaucuuuuuuuuuuuuuuuaauuguccaaaguaauuugugauauguuggcaaaaaauuuuuaugaaauuuauuuaguuucuaucuuuaaauuuuuauuuacgccaugucuuaguuagggauuuacugcugugaagagaaauaaugaccaaggcaauucuuauaaaggacaacauuuaauuagggcugacuugcaguucagagguucaguccauuauugucagagugagaaacauacuggccggccagcaggcaggcaugguagcuaagaauucuacaucuggauuggcaggcagcaggaagagugaaugagacacugggccuggcuugagcaucugagacuucagagcccacucccagugacauacuuucucuaacaaagccacacccacucucacaaggccacaaggcccuguggugccacugcaugggccuauaagagccauuuucauucaaaccaugacaugccacauaugucauggaugucacccuuuggccugaguuuaggagaacagguuggcuuguugacuuuaguuuuuauagucaugaggcuagagucugauuuucuuacacaguuaggugauugugagaagcacauugcaccaacagcuggugugccuucaucuguuuggcagcauuccugauaaggugauaagcccuucaguuccuuccucuguagacaaggaccuaaggacaagugcccaggggccugaaggacugaccagugggacaguucucuaguccugggcaguugcucuuuccauugccaauaacugugccuuuggugugucaugagcuagauauguuuguugguuucucaguuuuguuuuuuucuuuucucgaaauuaaaauguucuuggaucgaucuugaaaugcuagccuguucauccaacuauuucugcaaaacuguuuaggauauuaugcauuuaauuaaucuuauuuacaaaaugcugguuuaaaagggaccuguuuagaucuaguucucauuagagugugucucucauuugaaguaucagacagcaguggauauuugauacuguccuaauccauuauucuuuguuugagauaggaucucaugcagcugggcuugcucugcagacauccugccuccaccucccaagugcuggggccuucaggugugugcugccacguuugguggcauuacccuggccuuaaaggaggaauucauacugugagaaacagauggggaugagggagggcauaguaauuauccugaugauccuagggagaggggaaaacagagaaaagggcaucuuggucaaaaccaacaguuugggcauaggaguuugaugaucugauugaccuaggaaauuucaugucacaaaacgcugauuuguguagggacuugccucugacaguuuugccaguagcccaagaaaagggaugagucacaacuuugccacuauccuuacagaaugaugagcuaccaaccucauuaaugagacuuauuuacaaaauuacuucaaguauaucuucuuuaaaaugaagauuugcuaucuuugagacauuuucuuuaaaaaaaccaccaagaguugaaguuauagaugauucaggcaaugcgagcccauccagaaggcugaagauaauucucccuugguauaaagcacgcauuaccaaccuguauauauauucugguguauuaaaauuuuuuguaguagcuuuaugcaugcauaauaguaaugacaucuauuuaaaaaaucuagaaauuguauccaaugccuagugaagucuuacucugaagaaucuacguuuccaaaaaguaaguaaugggguguccauacauuccguauuuaaacuaaagaaaauuaaaacagucaaugugguuuuauuaaagcaacagcacccuagucccagggaucaguacgacucagaagcacagcgcaccuucuguauacagugaucgacagccauuugauauuuaggaaacagugauuagcaggucauggugauacacaucuguggucccaucguuuucgaggccaguaguuucaggucagcccgggacacaugagaucuugucucaagauaaauaaaugaagagcaaauuagcagaagcaaaccacugugucugugugaugugcccgcaguguguacacgggaaagguaagacauagaugugaggauaagagcugucucccaggcugacuugguggugugugaaaaacaauaaucaacaaguguaaauacugauagagcaagugagugauagaguaaggguaagaagccaugcugagccugggcaggauguggguucgagccccccacaccccaacugccaacugggcauuugaggucuuucagcuuuuucucucauaagcauaaugguuauuagguagggccagaaacacaggccagauggacagucuauuacaauucauucccaguguuuguaagugugcugggcugugagacgagaccaaggugaugcuuagcuccugggagacccaauuuccuucagaaucaaagaaaaacgaaauuacaguugauguuuaauuuaguuuuaaaauuguuuccuuggaaacugggcuucguaaucagaaaacaggaccaguuugccaaugaauauuuuuuuuuuuaauguguuccaaauauuaccugggacauauguaggcuaaauguuuuuuguugauuaucugaaguuuaaauucuauuuaauagccguuuuagggccuggcgagacagacaggaacagugaaucuuugcucugcuuuaguauguaggagccugaaauacagacuguaugcaagucuucaagaaugcacuaguguuuagccgcggggggggagggggggggagagggugcuccucuucaauccuaacacucaggaggcagaaucaggcagaucucugaaucccaggacagccaggacuacacagagaaacccuacuuugguaacaacaggaauaaaagaauaccaguauucagaaccaauuuuaaaggucgccuguuuuuauuaaugagaacuaacaaggcauuuuuuacauuuaggaacuaaauucaauucagugaaccaggcuucugagccauuaacaaacucaguaaugaauacauuuugacccuugaggagagcaucuuccuauacauucucugguggaggaaaauguaugcagcaaguguaagugggccugugucuacuacgugggccuuagauguuucagcacuugaagauguuucggauuuauauauauauauguauauguauauguguauguauauauguguguguauauauauauguauauauauauauauauauauagagagagagagagagagagagagcgcugcguugugucuccacuuaaucauaaauaggugguagcuacauggaugccacugaaugauuuaaaguguguccugcaaagcucuagcucuuacucuugacccuuggagcuuaguccccuauucuacaauuuuaauagcugcacaacaauuucaugcaagucuucagauauuuugucacuucagaugcucauacaccuuaugggcgugacggcuccuuuauuuguaguuagcgucgucacccucgggagugauuaauaauaucagugagaccuuauugguuauacaaaagaaacuguuaucagguuagagcauugcccgagaccaugaacaaagaaaacccuggccuuaacugaaugaacgccucaucuucuuaaguuagguucuugccugcagccuauagggagcuucuaaacuguaagaaagcaagaggaggacuuggguuaacaggauaguccuggguuucuuuuuacuuaucacagcguucuuaacauguucuugauuuuuuuccugcaucuguuuaaguaagcauggacuaaaucaauaagaaagauaauuucacaauuauugcaccaaucugcuucccuuauuuugguaaucuaauaaauucucggcagugguucccagucaggggaaguaugcuugguuugcauuaacauugaaaaugcagauguuccuguaacucguaagaccugguuaauggaaucgccguguuaguaacauuuguuuucauuccacguugaaucuuauuacuuucaaaaauauuaauguuuuucuuucuuagcaaauaaaguauaugaaacaaaaaaaaugguguucuuauuuggguaccauaguuuuaugauucucaauaucaauucuucauucuaacucucucucaacuaaacuaucaauucuuuauucuuuucauguucauuaagaaaaagaauagagugcuacaaagguggcucagugguuaaaugcuugcugugccagcaggaacauuggagucaggaugcccagaaacuucuguaaaugccaaaguggacaggguagccaccuguaauuauagucccaaaaggcggggccgggguugggggugggggaugaauacccacagcaagcugaccuguagauacccgcuauuaugugagcucugggguuuuuuugguugguugguugguuuuggguuuuuucaagacaggguuucacugugaagcccuggcuguccuggaacucacucuguagaucaggcuggccucgaacucagaaauccgccugccucugccucccgagugcugggauuaaaggccugcgccaccacgccuggcgagcucugguuuuaauugaaaaauucaaccucaauaaaugaaggugcacagaagauggaggaugauuucagaccuccgcuccaggcuucaugugcacuugcaugccugugcagccgugcacgccuguacacauauguacacaugugaaugcacaccacacgcauccccaaauagaaaaaggauuaaaaaaaaaacccacuaagccaaauuaccacuucucuaagaguacuuggagugagguuuuaaguaauuuuaaaccauuaugcugggaagguggugggguagacagaugugccuguugcugagcccgguuaccugagucccauccccaccuagcagaaggagagaacuaacuccgacaagcugucuucugaccuccacaugugcacuguggcacgaaugcucccccaugcaaguccuugaaaaguaaaugugauaaaauuuaaaauaacuuguuuauacacuugacuaacucuuuacguuaagacacauuuucuaauuaaauauuccuccuaaguccuaauuaaaguuucauaucacuuuaaaagagcauuuuguguuuuacugucuuuaugggaaaauaauuuuauugguauuugaauuagaaaaggacugggugauugguguguucauuucuuuaaccuuacugaauaauaaauuaaaagaucccaaucauuuguuuuaaauaauuugcauuuguggaaaauagaaauauucucuaaaaggguauuguauuaaauucauuuaguagaauccaucagcugucuuugccugguaaauacagcucucagcccucaucagagaagauucucuuugcaauagaaggagaccauuacagaaaccgcagcuagucaaauccagagagcaacucuucauggaacgcccugauccaggagauagauuuacaguauaacucuugcaccuaaagucaaggaacauugcaaaggaggggacagaaagacugaagaaccagaggaccuaaaaggcuggugugacauugugucucauccacaguacugcaacaguauggcuaccuacacaagaccuaacagugacaacacuaauagacauccacacauggaagcuggaugucuaaggagcuuacccuuacuuagaacuacagacaacucaggacugcugagaguggaagaguuaguauuauagaucucaaucucucucucucucucucuggguggguguggguguauaaagcaauaaucaaagaaaaagaagccauggauuuuaaagggaguaacagaggaaaugggaggcuuuggagggagaaacggggaagagggagaugauuauauuucauuaacauuuaaauuuuuaaaauaaaauuuacuauuuuaauagagguaggacuauauauuuuuuuuucuaaaugacagcguuguuuucuuuuaccauauguauacaccgccacuguagaagcacucacuggucucuuuguguaaaguuaaguguauguuuauaugcauacaacacauacaugaaguuugaagcccucuccaggucauacaguuuccuguugagaauguacaaaauggugccauguguugaugaagcaugguggacacacagaagccucuguaagaguguuguuaagccuauucguuuauauuugcuuugugguuuauauauuugacucguaggcuagcauucauaguuuuaucaguauuuuaauaaagggugaacucaguauaguguuauuuugcuauaacuuccuuguagggaaugauuugcaagguucaaugguaguuuguuccauuguauuacacgaaggaggaaauaacauauauaauuuuaaauuuuaaccaugauguagaacacaaguguagucaugaacguauuugcugccuuguauguuuguuguaggagacagguguuugagaaguggcauacggucuucaagaggaaugagucaaaggauagauuguggauaccuuggaggccacagguuuguuaccgcuuugcugaguuauauggguuugucuucucaagggggugaggaacagaaaacauccuuuaccaucugaacacuaugaaaccgauuagaugaacagacacuggagagaaugucagauacuauucugaacaaugguugcuggugccuucagucuguacagcaagagcagaccauagaaacaaacugauuuucuugaaguuaaaggaguguguuagucuccuggugcugcuauaagagaccaccacagccuggguuauuccucacacuggcagcucuguuggaugaaggccccacccuuuuaccucaccuaaaacuucaucaccagaaaagucauauuggaauauaaggcuugugcauaggaguuuuagaggagaaauagcuaagucuauaacugagaaauucaggaaguccacacuguccuggaaggcucggcaaggccugcagaguuccugauuuuugucucaugucuaucaagcuccaagguggugcugaugcuguugcucugggaacuguacuuggaggauugcuuuuagauugcgggggugggauggggguguuacccuugagaggugugagacagggguauggcagaaacagaaggcagugggacguucuggagacuuucuugguucagcuuaccaaguuauguuuagucccgauuugagacauucaaagagauuugauugaagcuccaucacugacauugucugggaaauaagugcuaauuuuauuaacagucuuacucccuggaauauucagaauuuuggucaacuuuugucccccugccuuugccacuuccgaucuuagucuccugucccagucugaugcgugcuucugaggcucuggcuccucucagugcauacguacacaggggauucccgauccucuccucuucuguucugucaugugcuucucuuuacaaguagccuuucuucugcucgcucucucucucucucucucucucucucucucucucccucccucccucccucccucccucccucccucccucccuccccagaauaaacagacuugcauagcuguccucuuucuuguauucuucacaaaaggcugacacguucccuuguacuugguauauuuuagaaacuccaccauauuggcugguagacagcagcuucccugucacagguguguuguguucugaucugugggccauucuguuugcaaccacugcccuccguuuggagcuuaaaaggaggcucccaguauucugaaguuuaagugaugccgcagagcauaacccugugccuauguauuccacauuacuaagguauaucuucagaguacauuucuaguucuuuuggguagagugcuguugaugucugucuccacuccccaaauuccugccaugcucuugucuguggacuggguucaugauguaaggaugccuuauuaaaauagugaaguuuagaaacaauagauaauggugguagugaggagaacuccaggggaaucuguguccuugguucguuucuuugguuuuuacagcagccuuaauuuccuuccuggucgcgucugcugcuucuccagaagcacuguuuaugugagugugccauuugccuugcuguugccuugcaaccuucuguguaauuggguguuaccaugaccauccguauuugaauauucauccuuuuggcacuugguauuugauuuuuuuuuuccccucugugagugacuucaucucguuugucugugucauuuggucuccuccuuuucacaagauuucuuaagucuccuuuuacucccgugauaggugccauagacucgggugggcugugauuagugcccacagacucauggacgguggaggcccuguugguuugugguguuuauuaugcacagucauucgaagucucuccuuagaauauuggaagccauguguggcuuuguuuguacuuccugugguuuuaagcuuugagaaaggagaguuugggauuuaggguuuugcaguuauccuccuggcucagaaguuguaaaggaaccuuucauaaucaagguuuucguaugcuaaucuaggucacauacucuccuccuguagggcucugugucuaagucuuugcauuacauauacauguacauguacauauacaagcaugcagauguagauguucuuacaaugaccuagugcagaccuaguuugccaagcuguuuaccguaggccacggauaagcagacucuucuuuaaaaggucauuuuuuaaauuuuugaaguuacagaaaccaaauaaucuuugugaaauucuugcuccucccuauccuuuuccccucuucuuuccccucccuuaaaaaaagaaaaaaaagaaaacuacaaauacgaugugugauuuggaccaacuucugccguuugcuaucuaugaaaauuuuguuuauuuaguugggcuugauguuacauuuacuucuggcgauuuaaaaauaauguuuuuaauguuucuaauagccuuagaccaacucuggcuacaaaucacuaaaaacaagccaaaaaacaacuguaaaacgcaggugcgaguugcuuauucagccaaggaacuguccaggauuccuagacaacagcuuaguuuacaaacgcucaguauaaaaggacgccuuguacagugacccacacagugcugagcaucugcuguccuugcaacgcagacgugacaauucuuaagagaauauguugugaggauccuuccagaguuuuuuauuugaaguuuaagacucuauacgaaaugauuuuuacuuuuguuuggcagaaauggaacuuucugacaguaugcauguuccauugcuucuugcagcaacucuuuuuguuuguuuguuuguuuguuuguuuaagauuuauugauuuuauguauaugaguacacucuugcucucuucagacgcaccagaagagggcaccuggucccauuccagaugguugcgagccaccguguggcuuuugggaauugaacucaggaccuuuugaagagcagucagugcucuuaaccucugagcuaucucuccacccccuuauggcaagucuuauauugaguuaccagacagacagacaacacacaguagccuccucuuucccauagccaaaaggcaugagucuaaaagcucaacuaaugugcugaccagggauggaaagggcaguguagcacuuccuuggggucauugcauguaacagauugggagaguaaacaccaugaauaaccauaaagagacaggaacaaauaaggcucaguuaacagauucacacccaaucguccacccacaaguucuuucucuacccacuagaagaaaacaaagcagaugccaacccgucacucuucagggcaguuuaauccuucugcauuucacgaggggauugauuuccacgguggcaucacuauggcucagaugugcuugguuuuucccccuuuguguuagucaccucuauuuuuggucacuagucauccuauuuuucaugauucacugauguccacguuugaaaguuuuuacacagaccggcucgcaccgggagugggaaggcagcggauuaggcuuaguaaugcuggcuaaugcagucucuugguaacucuuuccauugucuuagaucaccugcuaagagugcuuacugcugaaucauggugaccauaggacugaucacaaaauucacacaagccagguguccugcaaaauaccuguaacuccagcacuaagggaccagacagccuguuccagucucuacuuuuauauauaccugcucauaucagucaugcucaccugcacauacaagaauaaaucaaucuuuuuuuuaaaguuaaacuuccaauucugcagaauacuuccaccaucccuuacuuuaacaguagccauaauaaucgcgcaccucaauuugaacuguacauaguagaacagcaaucaaauuccuuguguucugcgagcuccucaaugucugggccuuucuaacucaugaacuaacugacagguggcuuuugcuuuuuugcauuagcaaauugaccauucuguacuuuuggacacuguagccuuauucuuaccuuugaggccuuguuuuaaguuuuucugcuaagaaugcauuacaccagucuuuuuguuuguuuguuuguuuugcuuuuuuuuuuuuuuucuuuuuuuggcuuuuuugagacaggguuucucuguauagcccuggcuguccuggaacucacuuuguagaccaggcuggccucgaacucagaaauccaccugccucugccucucaaguguuugauuaaaggcgugcgccaccaugcccgaccaguuuucuuaaggugacuuccuuuucugaaguuaaaaagauucacauucucauugagagcuccuggcaugcuaguauacuucuuauacucuuuguaaguauuuguguucuaugaaauuauacaggggagacagacaaauuaguagaguuuuaaggcuucuuaugcugggggcaugaccaccauguugaccacuguucugugccucuguauuuuuuagcuuuaguuauuuuauuuccuauggaaaaaacuugaguacuuaugaaguucccuccgagucaucccaugggucucccuggaaguuaauggguaguuggucucaguuuggagccuuaccuggcgaucucucuuaaugugcuucaucauugaucuguagacuuaagggacaagacuuucuuaagauuuuagccuucuggugaccacaugguuguguauuuauagcaauuuauuauaaccaggaagauuguaguuaguuaccauaagaauaauugauguucaguucugugacuuagagaacuacauaaacuugaauuugaauggcaggaaauucaaguguuccuuguuuuuaagcagaaugauuuaucugguguggccccccuaucccugucccuaccccaugcacacaacacacacacacacaccacaguccucucccuuucaguuucuguaggaaugauuuccuuucccccugguugucuuaagcauugacccaugcagaaagggagggguuuugguuguuugguugguuuugucuuguuguugguuuguuguugguuuguuuugggguuuuuuuuuuuuuugugcuuucaaguauuguacugaaccuccacuguuggccagauuuuucgugguaucagagacaucuugaagcagagugccuuuccuuaauuagucaugccccccaccucccgcccccaacaguuugguguucuugcugccuugcauacuuaauguagauuauuauauagccacgcuuagauuugacuuguagugaucuacaagcccuucauuuuauugagaugucuccguuucauacuuauauacuccacccuuauaaggagucuaaauacagagauuaauauuuuacaauuuccaucccggucccuuuuuuuuuuggucgaagucuuugaacauauaaucugccaucugauguauaaacucucuccuugcaguauucuuguuuuuuuuuuuuaaauauuaaagaggcuagauauagauguagguauagauauuaccauugguggaauucugaaauucugaaaccugaggguuugauacuauagagaagaaaugaguacucacuuacaguuuggaaccaggagagggaagcacugaaggaguuggcccaugcacuuaagggaggaaguggcuuuacgccacuacuauauucuuuugaagagagugucaagggggguacauugguucuguggcauuuucaguuuaaaaugagggaagcguaaguuccauuuuaagcuuggacuguguacuuccauuuaaaauguaguggaucagugauugccguuggagaauuaaaaggagaauauuugcuagacaaauuaaucucaguuggagacuauuccuuaaaauauucauuaauguacuggaaagauuuggggaagguauaaucacugccucccacuugcccacacacaauugaaauuaaacuccuguggauaaaucacucaaaacagcugggcucuacacaggagcgucucagaagcuaggcccaagauccguguaaaauacuagguguuuaauguccuacagagucuguguucaauaucguuuggcagugguuaaggaagcuucucucggcccucguuuacuuucuuggaacuacuggauauguaaggccguuaguauuuuaaaaaccugaaauaccuuuuggagacucacuaugauuugggagaggacuccuccuccuccuccuccuccuccuccuccuccuccuccucuuuugcuaagagaaugacuuggacuuauaaaauccauauagauaagaauucuaccgaauucuauggagagacuagaauaacuugccucugugugguaggggcugggguggugcuuuucuuugguuuuguaauaauaacaguuuuaaauuuugcuuuuuaaaucugggaauuugggaauuagaauuguuucaaaaauggcaauuuaggaggguaguuauguuguauaaauguaggaauguggaaguuuuguuuugugugaauguggcagcaacugucaaaugaauaagauguuucuaguugcaacuuuaugccuuugguuaaggaaccguccgucucaggcaggcaagacugaguuacacaagcuuugcucugacuucauccuguaacaugugcauaugugccuauaauaugugcauaguaaccaaggucagaucacucuuguuuagaguuugaaauacagucuucauauuuuagaccuuauccaggaggcuguugucuuuagggagugcugcaggcauaugcagcuguagcugacaccaccacaggacuaccaugggacuaucaccacaggaguaucuaucaccaggagcucugcagccgucaguugugaaagcgugccuccauuuccuguguaauaaauaccuuaugugguucuguacagcccagauagcuacagcaauacauuauugaaaauacacuggaaaccaucaucuuuaaaugcauacaugguaugaugccccuccucccagcccccaccaccuagugauucugauguguaaaauguaaaacgaaaucuaagcuccuggguuuugcggcucagauagcaagucgccucuuccuugugaggaaauauguuauauguaacaacauuaaucucugagauuacuaaaagacauuuuucugcuuaaauagauuucuauauuaauuauucuuuaaagagcuauaacaccaaaacaaacaaacaaacaaaaaaaaaaaaacaaacaaaccaggguuucaucucagccagacaggcugggagcuuguugucuauacaugaauguagagcaauccuuccugagccuuaacggccugcaugcaaaugagccagcauauucuucaacguuguuuccgaaacuuucuguccuuuaauuuuuggaaaauacugacagcuaaaauuuaacccugccuugucauaacucucagauaaagcaguguucuuuuccauacugaaaugaccguggugacuagggcaguagaaagggcucuuuucuaacuaauuuaucuugguguuugaagcaggggaaauguugugauaggcuucaguuguagaggccacuucuccagaacgcaguuacaagagaaucauugcuucagcucuaaauuauguaauagccauacacuagagagguugcaaaagucuauauuuguguauuuucuccagcacugggguucuguugauucauuuggcauacguauguccgucuugugccauccuccacucuccagggguugacugcuaaugaagcaauagcagcaauguucuuagaguucagaaucauaauuuauaagacuaagcaguagugcugccuucagcauaggcgaguuagcguugcauagauguuucaacacuggauggcauaaauugcuauuuguauaaugagucccugcauacuguugcauacauguuuuauggaaagcaugagcauagacauauugcuagaacaaauugaugcuuccuaauccauuuuuaaugaaggauucuguucuuggauuguaaacuuaauaggacuuuuacccucugccucuucuuguuucuauaauguaacaugaugccuuuuaccuaaugaguuucaguguaaauauugaugauaauaaaagucccugauuuuuaaaauggagauacuucaagauuacaaccguacaaauuuuagugucugcguuuuaaauaaacauuacucucccccuccccccccccccccguguccccguguagcuaggguuucuguaauaccuguaaaagcauugcagauuugggguuauuauagcauuugaccauuuuuuaagugcucagauaucugauucaaguaagugugcuuucuguaauagcauuuccaguaauacagggcaauauuucacauuaaugguaggcuauuuuuauuuuagugaauugcugucuuuccaaagagaugaucgucucagagaggucagguguccuuuuaaauacaugcagagagcauagagauguggcgggauaugucgcaggcacuggguguggauccuagcucugcccuuaguaccugugugaccuuggaggauuaauuagccuuccuaucuguacuuuccccaaacggaaggaacgaggugcugcugauggagucgccuuuagcuggaaugccuggggccaaaacuguuucaguuuuugaugucuuuuuauauuuuacaguauuuguguggguaugcaguggacagaacaucccuagcuugaaaaugauaaaugcugcagaguccaacaugacccucaaaauguucagacuuaagagcauuucaguucuuugcacuauauguucuuccuaugguaccagccgaauaaggcaaauuaaacaccaugugaguguuagcgauuguuagugucaguauuauaaucaucuguuauauaauaaacugagagguuuuccuuaccucagucagccaaaggaauauuaauacaacguaucuuugcuguggcaagaacaguucuuaagaauucucuucuaauucugccuugugcucacaguuuaccuaucccuauauucauucaaauuccuugcauuuuucuugccaguccucaaaagacucuaaucugaaagcuggaauuaaccaucaccaccaccccuuuauucccuuucaauuuuauggaacuguaaauagccaugaagaggaaggaaggaagggagggagggagggagggagggagggagggagggagggagggagggaaaaaaaucaaccaccaucaggauauguagcuaggcugggcugagacaggaggaucauagguccuaggcccaccugccaugcuuagugaaaugcuaucucaaaucaaacucugcagacaaugacauccuuacugugccuguuguagaagucacauguucuguauaacuuccuuuuggggggguuggggggugucuuuaucucugcccacaauaccugggacuaaagagauaauauuuaaagauuccuguucuucucguguugauauguguucauggauuaaaacuaaacugacaugacagacuugaaauauauacacuaguugaaagaugcccuauuugguaauaaaguauucagcacuaaauauuugauaaaugaaaaacuaccuguaaguugucaucuucuguguauuuucuuacugcauuuuauccacauugcuuauuuaccuauuuaaaagcccccagucuuagcuaauauuuauaaugucagugcuggcugcuucaaggagcuagaaacccuuaugcucucugaaugacauuugccacaacaagaaggauuuccaacugcaucacagagaaaugauaucacauucaguucuaauccuuauggcagcucugaaauguugguagccacauuugcauuuaauggacaggaccuauaacucuuacaugggacauaauaugaagagaauuugaugggccaaggagauggcucagcaaguucagauucugacuacguacauaaaaggcugaguaggguagcacacaucuguagacucagcacugauggccagucaggaggaucucuggggcuugcuggccaggcagccuccagccaggugaagaguccugggcucugcaagauacuaugcuucaaaaguaagguggagaguuagagggcagugguccucaaccuuccuaaugcugagaccuuuuaauacaguuccucauguugugaacaccagucauaaaauuauuucauugcuacuucaacuguaauuuugauauuguuaugaaucauaauguaaauaucugaugugauugcccuucccaccaaaggguugugacccacaagaugagagccacuguuauagagggacugacuuaggaauauuggguagauagagcagaucagaguugcuuuuaccaguaagugauaguagaaacauugacuggaggagcguuucugaaauaaccuaugaaacacuggcuccaggguguauuaguagguauuaauggaggggggguggggagggagggaggggaagaaaguuaaaauuaagcucaggaaaugcaacauauaccauuucccucuuagagucccaugugugcaaggcugagaaaaggcugaagagacauguuuuacugggcugguagaaacucuguuagaguuccgugaguuagucccucuuuaggacauccagacucaguugcuagaaugaauuuaggcuuagaguuugaaauuuuagugucaagcgaguaaaaucaacagacagaacuuggagaggaaaaucagugugcaggugcagucugaacugaacacauacucuucugugugggccuucaggugugcacuagccucuaaugccuuguaugugcagagauauacacgauuggauuccaccgugcuguauagaguaggguaggaaucuaaaguccuaaguggguacugaccuuggacuguacugagguagguauagaggaagugguagggagagacagaaaguggcuagaaaagccagucacagaguacgaauugccuguggaaugcggaggggccuguccaugagaagaguagauaaggaggggaaggugacucgucuuacuugugcacacaugagaaaacugaggccagcagaugugaccugcuagggauuaagggccaggauagccuagccgaaaaucuuguuccucugauguucauucuuacacucagauuggaagaaggaagagguaacagaugaugguggccacgugucucaucuugggagggagaggacgagcugucccugagaggaucucucucacaggaugggaauaaucauauccuguuguagauuuaccucguaaugagucacacuuggagucgccgaagcucaguguccugacagcgaucaugagcuggauauaaaaaucagaaugccauuuaacugauuuaugguauuuaaaguacauuugucugugugugugguagaugagugugacuguacacacuuuuuugacuguauggaguggaggccaggugucagcacugggugucuccucugucacuuuucacgcauuguuugagacaggguugcucacugaaccaagagcucgcuccgucagcuggacugacuggccagcagacaucugagauccucccagcccuguccuucaguggugggcaauuugaaagggagguuuacagauggggccuccacuccucgcuuucacauggcgcagagaacccagguccucucaauuccacuugagggauuuuuuuuuuaaaggucaaugucagaaacucuccaauccugccuaugcacagacagguuacacagacaagaguaaaaaguuacuaaagagcauguuggauauauguauauauaucauaucgggauuuguagaucauguuguaccuuugucuuagucaggguuucuauuccugcacaaacaucaugaccaagaagcaaguuggggaggaaaggguuuauucagcuuacaauuccauucugcuguuuaucaccaaggaagucaggacuggaacucaagcaggucagaaagcagaagccgaugcagaggccauggagggauguucuuuauuggcuugccucuccuggcuugcucagccugcucucuuuuaaaacccaagacuaccagcccagagauggucccacccacaaggggccuuucacccuugaucacuaauugagaaaaugccuuagaguuggaucucauggaggcauuuccucaacugaagcuccuuucucugugauaaccccagcugugucaaguugacacaaaacuaaccaguacaauugaccccuugucaacuugacacacaaaaacaucacuaguaagccucaacccuuacaaucuuauucauucccauucuaaauaacuuuaaaagucccacagucuuuacauauucuuaaauuuucaaucucuuuaaaauauccaucucuuuuaaaaucuaaagucuuuuuuacaauuaaaagucucuuaacugugggcuccacuaaaacaguuucuuccuucaagagggaaaauaucagggcacagucacaaucaaaagcaaaagucaaucuccaaccauccaaugucugggauccaacucacgaucuucuggguuccuccaagggcuugggucacuucuccagccaugcccuuuguagcacacgcaucauccucuaggcuccagaugccuguacuccacuacugcugcugcucuugguggucaucucaugguacuggcaucuccaaaacacuacaugaccccuucaguccugggccaucaauugcaacugaggcugcacuuucaccaauggccuuccauggccucucacagugccaagccucagcugcucugcucaacuccuucaugccuucaaaaccaguaccaccugggugacccuuacacauuaccaaguccagccacagcacaauguacaacuuuggcuauaucuggaacacagccacugugcucucagaaaacacuucccagaagaugucaccucaaugaugcuggucucuucuuaaucaccgcuaauuucuuagcuccagcuaaccagcaucaauagucccaguaaugcaaaguuuuugcuuuaguaguucugguaucuuguuaaucacagcugauucuucagccccagcuaaccagaacuacagaaucuucacaaucaaaacaggaauggcccugaaaagagucuuuaauuuucccucugaaauuucacaaaccagaccuccaucuucugcaguguucucaacauuaucuuccaagcuccuacacaacauccgacagagcucuuaacaauggauggaucuucaagcccaaaguuccaaaguccuuccacaguccucuccaaaacauggucagguugucacaggaauaccccacucugcugguaccaauuugucuuagucaggguuucuauuccugcacaaacaucaugaccaagaagcaaguuggggaggaaaggguuuauucagcuuacaauuccauucugcuguuuaucaccaaggaagucaggacuggaacucaagcaggucagaaagcagaagccgaugcagaggccauggagggauguucuuuauuggcuugccucuccuggcuugcucagccugcucucuuuuaaaacccaagacuaccagcccagagauggucccacccacaaggggccuuucacccuugaucacuaauugagaaaaugccuuagaguuggaucucauggaggcauuuccucaacugaagcuccuuucucugugauaaccccagcugugucaaguugacacaaaacuaaccaguacaaccuuguucauggggauugggaggauuagcuagcaugagccauacauuguguguaacagaaaacgacuuagaacaguaccugcccaggugugcgcuuuaauucugguaacuacugcuagugacucacuuccuuccaucugugacacacagacuacuaaaccucacagugugcuucuaucacuuuacgcugaaugugguuuacacgaagccuggguuuuccuccucaagccuacucagucuuugcuugcuuugcucuggaugaccagccuguuucucccuguggaaugcaucccccguugaguuacccugauuuauucaguguaucuaguaaucauagaucuggagacccgggcucuauuuuauucuuuugagggcuuuugcucaaagugaucuuccuguuccccuccaugugcuggggaacuguugcuguuugacugauuuucgucuauagaaauggcacuggcauucggcugaccuaaugcaaggguucugcuuuuuacuuccuccuagauguuuccaucaagacaaggucagugaagucucaaguuuuuuccucucuucccuagaaagaccuggacuuuggguuuuggauacuugguuuucuguguucagauucuaagacgguucuucugaaggccggaugucucauuguacugugccguuucccuuuccuuguucagacuggcgugaagcauacacucuugguugguucguaagcguauugaagauguuacucagugcuuacauuauuaaaguggccaaaggacauacgaucaggacauugaugucauugcacuuggcaucuuuacauaaacuguugguggauuaaaaaaaaaucagggucccaagcaguuaauaaaagcagcauuuugacuuuguguugugcacauuacauuuggaacauuagggaagugugcuuacuauuuaauuuuuaauauauuuaucuuucauuuauuauuuaaaauauaaccuggaagcuaacugcccauuucuuccuaauugcugguuuuugucucuuuacaguauuugguuauaauuguuggguacauauguuucuguguuuuccucccuaaauauuaugcagcaaggaguuuuccagguuuugucuuaguuuucuuuaauguuuuuuuucaagaaucuuaaauauuuaauaauuuaaauaucugauuuuaaccacaggaagaaaacuuuucuccccucuuuaggugaccauuugauauucuuucaaauaugagccaaccuaguuugggaauuagcuguuauaaaauucuucagcuuuuugaaaauuuuaaauuucaucuggagucacuguaugaaaggacaucaaauaccuucaaauaccaaaauuaacacauuugucuguuuaauagauguauacuaugcacccuccacgauacaguguuaauauuaaguguauaguagaaucuaguuaaaauauuuuguugcuagucaaaaucaucaccauagcuugaguugucugagugcucguucuguaucagugcuggcucuaacagcaagcuaaguccagagaguuaaaaugaacaacuugcucacguuuuaaaaauuaggauggugagacaguauuugucaaggucacucugcuaguucaagaaaaugugacaugggcuaugugauuccuguucugauuaacuggugggucacguggccuuggaagugaugaaggaacccuggcuucugugaagcacagucugccuugcuagcccccaaugagccuuccuuccuaaaggaccaugcugucuuuauugguguggccacgugugcuccaguucaguuuaauuacccuguguugagcaguuuuuauggacaaagggcuguugcuggaguagucacuaggagaugcagaaaugaaugacucuccugccuucaggcauccuugggguuuaacaaggaaggaugcagucugcauagaacagaggccuugaaagaccaugggaacacaucaguggauuguucccaugcuuucaggccagaggaaaggggcaaugcagagaagaagcccauuaguggaaaaggaauaggucagcuuucacuagggcgcaugcaccaguguggcaguuggggcccucugcuagcgcgugggucuguuggagaucucugggggacucaugagcuagauaaaggcuucccaguuuccaucacuguccuccaagaacucuucaucuuccucauucaugcauuucacauucuguaaugcuaagaagggaaauuaaacuuguuucuggucuucucagaagauggcacaaauaucuuuaguuuuauaaagugauuucacuugucuuuauuaauagcagaaagaaagagucaacaaauuagaagauuacuuguuuccucauuggcucuauauugaccuucaguuucaguuauuuucuuuauguuaauguaaaugugugugggggcuggggaggggggagugugcacaugcuugcagaccagaggcucugagaucccugggaccagaguugcaggcaguuucagguggccuaugugcauccuaggaacugagcgcugguccccccuggaacaccugcuacagcucuuaacuauugagcuaucucccagcccuucccuucuccuuuaugugacugcugcugcuauuauuuuagcauucugucauggaggcggagguuguacuuuaggagagaagauuaguuucuguaaaauucuuuggagauagaaauaaugcuuuuaucacgagaccagcuguuucuugugccaccuccuuguugccaugcucccgauggcaucagagugucaugacuuuucaucuuaaccacccuguacuccugguccuggugagggcuauucuagacagugaagccggaaauuguucuuaaagccccauacucguugauacuuaguuguuuguucgccauuuccuuugugaguccuugggucguguuuguuuguccuugcuuguacacuugucuuuuuccuuuguagacugugaacagcccuuaaguugcauugaggacagauguuucuaguaggugugguagaaggagaugaaacuggauaagcuuguggguuaagaauccaggagauggaugcuuccuaaaggaagagaaagaaagaaagagucuuucauaggguagaauguaugugacuauuggacagagccguggacaaguuuuuuuuuuuuuugguuuuugguuuuuuuuuucagaugucuuugggacugauagaaacuuuaggaagaaaugguuuagaugagacaggguuaaguauaauaauggugauuucacuugaaguacugcagaauauuuaaaugauaacguggguccgcagcuguaaccuggagcaagaaagcaagguagcagauggaggccauguuguucuaugaguugccaagagaguccggcaaauacaugcagugaugcccucauugaggaugcuguaaagauuuaaaaagccagugaauuugguuagagguguaugagaacuaagugauacagugaauagaagagaggaaugcuggguaacaagacagcugcauagagaaugguggggccuggaaagcaacuugagaucauuaaucacuguagucucaucucaguagugugugcucagggauggauccaguugccaaccucaaggagagaaucagggauggggcugcauugaggacagauguuucuaguaggugugguagaaggagaugaaacuggauagcuccuggguuaagagaauccaggagauggaugcuucucaagggaaaagaaagauggucuuuuaugggguagaauguaugugaauaucggcaagccaagugagagaccuaacugaaaggcauugagaugcuguccugcaguggcaauuaaggaaacaggcuuacuccaggagugcagaucauguaagaaagucgugaaaucagaaaucaggaauauucugggaagaugagaugucagucgguuguauuuuacagugacucauguaaguuauuaaugaacuaaaaccugauucuuugggagagggcagagguuuuuuguuuuguuuugguuuuuguuuguaguuuuaguuuugguuugguuuggcuuugugguuugguuuucuuugguuugguuugauacaaggucucauccagcccuggcuggccuagaaccuguuauguagaccagaacucaggacaguuggccuaccucuguuuccccugcuuccugaacaccaggauuaaaggcgugugucacugugucuagccuuaagaaguguuuuaguuuguuuuucaguggguaugguuggugcaagcaagcccgagacagaaacuguagaacaucaaguucaagcccagccagcauauauaccaaguuccaggauaccuagagaugcauacugaguccuucucucucucucucucucucucucucucucucucucucucucucucucucucucucucucucucuccacccaacuccucaauuaguuaaagaugucuuuuuuuuuuuuuuuuuuaauccagauggcuugugucuuccaggggucaguaauuaaccagaugggcuuaguaggaagaucagagaaagucauacauaaagacacggggaaguuagcuuuugagggaagcuaguauugcuaaggagucugguggccuuagaagucagaacacgugacaagauuugguaaacuaaucagagaaguugugccagagaggaaaucugaaaauagagcaauuccaggugaugacccuauuggguggcacuggccuuuaguuacggucagaacaaaggaaggccagcaauuggugggggugggggaguaagaggagaaagauugggaaugcgggaagagcuuagaggaccauuggugaugugauggagugugccacaguucugaugcccagacucucugcacuuauugaguuaaccauaaaucaaaugcugccuaauaucuucuuaaaauauaguuuauuuuccagccacauuacuugaacuagcaugaaagggaguauugauuuuuuuuuuuccaagcuccucuucaguaccuauagcuagagauugcaaaagaccaucuacaaccagacuccauaaaugcaguagaaaggaagacacgggcaagggccucauccucucggcuuggugcucaguuuucaagugcugggccaaauccuugaaauuacagaguuuucaauuagugagacagaaagcucaugucaguuugcagaaaagaguuagccucccucaggacugccggcuuuauuuuugugaggcuguugggugacauaaugagcauccuguuucccuaagcauguacguguaggcucuugugaauugacaggcuagaagcucuugagcacugaguaggccggcggagcagcuggcgugacauucaaguguucauggugccucuuagcuccugaacagaagggaaaaacacuguuuuaaauuagaaaucucuuccuugacugaagcugaaaauuucagcaccagagagacuagaaaaugauagaacauuugguucucauauuuaaccggagguauaguauguucuuauauuugguaaauugcacaggauuauauaaaauuaacuuuauuuuggagcuuuucaaaagcaccccccuaagcaaaaaccuuugcaaccaagaaucuuacuguaaaaaugaaagaugccuaaguagaucaacagaauugggggggaaaaguauaguuuaucuuagagguaugaauagaagguagcuauguaauucaagcauuuuguuaaauuuguuaaaaucaaugccuuaaggugcuuaaacuuuuuuaguuugaaaguagaaaauuauucacaguauuugugaaauaugagacuuaaguagaaaaauaucaguguauuugguauuaaaaccaaaacaguucagaguaccagcucacaaaauauuuguagaaaauaaucugcuuugaguuauucaugcaaauuacgaaugaguaauuugccuauuuaguccaggaacuuuuggaucaagauggacauccaacaguuaguucaugagucaaaguucaggucacagucucauaaaauagugacuuacaaaauugacagcaggaucaucaucccuagcaucccagaauuuagaaauauguuuuccuacugugugcugcaucaauugaagacuuuucugagguggagcccagcagggcccauuuuaagagcccuacaaacauuaccaauaaguagacaguggggcugagaaguacagaucugcaguacauaguagcaauaacguuaaaauuuaucauguuuguuaaaucgagagguugugguuuguugauucuguagguacauccuugcgagauuaggccggucuccucauagaugugggugucacaccaguccacuggauaagauucuaccaacuuaccugcuuguaaagcaaacggaucucuaguuaucguuaagauaucugugcuuuaguucauugccauugagaucuugauuauauacacuaagugcuguguuguuaugagcuuguagucuuaguaugugcuggaaauggaaguuaucaaaagcccagagauguggucgaauggccagucuaugccucugcuucaguugaggcuggcauacacuuuuauagaugaaaaguucgugggaauacggguugcguugaggggaagauagagaagcuuuuuuuucauacuuucucugagcccgacugcugugugugcuuuaauugugaaauucugaaauaagagaaaaacaaaauucuuacacuugcacuugcaaguagauuuuuauuaucuaaaagccaaucucauuuucugugacuaagaccagaugaaaacaguuacuaucacccaacccugccccacuggcuucccugacaguuguucagggagcagagcaggcuguggaaagugaaaacaugcggccagagagagacaaccguguggugggaaggagaguccagcgguggagggauuaaaacagcagcaacgucaagaguggggcaguggcagagaguagcaaagguugccaggaagucaaacaaggacugugugaucuucagguucaggaccauggauucaccggucaucgagaaaguaguuucuccugcauaggagaagcuggaauggagggaguugaucagggagagagagggaagaaaaccggaacagugcguuucaagggauuguggcuacuugugggguuggggauugggaguuuuauaccauuguugcuuaggagcccuugcuaaguuaacuccuguacugaucugauauauuucuauuuggcacgguuaacuuuaacaguuuaucccuccaauaagcaugcuauauccuccaagcuuuaugaaauacuaaagcucagaauuguugcuuggccugcucucagugaucuaggagcauuguucaaaaugguugucaguaguguauaauucauuugagacucucugaaaauguauguauggauggauggauguauauacacccaugcacauauuuuuuuugaagccgggucucacugugaagccguagcuggccacucacuguguagaccagucuggccuugaacucccagagauccuaauuccucuuccccauugcugggauuaaaggcacgggucaccaagcacagccugaaguacuuuuuacucucuacuguccaaaaggauucagagggaaauagaaacgacccaucuuuauaccaagauggcucgaagacuccucaaaugcuaaccuucucggaaauuagcacauauuuuaaacaugugguaagguuuuuuggcuggucuguuauugaauugccauuacuuuaugcagagcugccuuuucaaauagaucacagcucaaggcacaaacuaaaagcauuuccacucaauaaacauugagcccucacuggaucccaaacacagaugaggguuaaaaaucaauaggacagauccuauccuggggucacaggucacugggaaagacagagagaggugacucaaaucguuacagauuugagaaaacagcugugcugagagagcagguuagguccucuucuguucuaagaauccgcccccgccuacccucagacauuugccgaagcauucaugcugggcuuacugcuuggcgcagcugcaacuacuuuuacaguacccgaucucugccuggaauagucuucuaggagauaaguaaauuacggagggagugagaaugguaggcaggaaucuuuggagauugauuaaucgggcauugugaacaguacuuguuuucuguuguaucagaucuguguaaaugagauccugcuuggacucuguguguguguguguguguguguguguguguguguguguguguguguagagagagagagacagagaaagagacacagagagauggggagagagagggagagaacaugcauuuaauaggaauuaacuucuaacuaagcuauguagacuuuauguucuuuuagaguucuuugaaaaacauaaagcagaaguucugagucauauuaaauuugauuuuucccuuggcuuccuaauuccuaacccaauuucuaauugauuuaaugaaauaauuuggaugcgcuguaauuuguaaaggaagcuccaccauucgugauuuuaaauuaugugcucucucugaagagaaacacuguaguaucagaccacaugcucuugccacuguuagaauuauaucuaauaguuggcaguaagguacuaucacuucuuaagaagaaauaucucgguuguugaaagauuucggguuuuuagggcaggaaucugauggaagguguuuugcacuccugcagaaguagcuauggaaguaguggaaggauuauaguuuucuugcugagacacaagacggcguagagcauuucuuuccuuuucguaauuuuucaguggagcaggcaguuggucuggucuaacguguaguaauuaucuaccgcccccucaagggaccuuuaaggcagcaguucugaaccucuaaaucaagacucuauuggguguuugucuuaggguuuuacugcugugaacagacaccaugaccaaggcaagucuuauaaaaaaacauuuaauuggggcuggcuuacagguucagagguucaguccauuaucaucaagguaggagcauggcagcauccaggcaggcauggcacaggcagagcugagcauucuaugucuucauccaaaggcugcuaguggaagacugacuuccuggcaacuagggugaggaucuuaugcccacacccacagugacacacccauuccaaccaggucacaccuauuccaacagggccacaccuccagauggugccacucccugguucaaggauauacaaaccaucacaguguugaaugacccuuucgccggagucaccgaagaccaucagaaaacccagaucuuuauauuuugaugcauaauaguagcgaaauuacaguuauaaaauagcaacagaaaucauuuucuggcuggggaucaccacaaccggagaaacuguauuaaagagucgcagcauuaggaacgcugagaaccacagcucucaggggcugagguucagguuguccacacuaacuugaauguaauugaggaagacugacagagcaggcugguucucuaaguuacaaagcagcuauggauaaaaugcuggucacagagagaaacaguuccagaggccagugauccgucucuugacugccuauggggggggggauggaauugauuuuaugccgauacacaugugcaugcguauuccacacaugcugagagagaaggggaguuaagacggaauucucuucacauguuucuuuugugagaauauguaaaagccguagucccaaacuauuuuugagucccuugaucuaucuaauggcuaaguguacaauguugugacagcuauuucgcuggguggcagguagacaucagcacauuguuaggacauguacccugacuucaggcuuagccguuuccuuuuguuuuacuaauucaguguuuacuguguggugaucaagaaguguuuggcuucagcaucuguaaaaugggaaauuagauuuuaucucccauaucccuuaaauuauaugacuccuucauaacuguuacauagcaaagugagggcuugugcuuguuguuaauauuaugcuuauauuauguuaaaaauauguaauauuauuccagaaaauuggugguuuugugauuaagguugacaccuuacuauuaacuugauaaugccaaguaauaucaaguuaacacauauuuagcuuugauaaauuuggccuuugccuuucauauaugcucacacauuuuuauacauauuuguaaaguuauguuuuggaauuaaauauaagaugaucauacaugggugccaauuaaguuucgccucauucccaucugucuguuuggauccugauccguuaucuaacauguuuuccgauuacccagcuuuaaacuuuuauacacuggauaagcacacuucucacaucuucagcucaccagcaucuguuuagaaucaucaaagaguugggacgcccguuuagaagacagucuuguugcugacguucuuaguaauaacagcacauguuuuuggcuagaggaaucucauguugguauauguauuaaaaucauuucauagaauguuuuauauaacuauauuucauuucauaaaucacuuagcucuucccuuuuauuucuuguaguuuguguaaaugauucuuacaaucuggaguuaccacuauuggccuuuauugaaucuagcuaacuuccauacugcuuccucugcggucucuuuuaagucagucuaccuugugaaagaaggaauugagauuguguuauuaacagcgcugucucuuagcuuacugagcagguggacuucacagccaccccuucguguucuccugugucugcccauuccuaggaaugcucaugugugggaagaauucaccuagauuuccccauuugaagauuauagcuauucuugcccugugucaggcuacagcuguuguauuuccauaaaaccuaugaacagugguuuaguuagaagugucauuuacuuugggauauauuuuauaggcuaaguguccuaaauagaguugugugucuucuuuaugacaucaccuuucugacguaucagcuuccacuuaaauuuuuuuuuucuuaaaccuuuaaaauggaggaugaaaugucuuugaagaacaaagaggaucaaaauagacgaucugguuucuauuccguauuuuauuugaaaccaaaauuaguuugucucuuacgugacuaucacuuuaaggcuaacaaauacagcauuuuuugauguugcccuuggcauuuuugucagccacuggccuaagggaaugaaggaguaaagaaagagacagcagugggagccaauggaugaccuggaaggagaaggcagcugauggguaacucguaggucagggcugaacuagggagucuacuuccgagacuggcugcucugcguuucagugcuucucaacagccuuuucucaagcuguuuccuugguguaauagaacugacuguagucauggacucgaacaaagcucuggacccauccaguaauugcaaacucaacuuauaaaaucaauuucuugauaagugguuggaaaaagcaaggacaggacggacuuuacuuauuguuuaagccagggccuuaaaugaggccuagggaggcucauguccauccugcaugcacucaccuguccaucauccauccuggugggccuggccuucccuguuggaucguguagugcgcagugaucauaguagcgcuccguguuucucacagacuuaaacacaguaagaggcaacaagcugguaggucacacagaggcagagcagaagucuccuugacagucuguuccggucucauucccacuuccgaaguaggaagaacauggggccaaugguuuucuguggaacuuaguucaaauuucguaagcacuagggaaaggcuguugagggaacaaccaaaauccacaacaguuucuguuuaauauugauuugcuuguauagaucauguguuugggguuuuuugacugcuuuaugaccaacagaaauguccauuguaaacuagaaaaugggaaaacuugguggaggccauauuauuaguggcaggagccugguuugucgcugcuacuccuaggucaauuacuaucccuuuucuuaagguacuuaagaacauccaauggauagcauucuuuuaucuuauugaaaucuguucagagaaacaacaaauauuggugccuacaaauaaaacauguaagugauaccauugcuucccuaaacaaacaugcuagcaauccgccuuccacacaguagugcagcucguagccuagggcagagguguucucucuuugcggugacaguuaaugcagagacauaccucacauggucagagugcugaauauaagugagucuuacacggucagcuuuaaacggaacaugcauaucacaaggagagagagagagagagagagagagagagagagagagagagagagagagagagaacauuacaaaagaggauggaaucuaaacgccacagaugaggaagugugucauaaaucacugucgucuacauaaugacaucaucauugcagccaugaaaacagcagcugugggcagcuguacaggaucugucccuccaacuuuuaccguggauagagagggugacagcgaggcucugaacgcuaauguucauggcuccugagguagagagggcauuggauuauaauagaggaaguagucacuggagacuaggugacagaaagauuucagagggugaguguguguguguguguguguguguguguguguguguaaaacucaaaaaagaauaaugacguuguuacugacuaaagcuaaucagaaggugauuucgugcgacuggaaugacauugggcccagaaugccacuucuccuuuauuccaagcacuuuaaacaacagggcacuuucuuuauaacuuguaagucucuucauuaacucucagucuagaauauccaggacuuacagccaugccauuccuuuaaagccaggugaagaagccacucuguugccugcuguagcaaguacuuagacagaucaucacauugguggccauugacagggguagcaacggccguuccuuagccggccauccucagcacagcagauguaaaugcuugcauacccuuuacuaucagcuuccauuccgugccaggacuugucagaaugcucucugagcguauggucugggaauuuaauagacguguaagcuguggaguacaugcuucguucugcugaacuuaacacucccgggacguagguccuaccaguugacuuugaugacugcugauguauguggaccacaaacagcgcuguaccuaccauccuucuagcaguuugauagguaaaaaguuguacuugccagggucuuuuccgguugccagacacuuuuagauuguuugagaggcagcaaggucaauuccgcuaacuacagcuugaccuugagugccuuuaaaaacaaugcaguggcaaaguaugcaagggacuaaguggaugcgggaggugcugucaugggaagacuuaaccagacucggagauugaaacggugaagggugggaucaaagaugaccuaaguucaaagccaggaaucuaggauaaggaugaucauggaaggcugcaguuaucagggaauauuauauaucuauuugucauggucugccaugauucuugguucuaagagagaguaacauguagauaaauuagguauucaugagaaaaugaagaaacagaaaggaugaaggcaugggaagcaacucuggguagauagaaguccggggguuaccauggcgggagcugaacagaagguagcuuuagaaaaucagagggcgacagagugaugacaguggagugaagacgaagccgaggagugaugccaggacagugcuucaucgguuucugaggcuugugcccuuucuuucauagacagauccauaggaaaagguuuagcaaacuaggugaggccaguguauaagaaguucugguuugagaccagcuauuuccuuccauugaguuagaugaaaacucaauuuaucuagaccuuaguguucuggauagaguaagagauaguauuauuuaauuuuaacaguuaaacaagaggauagguuuaaggcaacuaguaaaguuggaacuaagcacuuuggccgugacuuaguaauacaccaaacacacacagagauacacacacauacacgaaguucaguaacgauauucacuuucauuugauacugaguucuagugacuaaauaaacuaugcuuuuuucauuauuauacuaugauccaaaaccguaguucauaaauauuuguaacuaguguacuucgucuagcuaccugguagcauuuaaaaggcacgcuugcaugcauggguaacagacacucuugagagugaacuauuaacaccuaaaucuuucuucuuacagauguauacaucucaagauugagaggaagaaacaagucaugggccaguggucaagauacuucucugggaauuguugcugcugauacugcucuucagaguccuacaaugagugugugguuuaaggaagauuuucauauuuaaaagauuuucagcuuggaaaucuacaucaagugaaaauuucauucuucugggaaacauuuuccuccuaauaaauuauccuugugaugggcgacauggccaacaacucaguugcguauagcggugugaagaacucuuugaaagaagcuaaccaugauggagacuuuggaauuacgcuuacagagcugcgagcucucauggagcucagauccacggaugcauuacggaaaauacaggagagcuauggagaugucuauggcauuugcaccaaguugaaaacaucucccaaugaagguaagucuuguguugauuggccacugcagcugagaggaguguuuauccagcucagguggaaacguguugauacugucuuggcucuugcuugaucacgccuugauuuuaguaauggguugucagcuugcagcgguucgagucgguuaacuuagacuuugcagagugggaagcugaacuauuuuguccuuuugucuacauuaguguuccaguuuacaauaacaagauugcccuucgcuggagguguagaggauagaacugagaguggugcccccccaggggauucaguggaaauaaacugcucacuagccuucguuuugcccguaucuuaaaauaguucucacuuccaguagccgucaaaguuguuuuugcucaugggaccuaaucuaaacuuuuaauaaucagucaacugagaucugaaugcaaguuuuuagauagauggcacuaagucucucacuuaguaaacauucauguggucagauuaugucgaaugucccaugcuggaaaaggcuuuagcuucauggaucucuuuuauagcauggacucuccugugcaucugaccuuugaaauggucugacagaguuagucuuacuguucauaagccuaaggauacaaagguuucauuauuauuauuauuaagcuguuuucucuacauuuucguaacauuacugcugguggcaauacuuuauguaacagcaaaagaugauuuccagaauuauucagggauuuccaaucagaccagcagaguucuuugaaaguauuuguguagucguacgugagcgugcucccugcucgcucugacagguaggcccuuuggguucucugacgaccgcagugcugaggaacccagagucccugcucacccgugucuuaaauaaaaugacaucaucucacugggugacagcucaagauuuauuugcaucuuuucaagucagaacuacuaacaucguagacuuuguuauaccuguguaaugugauaaagcuugggcuuguucauuaugcaaacguacuuugagauuacccuacuuuuugacgugcuagauguauagcuuaaugugcucuuuucguuuucuuuacucauguguauuguauuucaucuaaaacccaacugaugauugcuucaugaucaccaaauuaauaagaaauauuaacauuaaucacguauauuuauucauaaaaggaaugcugauugguuaggguuguagcccauuagcagagcacuuaccuaauauacauaauccauagguuggauguccaguacugcagaagguguguauugaacuucaguuucagauauaugacugacugcccuucacacagccauauuucuguauuuuguugcugugagugacuagagucuuuguuuucuaauuguuggauauacuucuccuacugucuugucaucuuuugugagugugauuucucguuaauuuguaguacauauuccuuuauuuugaguaguauguuucauuguuuuuuaauuaguuaaugaauuaauuggaaauuuugcuucuagaaauucugggaagaagagauuauuuacucuugacaacaugguagaagccaugaauggucucuggagaacugauuuaacaguuauuuucccuuuauugugugugcuuugaggcaguaagugaaauuacgcacuguuuuucccucuucaugacacugagaauuaaugucuccuaaaauguguauaaauugaucgugauaguucauauacaaauaauuuuucaucuugaaauacucuuuuaaaagauuccaaaacauucuauuguaagcauauuuguguuuauuguuacacagugaaaauggcagcaaacuucauagaaauauuucccagugacucuucauagcuuucacuuauuaggaauauuucacuccaagaucuuaacauugugucacugaucaaccaggugaauuaggaucaacuaagcagcuggguuuguguggccccuacauacuacugugucuagacaguaaauacaugccuuuuuguuagaguaaucuuuauucaggggccgugagaacugaagugguucuucacacuacauggguuuuauugcugaaacuaaagguauccccugucccuucagugcauuuguuuaugagucacuccccgacacggccuuugagcugacuuggugcuuuguguguuucauagauuccauauaucucccugagauggaaggguauuggcaauuguugcaggaaauucugaguauaaaauggaacacagggccccuaaagaagaagcuagagaaaguacccaaggagcuaaaggggucugcagcccuaugaggaucaacaauaugaacuaaccaguaccccacaaaacuguguuucuaguugcauauguagcagaggauggccuagucagccaucaauggaaggagaggcccuugguauugugaaaucauaugccccaguacagggaaaugccagggccaggaagcggaguuggggagggaggguauaggggacuuuaggaauagcauuugaaauguaaaugaagaaaauaucuuaauaaaaaauuuuuuaaaaauuaaguuacaucuggcacucagaaauuuuaccauaauauauaugugccuuaaaauugcucaaguauaauauuagaaagugucugcucugugacagguacuuuuuaggcccugggcauauauccaugaguaaaacaaagaucuguacuuuauucucagaggagcgggacaguucaccauguuaaauguauagugucuaaauuaaauacacugugguagcguauuaggcuuaagaggacaaugaguggagaagagaacucaugcuggagucgccugccuuagucugggucgucugaaggagcagcucaagguuuuucuuaggaacagcaacaacaaaaacacuaacacuuacauuacauaacuuuguugugcuagauugguacuuccuuacaaauguaaguccauuuuauccuuaaaacuccuucguccuauuguaugggcaaaaagaagguuaaacagcuugcccaaagcgacacuucagcugugguaucucugagacaaugcuuuuaacuggcacaggggcugcuuuuuguaaaagcucagcccguauaccuuacagcaggguugagagaccgagaaagagcugcuuuguucuugucucuuaauuuuuccccucgguggaaaaacagacuuauuuuuggaguuaaaugguggauaaauggucuugugugucaacucugucaguaacaaaaugccugaaauaaucaaugcuggaaggaagaaaagguuuuagagauuuuuaucaugaucacuuggcccauuggccuggggcuggaaggaagcaguaacuauuagcaagaguacauggccaggaaacucagggaagggcccuuugggaggcauucaguagccaggcuguggaguuccucucacacugaggcccuuagaagcauguccuucuguccaggaagcuggguuucuugcuuccccauuuuuccuaccagcuuaccacguggucucuaaaaagguaccauuugaguccguucucaggaauacuacaaguaguuauuuguagaccaguagaacauguuugggccagaugaaauuuucccauccuucugauuaacugucauaauuccugagagggggauugaaauuaaaaguucaggguaaaaugaaggugagacuuggaaugucauauuuuugcgguauguuuuagaacaagcauguaucucacguuccucggagcuuugugcuaaaauaaucuguuuauaacauccuaacaccuaaaauucuuuuaaacuguucuucucucguguuuuacuuuccucuaucgagucuauuauuccugcucuaaaucccauuucucgguccgcuaacuuucacgguggcuucggguaucuuuucuaccuuacccccguuaucuuucuugugcuuugugcuggguggcagagaagacucugcugcaggcuucuggaugcaugccucuagcucccguaucauauuuguuaugucguaauacugcaccaaacaagguauaaaagugaauuaauacaaauuaaagacagaugcugaguuaccgggcguggcuucgugcgccacagagggaagaagucaggugaagcggagcuuucuaagugaugauuaucaaaaugaggcaaaagaggggcuaaaguaaaaaccaacaggggaagcuaaagacgucauuaggaacaguggcggugcaugaugggaggcaggagaggcauagcagcuguugucauugguugccuaguuuccauguuuuaaguggcagcugauauuugcucucccuagaaguaagucucuggcaccuguguacuuugaccuugucuccauguggugauacaguuuaagucuuagagaaaaucgaccuuucccuagggauaaaucauuagugacuuaggggcucuuaaaaaaaaaaugcucucaugcccugugguuugggcucgguuuugcagauuagcaccaauguuugcauggcugugguguguuagcauguacggucuugugcuucugaguuccaugucgcucccgcacagccugguccgagaaaaggguugcuugccccugcaguagagcauugaaugcuuucucuggucacuuguuuucauugcuuauagauuuuuuuuuuaagcuguguuaauuaguuguccaacuccguagcaagcauauaacuuuaaaagucauacuugaaccugaaguaacaugucauuggcuuucuauuaugcuucuaaguuucauuguuaggugacaguagaucgaauucccuuucugucuucugaacauauuccuggaguucuccuucuugcuucugcauguuccuccucccccguacuuuccuggucugcggguuucuggugguugguacagccuucugggcagugccauccaaaagccuauugaugauaucacaggccaucaccuggguguucauaguucccauaugaacaguuccugcccaggauucuccuucgccuugaggguggagcccaguuccucauucuuuuccuacaacuccguuccugaaccucucuaaaccuuucugcugaaacugucaccuguguggcugccaaguuagaaacuugaauggcuuugauuucuaugugaauuuuuuaaacccauucugguguagucguuaagccuuaggaauucuucuuucuuuuuacccacggugucuuuuucuuugugcccuguggguaggaucuacugucuugucuuucaaaaauugagcugggguaauaauuggugucucugccuguccuguuucuggucuuaaagccaccuauuguuuagcauugcuuuugaaaugaagcuuagacuucuccaguagaccuagaacucuccuugugaucugguucuaaguugauccuuuuuccuaucuuugguucuuaauguuugaagcagagaaucuuucauuuuucuuaaaaaugguaugucacguuguuagcucuuguuucuagucuuuuuagucucuagcauauuuuaccuccaccuacaacacuauauaagaagaguaucaagauugagauaccaaaaaugaguauauuggaauuucuucacccaucccagcccugugaguuuggagucuauuucuuuguguauacucuccuaguguccccuccacugccaucuaauauguaauacacugggugugucugauuauuagucaucccuaccaaacucuugaguccuuuaaggucaagaaccagggaaaggcauccugcccgacccauccugugugcuuuguaccuucccacagugccuggcacaugggauaugggaacguguauuuaagucugacuuuagauggaaggaucgaaaguuugaaggucacugagggaucaccuucuccuucaaaacugaaacagugaagaaggaugcacaugaacacauugccauauacucuucagucuguguccuucuguccuauauagggaagucaccuuaacuguuauacccacccacccccaccgccacacaggcauguacacauauauacauccauagucgcacaguuccuaguuguauguggaauggauuauccuugauucucagccaaauauaccugcaucaaacacucuaguaaaccaccaccaccaccaccaccuccuccuccuccuccuccucccccuccuccuccuccuccuccuccucccccuccucucccuccuccuccuccuccucuccuaaguuagaagcaacaauugagaugcagucgucgauauuccuuacaagagucaccuucagccagcaccucagcaggucuuggcucuuuuccuggaggauugacccauaccuucauuccugaugggucugcguccuuugucauccugcuuggauuaggcuguuguaguuucccauugacuuuaaucacaggacaugguaguacuaagagacgcccuaagggaucuccuacacuccagacauaaucuugcuuaccaccauugugaagagguaauccucuucacauuggacuugauauaaucgguuuugauucucucugcuccaguauaagaugguacuguuacucugucuuaccuguucagcugaucaguuucaggcuaccuuuuucuucccaccuagguggaugcagacauagaaagguuauacauuuggagccuucuauggauugugguugucuguucucuucauggagcuaacugugcuugaccuuggcugguugcccuugugcccuaagcagccacgcccacaggacucugcagaauucuccugauaguccuugauacauuaucugaaauaauuugcuacuucucucauuuaaaacccaggagcagguguuuuccuugcuccccaugcucugcucagcaguggcagcaucuucccgauguccgucacacugacacccucacguggauccguccccuugccucuucacaggccuuccucuaauaauauccacacguccuguaucguccugucaucucucuguucucuucauuuccuuuggucgguaaccugcuuugaagucugccacccaucuuugagaaaacaaacaauacccucucuagcucaccuauacuaauuuauuucuccccacuguauuacacuucuaggggagggaggggggaguucuacucacuccuugccauugucuccucaguucuuucuagccagacuuucuuccacaugugcuggaggggucuccucaagcucaucaucuuuuguuuagugaaagaaaaauggaucguuuucugccuguaucuugcucagcccucucccacuaccccagcauuuccuguagccagcaguaucaucuuuuaagccucuuucuuauggaagcauguguagugcugugugagccugcuuccuucuguccuggguucugucguagcacauccuucauguuagccuuccugccugcucucuaaggaugcucucaucuggcuggugucuccagcccagaauccuugcauguugcuagcccucugccucucucagacuuugcagagaauucugaauaugacuagcagucaucuuacuagauacugccccuuguuugcucaggucuacaaaacagaacuguuaauuccccguuccccuuccaccagcccugugggucccaaagccggcccgaucuugguaaacagcugccacccguccgcccacucgagugcacacguguuagccgugauuuucaguuaaacccaccagcuucaaacauuccaguaaaccucccccacucaaguccuuguaccaaaaaaaaaguuaaaaguugagucuagauaccauucuuucuuuuucccucucccuuucauccuacauccuucauuccucgcauuugucugaucuccuuccaggguaccuggcagauccaguuacuccccucucugccucuccaucuaaaauccagaaucaagcacuucugucucucugcacagcacaacagucccuugaccggguuuucccccuggagcacuccaacagagccaugugaaugaccuuucuaaauuacacauuaguuaucacuuccccccuuuaaagcugccagguaguuuccaucacaguuaaagugaauaaugaucaucuuuuauguccccccacaaucuugccuaucuuuuuugacccauucuucuuucuuugcuccuugaucacuggaccugagccacauugcuuugcuucugguuccuaaaucuuguaacccuuuguugaucucuggcuuuugcgucugcgauguugaaagggccucccuccggccuucucaugaccgacuccuccuccucauuggucagacucauucaggugguaguuuguuagaaaagcugauguagucuacucugaauucuaggggccucugaaaaaucauuuucccugaauuccagguaucuuuuaaacauaucuguuugucucucucggacauaauuuacacuugcugaguguagaacuggcccccaguguguagaacagugucugcugucuggaaguugcuugauaguaaguaacaucuuuggacaacucacaaaacucuuugcuucauaauaccaagaucauuaaaucucuaauucaaguuuguguuccaaaugggcuugacacuucuagcguucaaauuuguaacuugucuccacccccccccuuagugaacuuuacccuguaauuuuuuuacuugcagaguuaaugccuucugcuuuuuucuucuaaacaaccuugucgguuauuccaacaaaugguacugcugcucccuccaagaugagaaguaaaacaagauuucaggaugggaccugcgucuuaggucuucuaauucuccagcaacuucacgcuugugugguguaagcaugugcuuaggugugagugauguuuagaaaaucgcagggauccuuaaagcuacuugcuuuucuuggugcucgcuuuaacuguguggcuuuucuuuucaauaguaacauaaaacauuguagcuaauaaaagauaaaauugugauuaucaugguaauauuguuaggugaucaaguugugugaucaauggaaaucuccauuagggaagacuuuuuaaaaauguauacccauuucuuagaaaguggagagcaacauggagcagacaagcauuuggccuucuuccuccuuacugugaggucaccgaagcaggagacgaaacaaaugacccagacuuaccagacucuaguguucucuuucuuacuguagccuucucucgucuucguucuggugacuccgucucagaguugagagugcuccgaggaaaguuuugguugaguugucuuuaaggcuuucugaagccuugaagugugaccauguuacaguuauuagugagaaaauucucuggaaucuucuuuugguacauucgacagugaugacuucggaucuacauguuuguuucuuguccuagugaugcagucagauaucgcuggcuuucuucuuggcucagcauugaaaugaacggaagcacugaaaacaagagccuucucuucuaguaaugccguccuuuccugauuucuuucuugccuuucauagaugggauccuacuagauuuaaaaaaaaaaaaaaagaaaaaauuuaaaaauuuagaaaguuuugaauuaaggucuaaucugacaaauuagagggaguguuuugguaccucuccaccaucacuguucuuaaauaaacuaaaagaaggugagcucuguggacaaucuguugcauuccgagcuccaccacuguguuugugcacuuuccguuagaggauucuuucuguaucuguguuuguccggauggauaagaucagacugggaugugguugauacagugaaggaaaggaaaggugguguuugucaacucucucaggcucccccuccugucuuucaccucccacagccucaacagugagugugccauccuguagucuggcguuuccccaacagcagugguagcugcagcucccuuucuugacaggccguugugaaucuucugcuucgugacacaaaaaucucaccauucuucuuaaaaccaacauuuuaguggagaugcuuuuaaagguuguguuaaaauuaacucuuuguucuuccauaaguaaggauaaaaaaacaaagcauuuugcucauuugcagauuagcuagucaacauucggcaccuaaagcaaaucugcuuuguaucuucuuacggaaaugucccuauuuuaaagggacgcauuccuaaaaccagggaagcgauuaauuuuaacauuaaaaaauuauccacuugggauaagcgguuccgaugccuuggugucuauaaaaaguaucgucaaaagaugcaaaggaagcaagguaaagguaaaagcuuuaaagccauugaagaaaggguuucuugcaaugcaugcugagcaucaagcucagggccuuccccuugccuacccaugugacccacucuuaaguuagcuacuuaaaaauguguccuucgaguaaaccuccguguguuucucacugacuuaaacucuuguguguuuagacuaaaaagagcaaaggcaaacaucccgauacaguccugggacuugcagucugaaggggaacaaaugaaugugcuuugcaugaaguggacgcuuucacuuacaaguccccacacuucaccagaacuuguuuucucuuuuaucagguuuaaguggaaauccugcagauuuagaaagaagagaagcaguguuuggaaagaacuuuauaccuccuaagaagccaaaaaccuuucuucaguuagucugggaagcauuacaagaugucacuuuaauuauacuagaaauugcagccauaguaucauugggccuuucuuuuuaucaaccuccggaaggggauaaugcacguaaguaaauacaaguggggaggguucugugugaugcuagcucgguauguuugcuuaauaauaauaauaauaguaauaaugccagagaucaguuauuggcugccgugugaugauaagcucuguccuaagcacuucaaggauaucaucccagaugauuuucacgguaacucacaguuucaguguugccugcaucuuaucaguuuaauuguucuuccaugcauguguacugaguggaucuagauaugaaucuggccacugcacauguaugauacguguaugauacuguagccugcuagcaggaguuucucaagucuucaaguuacuuuacuuuauauagaaaugcucacacguagguuuaaugcccuucguccugcaaugcuugagacguaggcguuggauuucgugucuuuggauucaggaguaugcagaaugcauauauaaugagauuccuggggagagggccuguccaacugccacauguauuuauggcucagacauacauccccugaagguaauuuuguacaauauuuuaaagaauuaucugcauaauuuccuggcuagaguuuuccaauguggcaucgugucugugcucaaaaaguuucacauauuugaguauuuuggauuggggggggggauucaaccuggggggaacauugugacccaagacgaaguguagccuagagagagcagaucagcuucagggucuauccacagacaguuuccaugugcucuuaacauccugugguuuucauucauccuuucagugucaucuuugcccuucacaaggcucuguuacagugaguguuaugauccccagucuauacacuauaguauagucuauauaguagcgaauccagccuggauauguggauacuauauucaaaucagccuauaguguguuguaucaagacugacucuuccaaguuguuuuguucauggaaguuucauucuuaggcauuuuacaccaugaagaguuucacuuaaaaaguauugguagcucuaaaagcuguuaauguaacgauacaaagaaauuuuacaaaggugugccuaggacuugagugagcgucuuccugauuuuuaagcagaucagucagagaauguguauguguaucuuacauaacacagagcagagcuuccgagcaaugaugcuauuaaaguuugaucaaaaccaguccucauuguucacuggacagucccuccaacugagacaccaaaaaaaaguauccagauuuuguaucauguuuuauagggauguaaaauugucccuagaucagaaucacuggugcagauaacaaauuauuugauaauauacuugucaguauuuggauaucaucaucauacuaauaaacaauuuuuauuuaaguaaauaguguacacuuuucugugggaaauagagaagaagaaaagcuaauaagaaaauaauauuuacugaaaaauaccacuuuuuacaguuuuucuacuucuaguguauacauccuuccagauucuaaaaaguccacguguaucucugugucgucaugugugugaguauguguggacucucugcaggucuuaaaacuuacaacugagccgggcggugguggcgcacaccuuuaaucccagcacuugggaggcagagacaggcggauuuccgaguuugaggccagccuggucuacagagugaguuccaggacagccaagacuacacagagaaacccugucucggaaaaaaaaaaacaaaaaacuuacaacugaacucucuaguuuccauuuacucaaccuucacuauagaauauugaaaaaugauauucuaaauuguuuugauauucuaaacuuuaguuaaaaaacaauuuuuuaaauuuuauuuuuaacaguuuuucccaagauuguaaggaaaauauuuucaguggugugaaauuuaucaugugcaaagucuuagggccagccucccuggcaucucagcuacuucauuuaucggauguacugacuagacaugcccucagaugugauagaaguucugcucauggagugcguccgaggugauuagaucauccuaaaggcuucaagauucagaguccacuagaacuuacugaugaagccuagauugcugucccauggaaguuauguggcuuguuuucuuuuuuaagacugcacgacgagacaggcuggugccuggagcucauaggucagccagcccagcuucaagaucaaugaaagauacugccuaaaaagaugaaggugaugagggauucaggacacacacacacacacacacacacacacacacacacacacacacauaaaaauauugcauugccuuagauauggccaugauuuuugacucuugguauuuuaaugaaauuuagaauauaagccuauugcaguugggacacuucauguaaagucaguaacucccccaucuguacauaaauaauguugaaugaagcacugagaagcacagugggacuuuuuguuuuuauacacuccugccauguagcucagacuggucccaaucuugcccucguccugcuuucaccucucagugcugggauugcagacacacgcugacacacucgcauggcucuucucauuuuaguguggcuuuuguuucuggcuuaaagagagcuugagaucucaugucugugucugugucuguguccagaauguuacagcccgugugaugugaucuuugauaaaauaagucuuuaaagauuauuaaauaggggcuggagagauggcucagcaguuaagagcacugagguccugaguucaauucucagcaaccacaugguggcucacaaccaucuguaaugggaucuaaugcccucuucuagugugucugaagacaacuacaguguauucauauauacauaaaauaaauaaaucuuuuuuaaaaagauuauuaaauaaagaguuuuugaaugaaauaguugccuugaggaagauacggguggaauguagacugcauaugaauguauuuccaggggaacacuuuugguaaaauguauuuacagugggacugaaagcaugaaacucuuugcaccuuugagcuuggauuuucucucuuugaccauauagcuuccaaaaaguacaguggucaccagcuggcaaaggucuucuagggauacugaacuacuuccucucugucaagaucauuaugaucauggcugguguggaguggagccguguaugaagugaaauaugucauuguuucauguuuucuuugaaacacucaguaguuuagcgauaaagauguguuucaguuaaaacugauaauuacauaauuguuucacaguuccuuccccuuaaccucuauuauauugucuguaauuuuuugugguuacccuuucaggaaaaguuugaacacauaccucuaagugguaaauuuaauuauauguauuugccacaguaucuuuauaauguacaauuucaaaaguagaaauuuggagaauaaaaugauuaagaaagauuaaaauuuuauuguuuuuuauuauauaguaguaaccguaagacuucauugacuuaauuuugucauuuauuuauuuauuuccauuuuuuuacuugguggaguuauauuggaaaaacauacuuaccaaguccauauugagucucaguccuuucugucaauugcacagaggcuuggcugaaaugauaaguccaucuucugccuuuuugcuuuugaaauauauaaaugaacucuaacugaagugcuucauuuggauaauauccuaacuugucucuggguugcuggacguguucagcguggucuuuugaccuucauguguucuugaauccauacuugaacuaauucagugaguuugucucuuauuauuggugcauaggggcuaucuuacaaguguaaaucauaaauucacugaauuaguuaguauauacgauagcaugaucauugcuucagcuugaaaauaauuaaaaugcaaguucugagaacugaaucagggcaggcucgacacaacacuaaauaaguccuccugcuuccacaucaccuuacaaaaaugcuuugugccaccgagaauugagcucucagaacacuuucugcgcuuacugaccccauucagguggaucugacucuugcuuuucuucuugagcaucucacauguuccucuccaagacuggucgccgcccagaaaccucacacuccagauucuuugcuuucugcacgugucuggaauaugcuuagucauuucuagaauuacucauuuauucaauuuuauuuccaguaucguucucagcuuuaucuacccaguagcuuccgacauuucaguucaacucagaagauguaauuuuauguaguauuccaaagaauauaucccuucuggugaauuuguaaaugcccaaagcaaagcuccaaaggaugccgacagugacuucauggggcuacauaccuguaaccccaacacuuggggagaacaagcaggaagauagagagcuagaagccuaccagggcucuaucucaacacaguaacaagaaaagcaaaaacuaagacuuaaaaggccgggcgugguggcgcaugccuuuaaucccagcacucgggaggcagaggcaggcggauuucugaguucgaggccagccuggucuacagagugaguuccaggacagccaggacuauauagagaaacccugucucgaaaaacuaaaacaagacaaaacaaccuaagacuuaagccucccugcauguauguuuuuccuuuuuuagaugcuggucaugggccacugcaucaauuuuaggggcuugaggaaucacaccccaaccuguucagacugcucuuuucugccuuggaacauuacgacugacuucauuuucucccuggaauucucuucccuucauucggucuuuaugccaguggccuccgugaccauaugaugugcuguggagaccuuagagcagccuccuagcucacucaaccucauuuuauuuuguuauauacagcuauguuugaucuucuucaugaacuuacagauacauaauuguugaugucuuaccugaaauucuguauugcauccccaauaccuugguuuccuaacgcagugucugccagccaguagguguagauaugguugagcagacaaguagcacuuagcuuaaauguguaugcuacagaagcuaaacugugaccacacuguaauagaacugauuaugaauaauggaguguauucuguccuuaaguuuuuacuuacaucuugucugucaucuguaauaauagcaggcagccucuuaacacuaaacagccacauuguaagugcaaaaagauucuuaaggggaaacugccaaauguuacuguagugagcacggauaaucaccaaguggaacuuuagugcugauagaaaguuuuaguggucuggagagaagaucaagccacccacagcauuccugucagccagaguguaauccugagcagggcccuaaggauuccuaauccugugagggcugagagaagugaggaagcugcagaagaaaaccguaaaacucgccgagguuaguucaugaggcuuaaauaaagggcccgucuccauuugucacagccugggccucagggcugguacagaaacugaggcacaguguccaaaagacagagcugaugucauuggugagagcgguugcacaaaaccguuucuaguacagaugaaacagcuuguguuagaagagcagcuagagaaguuucagugcuagcuccaaugaggauggaugcuuacauaccaucuauucuacagccuguggacucaggaaguaauauugucuuuuggguaucuucaagaaauacauuuccuaaggcuguggauacugucagugauucgacagaggaaaaguaagcugaaaaccuaagggaagaauucaccagucgaggucacugaaggaucuaccgggguucauggagaaaggcauccccacuaaugggugucuggaagccaucuguucuacugcauggaugacugcgugguccuugaccucagugaaggaaaugacuagguagaacgugacugacuuaggacuaccggccugaacaugugacucaguugcugcuuuuggaugagcaaggaaaacagcgucgugagguggaauuggcuugcggguuuagaauauuauggguaucgaguaauaaagaaugagaggauugauuucaaccucagaagugacucuucuccuguugauaaaaugguccgaagcagccuuacaugcuccagcacacucaucugaugggacaagccucauuuuuggcugcugcugcuucuucuuuuuuuuuaacuuaccauuuuuaauuauuuauuuuauuuaaggggaugauaaauaauuacauccuuucuccauuccuuuuccucccuccagaccuuuccauacaccuguucucucucagauucauggccucuucuguuauuguggcauguaugcauguauaugcauauauauccugaauaauacaaccuuuagucacagccccaggaaggcagagacagaggcagguggaucucuaugaguuggggccagccucaucuggcuguuagcagcaaacuccaccaccuccaaaacuuaggaguugcugaaggcucagaugaucauuggcagccucagccacaaagcuguuuauaguuacagugugugcacuugagacuucacacugcugcauacuuuguaaucuauauaguguggcuaucgcuggcaggcgcuugcaggcuggaaaucuguauaaguugagaugcugauuuaacuggauuugccuggaauaaagcacuagauacuguagagguauguguguaacuucuuaggcugaauccugaguuucuccgugugcucacucgucacuggcaaccuggaccgccuuauauauccugaguuuguaaaucuuaaaggcagggaacuugaaauggcagagcgcagagcguaccuugguagagggaucaaaaugcugaguaaaauugaucggguacaaaaaagaaaccugaaaacauccacuugguauuuuaaaauugccacuuuuuguuucuuuccgaaaaguuuguggagaaguuucuguuggggaagaagaaggugaaggagaaacgggguggauugaaggagcugcgauccucuugucgguggugugugugguguuggugacggcuuucaacgacuggagcaaggagaagcaguuccgaggccugcagagucgaauugagcaggaacagaaguucaccgucaucaggggugggcaggucauccagauaccuguagcugacauuacuguuggagacauugcccaagugaaguacgguaagcccagcagagccccgcauccuccugcaagaugcagagcuggaccgaaaaaacguguggacggcucagcaugucgcugccuucucuuucaggugaccuucuuccagcugauggcauacugauucaaggcaaugaccugaagauugaugagagcucauugacuggugaaucugaucauguuaagaagucucuagauaaggaucccuuacuucuuucagguauggauuuauaaacuuggaacauuuuacuaaaagccaagaagguaucaaccuuagaggccauagagauuuuuauaaaaaggacgggcauauugcagagcuguauuucauaaaugaggauagaauccaaaaagugaagaaauuugaaagaugguguuagugucaaaacuuaaauauaagucuuuuagacuuuuuaauuuaacauuuaacauuuuuauggccuguuaaaguaaaucaugaagugacuguagguuucagacaaaaaaaugagcucugugaugacuggcaaaggacugguuaguuuuguuuuaaauacaacuuuauacgaucaacuaccucauggaauggguaaaaaaauuagucggaaaugugaacucugucagguuaugcaagugauggaacagcaggaauacuggaauaacauucauaucaccuaguugggaagaaaucugaauggacauguucgaggaaggguuugcaaaggugagagugcuguggggaagagaguguagcuagaugucugcuaggacacugcuggucagaccaggaguaaucaugucagcuaaggugaugugggaaugaaguuggaaggacgauacagaacggcaaacugccuucugaaacacuagaugacgagaagcaggcaugccgcagguugccuccagaagcacucuguacauuuaaauugcugagacucccuacucuuuguuucauaguacucuuuaaagcauuuuugaaauuauuugucaaaaguuauauuguuagauuaaauuucacacuggugcucgggaagccaaauguuaaccuauuuuuuuguccuccauuaucauuaucaaauauucauggaaugcugauguuuuaucaauggaggauuccugcugucuuaauauuuaaugacuauuuaauagcuuagcagcuauaguuuuuuucaggccuuggugagcuuuguauuugaccagauugaacgugacauuacugaaccaaagucagacuuguaauaccuacagaaauuaaguuauagucacagcuuuagaccagaaccuaaaauuaaccauuaucgcuuuaagauuuguaacuacaaugaagaaacguacuguuaaaaaaaaaaaaaaacccaaacaaccgaaucaauaaccaagaauaccuauguauucauuuaugaaaaggguaauugucaaucauaacauaugaauuucuuauuuuaaaaaagucgagauuuguauguauguuugucaauacccugggccaccuagagugcucauccuuugaguauuuguguugacguacgaacagugcacagugaggaugucacagugagugucuugcgaauguaaggacagugccuguaaguaacauguacuuauuuacagcuucucugccacguuucuaagaagcuaaaaucgguguuaaccaguuaagacccauaguggggggagaagguaccccacucauaaucuucucaccauagacucauuggccgucauauuggguaacuagagauagccuuguggagacuuuugauauauaugcuuuguggacguuuauguacauguaguuuguuuacauagugcuuagcuguuucaggaugggcccuuuaacuaagcuucaguccuccgacaaaaaugacuggcaagcuuugcauacgcucacuauccuaacaugccagaguaccaagagaacucuauaaauuuuccauguucaaagaaagauggaaauaaacuuugcacagucccuuaucacagugcgggugggaaaguuucucugcauuuauuucccuguuccaaaaauguacuaaaaaccaugacaugcauuuauuuuuaaauuuacucucaugaugccaucucucacugcuguucuuggcuucuuaaauuuagauuuuuaaaagcaggguuugguuagugguaggauaggaccugaacagagcuguuuacuuuuccugggcacauuggcugcaaacguuugagcagacuuggacuaaggaaaaacagacccuaaaaacugaagaaagccagaacuguuccaagaaauugucuuuuauacauaccuaauaaauauuauucuccugaauuucauguguuuaccuugugucuucacugacaaaggacacggugauuaguaaaacacuaagaauguagaggguuuuuuaacuaugcuagaaaaaucaaagaccucaaagugugcauuaaauaaguuuacccaguaauuuguagccaaaugugaguccuaguggcaugaacuuuauagucuuauuuagcaaauuccccuuggcauagaagaugguggugaaugcuguagaccauggccuacagucauuugugaacugagaaacaaaauacaaacaaaugauagcuguaaagaacaacuaauacggaaucaaaaagagaaaacucagucuauacaacugcuuaaaaugcacacaguagcaguguagaaagccuugcagaaauacucaggcagaaacuggagaacaguaguaagcaaguuguauccgcuaucucgacagaacugaauucaauccuuagccuuguuuguaauaauuguauaacuuuagccacauuucuagaauacaauaauaauauuugucaacuuguaagauuauuuguaaaggacauggccugaauucaguguuccuugucuguguuugcuagcugacuggcuuggaauuuuauguuggaauuguggacaagaaauucaagaagauugguuggucucaagaccagcuugcuucaguaggcaguguguagggucagaaaugacugagcccaaagagggauguucaaucacaugguaggaagagucgaacacaccaggacccacuagggaggcgggaagacuaguagggagccuggcaggaaucuuggcagacugaguuggaacccuugcuacagguugugaggauaagcaugggacuaugugugccgugaacuucuccugguuauacgcauauuucuguaugaacaguguguuuaguucaugcuaucccucgugcccuaugguuacaccuggguuacuuaacugaauauacacacauuccaagcacggugcuuuuuuuuuuuuuucauuuauagacuuucuugggaaaugugacuuauacauuuaugaaguuugggcacucugauauguguuuuacauggggaguugauacaucucauuuuccuauuuauuguuacuuggugauaaaaguuuuuagcucacauaugacagacugcagauugcuuaagcuuuaagacuccguguuggucugcuugacuaaauauugauuuuuuuguuuguuuguuuaauguuauuuuuuuauuacauauuuuccucaauuacauuuccaaugcuaucccaaaagucccccauacccucccccccacuucccuacccacucauucccauuuuuuuuggcccuggcguuccccuguacuggggcauauacaguuuguguguccaaugggccucucuuuccagugauggccgacuaggccaucuuuugauacauaugcagcuagagucaagagcucugggguacugguuaguucauaauguuguuccaccuauaggguugcagaucccuuuagcuccuuggguacuuucucuagcuccuccauugggagcccugugauuaaaaaaaaaaaguauuacugaaauuugaaauuggguaguuggaaggaaaccuccuauaauuuuuacaaaguucucuguugcuauagguacucaugugauggaagguucuggaagaaugguggucacugcuguaggugugaauucucaaacaggaaucaucuucaccuuacuuggagcugggggugaagaagaggaaaagaaagaugagaagaagaaggaaaagaaaaguagguguggcgguuugcuguaagcauugguauuugggaagaacaacaagugagggucuugaaaacugguaccgaaauaggauucuuucaugagaccgugauaugaagguguaagguguuaauuaccuaauucacuuuuaaguaacagaaaaguaguccuugagggguuuugucaguaugucaguccccuccaccacaggaagagacggucaguauauacguaauacuucagccugggcuuuuuccuuggccguuggaucagcaacaugaauugagcucuggcuuccugguugucuuuuucucccucucuacuaguuuuccauuucagccagagcugcaucgcacucucacuggguuuucagucuucacgcuuuguccuuucacauacuccauuguguacuguguauggacacgcugaagugugugcacacacggucagcggcugugcauugacuugcgugcuugugugucuauguagacccguuguuacaugcccacaucuuucauuucacuguuccugcuaaucccuccaagugaucuuucagcacuuugcuagcauagaguuuauccaaaaagaucuuagaacaaacugaccuacacagagagacaucucagaauguaagcucaggguaugccaccguagaaggcccugcugcauccucuuugcugguaucuucugcaucauccaucucacucaggcaccugucagaacccuuucuucuuugccuugauagcaguuugcuguccuguaaccauuuggacuuguuuaauuugcuucaggguguaagccuauauuuucuuuucucacaagaguauuuuaagaucuucuaaaauaaucccuggcugaauggcuuuuauuuugcugaguuuuuucuuugggggggugggggcgagguugcuguuguggcuuaugaugcugggcauuguuagcccgugagucaaccagcacuacaacagaggugcauguuuacugagacuguguuuaaggcagggucucagguuccaccucaggcuagucuugaauucaguggguagccccggcugacuugagcuugagacaguugucccacuucaaaguauugguauacaggcaugacaccuggcuugcagcagagcuagugaccaccccuuuaauccuagcacuagggaggcagaggcaagcagaaucucugugaguucaaggccagccuggucugcagagugaauuacaggacagccagggccacacagaaacccugugucgaaaacaaaaaucaacaaacaaaaaggauuggguagauuguuuguccuuugugcauuacuaucuuuccauaugaaguucuuauuucaaacaaaaugcacuugagauuaucuuuguguagagaguguagcucugugguaaagagcuuacuggcauccacagucucuggguccauuuccuaacacuagggguuggcagauagaaacuuguggcuggggaugaagguggcucgcccaguguucuagauuccuccauucaguacuccaggcagcccuugauaagccaccauagucuuuuugaaacauggcagucgugguugccaaaugcuuugcacacuccaucuucaucuaccuucauucuuacugucaggaaagcgaaccuugagaagguuguguaacuugaucggguagcaaguaucuggucaaagcgucucugcucuuguccuaagauacaggacucuuacauccgugaauccuaugaacacaagaaguacacugaugacugcuccuacugaccugcagucacuauucuaacgcgcacuguucccuaagucuuacccaacugucuugucuagcuuuuuuuuuauuuuucacuuuucuccucccucucuccaacccuucucacaucuugccaacuuuggcaucuaaucagacacaggcaaaccugucuccauguccuguccacuugcuugccagccuggaaugugcuuuucuggucuccaaaccugagcucccugaaaggagccagguauccuuuuacuaucgccugccucaucuuucccaagcuucuguucuuuccugcccauguuuguuccagguuucccugcuugaagaugcucuucucgauagagaagcuggaagaaaacaggcuguuucgcuuguuccaaacaguggagccggccccuccuugauuaucacuucagacuuguacuccuucugugcuccguggaucugauuuggcuuggugcuuugucugcucaucaucccccucgccaaagccuccggcuuuccuccuugucuuguacacucuucuuucccacucccaccagagcgcuccuggaugccuauuuucuuuuuauagcauccccucccucccuccauccucucuuuuucugcuuucucaggguuaugucuguauuuagcuugaagaucuuuugcaccauauucgggcuuauaacuuaucaaagaaagaauaaagccuuacguagaaauacaguaugcauacccuaaacuauuuuggaguagucuccccuuguaggaccuaggaagugguggacggggucagcaagcugcuguuuucuguuuguacaccuauacaccgcuguguaacaauucucuuauagaaaugugaacuaccucugcauaauuuaguguggccguauucauuucuuuuggaaagcuuuaauucccauuuuguucuuacagauaagaaacaagauggagcuauugagaaucgcaacaaagguaaauucaagaugauugaaaaguacaguuagcuuguuuucuuuuaccuccaaaaauagaucugcuguguacuauauuuauccaaaauuagggagcaugacaggggacgucaacagcguuaacuuggauuaaccucucuggccacugcuggagucaugcagaagagaguguuaauuacgaucugugcugccgugcucagguagcuuuccuaaggguugcagagugcuuuacaugccugaaaugaaauaguugguagaaaaaaaucuguguaguguaaaguacauuuaaacauaggcauguuuuucuaauguguaaucauauacaauauucuacauuggaucauaaauuacaugaguaggaucuguagucuucaucuaaccucguaccuaacaucacacgaaaagaaagaaauuuaguauucuuuauucuuaguuuaaggacuguauaugcuuuauuccugucacugaaggugacauccuuacaucuggaacaguaccacaggcuaaucucacuguugucuuauucacucuguguagccaucccaauacacacacauacacacacacacacacucucucucucacacuuacacuugaauguuuauaguucagucuuuuucuaucagaaacugauuuuauaaaaagaagaagaagaaaagaaagaaaaagaaaaaagaaagaguuucgaaauguuuaucaugccuuuacaauacaaccaaauuguguuuucucugaacuuagcaaaagcccaggacggcgcggccauggagaugcaaccucugaagagugaagaaggaggggacggugaugagaaagacaagaagaaagcaaaucugccaaaaaaggaaaaauccguguuacaggggaaacucacaaagcuggcuguucagauuggcaaagcagguacguacggcaggcaugggagaaugacagaaggaaggguguuuguucucagauaccuguaucugcuuuaaaaguggcuuuuuuuuuuuugguagauauuuuuagauauuuucuuuauuuagauuucaaauguuauccccuuuccuaguuuccccucugaaaauccccuauccucucccacccucccccugcuccccaaccuacccacucccacuuccuggcccaggcauucccccauauuggggcauagaaccuucacaggaccaagggccucuccucccauugaugaccgacuaggucauucucugcuacauaugcagcuagagccacaagucccucuguguguacuuuuugguuuagucccauggagcucugggguuacugcuuaguucauaugggagccugauguaucugucuccugagaggcucugccagugccuggcaaauacagaagugguugcucacagccauccauuggacagagcacaggguccccaaugaaggagcuagcgaaaguacccaaggagcugaagggguuugcagcccccuaggaggaacaacaauaaaagugucuucugccacagcgagggcauuuuggaggcauaaaggauauuagaagaauauuuuuaacuuuugaauuaucauagacucauaauaugauugcaguagacagacccuuacuccgccugcuggugagguaauugguggccaaguugaaauuaguccccaaguuuguuuaaccuacaaguccgugcagucaugucuaaauuucuaggguuagaaaugaagccaggcagugguggcagaggcagguggauuucugaguucaaggccagccuggucuacagaguggacuccaggacagccagugcugcacagagaaacccugucucagaaaaaaaagaaaaaagaagaagaagaagaaacgaaaagggucugucagggagacuguuuagcagauuaucgaacccuaaacguuucuugcacgcacucugcucagccuuuuauuggcugucugugaaaaaaaaaaauguacuuuucugaacacagacauuguguucaucugaggauacuuagaauugugaagcugauuggcugaaaugcugccuucgcuagacagcagcaccuauggaaccaacgcugcuuuucagaggagagcccgugguaagacagcgacgccagcauugucgccuuuugacagaugcuguaugcaauaugcaugcauucugagagucaugcagacagcaucacuggacagcuaggcauauaaugggcgaagcagccugcgcucuauacucaguaggcguauucccuaguagcagauacagugcauaucaacugacucauacuguaggaaaggguguucuuguguagugauagcuacuugaguagcuacuagguaggauauuagacccagaugucuagacuugcuugauguuuuaauacucauuuguaacacaucucauaggggcucgauguuuuguaauacguaguuaacauuccuuuuucggaguuaaugaaucagugaugauagaccagugauccaaguaguguaauuuuauguguauauuuuaaaacauggaguuaauuuaauuucaagacuguuaaguugaccugucuuccuaacgucucucagaacguugaacauagcgagcagcagcuugcacacugaccugugggaggucacuuguauuugcuucuuaaauuugucuccaccuuagacaaggcgcacacaaaaaaaucccaaaaagcuugucucucaguucucuggggucaggguuuaagucuggagagugucugaugugauaugucaguacacccuggagagaacagcugcucaggaaaauggaaaaagaaauaucuuagcugguuauaagaauagccuuauagugcuauuacagaguugcaguggguagcggcugcuacauuuaaacaauuguccuguuuccugccuguauaggucugcugaugucugccaucacaguuaucauccuaguguuguauuuugugaucgauaccuucuggguucagaaaagaccauggcuugcagagugcacaccgaucuacauccaguacuucgugaaguucuucauuauuggagucacaguucuaguggucgccgugccggaaggucuuccgcuggcagucaccaucucacuggcuuacucagucaagguuagugauggauaguuaaguagcccuauuguuuaaagccuccgcugguuagaaaauacacgcccagggcauccuuuucuggccuggaaaguggaggguuuccauuuccuuaaaaaugcaggcagugauuccaggacuucugugcacagagccgcucacuucacgaggagcagcagccuugugaggucucaccgcacccucucucccacucauaaaguugaggucagggugugugcaaaucaggauuuggcacacgaggcaggaugcugagcuugggcccaguuccucagccuuguuguuucugcuuugcuguuccuacaaggaagucuuccauaugugggcagauuuauauuuccagaaacaauucagauaauauuugcauguguaaaaucuuuugccucccuuccuauggcucgcagaguccugcucauucuggcccuugcccauugugccuaucugcccuacccacucucccucugguccaaccuucccugcugauguugagacaugccaucugggauuugccuuucauaauggguuugcagguuacucucaacagaaggaugcugcucuuguaacuugggaagguaguuaccauuucuccuuaaagaacauuucugacaaugagaaaucuaaccgucuucuuccgugcugacauucucccuucaguguucuaaauguuuuacaaacggccaguuauaagaauuuguuuggcuuacuguuuuaaguuuguuuguuuuguaaauguauugugucugcauguuugugugucacacggugugcaugugcaagucagaggacagauugcagaaaugaauucuuuccuuccucuauguagaacccauaaauccaugucaggucaucagacuugguggcaagcagcuuuacccacugagcgacccugccaauccccacacuguuuauuuucuuucagacauuuaacacagauuuuauaauuuaaauuuuuuaacauauuaagguguuacagagcacaguuuaacuaccuauuuauacuuuucccauuuuuuuauuagauauuuucuucauuuauauuuaaaaugcuaucuugaauguccccuauaccaucccccugcccuccuccccuacccacccacucccacuucuuggccugguguuccccuauacuggggcauauagaguuugcaauaccaaggggccucccuucccaaugauggccgacuaggccaucuucugcuacaugugcagcuagaguacccauggaaggaguuacagagacaaaguuuggagcugagaugaaaggauggaccauccagagacugccccauccggggauccaucccauaaucagccaccaaacacagacacuauugcauaugucagcaagauuuugcugaaaggacccagauauaacugucucuugugaggcuaugcagugacugguaaacacagaaguggaugcucacagucagcuauuggauggaucacagggcccccaauggaggagcuagagaaaguacccaaggagcuaaaggggucggcaacccgauagguggaacaacauuaugaacuauuuauacuuuuuuaaugcuuuaaaaugauuagaaauaauuagaauauagauuuuuuuuuauuuuagacaaaccaaucacucauuuuaucaaaauugucauuaguucauguugcguagucuuuagcgaugcuaguuuuucagucgaucaggaagauucauguucccugaguagagaagugagaugauugugcuucgaguccuuuaagcuugcauucggugucugcucggcccugaugucaucagcauccguuccguucacuguggugugguccuuacacauccuggcaguguuuuguaaaauugaacgugcuuccuuaucugcagaugucauucuuuuauguucucacauucugaucguaauuugggacguacacauuuauaugcaugaagacgcucuuguuuauaguaugcuuacuguaagaucugucuacuuguuuauuauuaucauguuugugugggggcacgaaugccagggagcacccaugaaggucaggcauuacucaaaaaccgaacuuuuauauucucuugugaauugguuacggguagggggacuuuggaaaugaguucaugugauuucuuucuacccugucuauaauuuaaaugccuuuugucauuguugugaagacucuuggcaucuuugcugccauccucuuuaguuauuaaggaagcagugaccuacacuuuggauuaguggaaaugacucagucaagucuucgaguguugacucggccugggaaguuagagggagacccccacccaaauggcuucauacucaccgagucuccauuuucauccggcuaaagcucugucuuugcuagaaaucgauaaggggucuucuuauuugcuacuuagugaaacuuaguccuuuaucuugcguuaucauaauuaucacaaagauugccauggagguaagacauuuuacuaagcauaucagaggcgugugguaccuaacuauauagauacugagaucucuguuagauuacguaauacaucaguaacaugcuugaaaccauugcuagugggaugaucuuugguggccucuuuggguaggucaaauauucuaaaauccuucugguguuuagcugauacuuuuaaagcuguguuuauaucaauugaucucauugcaguaucaugagguaauuaucuuucuguguaguuuaacugucuuggguugugguuucguuuuauuuucuugcugcuguagaaaaugaugaaggauaauaacuuagugagacaucuggaugcuugugagaccauggggaaugcuacagcuaucuguucagauaaaacaggaacccugacgaugaacaggaugacgguuguucaagcuuacauaaaugaaaagcauuauaaaaagguuccggaaccagaagccaucccaccaaauauccuguccuaccugguaacggggauuucugugaauugugcuuauacgucaaaaauauugguaagguuccuuuaauuuauaugcaugaaaauacuaguguuuauagucagcuuacuauaggaucuguuuacuuguuuauuaccauuguguuucagugggggcccgaaugccauggagcaccuguggaggucagaggucaacuucauggaagugauucucuccuucuagguucacuuguauuccaggagucaaacuugggguucuaggcacgugcaagugccauaaccccgaagccaucgucuagcccacgcuuuagggguuuucuuuaucuuuaauuucugguauucagaaacuuugagguuuuacagucagaaugccuggccguguucuuaauuuuauuauuauuuguggugguggguauacagccgagggcccuguaccuguuaggucaggguucuacccccacucaacauuacucauagacuucccauaaacucaucauacuaaauuaucgucgcuauguucaugcuguaaaaggccuggcugucucguggagaacaucaguguccauugcuagaagcccuugagaacuucugucagugcguacguuauauaugcuguccugcuugggggggcggggaggucuuacccauaaaguugucuuuagacauuuuagaagcucauaaaguaaucauagauucugugagaacuuuauuagguuauuuucgacuuugcaagcuuucaauuuuuuauuuaagcagaaagcguaacauguauguucgacuuuuuauuucucuagugacuuauuaaacuugugggcaagaauuauauugcaagcuggcuaaugaaagcguggguggguggguggguuagaaaucuagacgguugugguccuaggcuugaucuacugucaaaagccugagcuuucgcuuucuauaaguacagacuuauugugaguuacuuuauauagaaauauacaguaaaagugagacgagaaaauggaauucaggcuaaguccuacuguguaaucaacuguaagauacaugcuucuuaugucauuuaauuagaagguuuuaaguacgccuguuuauagcuccugaagccaccaccacagcaguuggaaugcuugacagaaggccacuugacuagcaacuaacugggcuuaggcagaagucacaucacccucccacaaaaaucuuucuaccuuaccugugcucuuuuuggaaauucucauagaagacauuuucugcaucauuuuguuuuagaaugcuaugcucuguuuugcauuuuuaaguuaaauuucuaaaucgggagguaagauaaauguagcuuuuaaugauuguuuauuuauuuauugcuuuugcagccaccggagaaagaggguggauuaccccgccauguggguaacaaaacagagugugccuuguugggguuucucuuggauuuaaaacgggauuaucaagauguuagaaaugaaauaccagaggaagcacuguacaaagucuauaccuucaauucuguuaggaaguccaugagcacaguccugaaaaacucagauggaaguuuccgcaucuuuagcaagggugccuccgagaucauucugaaaaagugaguaugaagggcuccgucccaugagugagacugucgcgugcgggacaccucugugcggugguucugagccucgugcaucuagacggcaucacaaagcuuuauagcauccuuucuggcauccagauaggccugcuauguucugccuugugcacucuggcuucuuaugucucggcagucugcucuagggaaaauaagcccauuguauuuaguguaguaauuuaaauaagcuaagcuuucaugguuuugugaaaccuaggcuuucuuuuaucugcaucacagcuauguggcuucagugggacagguuagcaaccuguuguaucucuggcuuucuugguuagcagauaaauggcaaaggaagguuauuuuuguuuuguuuuuugucuaagucaaucaagcauugacuucuuaccuugcagcuaaguaccuuuggagaccgaggcagaauuuuuuuuucuccuuacuuugcauuuuccuucauuagaaaaggggauggcauauaguaacucugagagugaagcaaaucaauguguguauguuuuauagaggcugacuagagacuggagguggguauauuguaaguauauuugcauucugcuuugagacugagcagguaaggaugaauaaagcagguauuaccauuacagcauuucuucaucaaagcucugggacagaaagcuagguauggugguacuugcauaugaccccagcauuugaacaucacagggauuacagguuaaacaccagguagcccuagcugagagaugagagccacagcggaacauagcauagaaugcaaaggaaugagcuuaucauguaugcuugagaggaagggauguggacuugggagacgauggcaccuugugagugaagaagccaguggucaggucaaacuguuagagcuaccaaaugcacucggaguaacauugauggcaaguucauggcaugcaggugauauucaauguugggcacugagguaaagugucugauagaaaacucaagcacuaaugggaagcuucagcaaacaggacagaagguguggguuuagcagacacccccauggaaccacgcagaggugcaucaccaagagaggaggauaguacagugugacuccauuacuuacugggggagaagcuggguuuagcaucacuaaaaaacuaaacuacuuugacguaauauuucucacagaaugcccguuuuguuauuuuuuaacgaaaagauucuuuuuuucuuuuauggcuaaaacaguauaggugaugaaaugacuucacagguaagggguugauggaauuuaaaauguuuauuuaaaaggagaaaauauuuuuugaccacucaggaaucuuugugaaaauguuuuaagaauaauguuuccuaaagagaaacuuuagaggugacccgagguggcugguuaagaaccggaacuaagagcgagacagaggaagaguguuuguaaaggaagaguuacgaggucuauagagagcaacauauaauguucccugcuuuccugacaccagauccugugacuucucuccuacccuugcacuugacagaaaugccauuaacucuuacuuuuguuaauuauugacguuuggauucgauguuaccuuuuagguguuucaaaauccugagugcuaauggcgaggcaaaaguauuccgacccagagaccgcgaugacauugugaaaacugugaucgagcccauggcaucagaaggccugaggaccauaugccuagcguucagagacuucccagcgggggagccagaaccagagugggauaaugagaaugaugucgucaccggccuuacguguaucgcgguuguggggauugaagauccugugaggccugagguagugaaagcucccauucugacugugcagagcccugugcuucacggagcuaggcgguagccacguuaaucagccuuccaguaaaaugucugggguuggugaucuuuuuucucugaaccaaagacgaaugaaauagcagcaaggugacaauaauaauguaguuaacaugcguuacuuuuuaugcuauucagugaggcagcuccccuggcuucccgugagugugacccagcaugaccuagcacaguaccaugacuggcacaguuuucuguugaugaugauggccuuaguaaggaacaccuuuacaugauugguuucauuguccagaccaggaccauccaguagagcagugagugaagacagaaaugucugauuuuucucaagacaaaagccacuggcuauuuguaucuguuauguucuugggguaugacuaguacaauuagaaaccuuuaauuuuuuuaaaaaagaucuauucaauuuuauucucuguacauuggcgguccacccgcgugugugucucugagggugucagauccccuggaacuagaauuacagauaguucugagccaccaugugagugcuagaaauuaaaccuggguccucuggaagaacagccacugagugcuuuuggccucugagccaacucuccagcccuggaaaacugaauuuuuaacuuaaaauucaaacauuuaucauaacugguagccgaacgugcuagacuuuguccuuuucaguugauugaaauuuguguucauuugauggcuuuuugguuuugaaguauaucccagguacuguucgauggacuagagucagaaagaguuuagaaaucuggucccuggcuucaaagaagucagugucuugggugacaaugagcacaguauuugguguuaguccauugccaguuaugcagagaccaugggguaucaaccuaaucuuugcucugauuuuacagagggcaaaauugagaugugcggugggacuguaggcaggagacaguauguccaaaccccaguucuguaaaacaagaguuaggaagaccaccaagcuauauucccucucugcaaggcucaaauaggacugcuuaaacauugauugccugucugagucuuagagcuaaggaaggggcgcaagaacguagagagcacaguaaguucuucgaagcaaagagggaacaacacaagaacugcuuuuguuuaaugauugcaucgccuaauugauucauccugucaugcagggcagccaucuaagaacuggaaauacugauuucagggagcaaaacugugagagaauuuguauuccggaagaaaacacccaacuuguacaaggauagaugcuuagauagagugccagugggaaggaaacacccaaauagguacaaggauagaugccaggacaguguauugugggaaggaacggauuuagaaggaauacuacuagucccugggcgcauaacccugauguuuuaaaugggugagggcacagcuaugagcauggaaaggugauguuaaaugggacuugcuagagcauaagaguuguaaaggauaugcacagggucguaaaauaagauagucaaggaagaccauauuaagaauuugagcugaaaugaaauauggugacacacuaugagccaggcauauaaauagcugcaagaagaacauuccaggcuauauuagucacgguucucuaaaggaacagaacuuacagaaugaaucuauaucuauauaggaaggagauuuauuagacuggcuuacaggcucugcucugucuaguccaacagugacugucuaccagccauuccaggaauccguuaguuguucagucaaugaggcuggugcucucagcuagucuucagcauaugcuagacuacugaagaagugggcucuaaugccaaugaaggaguggauuugccuguaggauggggagagcaagcaggcaaagcaagcuuccuucuucuauguccuuuagauaggcugccagcagaagaugugacccacauuaaaaguggguuuucccaggccaggcaugguggcgcacaccuuuaaucccagcacuugggaggcagaggcaggcgaauuucugaguucgagaccagccuggucuacagagugaguuccaagacagcgagggcuauacagagaaaccuugucucgaaaaacuaaaacaaaaaaacaacaacaacaacaaaaaaaaaaugugggucuucccacuaugaaugauacaguuaagaaaaauaucccucacagguguacccagcuguguagguuuuaguuaaucccauauguagucaacuuaacaaccaagaauagccauuauacaggcaaacagcaaaaugugcagaggacugcaggugaggaaauaguacugaacuauuuuaaagacaggaaggaagccaacguggugcuacguguaaagaaucaagagauaagauuaucccugcucuaacuagacugcaagcccucugaaguuuuucuuuuaaaauuuaggcacauaacauuauuuauuuauuuuauuauuuaugugcuaaaauacuuugaagccgagaaagagagauacagaagcagaaaaacggugagacuuguaacacucaacuccagugauauuggagaugauggcagaagaugagaugaaggaugacuucagggguggaauacuagggauguuggcuuuggguaugcuggguuuggccauguugaguuauaugagacauccuguguguaucacgugagcauuuggaccuagaagccacagaauaguugaagcuggagaaauuacucaugagacaaaaagagaccuggggaaaguguacagccgcagaaacagguagaggcugagagccaauuagaagccuuacagaggaagaggagccagucucuaccuuccaucauuugaugaguggcagaggguauugccaugucagaagagugaaacaaaacugcagcuugagagaucgagauaaauuuagcuugguuuuugccauuuuaugggcucuucuagaucuuugcccuaggaagagcaggcagaguucuguguguuggcuugcagcuuaaauuuuaucuaauagauacuaagucagggugucuguacccgagucuccuuaaccccaccauagucuugauguuuucgcugaugaagaggguuugggguuuugguuuucugcuuuuucguuuuuuugguuuuuaaccagugguugucaaccucccuaaaacugugacccuuuaauacagauccugaaguugugaugacccccagcgauaaaauuacuuucauugcuacuauauaacuauaauuuugcugcuguuaugaauuguaauguaaauaucuguuuuuucugauggucugguuugcuuugcuuugcuuugcuuuuuugagacaggguuucucuguguugcccuggcaguccuggaacucacucuguagaccaggcuggccucgaacucagaaauccgccugccucugccuccaaaguguugggauuaaagacgugcaccaccacugccuggcuuccgauggucuuaggggaccccugagaaaggguuauucuauaucccccaaaggaguugcgaccuacaggcugagaaccacuguuuauaauacauuaauugaucguucuucacaagauugaugggugcagaagggguggaaugcgagacuaugagccagcugcucugaugucuggccugugcaguucugaaucgggaaucaaaacaaauguaguuuuccugcagcuggcugggagcuuaaacaagacaugucaccucccuuaagugccuuacuuuuaaaaaaauggaggcagugugugaguuggaaguuagaaacguuuucuguuuggugggcagaaaauaaauguaguuuaucauuaugaaucagcuugauauaauuccuguaucauacaacuguagcucuaaugguccuccucuugcugacugauaguugugcagauaucacuacagucagaauaaucucaucaccugacacagaaacuucauaaccaccaauacccauauucauuuuagcucauuaaaacuaaauauugaguggccuacaucuugccauguccucuaccccuuaaacucucagcuaaaucaaguuuugguuuaaaaauagauaacccaaacagugucgcuccucgaauucaucaccgcaucaaucaaaugguaccuagcacuuaguaaauauuagguacaguggguguggagaacgucuccuuucaaugauacaccuaaggccagcguggggaagauaacaguguaaaccuuuacauuuagauacaagcugaaguuguguguaguuauuuaacuaucauaagacuaucagguacccugcuguuugugccacccuugaucuaacuuaauagugcaguaaauacuaagcucuaguuacuuaccaggucuuuaaauauguaaauagaugaaagaaauugcauuggugauucaaacauaaggguccugccuugagaaaaggaucaauuugcagaaggcaugaauaaacgaguaucuguaauauggugggguagucaauaauagagauauuuaauaauaaauaaaugaaggccaaaugucuagcuagggacucaguucaauggagcuccagagaaguuccauuuaaccugaacuuaacagaacuuacaggcacacagcuugcaugucugugaaguguuacacuccuuucucuuaaaaucguaaucguguuggcauugggcucuccucauucugccaugaaaaccaaaccagacaagagcugaguaucccuugcauuaagcguuucccuugggugucauuaccagcauguuuuccucagaguugcucucugcauggcccugaagccauuugaauuugcagcuucugcucauguaggaucuguauggauuccccccccccccaccagaggagcaagaaagauuuccugagcaaacuacaguagcagaagcacgcccugccaugucagucuauaugugguaaaguuuaguaaaucuagaaaacuauuccgaggccaucugcuacucuguaguaccgagagcucugcgcuuuguguguaacagcugaaugaagcgucauuucguaaaagaauuuuaucagaaacugcaucagauguucuaaagaauaaauggcauagagacagggagagcaguuagaggauguugcaauaaguucugaaaauagaacugacucaggagaaguuugggauaaaauauguuaagaccuguugguccuuacagaagcaugggggaggaauggauaaggaauuagaguuggcuccuaggcuuugauagaugcugagguuuagaaagcgugguauucggaacugugaugcccaccuuauagacagaaccuugaguacaguucucccugugagaaggaagggugacuggguuuaaagauggaugaggacggcucuccucagccuuccugaugcugugacccuucaguacaguuccuccuggugcagugacucacgacucacaacaaaauuauuccauugcuacuucauaacuaauauugcuacuguuaugaaugguaauguaaauaacugaugugcaggaugccugauauacgacccucccgcccaaggggucauccagaagcugagaaccacugguuaggggaaaggaaguaaaagugggccaucuauaacuauauguguguguguguguguguauguauauauauauauauauauauuauauaugugugugugugucuguauguauauauguguggguguguggguguguauauauauuauauauguguguguguguguauuuaauugccuuaagaauugccugaugguuuccagagggagagagaccuuaaauaguauugagaagguaguauacaaagcaaggguagcagcuaaaaaugacugguaguaauagaaacaaagacacuauuggcagugguugaagaaauauuggacaucuugagaucaaugugucaguuguggucuaugaagucauguuuguucaauguuuuucuuuggaaaaaaaaaauuuccauccuaaugauuuuauuuuuccucugugaaccagguaccagaggcaauaaagaaaugucagagggcuggaauuacugugcgcauggucacuggugauaauauuaacacugcucgggccauugcuaccaaaugugguauuuuacacccaggggaagauuuccuaugcuuagaagguaaagauuuuaaccgaagaauacgaaaugaaaaaggagagguaagauuuuuuuucccuuaaguuuuaaauugauauuccuagugcauuaguaauuuccucaaccaauacauauagaauauacauuuguuguuaggguccaugccucaguaaugcuguucagaagcaacacaguccugcguucuaggggacaagaguggugguucuggaaaggcuugugucuuacaagauguuuuaugaaaggaguuacuauaugucuauaaguccagaacuauaagacuaccaaggugggcugaaagagcaaagaggauguagacuuuaggagacucuguauucucagaguucucaugcuaaggaaguugauuuucauaggcaguaugccgcagggagguucacaaguuaaccuuaugguauagauugcaguguauuuucaaacuuguacagaaaucagagccaccaagacaguguguuaaugcauagauugauacaucccagucaggaauauuuacuguugaccugaggccacgcccaagaacugguaaacgugacaagucccaggucuuuggaccaugaguaaggaaccacgggugaauauggcagcuagcugauuuggaacugagacuaguuuuggcacauuuuaaccuugauaaaaauuuauagauugaacaagaaaggauagacaagauuuggccaaagcuucgaguacuugcaagaucaucucccacugacaaacauacacuggugaaaggugaguacauuguacaaccaucucacaguuuccuaacacagggucauguucugccuccugaaguucaaacaauccugacuauuaaauugagucacaaauagcauuuuucuaguaaaauauaaaaauauuucuuucugauauauuagacaaauugcauuuaucuucaguaauuaccauaaaauacuacucccaagccgccuuaguugcuagaauugauuuuuuuuuuuuuuuugcuccauagcaaaacaguuuauauuuuuacauuuguuuaaauauauuuuucuaauuuucgagucucuaaaccaggcuaauaaggauauuguacggaaccacuucauccauucugaaggauuuugauagcacuacuauuuccuucuauuuaagguauaauugacagcacagucucagagcaacgacagguuguagcuguaacgggugaugguacaaaugacgggccugcacugaagaaagcagacguuggcuuugcaaugguaggaacccaugcuaauguuuacauacagcuugcugucuaggagacugucugcuuuguuuguuuguuuguuuguugccaaaauugcuaucgauuugaaacaauguuccucaaaauuaguuuuaaaagauguaagugaauuuauagcucuaacuauuuuauaugcuaccuuuauuagauacuaucaagucuggccagaagaugauuucuuugaacagcuguaacuguguacauuugcuuuguacucugagacauguuuaaacauuauuccccucgccggcaucuuacagccaccuucuuaaacagacucauaagaauggugaccuaacuaauggcuuuuaaagaguaccugaaugucaucauuuuauguagcgauucagucaccuucaugaauagauacugcguuucauuauggcagccuuacucaugcauaugacauacucugcucauauccacacaaaucagcccucucucacucccccucccccuccacuaggccuucaccauccacccucuucuacucggaugccuuacauaguuuuucuaucuagauuccacauacaagagauuugcuuuaagugggggaggugccugcuuuuccacaaaauccucaacuaaguguuuucuuuacucuuuguauuagaaaauaaugcuaauuaccaaaacuaaaacauaaccaaaaaaaaaaaaaccuugaaauuuugaauauuuuuguuuaauaugcaacucguucuuuuuauuucugcacuggacuggagaguuucacaaauuaaauuaaacuuauuucaaaaguaaagcgaaggagucagucuggguggcugggacuugaaaccauuuucugccaaaacuugacuucugagacgacacagaucagaucagagacaugugcgcagguagucagucacacuaaggaacuccagguuccuauuccagcuaaccuaccuuuuauaacuauuucuuaaauuuauaaggaguugaacagagcuaugaagguuugcaaccuucauaugaagggacugcaaaaaucuguucuaaauaaguuacguguuccauuccugugacuacucauggccguuguagaaauaucagugugcuuuagaggugcuuuucccacaguaugggagacacugaguuccaaaacccagugugacacucagggcuuugugcgggaggguguuucuguaucccaggcugugcuugugugauuacccacccagguuuucucgcuaaaauagagauauagaagaugacucugggugauaagacuuaauuaagagaggugguaagaggaaauuccccucaagcaaaaauaacuauuucaaggacucacccgacccuacccuacccuacccuaccuuaccucuagacaacuguauugacauguaaugcugaaacuugugaagaguuccugacguggacugaggaguucuuggggguucugccuugugcuuuaagcaagugauaucauccucuuugggaacacugcaaucaguaacugucgcuccuccgcauguagcagauucuugcuccuucugugacccugacacuuagccaggaugccaaaacuaguaccauggaacaaguuguucuuuuccgaaaaacuugggcauaagacagauacugaagguuuuaaguaaauguuagcaaaacucaccaauccagacccccccccccaaaaauacaguacagaagcuguguugguaguggguuuuguuuuuaggguuuugcaugauuuaauauuaaauuagauucaaaaaauuaaacuuaaacuuauuucaaaaguaaagcgaaggagucagucuggguggcugggacuugaaaccauuuucugcuaaaacuugacuucugagacaacacagaucagaucagagacacgugcgcagguagucagucacacuaaggaacuccagguucccauuccagcuaaccuaccuuuuauaacuauuucuuaaauuuauaaggauuugaacagagcuaugaagguuugcauucguaaccuaugucauaaaacugaggugauuccguagaggcugagagagaagaccauggcuuguaauugcugauuuugaguuaaagugcuaucucagccuuucagugccgauccguacacugcacgcagcaguucuaacggggcucaucagaugugccuaccaugcgccauuuauuuuuugauucccaaaagaagauuugaccauguuagcuguuggguuuuucccccaucuauauaaacuguaaagaccccacugcuuugucagcauagggagcauugacgacuagcuuuuccuaaggaagaggccucggcucuuacacagauaucaggggccuuugcacgcucaugcguguguuccuggucugccagugggguugugucgucauuuugguuagaccagcauuucuauacugugucuauauuaugacugucagcuccauuccacccugagccacauggucuccuacaaguauuuuuacuuuucuggagaacuucuuuuuuuuuuuuuuuuuaauuuccugcaacuuauguuuuucuuauauaauuaacuuuuuuccuaauuuguaacauacuuggcuaacccucauucccagacucucuuugcaaugacucagagaccagucagugcucuuaccaaauucaucuuacagaccucccuccccaccucccgaccuucugggaccuggaguaggagugacagguuaccugacuggaugcauuugagaaggagcucugaggaucugguugccucguguuuucauuuuauuaaaccuggaggacaccuaacagagaagcaucuaagucauaaaugcacagccgaacucaagugcacaccauucuguguaggacagaaagugcacacugccagagacuccuggagcuugcugcuucugccugguuucaacuauaccaaaucauauguacuguguuagcauccguaugugaacauuaucuaugauguuuauaguuacaguuaacuuguuuugauuaacccacagucucuaaaccuaccauccugcuguugacagucucacuagccugaggcuccccagugcuuccucaggucuucaagagcgccucuccccugucucuaaguguucccugaaacuucagggccugagagccagcuaggaauucuguaaugggggaaaggccgucuccgcuucccuccugacugcuuaagcuuuagauugcucuggucuccugaguuaguaucagucaucaucugcuucauccuuacgguuuccgugcaagcucucccgucccucaccuuucucgcuucuaaucucuucucauuuuucaauacuguuuuaaacuugagaguacacacacuuguacauguguagugaucaucuccaccuccuccuucucaucccuccuaccucccaguccuuccaacauguccccugccaccuucaccacggccagccuuucuaaaaccauugguguuuuuaagcauacuuucugcauggccuuggaggagacaucccuugauuugcacugcaugcuucauuccuuacauaggaagucagcuaagccugagaguccuucccaggcgcaucuuagcauugacaguauuaccuucuuuuagcauaaauguaauucuuuuuguuaaguguaauggugcacauuugcauauguaaagugauauuuuaagcccauagucuaauucacaggcuuuuuuaacagggcauugcuggaacugauguggcuaaagaagcgucugauauuauucucacagaugacaacuuuacaagcauugucaaagcaguuauguggggacgaaaugucuaugacagcaucucaaaauuccuucaguuccagcuuacuguuaauguaguagcagugauuguugcuuucacgggcgcuuguauuacucaaguaggugacuguuaauauuuauuuuaaagcaaaaaauuauaugcucuaccuuuuuaaaguccuuaaguauugaaguaagaugaagcuuuauauuauaggcuaauuaacaugaaccguaaucuguucuguuccuuaagucuuuguagaagucuuuccuacuaaaggcuuuccgaaaguugcugcccucccccugagccguugugaaugucuauuaggaagccugucuuuucuaggacucgccacuuaaggcggugcagaugcucuggguaaaccucaucauggacacgcuggcuucccuggcucuggcuacggaaccacccaccgagucacuccugcuucggaagccuuaugguagaaauaagccucucaucucacgcacgaugaugaagaacaucuugggccaugcauucuaucagcucguaguggucuuuacacucuuauuugcugguaagaguucacuguaaucacguuccaguuaaacugagucuguugcacauugaugcuguucaaugugcuguagugugacagaauuucagaaacauaaggucuguuccugacuccacggugugucuucaaguuucacuuacuugggggaacgguaggggaagugaagaggcuuagcuuuuaucugggauucagugcacuuagaucugugguccugacaugucuccaucgugucagggcugcaccaaauaaccccagguucccuuccagcucuuucuguguggucauugcacaucacagauuggccaggcuuugcgauuaugcacucuguuaaguugcaugucgggugauuucagugauaauuacaaaaugguggcaucucguuucaggagaaaaguuuuuugauaucgacagcgggaggaaugcgccucugcacgcucccccgucagaacauuacaccaucguguucaauaccuuugugcugaugcagcucuucaaugaaauaaacgcccggaaaauucacggggaaagaaauguguuugaaggaaucuucaauaacgccaucuucugcaccauuguccugggcaccuuuguggugcaggucaguagaugggaagggaguuuagguggguuauucugugagacauaguaaacugguccguuguucacauggugcuccaguggggagagaugcuucuguauggugacuucugacgacucccuaacuucacguugccuaaaguauauucugaaagccauugcagcuugucucuagcuuucucagaaguuaguuccaccucugccuaagcaauuagcuuucuuuuaacuauaaagaauuauuguuaaugagaccaaaucagccaaucacaugauuauugguuuucccccaguaucuuaaugccuuucuguuacaccuuaauucuaccaaaacacaaaaguuuuuuacuuuaaaaaaaaacaaucuagagacacugagcauuuucucauucccuguuucuugauguacaaaaggaugguuuuuaguuucaugcuuuuuugaaaauccagaccugauggucacaucaccuaugaggaaacugaaugcuagacuccuggccagucgguggcagcucacccuggaaaagcacacaaauauucucgacauuaaaagacgaaaagaaaugaaaugaaaugaaaugaacaaguaaaugcaaagaguuagacuuauaauucuuuuuaaagaaaaaaugauaaccacuuucauaccaaauuacuuuguuuuuucauuucaauuauuucauagcuacuuguaucagaaagaauggucagacucagacaaaggugaauauuugguugcuuaauaccuauuauugccagguaugcuauuauaggacacuaaaagucaaggagucccagcgugaauuuuauguacguaugucguuggacuucaggcucacuguuggacagacuuggcagagcuagcccacauuucacaguguugccagguugcguuucuuucauugcagagcguucauaguuggcuuaacauuuaaauguaaaguaggagugaguuccacguaggagagaaagcaaggaggcauucucucuauccacgucuccauaacgugugcuucccacaaagccguucaugaaaggcaugaaggauucaaagcauagccaggaauguagcugcaugacauacauagcgagaacauacagguauuccuuuggucaugagauuuuuauuuuuauuaaacauaacuuccuauauauauuuaaaacuuggggucgagauuuuacuuuauuuuaguugucauuuaaauaaacuuacucuugauuaucccuccagauaauaauugugcaguuuggcgggaagccuuucagcugcucagaacuuucaauagagcaauggcuguggucgauauuccugggaauggggaccuuacucuggggccagguaaaaaucucacugcuuuugugguucuuuuuaaaaacaugcagccguuucuguuacuauucugguuaccauugagucacaaaaggggauccugagugacacgggauuugucucccuucccuaggcggcuuguccaagauggcgcuugcuuauugugcucuguucuuuugcccuuuacuaaagauuguaaaucagguugcugcaguuacaaagggcacauacaugacuaguuaagaugucaacgccugugucuuuaucaucuacuuauguauuuucagaauaaacauacuuccauuauucuucuauauaaguuaauauuuuuuaaagccuagaagaaguuuugagucuuaccuagcaaacaguucuuuaaaaucaugguauccggaaaacacagccacaaaaaaaaaggauuuucaggcauuggaaugguuuuaacagugcaucugucaaugagaaagacggaaaaguaagcucuccgcagcgguuccugagagccggcucggcucgcuugcagccgcaugcccuucuguuaaggacaggcggguggaaaugccacugugcucaccuccaggcuuucguuaccgguaugaaaccgcugcuggaaaaucagugcuaacacauccgugagccaaggguagugagugacuguggaacugugugcgcucugccguucugcagagcaaaccaaacucagcuuauauuuaguucacccuuccuuaucuuuuucuuagucguguuucuggguucuacgugucuuuuuauuaucuuaaaaaucucuuucucuaugauccguaauugguccacauuucuuuuguagauuuccaaucuaauuauuuugcaauguucucugauaggcagagcgcaagccuacaaucuagaaaucugccuaaugucaagaagaagcaacugggugcugugcagcagugggcucacguucauuuugccuguugauuuuaauugugugaugcuuaaaaaaaaagucuuggcuuuggugcccaggagaccuggaaucuuagccauuccaugagcaagucacuucacauaucugagccuguuuuacuucugaagucaggcggcaggaguccaagggcuccaggcuggucugugucuggaugcaucuugcuuuccccuugguaaacucugccugcuaacacucaacugcuaaaaugggcugaugauguuucugguauucuucuugucucuggggguaucccuugcuaaguaucgcuauuaucaaucaguguugauccaaauuuuaaauagcuaaguuuucuaaaaauaauuaacuaaaauauuucaguguaaccuuaaugauuuucuggguucugauguuuucguuuguugaacuuuuauagcacuaauggauuacaagcuuguuuugcauccaguuagaccacuuuuuauuugaagcaaauguaaucaauaagcguucaaguggaaauucuauauacguacacauggucgugcaguucacugucaugaaugucuaaaauauaagaaauacaagcaaguuaauucauauucagaaaacauuuuguccuugcaaacuuauguaauuuguauaacugaauaacuuuuauuuugggaaaaaucugaccuccaagaucucacugcuucucugguaaagauaaaugaacacucuugccguuuuuuaauaccuuaaguucuuuccccuguguuauagcuuauuucaaccauuccaaccagccgcuuaaaguuucuaaaagaagcuggucauggaacccagaaggaggagauaccugaggaggaauuagcagaggauguugaagagauugaccaugccgaaagggaguugcggcguggccagaucuugugguuuagaggccugaacagaauccaaacacagguaugggucugguagagagguaggagagcugacgggaguaaggacguuguuuaccuggggagaggcccaccuguguuuuuaacugccuuuccagccuucccagcccacaaaauguauucuuuugaaaacuacuacugauggcugaacugagugaaacucuucacugauuaugaaagaaugucucuuauaggcccucagcuuuuuuuuccccccuagcuuuuauuuuccccucucaucucaaaaugcuacaucuugccuauuuaucugcucuguaaaagugccuuuuccuuuacguuguaaauguugguugauggaacgguccuuucucuuguucucucucucuugcugagcaagcugucacgaucucugauuccuugcagauggauguagugaaugcuuuccagaguggaaguuccauucagggggcucuaaggcgacaacccuccaucgccagccagcaucaugauguaacaaauauuucuaccccuacacauguaguguuuuccucuucuacugcuucuacuacuguggggugugaguguguguuccuaagugcaugaaauuaacauuuccuacuccacacaccuaacguuucucauucucuccugacuguuuaaacucauuguuugggcuuuucauaaagcuuucuuuuuguaaaguggacugagaccucaaguguugccauuguuacuguuucaguucauagagggguagaggaaagcugggucagaugcaacuaaagauuacacucgaaaccugggagcuugucucugggcuaacucuuagaguucauacggggacuaaaacuacagcuuagcauuuauggaaacgacuauaaauuuuugaguauaugccuuucaacguauccauacugcauggcucccggaagcaugugacuugaaacugagcuaacaaaacaagaaaauugacguuugcaaagcuaaagagugaauuuggcgucucagcuuucacguuguccguuuagaaaguaaguuagcagcaugaagugaggcucuugcauagcuagccacuugccugccuuccuaacuggaacucugucugccuuuauccugugagccacugaauaagcuuucauuauuuuuacgcucucucuauugaucgguuucuugggcucuucccuuuuuuguacaaucaguucagcuugaaagugcacuguagauaauauucugaugucacaaacaaauuuggcaguguauucacugcuguuagucugucgaguuaaaauagaaaugcauggugaaguagaauuauggaaugauaauaaagucaaaagaaauauguacuggcugcauuugguugugugugugugugugugugugugugugugugugugugugugugugugcgcgcgcgcaugcagaaaugcagacuguguaggagcucuccuggauuagagucugccuuuccccaggauucccagucaggugaaugacacguuagagucugagaggucuugggguugcuuaugugugcuaacacuguaccauaguccauaaaaaccccaugggguguagggacauugcaucuggcuuaagguggagaaacuccauuuggcuacaccuccucauccucugguaggugggaggagaacucauuuucugucucccuuugucacucagccguauugauacucuguaucaccauauugauacucuguaucgcuguauugauacucugugugaagggcgguuaauuuagauuggugguucucagucucccaaacacugcagcccuggugaaacccgaaauaaaaugacuuggguugcuucuucacaacuauaauuuuaccgcuguuaugaacuggaauguaaacgggugauucggaggauaucuaauagggaauccccucccuauccacacccgaaagaacuguggccgucagguugagaaacacugauuuagacuuaacacugcacucaugcagaaagacaagcgugaagaaugacaguaauuugaaggggcauguaaccauauuuuuuuuuccauuuuuuauuagguauuuagcucauuuacauuuccaaugcuauaccaaaagucccccauacccacccacccccacuccccuacccacccacucccccuuuuuggcccuggcguuccccuguacuggggcauauaaauuuugcguguccaaugggccucucuuuccagugauggccgacuaggccaucuuuugauacauaugcagcuagagucaagagcuccgggguacugguuaguucauaauguuguuccaccuaucggguugcagaucccuuuagcuccuuggguacuuucucuagcuccuccauugggagcccugugauccauccauuaggugacugugagcauccacuucuguguuugcuaggccccggcauagucucacaagagacagcuacaucuggguccuuucgauaaaaucuugcuaguguaugcaauggugucagcguuuggaugcugauuauggggcggaucccuggauauggcagucucuacaugguccauccuuucaucucagcuccaaacuuugucucuguaacuccuuccaaggguguuuuguucccacuucuaaggaggggcauaguguccacauuucagucuucauuuuucuugaguuucauguguuuaggaaauuguaucuuauaucuuggguauccuagguuuugggcuaauauccacuuaucagugaguacauauugugugaguuccuuugugaauguguuaccucacucaggaugaugcccuccagguccauccauauauuuuuuaaauguacauucaauugucuauuggaaucaaugccuuagcuaucauuucccuguuaagaucauuuuacugauuacuguuuccuuccagaauguugguaucaggucucaacuuuaugaguaaauaaacggugccuucauucuuaaaauuacugaaacaaaggugaacauuucuauguuauaaaauauuuauauuuuaacuaauguaagugcucggcagaauugauuuuauccucugaaaaaauuuugaaugacaccgguuuauugggccugacuauuggcacuacagugacauuuuuauacuuuaaccuaguuuccuguauacagcauacaccccaaaagagagguaaauuuguaggccauauaagucuaaauaguugcuagaaaggaaacuuugaaacuuguugucuuuuccuugaauuuuuuuuucaaagagucccagaagguauguguuuggaaucuguucuuuccagagaacuauagugauuaaguuauaaucuuuaauucagaaaaacaaaacacuaacacuuuuauagaaaaauggcauauacucaaauauuuauagcuguuuaguagcauuuuauagauauguauucggguucgucuucaauuuuaauuaaggaaggaguggggcagaugugacuucauuguggcacucagcuuauauuugcuuggcuuguucauaguuggugacacccuaauuccuagcaugauaaauaguccccuuugugcuugacauuguuaaccuugaguuguuuugagaaauaugugcuuuuuuauuuaaauauaauucaaguaagcuuguguauggcuaaguucucauuuuguuuuguuuuuguuuuugucuucuuagggaaaaaaaauccuacaaaauggcuauuaaauuuguagccaguaacauugagauuuuguuaguuuuucuuugaacguguaccucucgauuagaguacgugguuucguuguucuguaguguccuacuaaaauauucauuuuuuuacaguguauugcaaguuccacugcauuacaugcaaauucgauucacucauaccuagcuguuuguggauucaaacucauaagugaaccauuacuguggcgaaguuccuggcguccugacaucucucuguguuuugugcuguuuacagauccgaguggugaaugcauuucguaguucuuuauacgaaggguuagagaagccagaaucaagaaguucaauccacaacuuuaugacacacccugaguuuaggauagaagauucagagccgcacaucccccuuauugaugacacugaugcugaagacgacgccccaacaaaacgcaacuccagcccuccgcccucuccuaacaaaaauaacaaugcuguugacagcggaauucaccuuacaauagaaaugaacaagucugcuaccucuucauccccaggaagcccacuacauaguuuggaaacaucacucugauuguaagaugaaugguaacacacuagcugcauuguaaagaaacaaaucgaaacugagucuuuucacauauugugacggacaagauaguauucuugucucuggacuucaacagaagacacacuuguacgaauguagauuuauuuuuuuaaaaaaaacaaaagcaaagcuuucugccagacugagggugcuuuuuuggggugugggagaaacgaacugacagaugaacagcggugacucggcaggaguggccugugggucgucagugguaccuaacguuguccugacuagcagagcugugguuuaucucaguucuugaugggagggagggaggagugacgcugggugagacagagagcccuggaucauugagugaauacuuuaauuucugcuguuggcuguuaauaauuuggauuauuuauguuuauaaaugauacagaucuguuuacaagguuuguagauacuuuuuuuguucuucauagacgggaagcuuccuuauaguaaugcagagaaaaauuaguccuucaaauacugcuguauuuucaggaaaaaaaagggggggguguuucuauugaaacuguacuaaauuuuugccuacaauuuaucuuguuacauauguagauaaauugcuaauacuaauagccaaauagauaacacuaaugcuuuguuuaaaaaacaaaaaagaaaaaagaaaacaagacaaaaaaaaaaacaacaaaaaccaugagcagugguguucuaaugaaguuauggcaucuguccuaauuaguuucuuaaauacauuuacuacuuaaugguuuugaaagaacuguuuaauuuuuaaauuuuuugaaaacuugcuaauaaccuuuuguucagaauuuaguagauuguuuauugcgggacaucaaauacacaaugaaagaugcuugaaaugccuuuguuauuucaggccaaucaaauuaaacuaucaaaguacaagagaaaccuuuagucuuuuuuuuuuuuuguuuuugucuaaauauguuaguucagugaugucuuagugaacugugagugacugcauugauuuuucuaauaacugcguagagaccuucacacagcauagagggggcuguuggcauuuugagaaagguuaauagagagaggcauacaucguuuccuuuuguuuuugaaacuuguuuguaaacauaaauaaauaugcccuuuuauuaaauaaauacacagcaaugguucuucagacagcucagcuccuugguucucuacgugugccgcauuggccugucuccucuaaccacaacuagaauaaauuucaagcugguggcagccucaggaagggcuguuugaauccuuucuuggucaccccauggagucgagcugagacagcaguuuugccaccuagcacacccuucauagaaucuacuuuuaucuaaaguaaaguagucucgccauuuuauacgaaguaaugaccacaguugucugauguauuuguuuuuuauuaagugucccagucacagauuagauuaaagggauggcgcaugaagauuugaggaagcggcuaaacacgaucucuguaauaaccaacucuaugccgaacucuaugcucaucucugagacaauugaauuuccaggcucucugcuucuuuucugucuaccuucuuccuuugucugccucucgucuugaccuuuuagaaagugguauuguuucagggcgcagaucucgccaguuaaacaauccucaggcugaccuaaaguuuacgaggacuacuacauccaagaaugcugaccuagcaaagaaacaucuaguugauggugcuugauauauauauauauuuuuuuuuugggcgggugggaggaaucuuuuucuccccaucaguugccugcaguaacucucugcaagucuuagaaacacaucggcucugucccaucgaucacuguacauuuuuacucaucagguguuuguaguuauucauacuguaaaaagagguagcaugauaugcugggacgcauauuuagaccaggagcccaagguggacuccucgucuugaauuugccauuaacgugcugcaugaucuuggggcagugacucacccugacggagggugggggacuccucuugaagaacccuuucaacucuaagaauugacccuauccacugaagaagccugugaggcauagggaauagagaaagggaaauguucucagcuuucuuuuuuauuuugguuaugcuuaaauaugaauguaauuaccaagagaaugagaccugcaugugcucuggaggguuugugucuagcuuuuccgguuuuuuuuuuuuuuuuccaaaacucaaggcaauggcuuuuuaccccaccucuaaauccauaagugggucuuaggacauccgugaagucauaauagcaaaacacgcucggugugcguuucucucuuugagacacuguaauuucuaccagaaauguccacagcauuauguaaguaggaaaaaaaaaaaaaaauacaagcaagcuguuaaagaucuuggaucccauucuauaguguguauaccuaaaucaacaucuguaauucacauuuuucucuuuuauucucuaaccaaaaucagaaagaaaaaaaaaacuuguuuaauuuugcaucccaaauguuuuuaaucuuuguauauuuuuuagacucccuuuucuccccaucauugccuuuccgugguuguaaauaguugucacacucugaggaugaguuacgucuugucaucuuacaaauaugugauaugguaauuuucauaacagauuaucaguuuugaaccaagaaaauggugauuuguuuauaagagaaaaaaaaacaaaacaacaaaaaaaaccaccuggcuucauuucugugaaauugcucuuugaaacuuucauuuccacguguaagccaacugggauacuaccgugaugguguugauuucuuuuaaugaugcuuaccaucucuuuuagccacugagccuuuuauuauuugucuauuuguaaaguuuauuugucuuaacucauuuaauaaauauacuguuuaucuguuucugaau

SEQ ID NO: 5719 - RNA, 2668 nt, Mus musculus
uaguucacgaaaguugucugucaggccgggaccagucgaguccuuacccagcaaagacccagggacccagaguggccggguacaucccaucgcgccuggcucacucaggcagggauggaagaaaggcuuucugccaagugagcuuugguuacugucagaaaaggaaagaagaaagaaaggaaaaacaaaaacaaaaacaacuuaccaauuuguuugcaguuggggcugaagucagcggaggugauggcagcuuugugaccuuuaaaagaacguuccagaaucggauccuccuaggauggaaaguuguuagguuugaaagcaggugcagaauuccagcucucgacaucagacgucaacguugccugucccccgggaucgaagaggaggaccccgcagcaucagcgggcagcgagagaggcgugggcauuacaacccggcugagaggcucgggcacugccccagcuuccauccggagggguccccaccaucgggaggaacccccagcccaggcaccagggcgagccgccgagggacccgcccaccgcaccgagcugcagaugcucgccgaagccucccgcgcucuuuaaaccucccuggugauucugacgcaggcgcgccgcgggaacccagccggcgagucccggagccagcuccgccucagccccgagcgccgggaucucuccgggagcagcgcucaccgcucaacccgggcacggcgucccgcuccggggaggugagcgagcugcggagcuccgggucucggggcuaccucccaggccugccagacucggcgugguuccccuccucccggucccgccgcccaaggaugaucggcuccgguagcggcggggaccuuaccaggccggaggccaugcggggagcggacggcgcccggggccuugggggaccagggagggguggggacgaggggggaccgugcggcgcccggaaccgucagacuggagugcgggcgcuucccggucacuacaacaacggcggcccaaucaaagcccgcgcuccaggcguggccagacgagccccgagacgccgcgcgcgcgcgcgcugccgacagccgagagccuggcgggagcgcgccgcgggggguccgccgcgcgcgcacacagcgagccccgcgagcuucggagguagcggacuaccggguuguugucgggaagcggguugggacuuggagagagagagagaugugaucggugguggcgaagcggaggagagucggugaucgaugcaaucaggauucuauuacaccuuaaagagaacggcgcccaacucggcuacuccggagaggggagcuugggugcacaagcuagacaguaacaggacguugagcgggacuaaguuccuuguguucaauuacugguuuugcacguacuauagauacaaaugcuggcagcacaugauggguaauauuuuauucacauguucacccuguuuuucuuuauucaauaguauucuauuaucuauuugauuuauucuguucucaaccgcuuguuugcauaugccuuauuaaacucacacacacaccugaaguggucggaagacuuggaaacuuuaaaguuucuagaccacgugguuacaauaacgguccccacuuuagacuuuuuuuuuuccccacacauacuaucauuugugcuucagcaacaggguuucaaagcuagagaauguugucgguggcaguuuguacauggaaggccacauuuugaugcuucuucauaccccucgacaacaaacaacagcauuaaacccugccccggagcauaaaagacucagcugaaaauuacauacggaacacaacuucuuggcaguggaaugucgugauaaacugguaagguacauguuguguguaaauaaaaaguguaguaauuacagguucccucgcuguauuugcguuuagucuuaaccacuauauagcaauuauguaagugcaauaccguauuaguuugacacauggguggauguuaaauaucuguuauauguuugacaccaagggcuaaacuuuguuauaaacaaaacaaaccccugaaugccaacauaguucccuccccucaagaacuuggcacugggauguagcucaguuggagagugccuaaugaacuaaacccuugcuuguauucccagcgcccucaucaacacaaccuggcaucaguaacuauagcccuggggagguggaggcaggaggaucagaggcauaagguuguccuuggcuauacugugaguuugaugccagucuaagcuacaugaacucuguuaagcaaauaaaaaacagacgacaacccugcuguauucuaccuuaaggagucucauguuuuaguauaauugaugcuaguugccaaagaugcugauucagcauauauggggcagaaccuagagcccuacagguauaacaaacugcuuagguuuugcuauaggagucuuggcuguguacguggaaaauguugcucuaauagaggaagggauguguuaagggucuugcugugauggagggcagugguguaggucggggauagagaauaugguuaacacagaaaaacauggauuugaucuccagcacucgaacacacagagucagucuccacuucucauauguguaugaggcagagacagaaugaaaugagaaucgguaccagcaaccugugauuuugccauucua

SEQ ID NO: 5720 - RNA, 1956 nt, Mus musculus
ccccuggaacaaaacaaaaauuagaauuuauuuuuaauaaauuuuuauccucguuuucuuaugggcagucguccccccccuccccccgucucccauuuuauccugacucagaguucacaaacuucaucagagcauccgugcucauggacuugggccuuuccagagggaagccuagggcucugcuccagaugagcugggacagaacgcccagugcccgcgacacuccgaacaggacuguguaguaauucaucucccucaugccguaguacuggagcagcaccccacugugagcgucuacguugggccaaggguucuuagccuucccuugcucuaagaggauaucggguacaaucuuguacagcugaccaaccagcuugaacaugggauccuuaggcagauguuucagagcaaacucucgcugacaggaauagcgagggucagucuuccucaguacugcauggccauagccugggacaacccguccugaguugaguguguuccagauguaguuuuuuaacuucucaucugaugcaucuucgccaacuuccuucuguagcugugucagccagacaagcaccuccugauuugcuagcccauggagaggccccgccagcccauucaaggcugcugcaaaggacagguaaggaucagaaagggcacugcccaccaaauggcuggugugggcacuuacauuaccacccucauggucacuguggauggugagguacaaacgcaugagcucggugaacugaggguccguguagccuaacauguugguaaaauugugggaccaguccagcuuagagucaauggccucaauauuccuaucuucccgguacagauuccgguagaucuuugcugcaacacacggaagcuuggcaagcagguccauacagucuucauaggugagcucccaguacuuaguucgguucauucccugcgcauaugcccgggcaaaguugcuuucauuguugaggacugugauggcugcacugagcugagacauggggugcaauuuggucggaaaauuguccagcauggugacgacaugagaagguagagcugcccuuuuuacccauucuugugagagccaagauaccuguuccucugugggcaucuguccaguuaccagcagccaaaauaagcccucaggcagggguucuuucccacccuuagccuuaggcagcaguuucuggcacucagggauacuguagccucggaaacggaugcccucaucaggaucaagaaccgaugucucauacacaagucccuucaugccucucaugccaccguacaucauguccacagugaucuggcccacaacugucuucccguguuucuuucugaaggucuuaauucuggcuugcuccuuggguaucagauuccucagcacgucuuucaaguucguggaagaagcacuggcaugccgggcggcaaggacaaggcaggguggguuuuugguucccaagaaccaggcugccgcaguaaguagagccauggcaggcgaacuccgagaccuggcaggaugggaucaaagggagagagcugcagcgacaacaguucggaauggccgccacugugauggagaccacgccaaccgccagugauguugaaaggcugagcucaaggacuugaauuugcgcuuaucagagaucaaagugugauucucucccuccuuuaagcagacugcuaagugcuacagcaauuuuuucaaaggaacgaagccacuugggaugcugauguccugaugucugagcccuccgaggcucagaucggucucuguucuuccacggguagugauuacguaauaaacguuccuccaagaggcucagucgguugagaaauggggucagcuuagccuuggugaguaauuauacauuuucaaaguucaacuuacuuaggagggguaaccgcaaccuauguggcgguuuagaacuucucccacaugguagacug

SEQ ID NO: 5721 - RNA, 1849 nt, Mus musculus
agagcugaggcaagcuacaaagagaacugucugcccugagacagaaggcuugacagacaggugagugaaccacaccaauuagucucaaggagcccaaugucuccuaagagaguuccaugucuucagagcuaugaaauaguucuuucccaagacauaaacuuaaaacucaacucuaaacacauuugauuuuaaauaauccaguuuuugaaauugggugguccuuuucauucuaauucuguuuguuaaaauuuguuaacuucugguaaaauauagagauagcgucauuuaucucugaaguccagaacuuacaaggcaaugcugggcacuuuagagcugacuguguguaccaggcuaucauggaaguuggaaagauccuccugccucugccucugccucugccucugccucuugagggcugggaucaaaagcauuuguucuuauuuuaguguauuuuguuugugacaauaaccacuauguagaaauggacaaacugguuauauuuuauauucuguucaaguucuuucugauguguuugguauugucuuucuacagcagacagauagagcucaaaaaacuugcauggguaaauucucuccucugacucuggcacacagagacugggcucaggucacugguuuugcucauaacaauaauuucauuuuuuuuuaaugaaauugugguguuaaggaacuguguuugcauuggaaucauucugaguagaccaggaugguauuugucuagcucucucauuugcaauacgguuagaaguuacagcuauauauaccaguuaaauucaauccuuuguuggucuauagugaucaaguucaaacuucuuguuuuuccuaaucagguucucaggaucucuuccuuauguccuaaugaugcaauaugcuaaaaggaaagauguaauuuuacauaaaauaaauuuuguuuucaaaucagguaccuuggauacaagggcaaauuccaugacuaccauggcugacaaaauggacauguuuggaagacaucauuaagcugaacaagaugcagcaaggacuucgugacaggccugauucccgggugaagcgaggcacugggccuaagagauaucggccagcuuucacccaugguggaaggaacaggcuggcaccauacugcagaccaaaacaacuuccagacaaguggcagcaugaccuauucauuggaggcuucaggggucaaaaccaugaggauacuggugggaagcuguuccugucaaaucugcacauuggagugucagaugcugauauucagcuacucuuugcugaauuuggaacguugaaaaaaucugcugugcacuaugaucgcuguggacgaaguuuagggacagcacaugugcacuuugaaaggaaagcagaugcccugaaggcuaugagagaguacaauggcgccccuuuggauggccgcccuaugaacauccaccuugucaccucacagauugauagacaaggaagaccugcacaaaacagugauaggggcggcaugacaagaaacccuggcucuggaguauuaggugguggaggcaccaagagauggacacuuggaggcagccagggaagcgggagaggcaccagcaggaacucaaaacugcagcagcagcagcagcagcagcagcagcagcagcaggagccagaggagcagaagcaccagaagcagcaacagcagaagcagcagcaacagcagcagaagcagggacagaaucaucagcaccagcagcagcagaaggagcagcaacagcaacagcagcagaaggaacugcagcagcuaucuguagaggagcuggacgcccagcuggaugcuuaucaggauaugauggacaccagcuaaa

SEQ ID NO: 5722 - RNA, 26414 nt, Mus musculus
cggucuuggcaggcuggggggcggggaguggugucgccuagcagccggcgccgcuucggcucggucgggaagaguuggcgggagcagccugagugcgcgaggaccgcucugggaagcgugaggccggggcgguggccgaacccggagguggucgcuguagaugagugacugcugcugguggcaggucuugguuucgguggguggauccucgugagccggagccgcuuagugucguucacaggaucguaaucccgagggacagggugcagcccuaccuauccagaccucugucgcucuugucugcagugucgucucggccucccugauugagcuugauuccgcaaacacuucauuuagcucagucuuuuuaucuacuuuaaaaauccucugguccccuuuccucagaagguuuucaaaaacuuccaaacaucuugggaguugguaccaucauugaugguaggggacuuggaaaaggggccucgggguuuuagcuccgaauucgucuuagcaagaaaauaauaauuuagcguguacauuaucguauagccugugucaggggaacuaauuuucgucgaggcuguuugccucugcaucuguuuugcaguucaggagccauagcucuuagccagcaccuagagaguuaaguaagaccgcucaugaucauguaaacacugcaaggccauuuuccuugaaaaugcuaaaauccaccugcuucuuuguagaggcugagagacagugaaagaauucaagaugccaccuaauauaaaguggaaagaauuaaucaaaguugauccagaugaccugccacggcaagaagaguuagcagauaaauuauugauaucuuuauccaagguacuuaauaaaugauuuguacacagagccugauguacaaugucaugaauugaaauugcuucuugaaaucauugaaugcuauaacuggaagagugcuuguauuuaaugugcaggguaugaaauaguccauuuuuuguguguuuguuuccuuagguggaaguaaaugaacuaaaaaaugaagaccaagaaaacaugauacaucuauucagaauuacccagucucuaaugaagguuuguaggaaagaguguguaggaaaagaaauauuuuuuaggagaaacauaaagagucauaaagaaucauauggucaaauaaaauacaaaaucucuccccuauaagcuauacaugaaaugauaagaggauucuagauucuucauaaauaaauacugagaaagaauauguauucuuuacauuaagguaaaagcauauagaaaaauauuuggggccaguaauuugggauauacuguucaagaguuugagaguauauuuugguuaucagcauuuuagaagggaauaaagguuuuuaaaucauacuugguaaagaaauguacuuaugaaggcaacauuaaauguguuguauagacugaagggaugagagcugauuaguuccaauuauaagaaggaauuacuaaauuuauuaauaauaacaauugggauaguaaaaaagauauugaaaacauuuuaaguaauggcuauaaaguuuaacggaaaaaucagauauaauucaaagucuugccauucuggaauuucuagccuuauguauuuauucaacaacuauuuacugacugucucuguguguuagucaucguacacacuacagacugagauagcaaauuccacacaguuuccauucccacuguuuacauuacaguguaaauaauacagauucuuccccucucguuuuaauguucagaugaaagcccaggaaguagagcucgcuuuggaagaaguugaaaaggcuggagaagaacaagcaaaauuugguaaaugucuugggaaaaaacuacugugguuccauuacuuauuagacaguauaaaaucuauccuauucuauaacauauguauucaauuuauacugaaagaugcuacauccuugugcaguuccagguacuggccugagugcugugguagggggugaagaaaagaaaacacacagacacuuagaacaguuguuuucgguuggaccaggcucucuaauggagcaacugccccaccccagaagcucacugucuguauuauauccacuugaccagagcaguggaguuguugcauagcugaacauaaagucgagugagugcauacagauaaacaugaaggcaggguuucugcuguugaauagggaggcagauuuaucaaaucucaguaggaguagucucuauaagggagccauaaacauuagggggacauuuucugcacacccugucaacauccacagucagacgaggagggaaggcuuugccguuugccauaggccugagacauuuggaguuccugacguggcuuugcccaugucaguaguacacacugacucagggcucaugcacugaagccuuccucugcucucuacaugaggcauuucuagaaugcauauuuuaugcauuuaguauauaauaauuacuuuccuguaucuguuaaggauggaaucuuuuacagagaacaguacuauuuuauuaaaguuuacuuaaaaucugauuauaggaaacuuaaccaauuaaaacauuuguguuuuuuuuuaaauagaaaaucaauuaaagacaaaaguaaugaaacuggaaaaugaacuggagguauauauauauccuuuuauauuuccuuguuuuugaauuuucuuguaguuguuauuaauugcauuauuuuaaauuguuuucaaauccucccagauuggaaaauacaagauuuugugcucaugcguuuauucauuacacagaaugugcuuuugugacuugaguucuaagaauuaugcauccagugaaguaaaaacggaucccuucugaauggggcugucagucuggagaagcauauagaaagcuuaguagcagcugagggggaagggugugggaaguaaccacaccgagauucugagaagcugagaggggaugcaguaggaaaggaccagacuuugaaaggaggaaccagggaaaggagagguccacaagguuuuaugcuugugaguuuaguucuuagaagcagagacagggaugagaucgcuuguaagguuuagccaugggagacugugagaauaagauaaccuuugagacaucguagacaaagggcugaagaccaagggcuaugggcucagaugggaguucuaguccucauuauuuugacuugauuaacucugugcacauggauaaguuauuucacaucuucagcuagauuucaagcucccgggaaacugucaggcacuuuuaauaagcacuuuuguaguaaacgaugucugaaguugagcugauucugugcuuguauuuaggcagacagcugguaaagaauagaagacucuggcaguucaaggucuuggucagaauguguuuaaaguauuggugaugaaaucuaugcuaaauggggaugaugucaagacuggcguugggacaggggaaguguggagucagggagcaggaacagugaagcauguguugggcccauuguguuuaucaaagggaaaguccuagagaagagcugagggaaugcuucuuugggcagagucuguuaggacuggcggaacgcaguaaaucaagaaacacgucguuucuuacuuguccuuuaaagcuacuuuaaaauaaaaggagcgagucaugugguuguagcaguggcucaggcugauuuguguagaagacugagcugccacaugccugcauccuaaggacuuacaagccugcacaggaaaguggugguuugcuggugcguauuggaguguuuaggauagcgacauaucuuguaaagucaaaaugggugaagauguggaggagcccucagagacuguugucaccuuuucuugaucuugaacugacaaacaacucgcaaaggaaugagcgcucuaaaagaaccuaacuguaguuuuguaaggaaauaaggaaagguuuaguuaagaacaaaugcucaggauguaaaaucaguguuuuggaagaugcuuuaagagagcagaguggugagccgggcgugguggugcacgcuuuuaauccuagcacuugggaggcagaggcagguggauuucugaguucgaggccagccuggucuacaaagugaguuccaggacagccagggcuacacagagaaacccugucucaaaaaaaccaaaaaaagagagagaaagagagagagagaaagagaaagagagagagagagagagagagagagcgcagagugggaagcuucaugaagcagagaagacugaaaagcaucugaguaagaggacguagcagaaauguguggggaguguucccugugacgcaagcuuaggggccuaguggcccagugguuugcgccauggucuaguugucaggaaugugaaguaaaauaaauugaaaugucugcuaagcuuuaaagugguucugucuuggcuugcuuguagaguaguaccaagcagucauggugcugugcaguuacauuuguuaaagcugaacauucaggucuucguugcgcuggacacaagucaagugugcacaugacucagaacgagcaaggacagacacgacugagaguguuucuucuagacuagagugaugucugauccaaccagccugccgugucaggaaagggcagacagagaaagaggaccaagcugcuuucaguuuuccuucacagccuuuacaguuucuaagccuucgcauuuuagucugucccuaggcuuagugacuguaacagcgccugccugcagucuguucuucaugguucuuuugguagucaaggaaagcuuguggguugccgacuuacaaauuaaagccuaauaaguucaggggguuuucuaguuauauuuuuauuauauaaagcgauuuuaaauguacauauuuugcucuuauucuucccuuuccccaaguccuuccauauccucuccuccucccuacccacccaacucuuaaguucuuuuaaaauggcauuugcacgacaagccuuaagcugccugguguuucugaagcagacugaaaauuuacaguggaguacuuguucguugguuccuuuaaaccuucaagugaaaaagaauuacuuauaguuggaagacugaauucuuugcuucugacuuuaagauggcucagcagucugcagggggacgugacacucgguuuuuacgugacgaaauucgccaacuugagaagcagcuggaacaaaaagauagagaauuagaggauauggaaaaagaauuggauaaagaaaagaagguuaaugaacaaguaagacccgcuuuucucuaugaaucuuaauauuuaggauaauccuacaccauuacucuuacugcuguaguugccuuugggagcaguucuugguuauaugucuaguugaggagcagcaugcacccagguaaguuuuguaccagucuucauuuuguagucacauuugaaauacauaauggaauugacuaccuacuucuaaugauacacuggaaaaugugcucccucucgcucuccuguccuuccuucccagcuuugauacccaugagccucugguaaaggcugcagacuaaaggaucuuucuaaagaaacaagagagcugagcacaaggcuaggucaaauccgagcuuuuaaagcuuacccugcuuuguggagagcagacugaggagggucaaauuaguaaggaaacacuuguauugguuccgacagugcugaugguggacuaguuaagggaauaacugcugggaugacuagacaugccugagggaaagggugacugggcuggugaaugacaggauggagagcagaggagaggcugccugucuguggcaugcauguggcuaggugcaauggugcccuuuggaacaccgaguugugugcagguuuaacauuauugguucaguuuugcccaguugaucuugagguucuuguaauauuuaaaucucauauacauaguagacaccacacugaucauggucuuuaguauagauauuaaugaagccagaaccuugauuguaagauuuaccacugaaaaaguugaauaaaauaauggaauagguugcacgaaagaaagcuaucaagagugaagcuaaaggaaaacaguggaguagcccugagugcuugaguauugaauuuucaccuuuccaauuuagaauacaauuggacagauaguaccagauaauaauugucacauuaaucaucaucaaacuuauaaaauuuucauuugcauugcaugugaaauguuuuuuucuuggaaaauaauaaauauucuuuauauuuuauaaagacuugucagaaaaaaacaauaaauauucauauucucaugguuauucaucaauugagauuucugucauaucguuguacacauaauucuuuaucucucauuuuucuuuuguugaaccauuuaagacuuaauuuuagacauaauaauacuuuauaauuaaauaggucuaaaaaugugaauauucccuuauacaaccaaaauagacuuaugauguucaggaaaugaaauguugauucgguaguauuguagucuauaaucagauuuucucuacugaccuaauaguauauuuuauuuccuaccugucuaaagaaccauucuaugccuccuuauagauggguuuaagcuuuuugcauacuauugugauugaauuuuuugcuugaguaaggcagaaaaacagaaagguaaaagaccauuaaaaugauguuauauagagaauagauaauaaagaaaagcuaucauauugguuauaauauuuuuucuguccaaaagaaaacagaaacugcugcaaaugaacuguuguaggugaagaaaacagcauuuaguacuguuugcuggucuguuuguugaguaucuuguuaaggacuuuaugcacaucauauuucucaugucaacaagagacaugaaaccaauugaagggaugguaaauggauuuuuuguacuuauguaagaauugauacucaaaggauauauaaacuuaggccaaccugauuucugauuucagcuuguuucagucauuucuguacccgcccccccuuuuuguagguauuucaguucauaaagagggaagagugauuucuccuucagcaguuuuuaggaaauugggcaauauaacuuugagauuguugucuucuuuagccuuuaguuugcuuugguauauauagauuauuuuuccuuuaaagcugagucuuuccuucuguacuuuauuaaguccuuaguuuaaacucguguuuuauuuguguucuagugugauaugaagucuuuacuaguccuuaguaguuacauggucucucuuggaaaggaauaagaauuuaaguaaaaaaagcuaaauguggaacuuagauugcauuauuuuugaguuuuaucuuuuuuuuauucuuuuacuguuuuaguuggcucuucgaaaugaggaggcagaaaaugaaaacagcaaauuaagaagagagguuaguaaagacuuucaguuuuggggugguucgacaaugacuuccuuguuuaaaauguuuacuuaaaaugcuauuuuaaccagaaucucaucuucuguguaacugaugauagucauacuggcucauuuuaugaggcuuugucucagggaauuacagagucaaccaaaaugcgaggccauuagguaguucaucccugccuuggaaccguguggggcgauguuguuuccuguuccaugaccgucuugcuaacagcgaacugggcauuugaggagguuucuuuucuuaugacguuuugucuggcauugucauaguuuuguuucucaugaagucugauaauacaauuuguguauaugugcuaaaucauaacuuucugucuuguaacagaaauguuuuaauucacauuuaauaugaucauaucauuuccccuauuccuguucuucuucugaccgccaccuacuguguccucuucuuuuaauuguuuuaucuaaaauuucuuuuuagccuaguuagaauuuuuuuccuuuuggcucauacuuaauauuuuuucuuuucuuucacuauuuuaaauaaugcauucaguuguucuaaaauguuccuuauucucacuuucuuuaauacauacauguugguuuuaauuauguguugccuuucucaucucuaauuauucuuuuccuguccuuuugaagaacaaacgucuaaagaaaaaggugaggcccuaaggguaguuaaagcuugggagcuuagagagcggcucuggggucagcagcagggguagaguuuugucauccucaguaguguuguccuguuggcucguuuuuggcucuggauagagguuuaacgcugacugcuguguuugcucuaaacucagaaugagcagcuucggcaggacauuauugacuaccagaaacaaauagauucacagaaagaaucacuucugucaaggagaggagaagacagugacuaccgaucacaguugucuaaaaagaacuaugaacuuguucaauaucuggacgaaauacagguaauaugaguaagucaguucagaggcuugguuuuacaaauguauuaccaggcugggguaaaucuaacauucacugcuuguuguuacuuuugaguauguauuugcuacuguguccauuaacugauuuaucuuguguguguauaaugcugccuguccauguguguaugcacauuggugccugcaugugugcugaggucagggguagccucugguauuuguuaccagcuucugccuuaugugagguaggauccccuugugguucacuacucugcagucugggccaucgagcucccagauuccauggauucaccucugugcucucucaguaggagcacugagaauaaacacgcaaacugcagcgucuggcuuuaugugcauucacauguuuaugcugcaaguauuuuauucacaaacacaucucucugccuccacauguacuauuaaaacacaaaauaaguugugccuuugaauuuucaauuauuuauuuacacugcauuucucuguccugggcaccaagaucaacugagaugccaaagacaauuuucuugacauuuaauuucauuuaacuggccaaugucguguuaauccuaaugggcuaucaagaauccauuuuuccucuggaggacccuauggcucuauuuaauuguaguuuaguauaaauuucaguuucuuguaagacuuguuuaaaguaauaguguauuuaacauuuuuagaccuuaacagaagcuaaugagaagauugaaguucagaaccaagaaaugaggaaaaaccuggaagagucugugcaggagauggagaagaugacugaugaguacaacaggaugaaagcgcuugugcaucagucggaugcugucauggaccagaucaagaaggagaaugagcacuaucgccugcaaguaagcgagcucaccguugaaaccgagccugguucucaccagccucauucauugcuguguguuugaaacuagacagacuuuaauguucuaggauguugcuuuuguugcuugucuuaauacaggaauguguugccauccugacauacuuguccaaagggcucuucacgugcaccuugguccuggccauuuggggaaaaugaaugaugcucaagggaguguagacaggagugcugagaauaguuucagggauaugaagacuuuuaaaaacccaauggcuauaaugacaggguuucucuguauagccuuggcuguucuggaacucacuuuguagaccaggcuggccucgaacucagaaauccaccugacucugccucccaugugcugggauuaaaggcaugcgccaccaccgccugacuuaauuuuauuucuuaaaacacugaaaauauaucagagaucaauauauuauuuauuauuuacauuggguagcuuguuugaaaaguacaauaauguuuaaaaaugugguucucuaguaauaauuauauaauaguuccuugaguagcacuuaucuaaaaugcacgggauuauaaauguccagagugugguuuauuuuuauuuuucauuuuuuuauuuuauuuagacuuuugggggguuuucagguuuuggaaguagugcaggauagauauauacaugagcacuuguggggauaccguuaauagcuaaacacuagacucauguaugcuucauguggcccugauagguaaaccaucaauacaguauuuuuaugccuguauuuugacuaaaacacagcaaauuaaaugugauacauaauuuuccacuuguggcaacauaaaaaguguccaauuugagagcauuucagauuuuaaaguuuuauuuagaauuauacagcuauuacauuucaccuuuaagaauaagacuacgcuaguaaugaauagcacauguaauauagugcagcuguaaacaugucuuugugcaugcuucaguaugcacaugcaaucacgggaacucgcccugcuuugaacuauuuuacaagcugauuguuccucucagguucgagagcucacggaucuucugaaggcgaaggaugaagaggacgauccagucaugauggcuguuaacgcaaaaguggaagaguggaaggugcugugccacaggauccgacccuucucauuuaguauuuugauuugacuuugauuuugauccuuaaggacuuauaucagacaauaacauguugauuuuuaagaaguucauuccauaccuggguauaaaagcucuaaagcuucuguaugugcuccucgagcuuguucauuuauuagacaagcacuuuccaggcaagagugaucaggaauggcaucaggggaaagauuuaucagucucauguggaaagccuuuucagaauacuccauuucuuugucuaacuuccauuuuccagccuaaguccagagcuguaccccaucagagacuaggauuaggauggugagaugacugaacuaguaauucuaguaaaagcuggcccuucuagcaucuccaccucuggccacgcccacugaacccuuaucugcaguuaggaacuguuuguuaucugggaaggucagauaguuuaugucgcagcuguaguugcaaugggacgaagcugcauucauccugcaggggucagauaaucuguaaagcucuagaaaguaacaguuuuagcuguccuguucuagccaugcaacugcuuggaaaggguagugcacagacaauccaugaguggauaagcauggcugccugacagggccuuaagaaacaagcuaggccaggcuugcuuucaaccuuagaguguaguuucuaaccuuuggaaaaaacccaguuccaaucacauuuuaauauuuaauuuuuguacauauaaugaaugaguacccuguuguaugacacucaggagguuuccaguuuuucuuuugaaggcaguauuuuaaugagaaguuauauguguguguguguguguguguguguauacauacacacacacauagacacaaacacauuauaaaugcacacugaaaaaaauuaaaaagaauuuuauuuuuguauucuuuuaaaugugcuaaagguauuuauacuuuucuauaaauuaugagugguuuguuaauuuacguuuuuauaacagaucuuauuauuauuuuuuuuuuuuaguuaauuuugucuucuaaagaugaugaaaucauugaauaucagcaaaugcuacagagucugagagggaaacuuaaaaaugcccaacuugaugcagacaaaaguaacaucauggcucugaaacagguaaaaccuucucaaggaugguaacaucagggaaugaugcugucuuagcugcucauccgugggccuggucggcuuccauuacuguguguguaacaagcuuugaagucucucaugcauagcucaugggggaggcaaagguagaaguaaguuuagagagaguguaacacuuuagaauuauuuugcuuuuucauauuauuauuuauugucaguuuggaauuacuuaguaucuauucaaaagcuguagcuuuuaaaauaccuugcuucuuauuaauguuuguuauuguguaucuuaugccuaaacuacuaagugaaccaagugugcuuauauugugagugugcuacuuaaaaguuguuuuuaggaaaacaaacucauucagaaaaccccucucacuccucuuguauguguucuuucagugaagugguaagauagacgcuguuugaaaaugagggcagugaugaggaccuuguuucucagugggguguagaaggcacagaagccugacuggccggaaagaaagaacagagcaaacagagagaguaccaaagagaagguucaauggguaacuagcaagaauacuguaucaggaguuauaaaagccauggacacuaaggaguucuagaauaaaaauuuccaucuuuaaauauucacaugagaacaguuguguaggcuguuugaggaauacauacgaaacuuacuuuccugggucugguagguggccacguagguaaagacacuuaauguccuuccugacaaccuuaguucagucucuggaacccacaaggugaaagaaguugucaccugaucccacacaucugccuauacauggacacacaaauaaauaaauguaauaaaaaaaauguuuaaaagaaacaguuuaucuaccaggaaguguguucucuuauuuauuauaaaaauguauguucauauuaaugaauauuugcuauuucaaaauauuuuguaggguauccaggagcgagacagucaaauuaagaugcuuacugagcaaguagaacaguauacgaaagaaauggaaaaaaauacguuuauuauugaagauuugaaaaaugaacuccaaaaagacaaagguaucuuaguauuuuauaagaaaacagcuuacauauaucauugugcuucaaacgacuuuuuacauuucaaaugauauucuccuuuccaguuaccccuucacaauccccccucucauccuccccucccccuccccuuugccucuaugaggguccuccuccacccacucacccuuuccugccucugaauccgagggaaaggggaacuggagagaagaaacagaaaaucuuuucugcaauaggguaguaaaaaaacaaacaaacaaacaaaaaaaaacuagguaguagccugaggagaaagaaagcuuaaaaauguuguaaguuuuaaagaagaaacaacacauuuuuguagauuaauggaaagacuccauuggugaagcagaggagaaagagacgucugaagguuuaggcuggcaauacaucuagcugaaaaucuauuuuacuguuaauagugguugaaagaaauguugauuauuaucaccauuaaauauuuucugucacagagaugcauccucuguaaagugggcuuuuacaacauuuuuuuuuuaauaacccauauccuuauagcuaaaguaacuguaaucaacucuacuuuuuaguugauuuuccuuuuuuugguucaaaugacuuuaguaaaagcugcagugcccacacuccccaguugccauuaguugguuuucuuaauaaaaccaaagagugcauuggucuuacagugaguagacaccuaagaagcuuuugugccuuacugaugcugcagcuccuuuuugggaacagcagauucauaagaaggagaacucaauucaguucguucaugauuucuuuuuucacacuguagguacuucaaacuuuuaucagcagacucauuauaugaaaauucacucaaaaguacaaauuuuagaagagaaaacaaaagaggccgagagaauagcugagcuggcugaggcugaugccagggagaaggacaaagaauugguugaggcucugaagagauuaaaagauuaugaaucuguaaguauuuuuaucuugucagucagagagcuuaguuauucugacagcaagcuggcucuguggcucguacugugucccauggagaaaacauucuggauccccgcaccgucaacucgucagaccucacagcauucgcuuucugucaagagaauugcuuccaaaccuguuuuccuucuuaaaaagaguuuauuuuauuauuauuuuuuuuaaguuugagauuauuacaucauuuuucucuucucuuucuucccuccaaaccauccacacacacauaacccuccucacucuuauugcuuccuuucuccuuaauuauuguuucuuauauauauguaauauauauguacauguaugauauauauauguuagauauauucauaaauauaaugaacucaggauguauauguuagaauaccuuuuauuuguuggaggcaguuguauucucagagacuuacugccccuaucuucuaaccuaugccuaguccuggaaguuucuagccccuguacaaucuucucgaggccuagaauguuuucugccuuugagacuuuacuguugaauaagcucacuccucccuaacucuuucugaucucucaacugagcuguucuggcucaaauuccucuccaagcuaacugauucaaucuggcuucucucuuguccucugaauuuuugcucugcuuggccucaaacuaucuuuggcaauaucugaugugguuaaaucucauuuucuggcuuguucugucuucaucuaugucuggcuuaucucucuguaaccugucucuguacuguuaucccaguaaaaacugccucaucucugucuuugugcuauuguuucuuaagaugcaucucuuuccucucucuucuccugagaguugggcauauccuauucuguaaacuccaucucugauuuaucacuuugucugucacacagguagacaucacuuccaaacaugcuugcuuccuucuacaaauaaccuuuaccuucuuuguuugcaauuaaaguuauuguacuaaguguguuucuguuuuccagccagagggauuaaagguauaugcuaauggcugagccacaccacaacuagaaagaguuuuuuucaguaaauaacacaaucucgguguucacagugugaucauauauccuguuacauguagaauuacuuguauguauuuauuggauauuggauaaccaaacaugcuuuuucacuggagaagacuauuuuuuucugcucacuuugugaauugcucuguguguaguucucuguguuagggcugagguacugugggcucuuacugcaaagagaaagagcaugaccuuaucuguagguaaaaggacaaauguuuacaacguuggugggauuaugcugcuuucguagaguaguagcugugacccuacaguaaccgugacugaacgaguacugaguaguuucccuuaggauuacuguggcaugcuggucagugagguucauaagcugcagagguuggcaggguuacuugcguuccaccuuuucaagcuugcaugguaccuucugggaccuugaaagcucguccucagggaagaauaggcuuaaaaaaugaguuccaacuugaagucucuaggucuuguuucugaaaugcauuguguauucaguaauugggacuuacucucuaccucugagggccaaucaggggcaauagcaauaagcuguauguuuucagagucuuuuagacaaccuuggcuagcaacucaaaaaaagacaucucaugucugguauuggguuuucguuacauggucuuuggcucuuggugggauuguugucaguauagaugagaaaagauuauuuaaaccauguauguauuuauacauaaaauuagauuugguaucagguuguuuguacuuucauaugaauagucaaucaugugauucuuuauggcuuuucagacagcauuauugcuuuuuacccucccuccuccuccgucugucuuuacuuccccauuaagccuuuugaugaaguguuuuguucagacaagcagcucaggugagguaucaugauuagucccuuguaucucuguccuuugugccugaauggagguaugacugugacuaccuugaugaacuugugguggggauggcuuuggugccuacaauaucuguaucaacugacuccacuuggacuuuucauaucuuuuuuuauuauuauuagguauuuucuucauuuacauuuccaaugcuaucccaaaagucccccagaccaucccccccacccacccaaccacucacacuucuuggccuugguguucccccauacugaggcauauaaaguuuucaagaccaaggggccucucuucccaaugagggccgacuacgccaucuucugauagauacguaugcagcuagagacacgaguucccgggguacugguuaguucauauuguuguuccaccuaugggguugcagaccccuuuagcuccuuggaugcuuucucuagcuucuccauugggggcccugugauccauccaauagcugacugugaacauccacuucuguguuugccaggaccuggaauagccucacaagagauagcuauaucaggguccuuucagcaaaaucuugcugguguaugcaauggugucagcauuuggaggcugauuaugggauggaucccuggguaugacagucucuagaugguccauccuuucaucucagcucgaaguuugucucuguaacuccuuccauggguguauuguucccaauucuaagaaggggcaaaguguccacacuccagucuucguucuucuugaguuuaauguguuuugcaaauuguaucuuguaucuuggguauucuaaguuucagggcuaauauccacuuaucagugaguacauaucaugugaguucuuuugugaaucuguuaacucacucaggaugaugcccuccagguccauccauuugccuaggaauuuuauaaauucauucuuuuuaauagcugaguaguacuccauuguguaaauguaccacauuuucuguauccauuccucuguugaggggcaucuggguucuuuccagcuucuggcuauucuaaauaaggcugcuaugaacauaguggaacauguguccuucauaccgguuggaacaucuucuggauauaugcccaggagagguauugcgggauccuccaguaguacuauguccaauuuucugaggaaccgccagacugauuuccagagugguuguacaagcuugcaaucccaccaacaauggaggaguguuccucuuucuccacauccucaccagcaucugcugucaucugaauuuuugaucuuagccauucugacugguguaagguggaaucucagaguuguuuugauuugcauuucccugaugauuaaggaugcugaacauuuuuuucaagugcuucucugccauucgguauuccucaggugagaauucuuuguuuagcucugagcccaauuuuuuaaugggguuauuugauuuucuggaguccaccuucuugaguucuuuauauauauuggguauuaguccccugauuuaggauugguaaagauccuuucccaaacuguugguggccuuuuugucuuauugaaugugucuuuugccuuacagaaguuuuguaauuuuaugaggucccauuugucaauucucgaucuuacagcacaagccauugcuguucuauucaggaauuuuuccccugugcccauaucuucaaggcuuuuccccacuuucuccucuauaaguuucagugucucugguuuuauguggaguuccuugauccacuuagauuugaccuuaguacaaggagauaggaauggaucaauucgcauucuucuacaugauaacugccaauugugccagcaccauuuguugaaaaugcugucuguuuucccacuggaugguuuuagcucccuugucaaagaucaagugaccauagguguguggguuccuuucugggucuucaauuguauuccauuggucuacuugucuguugcuauaccaauaccaugcaguuuuuaugacaauugcucuguaguauagcuuuaggucaggcauggugauuccaccagagguucuuuuaucauugagaguguuuuugcuauccuaggcuuuuuguuauuccagaugaaugugcaaauugcccucucuaauucguugaagaauugaguuggaauuuugauggggauugcauugaaucuguagauugcuuuuggcaagauagccauuuuuacuauauugaaccugccaauccaugagcaugggagaucuuuccaucuucugagauccucuuuaguuucuuucuucagagacuugaaguucuuaucauacagaucuuucacuuccuuaguuagagucacaccaagguauuuuauauuauuugugacuauugagaaggguguuguuucccuaauuucuuucucagccuguuuauccuuuguguagagaaaggccuuuggcuuguuugaguuaauuuuauauccagguauuucacugaagcuguuuauccaguucaggaguuuucugguggaauuuuuagugucacuuauauauacuaucauaucaucugcaaaaagugauauuuugacuucuuccuuuucaauuuauauccccuugaucuccuuuuguugucuaauugcucuggcuaggacuucaaguacaauguugaauagguagggacaaagugggcagccuugucuagucccugauuuuagugggauugcuccagcuucucaccauuuacuuugauguuggcuacugguuugcuguagauugcuuuuaucauguuuagguaugggccuugaauuccugaucuuuccaagacuuuuaucaugaauggguguuggauuuugucaaauacuuucuccacaucuaacgagauacucaugugguuuuugucuuugaguuuguuuauauaauggauuacauugauggauuuccguauauuaaaccaucccugcaucccuggaaugaaaccuacuuuggucaggauggaugauuguuuugauguguucuuggauuugguuagcgagaauuuuauugaguauuuuugcaucgauauucauaagggaaauuggucugaaguucucuaucuuuguugggucuuucugugauuuagguaucagaguaauuguggcuucauagaaugaauuggguagaguaccuucuguuucuauuuuauggaauaguuugugaagaguuugugaagaacuguaauuagaucuuccuugaaagucagauagaacucugcacuaaaaccaucuguccugggcuuuuuuugguugggagacuauuaauggcugcuuuuuuuuuuaauauuuuuuauuacauauuuuccucaauuacauuuccucaauuacauuuccaaugcuaucccaaaagucccccaugcccucccccccacuucccuacccacccauucccauuuuuuuggcccuguacuggggcauauaccguuuguguguccaaugggccucucuuuccagugauggccgacuaggccaucuuuugauacauaugcagcuagacucaagagcuccgggguacugguuaguucauaauguuguugcaccuacaggguugcagaucucuuuagcuccuuggauacuuucucuagcuccuccaugggggcccugugacccauccaauagcugacugugagcauccacuucuguguuugcuaggccccggccuagucucacaagagacagcuauaucugguuccuuacagcaaaaucuugcuaguguaugcgauggugucagcguuuggaaucuuauuaugggguggaucccuggauauggcagucucuagaugguccauccuuucgucucagcuccaaacuuuguaacuccuuccauggguguuuuguucccaauucuaaggaggggcauaguguccacacuucagucuucauucuucuugaguuucauguuuuuagcaaauuguaucuuauaucuuggguauccuagguuuugggcuauuauccacuuaucagugaguacauauuuugugaguuccuuugugaauguguuaccucacucaggaugaugcccuccagguccauccauuugccuaggaauuucauaaauucauucuuuuuaauagcugaguaguacuccauuguguaaauguaccacauuuucugaacucaagaagguggacaucagaaaaucaaauaaccccauuaaaaaauggggcucagaacugaacaaagaauucucaccugaggaauacugaauggcagagaugcaccugaaaaaauguucaacauccuuaauggcugcuucuauuucuuuaggggggauauaggacuguuuagaucauuaaucugauccugauuuaacuuugguaccugguaucugucuagaaacuuguccauuucauccagguucuccaguuuuguugaguauagccuuuuguagaaggaucugaugguguuuuggauuucuucaggauauguuguuaugucucccuuuucauuucugauuuuguuaauuaggaugcugucccugugcccucuagugagucuggcuaagaguuugucuaucuuguugauuuucuaaaagaaccagcuccucguuugguugauucuuugaauaguuccucuuguuuccacuuggcugaguucaccccugaguuugauuauuucuugccgucuacuccuccugggugaauuugcuuccuuuuguucuagagcuuuuagguguguugucaagcugcuaguguguguucucucuaguuucuuuuuggaggcacucagagcuaugaguuuuccucuuagaaaugcuuucauugugucccauagguuuggguacguuguggcuucauuuucauuaaacucuaaaaagucuuuaauuucuuucuuuauuccuuccuugaccaagguaucauugaguagaguguuguucaguuuccacgugaauauuggcucuuuauuauuuauguuguuauugaagaucagccuuaguccauggugaucugauaggaugcaugggacaauuucaauauuuucauaucuguugaggccugacuuuucauaucucuaaauugauucaucaggcagcuaagaauacauucugauugguaugcuuuaucucugccuuuaugucugucuguauguacucaguguucaauuuguaauaugcugagucacauugccuuugggccagauguuuauauucugcccucuuuacuagauuugguuuauagaagcacagugaaagauaauauguaccauuaauauguacuauuuuuauuuuuuauguaucaguuauaaaaagucugccauuuaaaauacagguauagguaaguuaacccaucaccuuaauaaaaaaaguaaauucauaccuuugauuuguuuauucaaauaaauuaugaaauauugaaguuagaugggguauuuuucagggaguauauggcuuagaagaugcuguuaucgaaauaaagaauuguaaagcccaaauuaaaauaagagauggagagauggaaguguugaccaaggagaucaauaagcuugagaugaagaucaaugacauccuugaugaaaacgaagcccuuagagagcgggcugguaagcuguuuucugagauacugcuuuguccucagucugauuuugaaguccuuuuuguuuucuuuagguugguuuuacuuuuguaggggaagugguccuaauccucaagcaaagugcacauauucugcugagguguucuccuuccugcccucuccuuccccuuuagcucuuaccuuacauuuguuuauuucuuucuagcaguuggugguauuuuuacccaaauaaauguuucuguagaagcacuuaaacaaaaguggagguacucugacagaaguggguuuggggcuugauaaagaacauggcuuucaucgacccaguaugccuucaguaauaaucgaauggugaaagugcauugcguuaugcugcauguaagaggauagcugguucucugcaauaagaaacaacuguacagccgggcaugguggcgcacgccuuuaaucccagcacuugggaggcagaggcaggcggauuucugaguucaaggccagccuggucuacagagugaguuccaggacagccggggcuacacagagaaacccugucuugaaaaacccaaccaaacaacaacaacaaaaaaagaacaacaacaacaacaaaaagaacuguaugaauuguuagcuuacaaaaugauuuuuugaggccauuuaaaaguccuuuguaaaccuuuuaaggauauauaaacacauuauaaacugcuuauauuuucuugcguauuuuaggaguuccauuuagucuaagauguaauuuccaaauauaacauggggauuuauguacuuuuaaaauuaggggugaaauauuuaguacuacuacuuuacaugggguaaguuauaacuaaaguguccaaucuaaauugcuucuuuaaaaugacugauuuauauagugauucauugugcucacuggcuaucaauuagugcuuccuagaguuaaacuaacaaucgaggaaaucuuuguguagaagaaaaauaaauacuuuauauugaucauuucugaaauaauuuaacuagaacuuaggauuauacuaggugguuaagcuagauuucugauugacgugacuagucuagucccagcuaggaauguagacguauguguggauaacuuaugaccuaucuagacugcuggcacaaacaccauguuucuugucuguaauggguuuagcuuuuaauauccaaagucugaugcacaacuauuuagacugucuugguacuugauuuucaccaccuaguuauuuaugaaucagguucuauaauggaggcauauaauggaggaguuagguuagcugagagguuuaaaucaauaacaacaugauuaguaauaaagauugcuauuugacaaguaucacucuaagcauuugauuuagucuaaucauauuauuaaaugucaucuccauaguaaguuucaagugagcacugagucguuuacuuaaugacagacuuucuuaguuaaugaauugcaguaccuuugcagcauccccauaugcguuuguuaggacuuucauaauuagcuaacauuuagcuuucuuguaguauaacugucuagacaucuuauacaagaaggcucuauguuucaaaugauaaugaauacuacuuauuugguguuuugugaagauuuugucauuguuuugcaaguuuuuaaguuuguaauuauuugcuuucuauuucaggccuugaacccaagacaaugauugauuugacugaauuuagaaacagcaaacgguuaaagcagcaacaguacagagcugagaaccagguucuuuugaaagaggcaagugaugcucgcucaguugacgaguuucuuaucugaacuaaggagaacuacuaauaacucgugcuuugcagaucgaaagucuagaggaggagcgucuugacuugaaaagaaagauucgucaaauggcucaagaaagaggcaaaaggaacgcagccucagguauucucaguuacccgaacuuggaaagagucacgcggaaagcaggcgccugcauguggggcggucuguguguugaggaugguugugcucuguugcugugcaugugcucucacaaagagauaacuggguauaauugagugugacccugaaucugagacaguuaaagaauuuagauuggaauuauggacuuuugaaaaauucaguguacacucuggucccuaccuuguuaugucgaauaucuuaaaacaguaauuuuuauauugcuguauuucauccuuagaaugcuucuuuguucucaaagcuguacauugggaguacuuaaauuaaauuuuauuaaaauuuacuggaauuuuucauuaaucuuauauuaacauucauuuguucaccuuccuuuuaaaaggacggugugauguuuauaacagcuauugcaguucacuuuuugaggaucauauauagacgcuuucuucauauauauauauauauauauauaauauuuccauaugucuguuugccugcucuauguaugcccgugcccguggaagccagaaaaaagcacuggauccccuggagccagaauuccgugcaguugugagcugcauggugugggugcugggaacuaaacuuggguccucugaaagagcauuauacacauuuaaaaauuaaaauauagagagauuauuuucucacccuccuuuaccucccaugucucaucccaccuucauccuguguguguguguguguguguguguguguguguguguguguguauauaaauaaaacuacugaauccauuaguguugggcuuauaugcuugcuguuagggcugacacuuggcauugguauacuggguagaggacuuaucuaaggggaagacaaauucucccucucucagcauuuuucaauuuccuguaacuuuucaucuaguguugaggcccagugucauuuucccuguccauguuaguauauuaacuggcauuuucauuguucaggucuuguuuaaacggcugugcuguugcaguuucauggguguaacuucuaugucguguacaaaagacucuaucuuugcucagauguccugguccucuggcuccuaaaauauuucugcccccuuuucugccauguuaugcuagccucgggugaaacccuaguauugggacacuugucuaccauguauagaaccugcacaaagucacuugccagcagcacacacaaaaaaaguaaaauguaaauauauacaguaaaaauuuauggguuuuaauuuauuucuuuauauuuuuaaaaugucuuacuacuuauuaauggguacuuuaaaauuaauacagaauaaaaugauaaagaugauaaaauucaaauuauugccuuauugauauagcuuauuaaaauaagcuagaucaaaguuauauuggcugcauguuggucaaagauuuuaaaaauauuaaaccauuuuuugcguuaaaacuuuauucuuguauuaggauaaaagaguuauuauuuuuguuguugcugcuucuuauuuguuauuucuuucgucuuguaggauuaaccauugacgacuugaacuuaucugaaaccuuuucucaugaaaauaaaauagaaggaagaaaacuaaauuuuaugagccucaauaauaugaaugaaacacaaucaaagguaaauaaaacaguaaugcucugacuuaagaagaaggaaaaaugcuagcaguuggguauuuuucuucacuuaaccucauuuagcacaucugcccccuuagcuuauuaaauaauaauuuuugcuuguuuaaauaguguggugaucagaagauugauuaaugagacauuauuuacuuugcauacagauuaagaguucagcuaaaacagagcugcugcauaggaggccaucauucaguguuguacagucagaucaaagugaggcagaggagaacauggccacacgauccuuaucgagaaugcugucuggaauccaucagaguguaggcagugcaggggacccuauugucuccuuaaccagaugcuccucauuuaugcaagugaaagacagcagugcaacuccagaagcuauuacaauaagggagauuuuuaaagcaccaugccuacgaucuuugagaaagcuagaaucguuagucaguaccuucaguaaggacggcagugaagaacuaagugaauacuuaugcucucucucugaugaccauaugaagagagggucaggaaaccaucgaggucuagagaaaaccagguuccuacagaagagcaguucaucuuuucaagugucaccagcagcugcagaauuaaugcagaaacuaucacauaggcagagcuccgcaauauuuccucaacagucguaugaccgugauguggauaaaguaacgucagaagauaaccaggucuauucucaaauagagcaugccguucucaguuugaaagacgauaaaggacaaagugaauuacccucccaaacugagaugcugagcaguaagacccaagugaaucuuucagaucuugugcccauuacugcccaguccaaaccgucucugauacacccccuugaaaagcucauagggcagccacagcgccagcuagcguuccuuaggucucaggugagcuuccuuuccaaauagauucaugcaauuccugggcuacuacuauuacuauuacuauuaaccggaguucucuaaaaaauucuggaaagauuucuuuuuacuuacacauuaacacucauguauaacaaaucuauacuuuuaaaaaaucuaaaguugcaguauauuugcauuaaauuuguugacuccccuaauuaauacauuaaauguuucuuuagaacgaaaccauaguucaggacuuaccgauccaagaagagcagaguagaaaugcagaauuagaacuugaccaucagagaagccaggcagaacagguaguguaaagaucgaccauuaagacaacgauauaguugacgcuaaagacagaaaaccccuguauaucucugugcccugccauggggaaugugggugaaugaggugguagaaucguggccaucucuguuuugcccucuggacuuuauaacugcuaugcugcucuagcuuguuuucuggugggcuaaacuugaaucaguaaagcauuguuuuaacuugaaaccugcuuauuacugagauauaacacauuuuuauucucuuuguucagaaugaguuucuuucaagagaauuggcugaaaaggaaaaagauuuagaaaga

SEQ ID NO: 5723 - RNA, 2648 nt, Mus musculus
uucaauauauuaauuaguugaagagauuaaggaaaauaugguacaacccccagguacuuagccuaaagcucaguauuucaguuacuuucucaaaguuuucuuuauggacaucaagaacaagucauuauuagggacaucaaaauauauuuuauaacauuuggcuuauuacauguauuucuaguagaguuuaauuaccaguagaauagucuuagggaugugaacuuuaaguguguauaugucccaagaaacauagucucagaagcaaacauaucacuuucccugcacagguaaauuuaaucuuguuuuuagaggacagugcuuuccauuuucugaaauugcuuacccugcaguaugaagauuccagucucaaccuauagagcaauguauguguauguguaagcaaacauuugcuugccucuaguaugugagggaagaaccacauuaugaccuaagaucgucacuaaaagcuucuuguagaugucuucguuuuauuuuuuaaugaaaaagcaacaucagugauagaaaagaggcaccccagggauuaacuuugacauuuaauuuuuuuuuuuaagugaauuugaagacaggcugguggaaaaaucucucgguucuuugaaaaggauuaguggcaauguucuuaccugaaaucuagguucuugugauuccuuugaaagauauuccucacuuuaugagaacaucuccaacaguggcuucacuacuaaaguuaaucuuaauuggauacaagccauuaaaaccuaagaauauuuuccuugggaacucuacacacugaaguuuacaucccuuacuuacaugacuccacugauaacugaauucuacucuaaaagcauguaaccagccaacugucacaaaauauauagugaugucccuaauaauggcuuguucuugauguccaaaaagaaaacuugagagaguccuuggaaggccuacaaacgauaacguuuauugacauguuaauuaucuuaaaaaugaugaaauguaccucgcugaagaaugaaacccauccuccuguaauauguucuagguuccuuuugcauuuccuugaaaaauuucaagugucaacgaucauaaauuuuaugucuuguccugcuuaaggaggaguucaguuauuuuuacagaggcaaagcuuuguguucauccaugcauaguuuaaggauucuccacguggcuuaguugaaagcaugcuuugacuauuggaagagguaagucagucuuuagcugguagagauccuuugaaggagaaucugcuacauaggcacagaccuaaagugaggauuaguucccuaauaccacuuuacacaaccucgcugggauccuugaggcugucgggacucagcugagaagcaaagauccaaagcuuuucuuucacaaaauauguaaauagaugguauggggggcuggagaggcagaaagcccagaauccuuuaccucuggcuagacuucuuacagauuccagcaaaguggcagaacaggacaauugcaguuguuagcguugccuuuuagcugaguggguuagaagacagacguuagaauggcggagguguuggggagggguuguccaacuuguuuuguuggcucuacguggggcuuccccagauccacccaauaucccgccgcgggccuagcucugugcgcugggaggacgcagcgggcagccgcaguggacucugcgucaugggugaugggagaggcggcucccagccugcagaccuggcucgauccuuggcgccguguccccgcccgcagccacccccucucccccgcagccugucggggggacgcagcacuagcugguugggcacgugggagccuccgucacacccucacucauacacacacacacacauacacacaagcacauacacacauacacacacgcacgcacacacacagacaugcacauacacacauucacauaacacgcacgcacacauacauacauacauacauucacaggcgccccaggaaccacacgccagcaucccgugcaauauuccaggcagacacaggcgcucacgaguuucuccgugccagcuugcaggacagcgacucccgaaaccaauccugcccuuggcaagcuguuucuguucuccagacagcuccucugcggccucccgcaccaucugcuggauccgacccuuuuucgaccuaggaaccuggaagcuguaagaggugcuagcucaagaagcaccagagguaauuaaugucucuuacuggugcuggagcaccgccggggguaggguggggcucuccauucagccacccuggaggagucgggcgccaagaaagaugcuuggauggagcuccagacucaggcuggauccugggaugggaggaggaacggcggugggaagcguggaaagguaacgcugguuucugggggcuauccucuggcucugucuccugcaccugugcaaacugggguucugguggugggaguccgaagcggcacuuguggggagaagcacgugguucgaaacgugccgccauccuucguaaccuagguggaaacugccuagugcauccguggagaccggcugcuuuccaaaucaaguuggggguuugaagggcgggguucaaccgggcaaguccgagaggaaaguugcuuucagggcagagaugcgcuccug

SEQ ID NO: 5724 - RNA, 2648 nt, Mus musculus
caggagcgcaucucugcccugaaagcaacuuuccucucggacuugcccgguugaaccccgcccuucaaacccccaacuugauuuggaaagcagccggucuccacggaugcacuaggcaguuuccaccuagguuacgaaggauggcggcacguuucgaaccacgugcuucuccccacaagugccgcuucggacucccaccaccagaaccccaguuugcacaggugcaggagacagagccagaggauagcccccagaaaccagcguuaccuuuccacgcuucccaccgccguuccuccucccaucccaggauccagccugagucuggagcuccauccaagcaucuuucuuggcgcccgacuccuccaggguggcugaauggagagccccacccuacccccggcggugcuccagcaccaguaagagacauuaauuaccucuggugcuucuugagcuagcaccucuuacagcuuccagguuccuaggucgaaaaagggucggauccagcagauggugcgggaggccgcagaggagcugucuggagaacagaaacagcuugccaagggcaggauugguuucgggagucgcuguccugcaagcuggcacggagaaacucgugagcgccugugucugccuggaauauugcacgggaugcuggcgugugguuccuggggcgccugugaauguauguauguauguaugugugcgugcguguuaugugaauguguguaugugcaugucugugugugugcgugcguguguguauguguguaugugcuuguguguauguguguguguguguaugagugagggugugacggaggcucccacgugcccaaccagcuagugcugcguccccccgacaggcugcgggggagaggggguggcugcgggcggggacacggcgccaaggaucgagccaggucugcaggcugggagccgccucucccaucacccaugacgcagaguccacugcggcugcccgcugcguccucccagcgcacagagcuaggcccgcggcgggauauuggguggaucuggggaagccccacguagagccaacaaaacaaguuggacaaccccuccccaacaccuccgccauucuaacgucugucuucuaacccacucagcuaaaaggcaacgcuaacaacugcaauuguccuguucugccacuuugcuggaaucuguaagaagucuagccagagguaaaggauucugggcuuucugccucuccagccccccauaccaucuauuuacauauuuugugaaagaaaagcuuuggaucuuugcuucucagcugagucccgacagccucaaggaucccagcgagguuguguaaagugguauuagggaacuaauccucacuuuaggucugugccuauguagcagauucuccuucaaaggaucucuaccagcuaaagacugacuuaccucuuccaauagucaaagcaugcuuucaacuaagccacguggagaauccuuaaacuaugcauggaugaacacaaagcuuugccucuguaaaaauaacugaacuccuccuuaagcaggacaagacauaaaauuuaugaucguugacacuugaaauuuuucaaggaaaugcaaaaggaaccuagaacauauuacaggaggauggguuucauucuucagcgagguacauuucaucauuuuuaagauaauuaacaugucaauaaacguuaucguuuguaggccuuccaaggacucucucaaguuuucuuuuuggacaucaagaacaagccauuauuagggacaucacuauauauuuugugacaguuggcugguuacaugcuuuuagaguagaauucaguuaucaguggagucauguaaguaagggauguaaacuucaguguguagaguucccaaggaaaauauucuuagguuuuaauggcuuguauccaauuaagauuaacuuuaguagugaagccacuguuggagauguucucauaaagugaggaauaucuuucaaaggaaucacaagaaccuagauuucagguaagaacauugccacuaauccuuuucaaagaaccgagagauuuuuccaccagccugucuucaaauucacuuaaaaaaaaaaauuaaaugucaaaguuaaucccuggggugccucuuuucuaucacugauguugcuuuuucauuaaaaaauaaaacgaagacaucuacaagaagcuuuuagugacgaucuuaggucauaaugugguucuucccucacauacuagaggcaagcaaauguuugcuuacacauacacauacauugcucuauagguugagacuggaaucuucauacugcaggguaagcaauuucagaaaauggaaagcacuguccucuaaaaacaagauuaaauuuaccugugcagggaaagugauauguuugcuucugagacuauguuucuugggacauauacacacuuaaaguucacaucccuaagacuauucuacugguaauuaaacucuacuagaaauacauguaauaagccaaauguuauaaaauauauuuugaugucccuaauaaugacuuguucuugauguccauaaagaaaacuuugagaaaguaacugaaauacugagcuuuaggcuaaguaccuggggguuguaccauauuuuccuuaaucucuucaacuaauuaauauauugaa

SEQ ID NO: 5725 - RNA, 5681 nt, Mus musculus
guaacuaugugaaguuguacauuuauucaagcaaguauucauuuagugucacccagcuuguuucugcaggguacgcaaaaaugaguccgagugaauucuugcuuugaaagcagcuuuuuuugugucacagaucccuuuggccaucuggugaaaucugagcuucgagucuagggaaaaaaauguuuuaaaugcaugaaaaaauaaaaaccacacacacacacacacacacacacacagaaacaaauagauugaaauauauugauccaaugauuagaacucaaauacacuccguaguacucagucuucauuaagcuauguaauagcauaauaaaguacuagguccauuagcagccagcaaauugaaguauucaucagcauaaauaauguuuuuguuagcguuguaguaccugccaugugauggaagaaccucuguguuuuuagcugugggaggaggagucuuugcucugguguguugccuucauuugcaguugaagacaauguugacuaauuaaaaagaagauaucccuuuccuuccuauccaagugucugagauccugaguuccuugaauugugguggaaucgaggaggaugaggaccccugggaccacugaggaugcauuuauuaaaaagcaaugcaacauauuaagcuaucagggacauaccaguagauuucuugggaucucacugcuguagcuuugagaaguuugacugaggucaguagacaucugagaagggaacagaaaggucagcagcuagcaucaauugaccacaagggacacagcucagugguagagcacuuugagcaucugucccauacccugccuuuaauccuuagcuuuacaaaaccaaaccaaagaaaugcguacccggugacugucacacaugacggaaacagaaggguucacaguuuuauuaaaaggggauccuagaagaaagucuccucgcagaugcuugagucccgucuuccucugucaacuuuauucaaaucucaaagcuuagugucaccggguccaagauuacccaggcuggaugcugggauuuuauuuguuuuguguugaauuuucauagcuauuuguauuaacucaagagucuuugccuuugaguauauuacguaggucugaaagcgucacugccaagccuugaguuucgugaaugugcaaaacauugugaaaauaaaauguuaguccaagaaacuguuugaaagccuggucuaggcuugaguggaggaguucugaguaaauaucccugauggguuuguggagaaaacguuggaagcugcugauuugguuacuagucguuucuccuuuugcuuuaauucuuuccguuaaacagccuugauauuuagagcacauugaaauggauaucguuuccccuggguuggaaugaaauacaagaacaaaaugaaaagagauggaaaaccugaaaggcaucacgggacucaguguugguaaauguggaaagaguucggaagaagaaaugauaccuugucuucggccgacgacagugugaagaucucacuccacucuagaucuagaaucacuagaggcacugcuuugggaucagaagaauagagugaaauauuucugaccacuagggauguagcucagugguagaacacauacauugccugcccaguacccuagguuuaauucuuagcuuuacaaaaccacccaaagaaaugcauauccagugacuaucacccgcggaguaaaaagaaggguucacaguuuaauuaaaacugaauccuuuaagaaagucuucucaaagacacuugaauucccaucuuccucugugucccuuuaucauucuccuuuguccucaaacagagcuuggucuucuccucuuccugaucauguuucauuucuuuucuugcugcucaacucuuuccuccucuucuaauuucuacucuauaccuuucuucccuuucucacucucuaccaccgacagcugaugcugaacuuaauuuggggguagacgugggggcugggcgagcuacgucaccgaugaggacacuuugaggcauguuuuugaacauuuaucucggacugccuaaauagcgaagagaugcucaccuuaggugguccaggacauuuugugaucagagugacacuugugagaagacucggcaaggguuaaggcaggcacaggaauacugugagcuacccagcuuggcaagaagacuuaggaaauugcaagucauucagggugaccagagagaaggguauguuuuaugcaguagacagugguagaaauauacagaaguaagcagaaaucaguuuguguugggcucuugaugagccaaggagugaaacugaaaguuccaaggaacucuuaaaggagagauagaugacaggacguaagccuuuuguuuuacacuuauuuaagacuguuuugccugcauguguauaugcauggcagccacaugcucaaagugccugaaaaggcuaugaaauguaaccucugucauguaggcucuggcaacugaacccaggccuuuuggaagaauagaaguacucuaaacuguugauccaucucuccaaaccaucaagacaaauuuuaagaguccuuagaaaggaacaggauauauggagaagaccaagcuggagguaugaggggcagauagcauucuuuugugcuaaauccagagcugucucuacagcugaagaaagacaaaaaggaagauaaacccaagagaguaaagaaguugacucugccagauuugccaacuggacaugggaaacaggaggaaaguccuuaaugauucgccacaguuucagauaaccuucaaaccaucugggcuguccucuuuaugcaagcaugucgggggaguaguguagagaggacagauauauaguucauuuccggauguguccuacuugaaacucuguugacacaaaaacuaucauagaguuacaaacauaugggcaagcagacacgcugugugccugacguuauugcugcauuuaagcagagucuucaugagucugcaugagucugcaauagucccguguugccuugcuccugacaugcaucgccuuucuugcaaugucuugagacaguucuguacugggaagaaacagaggugaauagagaggaggugauacucuccaaccuuacagaacaggaguaaaacuugacauucacagagucccugggggugggaacugauaggauguuuaaguccacugggagguuuggugcaguguggaguuucucaccucgugcccgacacgugcccacccacugaagcucuuccagcugcucagcagugaaauuccuccucguggugugaaccugcucaccagacagaugucuuggguguuugcugauaugacuugugggaguaacggaugagggauaauuuguauaucgugcacuccgagagaggcugauccuagauuccuuaaaucgaaugaaugaaaagaggcuccuuauaacacuggaaagugucagagaaugcgaagcaggaaaugaacggcacagaauacuugaaaagucuuccaaauaccccuauuaauuaucuagagggcauucaccuaggagauuguuuagcugucaacaugucagccauuuuccuggguuugacaucauaaauugccaucucaguuuauaacuuauucuaauuugucuauuaauuaagagauugagaggaaaaaaaaccaaacuaaacaaauagaaaaauaauaaaaaaguagcugaacuucuuaaaaaauuaagacauuuuauuaccugauucauauuccauguuuauuuccauuuuucuuccaugcugugugugugugugugccuacacauaugugacacaugcaugagugugcagauuugugagaaaguguuaaaccaugcgcaugaguauggaggccagagguugacuucuuucucuguuccgcaccagacugaaucuggagcacuggcuucuagcaggcugccuggagccaggucaggaugcucucuucuccccuugguacugggguuauaggcacgugcugcugcagugucuggccuuuacacagugcuguggauucaaacucaaguacuuguguguauaugacaaguacauuaugcccugagccaucucuccagauccucccucuuucuuaauuguuuuuuuuuuuaaguuauuuuuguaggauuugguaaaguaggcucauaguccugccugcauggggccacuuagcaggagcaaaaguaguugucccuucauuacggguguuauagaugaggcagcuuaaggaacacagaaauuaguuggcaucccccgaggauacacacaguuauuguugggugcgauauccuauuucauuuaauccaauuacaaaagaacugggcacaauggccuucuuggucuucugugcugcaggauguaaugcauugcaaaacuaugccacagaugcaaacugauuguugccuagauguggagagacuugaauucugugagacucaaagcaggcuaauaagaacaaagagcauccuugggagguaaggccggguuuuaauuccuagauuuuaugcaggucguuaaagaaccuucaaguuguuuacugggggucacguaccugugaacuuauuugaccugcuccuagguagaacauuuuuauacuacugggaaggucaagaguugauuggcugucuggguucaucuggauucagaaagcguggauuuccuauuuguaggauggacaguagguccaggguguuuuugcuuugugaggacugggcaaagggcagcgaguaguaggauucauggaacacuucuaaggaugucugccccugcuugauccaccaacucucgugcucccagccuccuuuacuuucuuucuaaagguuugaauuuucacaggaaaguguaagcuucaauuaacuuacaggauuuacugaaguuggaagacuguauauuaugaucaacauaguaaugagauaucucaguaaacagaauaggcgucuugucuuaggaagaaacugagcugcaaauacacgcgugcuguuguuucuggaguguaguccuguuggcuauacuuagggggaagggcucucuccuuuuagugaguauauucaugacccuuauugugacuauucuaagacaaauccauuucuacagaccugacuucauuauauuuuaauaagccagagucauaaaauguagaaguagauaaauaagggacgcuugaaacaucuuggcuuuauagacuguaaauucuugggacguaaucggucuacugaacaagggcaaacaccacacgauacaaucaccagagcuuugggcaagugccucuuccucuuuaucccagaucacucauguguucuauaccagauuacuugcagaguaguuuucuuuggucuugugcccgauagagaugauuccaugucacucuuagcaugaugucauaauucagaggaaagcacaacuuugaccucacacccuauguuguaacugccgcucauugccaguaccuaaugauggagauauuguucuauacuuccacuaaaagccugauaauccuuggcuuuuugaaagaaaggaauuucaggaucaguuagugcgaagcagaguuggaguuaauugaaagacauuuuuuuuuuuuuuuugacauagauucuaagcacaggaccuaguggagagaugcucaaggaaagauuaagacauaccuaugugcagucaugagcuccucaagggagugccc

SEQ ID NO: 5726 - RNA, 1086 nt, Mus musculus
gaaccugcaaugcaaaugugcuauuguuagaggcucuuagaagcugucuugagaguuaacaauuaccagguauuccuugugacucuuguaacuuuacacuuccuugugacucuuaacugguaucuuugguaucuuccaacaacgcccuccccacuuccuuaaguuucgguuucuuccuuuaaauacccccuuacccagcuacucggggcgccaugguccucuaccccugcgugguguaugaccaugggcccgagagcgcucuugaauaaaaauccucuugcaauuugcagcaagacccguuucuugugggugauuuuggggugucgccucuccugagucagaacgugggggagcccucacauugugggucuuucauuuggugcguuggccgggaaacgcgaccaccccucacacccgagaaccgacuuggagguauggggauccccucuugcgugcgugugugccggccggugucucuguuuugagugucuguuuucugaaacgaacauuggaacaugugcuuguuguguuggguuguuugugucuuguucuauguuucugaaguacggcgaagucugaguuuggauccgucugaguuuauugaacuugugccuugguuuuccgguugcgagaucguggguucgagucccaccucgugcuuugguuuuacaccuggcagagugagaaacaagugagauucucugguuuugguugucuagguagaaguggacgacgguguuuguagacgauggggugaugggguuuucugaaaugcgcgcgucuguauuugcagcuguccuuuugggccguaaguaccggaggacuguggucggcagacgugcuaagaggaccacaggcuguggcccugggggacgcccugggagguagggagagucagggacaccuggcugucuccggagaucggucagagggaccgaguucuguugaagcggaagcuucccccuccaacaucgucuaauucuuuugccugcuuguggaggacaagaaagggucgagugugucuggaucuguugguuucuguuuuguguguuuuuguguauguguuuagagcuauguaaaaaucua

SEQ ID NO: 5727 - RNA, 4032 nt, Mus musculus
uggaaauuauguaugacauaaagagguggaauuuuguuugucaaguucacaaguugacaucuugauauucaacuuuaccauauuuggaauuaacuauaacccaagcugcugaauauaccucugugggauauucuugauugggucauucgaggagacacauuaaaccagggucauaccuucugauagcagcccacauaaaaggaccaggaaacacaaagcuguugauacuuucccugcuugcucucucuuucauggacaguuucaucuauccugugguugagaaauuccuuuccugguaccagaacuuauaucuuuggcaucgcauacagccuggugcacucaaagaauacaggauucuuagccuuuccauugagagacaggcauuguaaaaccagccagaccacaaucuauaauccauuuauguauuuucauuauauugggucuguucuuuagagauucuggcuaauacuauuauuucauuugauacucaggacauguauaauugaaaaaucacccacuauaguauacauaaaaguaguuuugugcuauacuccuuuuaaacaauaaauauagaaaguaauauuuguaauaaaauguacaaaagaagcauuauauaucuaugaccaugauccuauauguaucuacgaacuaaauucauauuuucaucuuaugcacuaauacuacuaaauguagacaauuauauggagauaguuuuaguucaccauacuguuuaauuuaccaucuauuaaaaucaguggaagccagugauggccuuaacauuaaaacuguucauauauaauaaaaaguacaaaaagacuuuucacuucaugaauggauauuuaguagcuccuuuauuuuuuuacauuucugugaauauuuaggcagugguuaucaaugugggaugcugagauagcuggacuaguaucauuuuggaacuucucaggaauuauaagguugagacagacagcaccuuugaccugaaggaugcauggcuauggggguugagaccaagcaagguucauuauaagaagcugccuuggauauauauauauauauuguaugcugaauuggauggacaauaagcuauaggaacauucacaaugguguuucuuguguucuugcuaaugggauaaucuagugcuuuugcaaacuucuuauacgaaccuuucuccauuuugauagggaaugacuguuccuagcggccaauguuagcgugagacaaaauaauuagccucuggaccuggaacauuccaaucaguccauuagucucaacagacacagcuucuuugaggggggagauuuuguucacaccaaugcaguguauuguauagacauuguuaagaguguggccucucaggauccacccgaggcuuagagucccagcaucuacaaagaacuaggacacucaagugagcauguuugagaaauaguacuuuauguagcauauaacaauaauacuauucaucuacuaauguuuaauauuuuuacacucaauucuuacauugugaugcgaaacuugaauaacaguccaggagagaaagggauauaaaucauauggcucaucuuaaacuuuacuguagagucaucaacuaguuaaguucuucccccaaaagaacuucaucuagugaucauacuucagugagucaggaugugcacaucauuucucagugaaaucuggauucugcucuuuggggcuucuaauacugcuuacucuggacccuugcuguaacuucuauucaaugucuacuugaugcuuaauucucuuuguguuccuuuagugcaucaguaucuuccucucucaaacauuuccuuaauguauugguuuuuaucuacuggugucuccuuauucuugaucuauaugaauggacacacacacacacacacacacacacacacacacacacacggucggggagagggaaaagagggaggaaagagacagagggagggagagagucacagagagagacagagaugcuugagggaggaggagaaaugggggaggggaaaguuucuggggacuagaacauguucuuggggcugccagacuauugaaagcugaaauucagucaugcagacagggaacacuuaacaugagauccucagcgcuaaggcaaugaauggaggcgaccugaagagguaaggcaaagugacagacccagccacacccuagacugauucagguuccggugagcuugacuaccuugccucugauucaagagaagaaagcggcagagagccacagcaaacacagaaggccacagagcaggaagguucccaguucucaaaagcacaugccaacacaagcuuuccuguaaagaugauugugugggaaaagcgcaggcagggcaaagagaacccauuuauacuuuagaucacccgugguccucgcccucaucaggagcauugagaccagagugauccucagcagccccggagaagcuuuuggggagaagaguggaauguauccacgagcgcgugugcgugaggaggagagaaaagacgugaugacuucagaauuuauuuaagggccgccgguggaaaccacugcggcagcuuccaggggaagcccuuguuccagaggaagaggagguggagauugccaaggaggaggaggggaggagacacagaaggaggaguauccuaggcuugcacuaggcaagugagaagaugcuguagcauccucacucaguucccagcagguugguucugucggccaacugaugcaagcagaugaauugcagagggacuggaaggaaaaaaaaauuguugcagcgggcggaggcagcgcgcgaugauggggcgggggugucuucggagguggguggugugcauguguguguguguguguguguguguguguguguguguguguguguguguuucugcuuaccuucccagaaaagaagcaccuccuuuaagugaaaggauacacccuagaauagaaguaggcugggcacccagagaagaccuguccugcuucuagcauccccaggggacucacuuccuuuuaaccaucaaacucccaacauuuaccauaaacuucacaggggcuccgggugggguauuggguggagaaugucccuuccauauagguacuucccacacuucaccccaaaguuccuguuuggagggacacgucuucacccucucuggguggcccgggaugccaaggggagaaguuaugcuacguuaaguuucugaaagucagauccagucccggauuaccaucucuccgccccggggcuccugcugcacgcgaaaguggcggcggcggcggcggcugccgcugcuugggcggcaaagggaccgcggcugcuuuaagaaccgccucccccucucuucccuuugacaauggucugaaccgagcccugcuucccaaagcaaaauuuguaauaugccauuuuuccgauggaccuuucuccuuuuggcugcugacggagccacgggaagaugccgaacugcugccacguuaggaagccagggcacguuccaagagaacgcuggggcucgcgagugucuaagcugucuuucuccucccguugcuaaggaaaugguccaggacugcugggugugagccucaccucuccuccagccgagacugcgguugucauugacaauugaagaaacaggaccugaaauaagagacauuagguacagaaacuguauucgaguugcaugguuucucuuccgcuucggguuuuuuccccccuugaccaccuccccagccccaccccgcccccagggaagaggagaggcaaaguccuccuuguggguauuaguuaccuuugcuuuccacccaucuucuccauccccgauuuuucuagcuccugccuagcucguucucuccuggggcugaugaacaauuuuaguguggaaauuaugaagucaacuucuuucggggugguggggguguggcugagcaguaacuguccagcagugugggguacgcuugcuguuugaccauccgagcaggcacagagguaaagaaagugaaaaugcuuccauuagacaugguaggaauauuucccg

SEQ ID NO: 5728 - RNA, 3229 nt, Mus musculus
ccaccuccuuuaaauauuuuauugauaauaauaguacauuuauuuaucaaguuauuuuaaggcauauacaaauaguuaauaaaaccuggcucaugauuggcaaaguacuguauauaguaaaaugacauaauacuuuuuaagcuuuuuugcuuaaacaaaugauauuauccuauaaaauuuuacaauccuuuuuuuuuauauacaacuggacauuguaugaaauaacaacaaagaaaagggggcuucauuuaccaggcauucuugaaaugugcuuacaauggaaauguaauauuuuuacaagugacaucaacaaaucuaaaagaaauucauaaauuauuucaauacauaucuacaaggcuaacugugugaucauauuuaacccauucuuaaauguuucguguucaugguuugcuaauuucauuggggauguuauuuuuaaaggccaagaaacaaauuaguuauuucaauguuauuuauggggaaauuuacauuuuuaauaguuugaaauugcccucaauguauuauuuauagcuuacauugaaagaaguauuucuuauaagaaaagauguaagauuauacgauuaaaagauuuuaagaaaguauauaccauuaggcacaacuguuauauuuucauuugaugauacacuauuaacaaaagauuaaagagaaaagcaaaaguuaaauauauuuuuaauucccuguaauggauuccaagcuguuaaaauguuauuuugaagaaaaauauagagcucuaaauaccaaaguuauuuugaugugcaauauuuacaauauauauguauaaguuaagaauuacucuaaguaacugucaauuaauugccuccaacagaaaaauauuucuggaaucauguaucuaaagcaauuggaagcuaaaaaaaaaaaaaaaaaaaaaaccgaaagcaaaaagaacaggcagaggagaauccauuauugcaaaugugacuuucaguuaaaucuauuuucucauaaaguggcaagacaguauuuacaaccgaaaagcacguauucugcccagcuugucuuuccuucagcuucagggcuucuuuuccuccaugaaggacgcccuccuagcaggagugaucaucgggagagaguucauaauacgugauagauaagucuggagcuggagggucccgggguagcaggcugugaguuggcgcuggucgcuggagagagggaagcuguguccugaagagccagcucggauggcucuguagacgugauccgauccacaaugcuggacaagcaauccaagcuggacacggagcuuuuaucugcagcacaugcuaacagcccaaggagaaaagugcuuucagaaaaccauccccacgcagacaggcuugcuuguggugcccuuuaaacccggggucagcaccuuugaccgcauaggucaggugaucacagagggacugauguaaaacuuugcaguaaauaucuagcaauuccccaggguagagguguggaagaccccugguaauauuucaagcaaaagugagugugugugugugggggggggggggaugcaugcacgugcaugcguguaugcuggucugucugucugucugucaggguaaucuggagcacaaaacgguccuuagccucccccacaacagccaucguuuauauaccuguucuaaauacuacuuugaaggacagacugccaugacugaauuacgagacugaacagaucuuuaaaggugucugaaguuaucaguucuuaccauuugauacaucaggacaguagaugcugucaaagcugcuguucuuucgggaccagacagggcuguuacauucaggcuguuaacacaaaacgcacagaaauauauuuuuaagccuuggccaaaaagacgcacagaccuagggugagaucauaccagcccccuaacucaggaaaccgaacggucuuaguucccuccccggcagcacugaucuaggaaggggcugaugucuccaaaucuccagggcaccaaggucagucucggggcugggagaagaggaaaacagaagcaaagagaaaacaagucagagaaaccccgcagcaaugcgcccuggguuaaccaugcaaaauggauugcgguagaaggaagccacacuaauucggggagagaaugcuuucccagggcaaaaacacauuagaaaccugccaacaccacagcccucugaaaacaguguaucaacauugccuuccagccuggccucagagcaggaauuggaaugaaguugggaugcuuucuaauuaguuacugagcuauauacacuggguggcugcucuaaguaagaaauaacagagaaaauacuuuguuagucacuuaaaggcaagccaagcuuuuacugccaucuccaugcaucugcaaacagcuaggaaaucaaacuaaaauccuguaggacaguuuucguuuuuguuuuuuaaaucuuucugugaacacggcucuuaaagcaauggucccacugguuuagaagagguaccaggacuuuucacaaagacuaugguaaaagcgaggcuuaccaugccgucagagcaguuggagguggggcuggugggcucagagcagcucugucccggcaggcuguaauaguucuccaccuguucccucagcagcuccuggaggcucucaauguagcggauggcauuccugaggaucuccaccuuggggagucucugguuaggguuggugguggugcaccucuugagcgucucgaaagcuugguugaccuucuucaggcgucuacgcucgcgcaugguggcggccuugcgccgauccaugguaguggacuuccucuugcaagcuuugcaggcccacaugaggcaguggccagccuggugguggccgguaggugcacgcacgugcuccucaucgucugagcccugcagcucagcuuugugugcuccgaaggcugcuacucuuggcucaaacugguccccaaacucauccucuggugaggggauacaggagccuucauagaaguacucagaaggggagaacuggcagccguccgucauguccauccuucagagaagcaggugggaauaccuggauucagcagagagggagacacgccagucccuggcugcugcaggccagcaaauccaggcggagcucccggaguuugggacugucucucuguaauuaacaaggacagaugccuguuggccagggucggucaguggcugagguuggggcucuuuauauauuccugggggaugggaagg

SEQ ID NO: 5729 - RNA, 122418 nt, Mus musculus
agggcgccuccccggccgcgaucucgcgaaguuacgcucagccgggccgcggcugacggacugacgggcgggcggccgugccgggggcgggagggcgucugugguaggaagagaggcccgcucggccgggcucgccccagugcucugugggauacuggaagucucgagcgucuccuccccggcucgcggcuccgcuccgcuccggccccucucucucucucucucucucuuucugucgccgacgcggucgcauacuccccccggcggcguccccucgccgccgccgcccccuucccccccgccccagcucgcgauaagaggagccggcggcuggagaggggaugaagauggcggacgcgaagcagaagcggaacgagcagcugaagcgcuggaucggcuccgagacggaccucgagccgcccguggugaagcgccagaagaccaaggugaaguucgacgauggcgccgucuuccucgccgccugcuccagcggcgacacggacgagguccucaagcugcugcaccgcggcgccgacaucaauuacgccaauguggacggacucaccgcccugcaccaggucugugugcccggcguccccucauccggaccccggaaccccggggcccgcuguggugcucgcgcccggggccggggcugaggccgggggguggcgggagacucccugcuugcgggugagggggcggcuccgucgcgggaggcuggcuggggcgcggggcuccgggccccccuccagagccgcucgcccgcagccugugcaguuuggggggggacccggccgauguuccugggcgcggggcagaauggacugugguccucuugggggccuccagggccauuuguggacaugugucugggucugguagucugggucaagccgagccggagaguaauggguugugccgaggcccggugucagugauagaccguggggcggggaggguuguugaaaaaaaaaaauccacuaacagggacucuuggggcagauggagcccacuggccuggaggugggcauugguguugguguacauuuuuaggacuugauuacaaaugaggaugaugauauuagugaucccgaacccuuaaagcccgaacccuuaaagccgggugccccgagcgaacgauuuccuguuuucuccuuuauuacucuuggucacuggggagggggaaacgggguguaauuagcuaauccggaguggcugaaagagaggggauugguagugaaucugauaagggaagucuucccgagugggcuugcccaccucguaacuggagucuauggguuccuguacucgaaguuggucgcagucacagaucccugaguccuggcuccuggagugcacaccggggcuagggaagaugggaauaaacacuguguacuccucaaagacaguugccaaacuuuauuauuauuauuuuuuuauuuuuuggugguggugguggggagggggagagaaaaaaaaaaaaccaaagcuaaucacaaccuuuucucaaaauggaugcuuugugcauguuaaaguuuuauaguaguccgauugggaucucucaauguuagccaaauaaggagaaacuauuggcaauccagagauaauguugcuuugccuuuaacaagccaaaagcaacagaacccuuagaguucugcuugaaaagcaaguuuaaagugcugguaauagaugccacgacagauucuuucuauuuucauauuaagaaacuuggaauuacuaggaaauuuacagugaaaaagaauuuucccgcuccccucagacuccucuugguugugugggagagcauagcucuauuuugaauaauagugugguuaaaaacagagguugaaaccuaaggcuccgcacuuuguaccuaaacuuuauuauuuugugccuguuaacuuuauaccuuuuaaaaagacaugguauggaggcauuuuccuuuuauuguuuccugcuuuaauaagugaugaccauuuaaaguuuuauuuaaucaaauucacauaucaagcuuggcguagccuuuguuuacaaagcugacuggaagggcugaagugccugacaaucugcaggacagaucuggaauuuagaauggcaccaaaggaaaauauagggugguucucuaauguaaugcaaaguucauuugcuuacagcuuaaggcacauuauaaaucuagaucuggaaacaugguuuugagaaggaaaucaccuucagcauuaaaaauuuuuaucauauaacauuaaaaaaauaaucuucuuuuuucacauguccuuggcaaguuuaaaugagaaauugguucugagacacacuuaacuauaugucagaauaauuggauagugguuuauaucagcauguuuucuaaaacuaaguagaagugugaaguuuauucccuuuggagaauuguacuggcuuagaggaagaagacaaugucuaacauuuuuuuuuaauguugcaguacuaguuuagauaguugaaaagacaagaaauuggcuuuuaaaggcuuguguuuaacaguuuuuacuuauuuaaagaagccagacuuaaugauaucuucuugauuaacugaauucagugguuuagugaauguagguauagucucuaugacugcauauuuuguuugaguugacaggagauguuucuaaguuuaugccauuuguauaaagcauuuuuauuugcaguugguguggagcacguuccuuaaaucaaagaagccaaagucccuaaaagaugaagcauuguggggcuggagagauugcuuaguggucaagagcaguggcuguccuuggagagguccuaaguucaauucccaguacccacauggcagcucacaacuguccuguaacuccaguugcagaggauccaauacccucaaaaacauacaugcaggcaaaacaccaaucuauguuaaguaacugauuuuuaaaacgcagcauugagccgggcagugguggcgcaugccuuuaaucccaacacuuaggagacagaggccagcuagaucuacagagugaguuccaguagccaggucuauacagagaaacccugucucaggaaaacaaaacaaacaaaggcagcauugaaauguuuguguuuucuguauugcucuccuuuucucauacuuguuuuccauuaugacugugaagguaaggacuucacuuugagcgaauuagggacacaccaguuagugagaugugagaaguggaaccccugugcuccucuucaugggaucuuaagcuuuucagagucucuccagugacaaucagcacuugucuucuuuagcugacaauaaaaagacugacuuggugacugguccuuaaauauuuuaauucugucaaaagaucacaaaauaucgaaagucuuuuaccagucuaauuuuucuuuagucuguuuacauauuuauucacucaccuuuuguuggguagaauagccucugguucacaggucaaaagcuuugguccuucacaucccacuuagcacccugcuauuuuccuuacauuugaaacgcagguggucuguacuuaaaggguuguugguuaguugguuagugaaacuacuucccagcuucugcucuucaucccucccacauagaaaugccauccauauggagagaaagcaaacgugggucuuggucuccagacugcucuuccuccucuuccaaguguaggauaccgggccgcucucugacuuucuaaaccuaaggucuggagggcuauuucaguuuugcuaguuggcaguuacucaccgguagacuuuuacuuauagcaugugauuaugccugcauuuuagcaugcuguguaaacacugucaagauuuguaggguuauggauagaaugccuuuggcugguccuuacuggcaugccuaaaaugcaagaguggcauguuggaguuuagcuuuuuuauauacagucuuaacuuuuuccuccgugccaaugguuuucaagucaauuuucaauucccauucuucuacagcaaccaacuuacuaauuuaaaauguauuauaaugauauaauguaaucuuuagcuaaaaguauauaucuuuaaguagugguguaugugcagauguagucccuguggcuauagguuaaagcuucuuuguuuucacaaaacauuucuuuaaggaaucuuuacuguucagaaauuuuuuuuguaauuguaacugaguuucauaaucuuuuuuaaucgucuauuaacuguuuuucuugucuugagaaugaauagaaucuuuuuaugucauuguaauauucagcuuuaguuuuaaaccaucaugaauuucacccuacaguuccaacucaaacucaguagagauacugagcacugucuuuucauugaccccucuauucuguuaauaauguugucaaugucaagaugaaguuaaggauuucaguuccuucacucacugucccugugaauguauguccacucagacgccuggcuuuucuucaggacuaccuuuguauuacuucuuuucuuugcuacuuugauuaucaaccuguuccaagcaguuauauuuuuauccuggcauuauacuaacaauuugucuuuccaucuuucuaugugcauguaugcaugcauguauguuucagucugagaugcguauggauuuuagaaagaucuuagcacuccuguguugugccucuccucaguguagguuuaaaacuccccgucauuagcuuaugcuucauggcugugggauuggugacguugaaucuagaucuuuacuuuucuauuucuaugcuuuuaguuguuucuuucccuccacuaaaauacccuuacuuucuuuaccagcucaguuuccuguaagguuccauccaacugccaaccgcuuugaaccuguauagcugagguagcgagacugcgcuccucuggguucucaguacucagcguacucaugcuccggccggccuuguuuaaaaacacuucuaauagugucuagaagcucacauuccaaacuagaagagccaggaccauccuccuauauauuuaugucuccaggggguccugacacacuaacauuuuuacugaauuguuuuauuuccuuuuuauaaauaaguuucaugguuauuuguauacauauuugaagacugcacguccagauauuuagaauacugguccaauauuauagaaccugucuuuuuaugaaacaaaugaaaaacuuggaaguagauguuaaguacauuucuuuuaauugguaaaguauuucuaaguagcguccccuucuauuaaaaaguccuaaauccgcgucuaguuuugguuaagugcuagaaaaugcauucaguuaacaacuucauaagaaccugagguagauucuguagugaaauccaagguuaaauggucaguguucuuuuguaauuuuacaguaauaccccccaccccguuuccaacuagacagacuugcagauaagcuuaauauuaaaucauugugcucuuaaauaaaaguugcauaaacuuguaagggacucauugaaagccucuuuguaaaauguaggaauaguguaguguaguuuuuccuuaagaagcaaagcauuagacaucaaaagcaguugauuucgaguuccuuguugcagaauaauucaagugcuaucuaugagcagucuuuuuuaaacugaaugcauuuucaguuuuuaacuuuuaccucuuuuauuuuugucauuagauguuacaguuuuagaaguaccuauuagauuaauuauaaaaguauuaaacuuaguguuaaaaauguacaugaaauuguuuuucuguauaccuuuccuuuagaaaagcugugauacuucaugcuaauaauggcucauagaagaacuuuuuauugaaaucacccagaauccauuuuuaaauuuauuaaacaaaucuccaaggccacacuggucccuuccuucacaauaaauugguaguguagccauauauggggugugcugcucugcagagcacugcacugcaaugcuuagauagaucggcuucccugcacuugcuggccccgugcuuccuggcagcacuucuguggucugacuuugaagugucauaaccaagacugucuuucaugagcuuuagcuucagugugauugcaagcugugacugagcauuuucucagagccagguagaagcagcacugggucgcccacaggaaacgugggccauccuucucuucccguguuucccaugcucuggucaguaagagaaaacauguuucaaaaucuaaaggauucugaauaaauggcuuuuagaaaccuuuauuaggcauacggacaucuuauuccuacuauagaguguuauuuccuggcacguccuaaaggugcugcuuucguugcuuuggagucuguuuacacauagccaucuuuucuuauaccuuucuucugaaaggaucgcuuuccacaaucacagugaauuacagugaauggcaguucuaaagcagucugcgugcagagcccaagcguuagcuucgguccccagcccacagccuuuuauguaguccuagcugcccuggagcucaccauguagauaaggcuggccucaaacucagagauucuccuguuucugccuccugagugcugcgaguaauggcaugccaccgugccugguacccuaacuuaagccugaagaagaaaagcaauuuuaaauauuuuggugauuguauugaugauuacuauuugaggauuuucccugucaaucagcuaaaugaaaaagcacgaacagauuuuuuucuuaaucuauuuuuguuuuaacuaauacuugagauuuuuuuaugauaauuaaaauccaauaguaauauguuuaaauuauucuagaauucaaaauuauccuaaauuuuacgaagugcuaagauuuuuuucugaccauuaaauaaagcauacuugauuuuguuuuguuuuauuuacaaaggaaauuacuacaaaaauauuccuuuuuuuuucagaauauagaaucuagcuuucauuuucauuuuucuacuagggacaguuuauaucacuacauuugcuauguauuuauuuacugugauuuuuauaccuaagugcacauucggugcuuggcuauaaacuauaggaagcucauauuugaaauguuaaagaagacgaucucagcugggcauggacgcaggccuaucuuuaaccuuagcccucugggaggcagaggcagguggaucucugaguuucaggacuacauagugagguccugguucagaagaacaaauaaucucaacuugucaacacugugcagcauaaguaauucaauuuguuuuguguacaaugaucauugauauuuguaaacagagcaaucaaaauacuaauaauauuaucuaaaguguuuucugagcugguaaaaugagcuuguaaguuguugaucauucuugacucuaguugggagccucuuauuaacaagaauauuaagcuguauuuucauuccaugaauuacaaaguguaacugaguuauaauucuggucuuaauuugaaaaagaugaaaggauuuuuucauuuugauaaaaauguaaaaugugauuuacuuauggcucauaauugauucucuuauuuauaugaacauauuuaucucagucacuaaaagaacaaaaucuguauuuuuguuuugcuccaucagcacauuuaaaacaaguaguuugaucaucugguagcauuucauaaaguaaggagguagcaucaaaauaaagggcaguugagauucccaugccagucuauaaaauuaucaagauuggcgacagaugcucuuugugcuuuggugaagguacaguugcagcuaaggaugagcagagcccauaacacugccccgugucccgcuuuuaguagggcaugguagaguacagaugguggcauucuauauccgaguuuaggcacugcgucucuuggauacauaauaggaaacaagaagaagcuuaucuaaagggauucagagguugguuggugaaagacauugggaaccauugguuccauauuuacauguuuccauaagucuuugugcuuguuguuauccucugggaaguguuucccagauuauuuuuauuaaggcacugcucaaagcacagagugugaaguuuugaccacugaagaacacugauucucuguacauucuauaccauauguuuagcauuuauagacuaccugcuauuagaaguauaucuuaucuucagacagaauagaaaauuccuuaacaucguuuucugaauugauucuuucucuuaauuuuucuuugaauuuuauuucaguaggugcagugucuuaauuuaaaaaaaaaaacugaauauuguaauuuuaacagaguucaaagaaaaugaacugauaaguuguguugacaacucuaucaagauuuacagcauuaaaaauguaucagaggcaagguauagugacauacaccuuuaaucccagcacuugggaagcagaagcaggcccagcucugugaguuugagggcuagucuggucuacauaguguguuccauuacaguuggagcuacagugugagcucuugucuaaaaaaaagugucagaaaagcacauaccaacaacuuauguuuaaguauccauuaucacagugcaauaucuguacuuuagauuuacuuuaggaguggaauauaccacugaucaccaauacacguggaguuugucaaguugaugucaucuauuuuaaaaaugaguaucuuuuaacaaaucuuuuguauucauuuaggaaaggauuucuugguagcauagcaauaaaaguaauauauacauuguagugguucuaauuacagagucuuuucugaauguuuucauuauggauccucauaugccagaauuuucugaccucacuaguauuuugggugcuuaucuuuucauuguugagcuggcuagccauaaaaaggcaggcuucgcuucuguauuacugcccuccaugcuuggcugacucaaauguucuuucauggguggagacauuccacguugucaugugucauauaggcauuucugaaaugacauucacuagaaaccaugcaaagcagugaaagcauuucucucucagcugucaccuuuuuaaucuauuuacauguguugugugcuugagaaagcgagagucaguggacagagucuuaccuaauagaaagccuuagcuugaauauuacuucauauugaccugauugcucuuugguuuaacacagucuccuaaaagaauuuaagauugcacaaacuguuaacuuucugcaguauuugauaauaaaaggagauugaauuugaugaggugugaauuuaugccuucuuauuucuucacaaacuaauacacauguuuacauacacauuuacaaaucacucuuauguugaaauuacauaugcacacacauauauccuucaaaauuguuuuagagggaaacaucuguacuuagaaacauuuauugaacuuguggggcaucaguucuagaacauuuuuaugcauauccucuguagugaagcauagucacgaaaguuacauuguaaaauguugaucauuugaaguuguaucuggugaauuagauugugauaauaaugguaucaguaacuacauauuuucuacaaaacuuauuuuaaaauuguuacugcuugagaauuuuauacaugcacauaagguguuuuggucaaaugcacccccuacccuccucccugcuucucucauccugcuaucccugucccaucccaaguucauguauuuuguuugcuaaauccaccaagcccacuuagugcugccaguaugcauguagguagcuuccgugaguucuugugggcagccguccuaucaggucaugaaagcacugcuuucucucuucugagccuugggaggaggaagucugauagagauguccuaccauagccucuuaucccugcacuugacuaguggguuucuagauugauugccaucauugcaaaacaaagaguugaagagauaagaacuuagggaguuguuuaauucuauuuccauuuagcaggauaauaauauuggguucuucccugcggccuguguccugauauccauccauggauuccuggaccuguuagugaagccaggcaugcguucugucuuguggugcagacuacuaagcuuauuuuaaauuagaacaggaucauaaagaggcccucagaguuuaguuaacucuuagcacaguuucccccacuggauguagauuguuucagaauguauaaugaaucuacuauacucucuuaucuguguccuagguuuuccaugcaacaagucacuguugcaccugacaguuugaauauuugcguauauguuuuuguuccuaaacaaaguuuugaugcuuguguacccagauuuggaugcuauauuuucuuaacauuuuuaaagagaagacguguuucuguauccuuccaaaguacauugggaagucuaaacaaaaauguagcuucugucuuuuccuuuaaaaaugccuauuacaacuuaaucuuuucagccaucauuuuucacauuaaaacgucuaagcucacugcauuuaucuuagacaugagaagaagcuauagguaauuaaaacagcauagaaaaaaauagauguuuagugcuaaacauucuaccucuucaagcuagucuaguaaacucacguuaauaugaguaugugauuaucauaaaugggaucauccuuagguuuuugguauauaaccuauuuuaaaaauugcacaucuuuguuaaucagcauuaauacacaguuuaccuuuauuggcuauaugaaucugaauuuauuuuucuaaauugaugaacguuuaguaucauuuccacuuuuucaugguaugguaugaaagaaaauacuauacuuuguucaucuuaacucuuauauucguugaauugcuucuaaaaaagauguuaucaaaguuuuauguuuugcucaaaaugcuauguugcuuuuguacuuguuuauagaggacacuuuucaguaaagcuuguagcguauggacuguggaaagcugaccuugaccaggcugcugcugacacaucuguaaaaccaugggugaggucauccuccagccgucacccauaggaaaacuauguuauuguuuuauuacucugugaauguguacaauucaugggguucacucagagaaguaguuggaagagacagaagaauuauuucuugcccacuuuucuuuuuucuuuuuggaguguguguacccaaauguagguguagaagucauaagacagcucuggguguccaugcuugccuuccacuuuguuugcgguggcaacucuugcuuuucuacugacugccggugagguuccagggauucucuugucucugccugccagauccucuugggagcagugguauuucagagguucauguuacguaucuggcuuuuaucuggguucugaggacucugacucaaaccucacauuugcauggcaagugccuuuacccacagccacaugccugagucaccucuuuacauagauuuaauuccaggggacugaggagauggcuacucuuccagagcaucagggugcaguucucaggaccuacauggcagugcacagcugucuguaaauccagucccagagaucagugcccucuucugacgucugcaggucccaggcccacauguggaacuaauaauuaauucaccuaaaaagagguacaucauuuuuaaaaagauuuaauuugaaauauauguuguuaaaaauguuaacaugaucugcauugguauaaugccguuacccauuuaaauuagaaggcaacuccaugcaacaaauauuucaaucaucuuguauuugacacuuuacuaaucucuuauccaguguccagugugcuuuugauuggcauuuguuaacaaaugauaauaguucaguaacugaaaacauacaggguuagauuuuuuuuuuuuucaaaaaaggacuuggcccaaaauuaaaaacaaaacaaacaaacaaaaacaccuauuugaaugauaaauaacuuauuaauuuauaucuuaaccacuuuugaaccuguuuccucugguuuguucucagaguucuuguucauuuucuuucugauccacuuuucuaauuagggaugaguguuucuaagacuauuuugucuauuuuucuuguuucauucauugcuguaguuccaacuauguucugaaaaucuguccguccuuucuuucuuucuuucuuucuuucuuucuuaucaucagugacagccagggcaggaaccuggaagcagaaacugaagcagaagccacggagaaauaacugcuccuucugacuugcugcucagucagcuuucuuacagcaccuaggaucacgugcccagaggugacaccacccacaaugccuugggcccucccacacuuaccauugauuaagaaaauguacuacagacuugccuauugaccagucguauagaggcauuuccucaguuaagaguucuucccaaaugccaccagcucguguuaaguugacauaaaaccugcuagcacaguuccagacacuaguaagugcucagagauacauuucuuuucuuuucuuuuuuuaaaauaaaacagauuccaauaguacucuuauguguucaaccaaguagaaguugcuuaggcuucaggaaaacgcaaguuaaaaccacagggagauacccauuucacagccuuuaggauggcuguaauaaagaaaggacaugcugccuagauaauguaaguuggaaccgugcuacacuguuggcaggaauguaagccauguagccacuuuuuaguuauuaaauuuuuaauuugugugugcgagagagagagagagagaaagaaugugugcaaagacuggagucagucagcucuugccuacugugguuugagggaaucagacucaagucaucaggcuuguauggguucccacugagccaucucagcagcccaacucuuuaaacaaucucauuucugcauauggccuagcaauucugcacuacauauauaucuuuugauauaucugcaagcauguccacauaaaacccuaccugucaguauuuagagcagugguacucacaauagccaaaacguagaauacaaaucuuuaucagcuaguaaauggauaaagggguuuauuuuguuacuacaaucagaagccuauucuucagcaauaaagugaauaggauacugguaaauacuaaauaaauaucuaaaacugcugaaugaaagaaaccagucacgagagaccacaugcuguaagauuucauuauguuaagugucuccaguaggcagacauauauguuauaugcauuauauccaaguaaacuuagguuuuuagagcagaaauuguuuauuuacuacuagaaauuggaacauuggcugucccaaaccuuaugguaaccuuggcauuauucaguguagcuuuuauagcaagcaagauagucaauguugccuuucuagcuugcuguccgcuagaguguauaggcaaacauccaggcagucguaagucucuccuuaugucuagugaccugaaggggucguucuacaguccuguggaagcauuuccacacacugacaagcccacacuagagucagggacuucaguuaccccaagucgggguggaugagagagauguuugggagacuaccucggagaauagcauauaaagagagagagcccuggugcugagcagaagugcugaaagacuuuuauuuuuuuaucuguauaaaugagauaaucacauuuuuuuuuucacuuaaaaaaaucgccuuugcugcaguguggacagugcacugagaaaaggauaagccagaggcaggggauacaauucaaagcagaguagucugcaagaacugacuugcuggcaagcuuaguagcaguuggguuagaaaacagauuagcuaaagauauaguuaagacaaggaguuagugaacaugaaaagcagcagaacaacgugaaagaguggaagcaaagacuugugugcugugcauucccauguggcucuuuguaaaggaaggcuccaugcccugcuacugcuuagcuaacagagcacugugcaagaaugacugauggagcauugacucuggaaaguguucagaggauguguggcuuuugugcuaguagagaugaguagcacccaugucccuaaugauauguugaauuuggauggggagcagggaguugaaccagucgguucugugagcuaaaauuugaugaccaaauaaaacaguauaugaaguuauagaaaaaaacacaagaauucauaugccuaaaauaaauucucugucugucucuccucuccccucaaguuuucuuguacauuucaguuuugggauauuuuaugauugcugggagguguggggggcagguguucugagggaugugaggagcgacauacagaguguggaagaguagugagugauuggagugaccacaggaaguaguugccauguauugaauucuaauauaauguuuucucuuuuccacuuaucuugauguuuaaucuucuuugggagguaggugugugugugucugugucucaugugugaaaugaacugaugauuugaaaguauccuuucucgaaauacuuuaguauaaaaagacuacuuaaaagacuguuacagcagaggacugccuggucucuucucaguaagagaagacacaucaaacccgcaaaagacuugaggccccagggaguguggagguuuggugggguggggacaucuucuuggagacgggagaggagguaugggaugaggaacaguuagaggguggacugggaaggggauuaagacugaacuguaaaaaaaaaaagauuuaauaauaguaguaguaguaauaauaauaauaauguguuguauuauaccauguggaggcaaagcauuuguguaggaccaaauguggauauuauuuuagcuguuaacacugacuaaaauagacauuuuuacaauuaugucaucucugagaguuuuacuagcaaaguauuaaaauucuguucagacaagggggaaauacuuaaauggcuacuucugguaauauuuuaaggguuaaauauagauacuuggacacaguuggugacuaucaguuugcuaguuuguuaagggguugguguuaaaggguacaugcuuauuucuguauuauauuuuuuacccuucuguuucaugaggauaggauuggcaguuugauaggcaagaugggugagcuuugaaggguuuuuuuuguuguuguuuuguuuuguuuuguuuuguuuuguugagacaggguuucucuguauagcccuggcuguccuggaacucacuuuguagacccuuggccucgaacucagaaaucccccugucucuuuuuuuuuuuuuuuuuuuaagauggaaauaauguauauuuuguugcucuuggcugaugaacucagaaaguucaaagacaaguugauuacuaaaaaggcagauaauuuucagaggauacugaauuuaaaagauaucauuugauguuagaauuuuggacaauacuagcggaagagauguagacaaaagaaaaagucuguaaagcaguuuuuauacagugaaugcuauugcuuugcaaacuauaaauauaagaauuugguaaugaauaaccauuuuaagaauugauuaggaaaauagccacaggucucuaaaaacuauaagugacauuaaagcucagcauaaugugaauuguuggaaaacauuuuugaaucugcugaaagaaaaugcuuguugaguucagguccugaguucagguccugaguuccgauccuuagagccuacagaagaggcaguaaaaggcucaguguggcagcgagugucuucagccccagcaugggagguagagacaagggaaucccuagaguuacuagucagccagguucccagaaacaaugggggucucaaaaauaaggcagagagcuauuaacuauugaagaagacauucucuaccaaccuguguacaccacacacccagacuguugaagaauaauguugaaacuuacaaauuagaagagguuuaugagaccccacccccucuccaaguuagcugagugguuagugguugauggggcgaaggguugccauucucuuucuagugauugccugugcuuuaauagauaagcccauuuaugcucaugcaaguaaccacuaauuaaacccaauggguugcacuaaaaaaagauaggaaaauagggugaaggucuccggagaaguguuucagcaagaagagugacagagggcaauaaaggguaaaaauggugaacuucaauacauguauuauaaaauugccagguaauuuuuaaaaguuauaaauuagaagaagauaggaagaaggcaauaguaugacauuugcauguacaguauguacauuuauuguagaagacugguaaaacucaaguauccauugugucccagaucauucuggaggauauuguacugguuccuagaugcccuauugaguuucuuuucaacaaguuuguugaccuuuucaaaaagacuuuguguguguguguguguguguguguuguguguguguguguguguugugcacgcgcauaguguauuuuuggauauuagaggacagcuuguugguucucuuuuuccauuuugugaguucccagagugaguuucagcuucgguguaagcaacuugacccacugagccaaaccgcuggucuguccucuuccuuuuuuugacaacguuuguaaguucaaaggagagaaauauugccaacuaaguaugauuucacacuaguaggacuugguuaaguucauauugccuuuguuguuaacaugccacaggucugucacagacgucagccaggaccagaugguagcuagcaccuggauaacuagcugccacuauguuaguuuuugauaguucugugucucugugguuuucacucuugacccuguguuagcuagcauuuuaaucaacacagcucaagaacacuuaaaagccugcagaaaugaguuuuaaacaauaagaugaaagaugaugguauguuguaaaacuacauuuccaaguugccaaauguagguugaaaucauugacagacaugagaagcaaacaugugcagagacaggcuaacauuggcuuugccuuuacuuaauuccaucuuauuuuuugagguacucuuuccuuaaacccagaacucauugcuuaacuaaacuggaucacuagugagcucugagcacagucuucauagacaacucauauaggcccuuuuccuauccuaugaaguuuucuucuuaacagcacccaugauaaauacauuuaauaguuuaaaaagauauucuuacccucuuguauuaacaaauguggcauugaaaauggucuuaguucagguugucaaguuuuugauuauagcagguucuuagauucuugacuguggaaauguauagcugcaucuguguuucaauguguaacagcuucuuuuaggcuuguguaaggauuguuuauugcggugaacaaagugagguacaguugugagugcuguguugcagagcucagagaugaacuuggauauagugcuuaaacacuuuucugaagugacuuucaacuguuugaaccagauccuaucacuuucgugccucaggaaucucuggggcuuaauuauaggacaguugauaggcccgagagaaucuaguuggcccguuaucucuugaaacugaaaaagccagcuaguucaagagacugcugaaggaaccagaggccucagaaggcccagcuuugccucugcugcucuggaacaucuuacuuaggacauuagguggcacuggguaggaaauagggaucuucuugguucacaguuaauuuuuauaacauuagcccuugcucucauuuccuuaaugcuggcacucugugggccugcgacguucuuuuucgaugcguauaucaggaaguaugugagcuuuagcaaaagcuccugucugacuugguuuccaaugcaugggcuuauacaccugcucuucuguuugcucucauggucugucagguuuuccauuacuaaaagcuuguuuguuuuuuuggauacucugacuccaaguuuagaacuucuacauuuuacgugacuggggaugacagggagaugaaaacaaaauccagcaagaaaagcaguucugaguugcagcaaaaaauaaaaaaauuuuaaaauucacuaaguuuuuuuucuauuauuaacuguucuuuuccuauuuuggaauaaaguggaacuaaagccuaaacuagauaagguagugauuaaagaugcuuauagcaguacaaguaauaugcucuucaaagauaggaaauaauuaauuauguagcuuuagcuguuacuugcuggaaauagaaaugaauuuucaggaaaggcaauuuuuuuaaucacucugaagagauauuguuuggaggaagccuuuuauuggaaaaaccaaucauguguuaguauuguaacuauuguaaaagcuauucagauuguuucaucuuuauuuucuauuuaugagcauuuugcuuacauguaugucugugcagcaugugagcaucuggugccugcagaugcaggagaacuggagugacaggcgcuugggagcuaccaugugugagcugccacgugugagcugccaugugugagcugccaugugugagcugccauguggugcugggaaucaaacccagccuucuggaagaacagcuagugcucuuaaccagugagcauuucuccagcccuuuggacauguuuuuauaaaaaauauucuguucuuucagaaauuuacuguagccaguaguagucugguuuccuuuuagguucgcuccauuagaaaugcugugaaaguuguaucaagccauacaacucuaaguuauauuagucuuccaguauuuaaagaauacauacuuguacauacaguaauaaaaugaaaugaaguguauccuuaguaggaguacgucauggaggaggugugcuuaugcucucaagcaagugcuuuauuuaucaaugccuuuaucuucucuaaacaaaacaauauaugauuuaauuuuuguuuuaauuucgugugugcacaugcacacagacacacgcauggagacacacacacaugcgcgugcacacacagcacaucagauaagccuauggauaccacacgagaauguuggauaggcuguggcuagaguuccagucaguuaugagcccaccugacaugaguauggggacugaacucagguccucuggaagggaacaagcauucuuuuccacugagccaucucuccagccccugauuugauguuaguguuggcuaaaagccucuggacaucuaaauuccccucuugcccccaacuuugaagauagcucuaaaguucaauauuauuuuuuaguuauguuacuguugaaaaaaauuauucuaaaauuaaggaaaggauuggccugauguuaaugaucaagguaauuuuuuaaacuuuuuaaaauuagaucuuaaauuuuuuacauauguguaaaaauaucuuauuuuauauagcauacauacauacauacauacaugugaguguuuuuccuauguguauguauguguaccaugugcaugccugguacuuguggaggucagaagaagccucagaugcucuggaacuggagacagaucuuugugcgacuccauguuggugcuggauaagaaugagugcucuuaacugcugagcagccucuccaguccccaguugggagucauuuuaccaaaagacauuuuaauuuuccuuuguauauauuucuggcagggacuuuuuuguagguaacagucauacaucuccaucccuucuuggucuggcugcucacgugcacagaugugcagauagauagccagaugaguagagagacuacgaaguuuuaguaggcaggcagcccuguacuguggcauauaauaucuaugauguuuaagccuauuuuguauggccuugcucauuauuuagaaauacucacauucuguuaaaauucagaguauacucacccggaagccaugucccuaaggugaaucauuagagguugugcagauuccgucugaaaaccauuucugaaucaugggcagggaccuaauucucuuaucuacgauagauuugugaacauuaugcuugggccuuugaaaacugggcuuguaagacuauuauucaggauuuaaauacacugccaucugcugacagugcauuuuugaaauuguguauguuuacucaaauuguaguaagcacuuagagucaucaauaaccaaaacagacaaaaauccuggacaucuuguguacacauauauucuguuuccucaugccuuuauaauauagauagauagauagauagauagauagauagauagguaugacauggcaccauugugaaaaaucagaauggggaaagggaucaaaaaagaauaagauaaaauuacuagguaguugcuaaaccuuuaucaucuguagccuuaguucauagauauuucuuaugggaaacccuacccccagcuuacucagaaagaguaaaaacauuuugcuaaauauuucaguucaacugacaguuugcuugauuuacaaaacucucugcuguaaaugguggaaggaauggcuaauguggucugugcauaagcaacagcacacagagaggccugagagguguaccacacacagugcccaccugcuguguccaccggaagaguauaaccuagucagaaaggcgaacgugaccaaccucugucagacauuggugaguggagggcuggaagagcucugcggaugaaguuguaaauugguacagugacuuuaggaaaauguuagggaguuucuuaugagagucaauguacauacacugugcagaauucaaguuuuuauauuuacccaagagaacaagacaauaggcuuauuuuagggauuuauucuucuuauuuucuguguguguuuugugugccuggugccaguggaaugcagaggaggacaucaccuaccaccuacucauaaacaugaacauucagaggcauucuucagacaucuuuuucuccuaauuuccacuucaaaguguuuguuuuacuaauugagguuuggggaaggaaaauauaugaacacaguuggucaggugggcaaauaaaugaccauuuaagaucuaugcauuugcuuuuguuagggaauauugaagaauacauuuacugugauagacaaagaaggccaaggguggcuuuaguuaaaaaugucaaguuuguagugaggagggcugguucuuagaaugauaccaccagcugaccccuuuacagguaaagugauaacaugguuaauuuucauuuguauuuugcuuaaagcauguguacuaaguuuauguuagcauuauucaaauaauauaauuucagccaauuuuaaagagguuuuuuucagagaucccuauuuuauucauaauugaaaaauaucuguuguggagacuaaauuugggguucuuuagcaugguuuauaaagugaauuacaacuucccucuugccuucuccuauauauuaauuuacuucuuucuaguaauuugcuauuuuuucaacucauggccauuugacaauauuaaguguucaguaccugacauacugcuauuuuccucccccuuuaaggaguucuuuuuuuaaccuuugcuauuuuauuuuuuaagcuuuaaauuguauuuccuagaugucccauuacugcuuaaacuguugccaguuuucuaaacuccugcuaagaaauguggcaguugccauauuaaagaaggcuuauccuccuuccuguuuauaacaucauuuacaauuugucuuuguaggucagucauagagugccuaaggaaaugguuaacggccaauaauuauugaaaaguuacacacgauagagcagugugguaaaguaaaaagaggaaaaaaaggagcaagcugauuuugguauuuuuaaagaacuuuucuggggaaaacaugccuuauuagaagcaacauuaaagaaagagaagugcucagcucaccugcauaugcguaugcuuuuaugucagcgugaagagcugcaucugauacuuucauguguauuagagcuagcguuguugagcuguauacauaacuaacauuuguaaaccggccucuuuuacaucccucuguuuguccucguguacgugaaagguaagcuaccuguagauuuguaaguaauaaaauaauaaugcaguuguuaccgggaaggguggacaugccugugauccuagcucacguguggcugaggcaggaggaugcuuagucugggcuguagagggagagagggaauagugggaagguguucauugugugaguacuucucccauagggcuucugaaaucagcuggaaagauagcuucauguggguuucuaagucccguucuuguaaagaaaggaaggguaacgacguuuauuagauuuguuuuuuuuuucuuuuuuuccagaagucaguuuuuauauuccuugguuaucuccuuuagauuuuauaggcuguaguuccucuaaaaacuuucuuccaggguucgaaacuuuauguaaaauauuaaauauaaagugaggggcgggaaagauuacuauagaacugaaaaagaauuuucacauuguuuaagcacaaggaccucacccauaccuauguacuguuacuuaaggcuccauuuuuuaaaaaaauguuugguaaauuaagcgcuauaaacuagaauggaagaucaaugcuagguaaacagaggaaacugaaccuaaucugucuguacuaggcuuuauacauucauugugagcuugcuuuguuuguuugcuuguuuucaguaacauugcugggauugugagaaauacguaauaaaaaauccaggcugucuugugguagguaauucgcucuugugguaauucggcaccuauguucguguauuuuaaggcuuucaaguuugccuuuaacccccugcuuuuucuuccuugggaaucccagaaccuuauauggucaagacucagcuuucagacuuucaguaaaaugcaaggcaccacuccaaaaagaaaaaaaacaaacaaaacgcaggcuggcuuuuacuuugucuucaguguucucuucuuggcugccuuuauuaccacaguagccgaguuacucagaaccuuaugugcugcauuagaagucgucuuucugggggaaggaauuccuuuuguggaaguauuuuuaugcuagaacacuaacauuaacaaaugguccguggcauugguuauauaauuugauuuaaaaaauaaaaccgcaaagcaguuuagguucuuuugucauguuguaaaaaaggaggguauauuguaucugugugucucauaccuaggaaauauggaaauuuuugaugguacaguauugacaaagcugaacaaugaaguugcugccugggagucuuuguguagugaugcugcugcauucugaguagagcacacaggaaaagauggcgagcaugaauacguucucugagugguucuuaguaucugucacucaguuauaccauuaaggcaaauuaauauugugaaauucuuaguauuaguucacaguuccacuuaggaaaagggaagcuauucucucuguguuaaacuaaagacuauaaauuagcccagcucucauagcaagucuaugacacacucaaauagaauuuccaugaucacggugaguuacaaguagcaaagauugccagcuuacacagcuacugguagagcugcagcaucauccugcaggcuccuccuauucagugucugauuaaaguccaauagacuccagagacaacuaguugucauuaucaguauaaugacaacuaaagaagggcccuugauuuugaguguucauaguaugguagaggacaacaaggggggaaaggguagagaaagcagauagauacaagugaguaaaucacuguugguaguguuuuaggacagggguguucauguuacagaaaacagucauucagucccagggguauuuguucaagcuguagaagacguuaaagacaaaugcugaggucuaacugagcaauuuaaaggguauacuagucucuuaaccauuaccuagugaaguccaagaguguacguccuuugucuuccuccagagauguuggcauguucuaacuaguucauucugaggacugaaaagauuggaauucuugguagcaguucuuuuuuucccuuccuucuuuguaguugaacuugucucucucuuggaccuccaguuaggagagagaauuaccuuaaucucucucaggagcuccuccagucaucacaccuuguuaaaaggcgcugcagcacugaggaccaggcucacacaugaacucuugaggaaauacuccagccauagccaaaccuuagcagaaccuaagaauguccuucuguuguguuuccagcgcuagcuuuguuuugucuaagaacuuuaguuauuuuagcaaagcuuuauaaugcuugcuuucuaacaaagaaaccuguacauguguuaaaacuuuuagugggagaauucuccccaacuaggcaaacuauauuugaauuuauguaaucauugaauuuguaguuagauaaaauaacuucuguguagucaguguaaaauuuguaugcaaagguuucuccccucacauugaaauuuuuuaugacauuauaaaauuuuaauucauuauuaucugauucagagauucagaguugucaauagucauuuacuuuauaguaauacagauaaguuucugaaaagugauguuuuggaauucauuuguaaguguucuuauguguuguaaccauuuuucagcauugauccaaauucuaugauugauacuaaaaugcaacaguaguuaccauuaaauauuaucuauaauugcuaucaggaaacauuucaaaaucuuucuacagaaacauuuugguauguuuuaauuaagaaguauguauaccacacauucuguuuuaaacaaaaaagcauuuauuuugccaaagacaauaaagaauaaagagauaauuaaaucuuagguguuauuuucuuuauaacuugucuuuccucauuguaacaggcccaggcuuguuuuagacuuguuauguaacuagggaugacuugagugccugaucuuucugcuuccaucucccaaaugauaggauaacaggcuauguucccagccaugccaauuucuuuauuaacaaacuaauuuccuauaauaguaagaagauauacuaaauaaacauuguaacaggauacauuuugacaauaaagaguucuaaagggguuuauuugucgucccagaauaugaagauacagcuagaaaaaugucauguauuagggagacaucagguccucaccaguuacugaaucuggccaggccuuggucuuggacuucagacucaagaacucucagauauaguuaggcuuagaauagaauuguacuaaaugcuaggcaaauaauucaaggaaaauaaaucagcaaaaacauaggguauauaguuuuccaguucaucuuuugaauuuuugagacagucucauauagcccagguugaccugagauucauuguguagccaguggugucucucucgugcaucucccaagcugugagaccuaggguaugugccacaaacuuuucaucauaguucucuguaugacaaaucauuguagcucacuuguuuucuucaccuugaaguugcugaagaaaacagaaacaggguggaagucauuagcccucuuguauauauuacccuaaagccuuccuucugugacaguucccaccaccuuguguggucugcaguuggucuagccauauccuacugugucauauuauucuuucagacauaacuuacauguuuuauagauagauagauagauagauagauagauagauagauagauagauagauagagacauauaguauuuugguuuuaucuuuaacacugguuagaaacuuuacucauguuuauacuuaugauuuucacuugguaauaugucugaauuuauuuuaaauuacuccauaaauuaguucuucauugaugacagauauguucuaguuugauucuccgucauuugugagaaacgcuaugaccaaaagcaacuuggaggagcaggcuuacuugccuuacagagcaaguccauggcugaaggggaauccaaggcagaaaccuggggacaugaacugaucuaaaguccuuggaggaaugcugcuuacugucuugcucuuacuuuucuuuucuuugguacauccuacaccuaggaaugguccauaaugcccucccacaucaauuagcgcccaagacgauaccuacagagcauuuggacggcgguaauuccucaacugagauucucuucccagguguacuggcuaguuuugugucaacuugacacagcuggaguuaccacagagaaaggagcuucaguugaggaaaugccuccaugagauccagcuguaaggcauuuucucaauuagugaucaagggggaaaggccccuugugggugggaccaucucugggcugguaguguugguuccauaagagagcaggcugagcaagccagaggaggcaagccaguaaguaacaucccuccauggccucugcaucagcuccugcucccugaccugcuugaguuccaguccugacuuccuuuggugaugaacagcaguauggaaguguaagcugaauaaacccuuuccuccccaacuugcuucuuggucaugauguuugugcagggauagaaacccugacuaagacaccagguuuguuuaggucuuuaucaagaugacacaagcuauaacagucuguaaauuaacuauuuaaagguauugaaacuuaccagguuuucauggguaauuuugugcaugccuguuuugcacauuugugagcaugaaagaauauguuucuagagugaacugcccugucaagguagggcauauucauuugaaguuuucauagaccacacuguucagggguauuauugugccuugugcugcaacaaauguuuagucaguuguauauccuauugguuagagacacagguaguagaaccagacuugugaguuucaaucucaguccugcuagguaucagcuauuacgugaucauaaugauaauaguucuuaaauauugggugcuauggggauaaaguccuuauacccugugaaguacucagaacagcuucuagccuagucagaagcgcuguggaaagguugguguuuguuuggaaggaaggcucaguaaagaguggcuucaacucugccgcuaggaagccuccagccuccugaaaguaaagaguggcuucaacucugccgcuaggaagccuccagccuccugaaaggcuuggguuaguuuucuuuucauucucuuuguuugcauagaacacuacauuuggucuauuuauuuccuuuucuuuaagauaaugcuucugauuccuuuuguugugguuuuuauauguaugauuauugugggauacacauaugucuguacaccauguaugugucuagugccuaaagggguccuagaacucuaauggcagccaguugccagcugccauguaaguucugguaucaaacuuggguccucuggaauagcagucagugcuccuaaccccugagucaucccuccagccccuguucuuacguguuucuauuuugaagauguucaguggacugugauacaaucuugacugaguauguuuuaaauaugcuguuuaugccuugucaucucaucuguuccucucaaucaguuaccacagguaucggaguuuauaaauccagugaguuuuuuuuuuuuuuaauagauuuaagaaguccuuaagguggaaaugcugggaccauugugaaagauuuuguuucacccucaccuugugccccuaaaucuagguuaauauuuuaguccauauaauuuacaguagcucuuuuuauuuugcauuuguuucuuccugaguucagaaaucuagcuuguguucuucaccauuggauuccuagcaggcaacacuguggccacaguggacacuugauaacuguugaauuggggggaaacugugcuuccuauggucugcugaacauugaagagcauuuagaagcuauuagaugauuaaagaucuaugauuuacauguuuugaaagcuauaagaacuuuuauguucucaguaaacagaagacauuuuugaaaacaguucagugauuuaaagauguuuguuaguuaaucauuugguauguauucagacuuauguucauuugucaaaucuaugccuagaauugaaucucaaugcauaauuuuggcuauguuaagaacugaaaccagggcuuaaugaaugcgaggccaaguguucauucuaccacugaguuguauucucgguucucuuucugagacaggcuuuuaaagcuuacucacccuggucuagaacacgcucuguaguuccaccuuggccuugauaggacuugugucacuagacugcauauuuuucuguagccuguuuuauuuuuucuuuugauugcuugagaauaaaaugguagacacuuuuauuuccuccccugaaacuaauguuguuuucucauugguaaguugacuuaguaaauucuuguagcugaguuuguaaucgugaauacuaaaaucaguuucaucaaagaaauggcuacuuguguuugcuuccugccuucugcacaguccaguaguacugagaccugggguaagauuuguucuguaccaucaguuugcuuuaacacagcucuaaucacauacugacgugucuguuauuucucauaaauugcauaguagguuuugugaauauaugaagcuauaguaaaacaacauguuugagauuuucagauaguacugaacauaauuuuauguacauauuuacacacuaggucuuuaguaccuacuuauuaaggagguuaguguuuuagugugauucacuucuuguguuuauuauguacuuguggaccuuccucuaagcaguaaggaaaacaaggagaaugugcccucuagugcuagucuucagcucuacaaaaugcaugcuuugacuuguacagagugcaaaauuagaaaauuuauuagugagagaauaauucugaaauuugauucauuucauaguucuaagaauuuuaaguuucugaagaaaugguguuuccuuacuaauucuggaaaugaaaguuaccuauccucugaaaauuuagcuucaacuccagcuuucuacauccuuaucaauaaagggaagaaaacuaaguuggauuugaacauguuuuaaucuuuggauauuuguugcuuccaguguugagguauucuuauucagauaguacugagugaauguuugagcagugccuaaauuacuuuuuucauagaaacuuggguuuugcuuuguaaaacguucuuaucaguuuguuuguuuuuuaaauagucuguauuugccgucucugguuccuuccacuaacacaucuauagugucuugucuuugacaggcacuccggugguuucuaggggauguaagcugaacuuucccuuuucugaacaaggcguuucuuuugacuucaucguucugguggcuguuugggacuuacuguccugaucauuguaucguuuggcugucuggccuuuaaagggcaggguuuuuauuccaugcaccuccuaaagggcuggacagagagaagcugaggaaccuuaagcuuucagcagugcagagcuccccuugccuucauaguuagauguagcgauggccucucuagauucccacgcuggcucauuugucaauccucgguggaagaccacgggugcuuagugcuaacauaagaacacugcuuggagaccuuguuggcuaacucacaguuccucuuuugaaaugucucacuguacuuuaaaauagagugaaaccgugacuuggacaaugacauuucaguuccucuugaaacagacugugugucacacggguauauggacugguuccuagcauacccccagacugcuguuucuaucaguagggcuuuguucuuuauaagacucauacagaguuuuuguuuucacauugucuuuuuacaugccacuaacugguacuaaugauuaggcauaagcauuuuaauuauugcugguaauuaaauuuuaaugcuaaauugcuauaauuacguucauaugcaacuacuauuuuccaguugcuuugcuuuuucccucauaauuugcaugacuaaacuuauaggagucuguuugaaggagguuuggaaucucuaaggugcucuuaauauaccacuuaaaaccuccccauccccuuagaaaucauucuuuuagugguacuaaaagaaauuuggcaauuuuccacucuuaauaucauuuuauaauuuaaagauggaaaugguuuuauugaauuuaaauauaaaaaaugaaaauuuuaacgggaggauuuaauaucuuaguauauaguaaaaaggaauuuaacaguauuagaguuuauuucaaauacuguuguuuuuguaauugugauuuuuaccucauuaaacuaugugguugcuaaacacauugguuuugaccuauuuuagcaauacaauuuagugauuaucaaaguuaaacagguucaauacaaaauuugucuuuagagcuuugaccuuuuucuguagccucuuuauguaacucugcuuucaaacuuuccaacuucucccaugcacacguguaagacagugagugcagaaaucacagguacgugaguuuguugcacugccuggcucuggaauuaaaaggguggugaugucuccauagccacucacuguugguaauuacacucacugggugugcagucaguaaaaacuuaagccaugucuauuaagauuuuggaaauauauuugauucauucuguuucuuaccuuguauggcucaauaacugaccaaauuuaguaaaauauuuuaagucugcaagucaugugucucuuaaugugcugcauguguuagcucuugguucuucuagcaacaauauuuuuaugagaaugccuuggcaguuucuuauguguaguuuuuaaaugcucagggcaacacuuugaacaauuuacacccugaauuugaaaugcagauauaauacaaguuugugauaaugcuuuuagcauuacuucauguuaaaacauuuuaacuuaugaauagaauaaaaggauaaacagauuuuuagccuuaauuacuuuauauauuuaugcugcuauuuuuuauauuguauugaguuaaacauacacauguuuuaaaaugucagagcuucauuuauuguagaauagauauuuccugugugguaguguuuuuuuuaaguagccuucauuaaauggagaaacuuugaaaauaaaucuuuuucaccaaaaaaaaaauuuauaaaaaaguguuaacuguaccuuugcgguaucugccucagauaauuguuacauacaaggauguuacccaguuaguuuuacuuuaaacucagcuguauggucucuccuguaggaaaaugagauucugucccaaauggcuucucuaauuguagagaaguuuauugagacauuuagauuuuaguucagguuaauuuuagugugugauagguguucauuuacaaguucuuuauguuuauuuuuaaaauauuuugcuuuacuaacugaauaaaacaugacagaugucuuuauuauaaguugaauaugcugauuguaguuuagucucuccucugcuuaugguuuuuugauuacuuuuuucuucaauuauuucaaguuccauuauuuuaauuguuuguucauuuauuuuaauuaagacuaaaucauuuguuuuauuauuuuaaauuuuaaauuauuccauuauuuuaaagaauuaccucaguuuagguaauuuccuaucuguuauuuuuagcucauuuuuauugccaaaccuaaaaguuugcaagcuagauagguguccagauaucugagcucauauacucagaauuaaucauauuccccuucaaucugcaccgugaaacucuaauuuucauccccaugaguggcuuuucuugcccuguagucuugucauuaaccuuuauaguuuuuguuuaguuuaguuuaguuuuguuuaguuuuuuauucaggguuucaacauaagccuuuaauuccagcauuuaagguaugugggccccugaguuuagucaggccugcuugguccacauaggaaguuucagaccuaccaggcuacaaagugagaccugcuuccuuuuucuuuugucuuuuuuaaaguaaauuaaauuuucuuaauuuaguugcacccuuguuauuugcugcugcugucuagaaugaaaugaaugaaagcaugaagagagguagagauagagagagccucucgucuuuaugcuguuccuggugaucaucugagaugcugaugggauugugugugacaugccugcuuuaaagcucuguauuuuccuugugcuucucggcacuguuaaauugagccauugucacugaaggaguauaguguauccuuuuauaaagagcuauuucuuauuugauugauuuauuuguaaaaccauaauuguguuuguauuauaaacauuuguuaaguggauucauauuugguauuggugauaaucagaauggaaauuaacaaaguuugaaaaagugaagauuuuuuaggaauuugaauauuauguuagaauaucuccaguaagucaacaugggucauuaguucuuuucaaauagcauucuguaaaguacuuccuagcaugauaaaguuuucuaucacuucuuuauuuuaauagcuguguccuauauuuuacauagcuguggcccucaaauuuauaauuuugcuaccuuuaaccagugcccauaaaacaaaacaaaaaccucuacaaguuuaaauuaauaauaacugcuacaaaauauuuauggucucuuguguucagaauauauucugaaguauuauauauaaaacagagaagggagucguggauauauaugaauuuuaacaugauugggaacuuuagugcuauguaaaugucagccucauccuuugacuugaaguauuaagauacagugcccauaugacuguggacgauggcuguagguguguguugaagucagagguugaggucuggugccgucugucugucuucucuguugcuccuuccuuaagacaagaucucggugagcugcccauuguucucaguccccggaucuuccugccuccacuugcuggcuagugugguccaggugcauaccugugugcuggcuucucacaggaguaaggacgcaagcucaggcucacaugcuggugcagccgggcagcccuucaccagcugagccacguccccuggaauaaauggcguugaguaaaaugguagggcaggaauuugcuacuuuuaaauggagaccagaaaagguccuauuaaaaagcagacauuugggcuggugagauggcucaguggguaagagcacccgacugcucuuccaaaggucaggaguucaaaucccagcaaccacaugguggcucacaaccauccguaacgagaucugacucccucuucuggagugucugaggacagcuacaguguacuugcauauaauaaauaaauaaaucuuaaaaaaaaaaaaaaaaaaagcagacauuugcugguacuuggagcucagugccuaacccuaacccuagcaugugugaggcuuguagucgauucccaucccccacuagaaaauccuugaaacugauuuguugucauugcuuaggcgcuggagagauuguugaacaguuagggaugccugcugcucucacauggaacuagaguuuuccaucacccuuauuaggcagcucucgacagcuuauaaccccagcuccggggcaucugaugcuguuuucuggccucugcagguauauacacagagagucauacagauacacacauguaugaaugcaugcaugcacgcguaauuacuuaaucaaaaauggacauuuaaggaaagacucacuuuugaagugccacauauuugugaaguucucccauauaggacuagcucauuauaucuaauuaucagucaucccuaaacugguugcaaacuuggacuuaguauguuaguuacagagacucauucaugguucucgaguaucaacuuggauugaugaacuaaaaaguucuccacauuucugcuaagugcaucauaucuaacugaucugucauuuugcaucauaucuaacugaucugucauuuuacauaaguagcaaaacaaaaugacacuuaacuuagugguugugauauaggagcgccguuacaguuacagccuauuagagguggugcguacccaagccaggagccuaggaauauguaauguuguguaauggugcucuccacugucugcaucagcagauaacaucucaagagauaaaauguuagauaccagcauuagggacacugaaaccccaugauucugcucaaaacgcagugggaaaaauauucauggugaaauauaggauauauaugcuuucguuggucauuuugagcacaaggcaacuaugaaauuauguugaugucagcaauaauaaaguuuacuuacaaacagcuuagaaaagaagcacuuuguguuuuauugguuucagaucuauuuuuuuuuucuuuucccauuucagucauucugcuguucuauuuucauucccagaaaauuguuucuuuuccuaaguaugagcagacacuggugaagaacuggcuagaaucucccuuuguagcacugguuggcuuuauucgugauccucuuaucguucuguucuccagugucaagacuauaaguacaggucaucucacgcugcuaacuuguacaagugccugccucuauguauaugugugugccguguguggaccuggugccuucagaggcugcaagagagcuuuggauucccuggaacuggaguuucagaugauugugagccucaauauguggguacugaaaacugaaccuggcuucucagugagaacagcaggaacacucucaaccucggagcccucuccagccucucagacuuccuuccuuacgcuuaagacauuuugaagagucagugagauuguacuaauauuugcagacucauauauuagaaaugaggauuuaaagugucaaacaaaacuauaauaguuguguccauucuuccguugagggacaucuaucuggguuguuuccaguuucuggcuauuauggauaaagcugcuaugaacauaguugagcaauugccuuuguaggaugguagagcaucuuuuggguauaugcccaggagugguauagcugggucuucagguagagcuauugucaauuuucugagaaacuaccaaauugauuuccaaaguggaugugcaaguuugcacucccaccaucuuaguugcuucuuggccuuuagagauuccucugcugagacuucucugucucgcucuguaugccaugucuuaauuggauugucuaacuuauugaguuauaguuguaguuuagauagauagauagauaucuccaaaauauaucagauguaggguuggugaggaguuuuucccaauguguaggcuguuauuuuguccuguugccaguguccuugccuuacagaagcuuuucaguuucaugaggucccauuuauuaaucuuagugcucaagcuauucuguucagaaaguugucuccuguaccagugaguuuaaguuuauuccccauuuuucuauccuauuggauuaaugccugaagugaccacugucuauggcaaggcaagacucccaguggaaggauggggacagcaacccacccacaaaaccuuugucccaggaugugcccuuccugcaagauguacagaacagggauggaacagagguggagggaauggccagccaaugacuggcccagguuaggacccauuccaugggcaagaaccaaucccugacgcuauugaugguacuccauuauccuuguaggcuggagccuagggugugccuggguggagugguacuuggaugucuaauugauauuaauugguauucaugaagugaaagacuaauuauguuaauuuucaaaaaaguggauugcuagaaaucaaauucaccauauacucauuccagcucaucauuuugguaaaguaauuaauacucauuggaaaaguagcgaguuaucauugguauaaaugcuucuccuccagauaccuguccugucuggaaaaggacuuuaaucuguacuucuuauuuuauuccauagaauauuagauaaacauguauucaggaguugagauucuauauaauuuacauuuuuuacugccuuaucaaggacaguuauuauuaagagcagcuucaaaaauauaccgugaguccuuacuggucagugcgaugccuguuacuagagguaacuuguauucaccacugccuuggcuggugccuaugguacacauguuuuuaucacuaucacuuuugcauuuccaaauguacuugucaauaaaguacaaggaagaguaauauauugauacuauuuugaagauauuuuuguuaauuuccuaaaaggaucuuggaucccuaacccccuucccuaauuuucuaauagaccacuuuuuggaaaucacugcuauaguaaugauauuaauauaacugcuuaguuauauuauguugguuguuaaguauauuugccuuuuuguuguuguugagccagaucuugaauucacuguguagacgaggcuggccucaaccuuguugguacccacuuaccuuuaucuucccaaugcuaggucaacaggcgugugccagcgugcauggcuugguggugguguucuguuccauuguagugaauuauaguaguuuuucugguuggguucacauaaagauuagucaccugcaguacuacuacauguauugaaggagggacucuuaaaauacaguaucauugucuuguuugauggcugcacaaucaugauugcuacagauuaauuuauauagaauauauuuaaagauacauaaacaagaauuuuauucuauugaugacaaucaaauuauucaaauuuuuucuagucaugcuuucuaauuucuuuucaggcuugcauugaugacaauguugauauggugaaguuucugguagaaaauggagcaaauaucaaucaaccugacaaugaaggcuggauaccacuccaugcagcugcuuccuguggauaucucgauauugcagaguaagccaguucuguguuucaguuuuacgcuaauauuaaaaauagauucuauaaaacuccuguuuaauggccaggcaaugguggcacaagcacucaggaggcagaggcagaugaaucucugaguucuggucuacagagggaguuccagaacagccaagacuacacagagaaacacugucacaaaacaaaacccaauccuuguuaaugauuaaucauauuaccuuaauucuugaaaauucuucccagaaaagcaaacaaguaauucuuacacagauacugaauugcucacugcuguggccuuuugaauuuucuguuaaaaucaguaauguauacauucuccauauuuucuuuugagauggcuauagucuuguugaacuaugcaggauuaguauuuaacagucuugugcacaccuauauaaucaugaaauaucagaggaaagaaauaguucuuaacugaguuguguugcucuagggacuauagagagaguuauacauaauucuccaauugguuuucuuaagagcauuuucuggaaguauauauuagagaauauuuauugagaaugacuguauucccaacugccuuuuauguaugaguacuuuguucaaacauuuaaugggggaauguagacacauugaauguauuuucauuaaauuaguuuuuauuacuauguauguuauuguauaaucuauuucuuauaucagagauuaucaaauacuaguuaggauaacauaagcacaauaaaaugaacacgaauugugauaguagaacauuuuauaauaugcuuucauaaaaguuacaugacaaaguaagaaaggaaaagaccaguuacuguguacaccgugcuugacagcagcuuugaaacuacagaacaggaagcuucaguuaaggcucagcaguuaaauggcuggagagauggcccagugguuaagagcacugaccgaagguccugaguucaaaucccagcaaccacaugaugacucacaaccguccguaaugagaucugaugcccucuucuggggugacugaagacagcuacaguguacuuacauauaauaaauaaaucuuuaaaaaagaaaaaagagggggcuauuguaaauaacuuuuaguaaaccuucauuguguuaucucccuauacuuuccguuuucuccauggguaugauacaguguaauagcuaggccuagaagaucuauaugacuucaacuuucugcuguguuugccacuaacugcucugcaucuauuagaggcuucaguuuauguuuuaaucuauaaacugaggaagccgggggcggugugugcauguguguguauguauguggaggacagagaacaacuugugggguuuaucagaugcuuuccaccaugguuuugaggcaucucacuagucuggaaguuggugaguagaggacaugguuggccacagagugaugaggaugacccagcucuauauccccagugcucuguauccccagugcuccauauccccagugcucuauauccccagugcucuauauccccagugcucuguauccccagugcucuguauccccagugcuccauauccccagugcucuauauccccagugcucuguauccccagugcuccauauccccagugcuccauauccccagugcucuauauccccagugcucuguauccccagugcucuauauccccagugcucuauauccccagugcucuguauccccagugcucuauauccccagugcucuauauccccagugcucuguauccccagugcucuauauccccagugcucuguauccccagugcucuauauccccagugcuccguauccccagugcuccguauccccagugcucuauauccccagugcucuauauccccagugcucuauauccccagugcucuguauccccagugcucuauauccccagugcucuguauccccagugcucuauauccccagugcucuauauccccgaacuugccuuuuuaaacuugaguuuugggaucagaauuaugagucagccacuacauugaacuaucuccucaguaccaccugaugagaaguugucugcuauugcaaauacuggcuauccaaaauuacaaauuacguccuuacuuuuuuugugcuuagacaucuacuaaguaccucugcuacuuagaucaguucauagaaaaauucaauaacuuuuguuuguuuguuuguuuguuuugagacggguuucucuaugguaacaaugcucuggcuguccuggacucgcuuuuauagaccaggcuggccuugaacucauggaggucuaccugccucugcuuccuaagugcugggauuaaaggcaugcgccaccaugccuggcaugcuaacuguuacuuuuucuucaaaaauaauguaaaaguuagguacuuaggcuuugagucagcuaauauggauuacaagugcuuccucgccaauuccugcgaguugugauuugggcaggcucagucuucuaguuucaguuuucucuucucuaagaugggauaauaggacuguugugaggcuuaacuagggugaccugguacacacaguacaguauggcacauaagaaauacugguacacacaguacaguauggcacauaagaaauacugguacacacaguacaguauggcacauaagaaauacugguacacacaguacaguauggcacauaagaaauccguggcguguauuaucuuuugauaguuaucuuuuuguuuccucugguaaaaugaaacucaaccucuuucuucaaaugcuaaugcuuguacuuuuuaaaauacagcuuuugagacugaaaaagcaauaacaguucuauauaauuuccuugcauagauuugauugagucauaaaccugcugagucauuugguauguuuuuaguuacauguaaaagauuaccauaguuccagaauuaugacuuaugcagccacaucuuaagagcuuaauuuaaaaaggguuaagaauaaaaauuaccuucuucauauuuuacagaagucacuucuuuauggcuaaaaaagaauccauuguauauauuaauuacauucuuugucuauuccucuguugauugacaccuagguggaguccauaacuuggacuauuuaaauuggcuauuguaaacaguacuacaauaaacaucuaugugccaguaucauauugguacauugguguauuaguuaggguucuguuguugucauaaaacacuaacuugacgaaaagcaaggacuuuuucagcuuacaagucuuaggucacacuucaucauugaggaaacuaaaggcaggaaccuggagauaggaacuaaaacaggggcaguggaggaguacugcucacucuuagcuugugcagucugcuuuccuauacaacccaggaccaccugccugggguggugcuacccacaauaggcugcgcccuccccaucauccgcuaauuaagaaaaugcugcacugggaugccuucaggcaggccagucuaaugaaagcauuuucucaauugaaguuuccucuuucuagaugcccugacuugugucaaguuaauauaaaaaccagccaacgcaggugacuuguaguuuuugguauagcagggguaugugcuagauccauaccccuauggauaugagagcuuaguggcuaugcuaguuuacauucugaacagcagcauaucaggguucucuuuugucacauccucaccgugauuugcuguuacuguuuucuuaaugacugccaucaucacugggaugagauagacucucacugugauugugauuggcauuucucugauggcuagugaaaauaacauuuucaauguuuccuggccauuuauacuucaucuucugggaacugucuucuguuuucacuaacccauguacugauuguuugauuucuuguauaguucuuuuuuuaauccuuguggccuagauacuaauuaugucaaaaaugaaagcuaacaacuuuuuucuccuguuacauaggcugucgcuugaugauuuccuuugcuaaacacaagcuuuuguaguuuaauggaauuccauuugucaguuguugguauuauuuuaugagagauugggguccuguucaggaaaucugagccuauucccauuuguuaaguguuuucucuuuuacuuaggcagaucuuugaucugcgcccauuuggucuuuacacagggugagaaauagggacccaguuucauucuguuauauggguggcuguacaauuucaccauggccacuguuuguugaagagguuguuuucaauguuuauguuuuggaguauuuuucaaaaucgggugguuacauuuggcuugacuccucuguucuacugaccucugugucuguuuugugcugguguacucuguaauauaauugcaguaggguaugcuaauacauuacuccagcauuuuguuuuugcucagcauugcuuugacgagcaagcauuuugugcuucuauauguauauuaaggguauuauuauuauaauuauaaagaauaacccuggaauuuugaugaguuguguauaaucuauagguuguuuugguaguguguccuuuucuauaauaauacacuugucuuagggauucuauggcugcaacaaaacaccaugaccaaaaagcaagcuguggaggaaaggguuuacucaacuuccauauugcuguucaccaccaaagggagucagggcaggcaggaagucaagcaggguagaaaccuguagguaggcacugguacagaugccaugaacagauguuguuuacuggcuugcucagccugauuucuuacagaaccuaggaccaucagcccaaggauagcacuacccacaauagaugggucucccuucaucagucacuaauugagaaaaggccuuaugccuggaucuuagggaggcauuuucucaauugaagcuuccuccuuucagguaacucuaguuugugucaaguuaaccuaaggcuaggcagcaugacauguuucuaguuuaugagcauggcagaucucuccaucuucugaugucugucuguuuucuuccugacuguuuuacaauuucuauuguaguauccuuucacugccuucgguagguuugguguauuguaguuagaguuugucugacuguuuuacaguugcuguuguggaauccucucacugccuucagugggucuaguauauuacaguuagaguuuuuguuuguuuguuugcuugggguuauuuuuggaggcaguuaugaagaaguauuuuugcuuucuuaaauauuugcuauugaaguauaguaauguuguuggucuuuuauguugauuuuuauauuuugcuaucuugcugauaguuuuuaucgaaucuaagagccuucugguggaguauuggguaucucuuuaauuuuagaacugugucaucuugauguuuucuacuuaggccucauuuauuuccucucuguggcuacugugcucccauauugauuuuuuauuggaauauuuucuuuacuuacauuucaaauguuauccccuuucccaguuccccucucuccuggaaauaugcuaucacauccucccuaccccugcuucuaugaggguguuccugcacccacccacuccuaccuccccacccucaauuccccuacacuggggcaucaagccuucauaggaccaaggaccucuccuccaauugaugcaugacaaggucauucucugcuacauaugcagcuggagccauggguacuccuuuguugauggcuuagucccugggagcucuggggagucugguugguugauauugcuguucuuccuguagggcugcaaaccccuccaacuccuucaguccuuuuucuaacuccuuuauuggggacccaauagagugcuggugcucaguccaauauuuggcugcaaauauccaccucuguauauguaaggcucuggcaggaccucucaggagacagccauaucaggauccuuucagccugcacuucuuggcauccaaaauagugucuggguuugguaacugaauaugggugaauccccaggugggacagucucuggguaaccuuuccuucagucucugcucaacacuugaucuccauauuuguuccugugaguauuuuguucuucuaagaaggaccgagucacccacacuuuggucuuccuucuucuugagcuucauguggucugugaauuguauccugguuauuuggagcuuuugagcuaauauccacuuaucagugaguguauaucaugaauguucuuuugggauuggguuaccucacucaggauuacauuaucuaguuuuauccauuuaccuacgaauuucaugaauucaucuuuuuuaauagcugaguaguacuccaucguguaaauguaccacaguuucuguauccauuccucuguugaaggacagcauuuuaacaaauagugccgguucaacugguggucagcauauagaaaaaugcaaaucgacccauuccuaucuccuuguacaaagcccaaguccaaguggaucaaggacuuccacauaaaaccagauacacugaaacuuauagaggaaaaaguggggaagagccucgaacacaugggcacagggggaaauuccugaacagaaugccaauggcuuaugcucuaagaucaagaaacgacaaaugggaccucauaauuuugcaaaggauauugucaagaggacaaaaggacaaccaacagauuggcaaaagaucuuuaccauuccuacaucugacaccucuguccgauauauacuggauauuagaaguuagacuccagagaaccaaauaacccuuuuuuaaaaaugggguacagaguuaagcaaagaaggcgcacgccuuuaaucccagcacucgggaggcagaggcgggcagauuucugaguucgaggcuagccuggucuacagagugaguuucaggacagccagggcuauacagagaaaccuugucuagaaaauaaauuaauuaauuaacuaauuaauuaauuuaaaaaaagaauucucaacugaggcauaucgaauggacuagaagcaccuaaagaaauguucaacaucuuuagucaucagggaaaugcaaaucaaaacaacccugagauuccaccucacacacagaauggcuaaaaccaagaacucaggugacaacagaugcuggcaaggauguggagaaagaggaacacuccuccauugcuggugggguuacaagcugguacagccacucuggaaaaucaguuuggcaguuucucaguuaauuggacacauuacuaccugaggacccagcuguaccacuccugggcauauacccagaagaugcuccaacuuguaauaaggacacaugcuccacuauguucauagcagccuuauuuauaauugucaggagcugaaaagaaccuauauugauuuuuuuuuuuaaacauaaugagugguccccugagaacccuucagcaaggacuaaguguuuuucaaguuaagcaacuuuugaagcucauacauuugaacauauuugaugugcugauggcagccucuugucaguugcccuuaauugguuagcaaauuauaccacaauucuugaagaagcccuguucuuuuguaauguguucugagaguauacauuacuacuggauugguaguuucucaguucauaaucaguagagguguuaaucuuuagcccuuucuucauugccaggcauuaugggaucaaaauaacacaucauuccuaaugaacuuugucauguauuacacauacauuagaccgaguguccaccacugguaacaguguuucuuuuggguauugucuuucugucuuuaugguauucuaauugugaauucauugaauggcuuuuuguucuguuuuugagauaaauuuuauuguaucaccuaggcuggcuuaguacuugcuacauagccuggcuggccccaaagucuccacccucagccuguguguguucuugcaccuuuuccagcugaagcacuccuuugcucguggagguacugucaaguagauagggccguuugguucuuuguuuaaguuuacuuuuacauuauuuuucguuguaauuuuauuauuuagauaaaguaccgaguucuaauaucaaugaguguccuaccacauaauuuccuccuauacacuauggauauccauuuauaaauuuuuuucuugauauccucuuauaucagugaaaauaaguaauccucccuuuaugcauaagugacagaaugucacaaauucuccuccacucucuacuuuaaaaagugacaauuaaaaguuguagaaguugcucauauuuagauauagaguagauuagaugcuuguucuguugguguauauggccauauaugucgcaguuguaucugucccacuuaacuagccggugaacaucguuuaguuagauaauuuuacccuuagccuugacacuugccuucuuuuaauucgugagaauauagggauuucugugguuauuuaaaaauacuuugugauuuaauguuuuaguugucuaguuuuauuacuauauuccuuuuuaaagcuuccaguguaaaugcuuaagaaaugcuuuuaucuugaguagcacuaaguuucuaguaugaacaguuuacccuguauuauggaagaagcuccuuucucacuugaucacuaagggcuuggcuaugacuuuuagagauuuguggugguucaguuauggcuugguucuuuaggacuuuagaacuuuuauccauaacaucuacgaaaaucuuaaagauuuuuguagcuucaccaccaaaguauguccacugucuaacuacuuuuaccuccuccuguuucucuaguccggagcacuguugcugucuccuggguaguacaguuccugccaagcugucaucuuucucucguguuuugcucaguguagcaggcaggauucuacacaauagcucuagcuggggaacauuacuuauucacuucacaccccgcucacuacgccccuccugcaaucccucuccccuuuuccucaaagcaggugaggccccugcugucccccuccugauccuggcacuucaaaucucugggaggcuaggugcuuccuccccacugaggccagacaaggcagcccagcuagaagaacauaguccacauuuaggaaacagcuuuugggauagccccugcaccaguuguuugggacccacaugaagaccaagcugcacaucagcuacauguaugcagggaauaccacagucuuauucagagccucuagugcauucguucuguguucagucgggguagaaagauaagugaccuauaagaguaucugucugccauucaucacucauaacuuucuggcuccaucuuugaccccuucucuaggcaauuuuguaucuauuauggucuccuuguugagccuuuagaccagguagguaucguccuuuuuuggucugcuuauuucuucugucuaaaaaauaaugcuauauuuaaacuuuuuaguuuuaguuuuaaaaauuaugcaauauauuuuaaucaugcuuuucuccccuuacuccuaggaccuucccggcuuccuacucaaacaacugcauaauuucauccuuauguucucucucuuucucagaaaacacaaaaauucacacaaaagcaaaaauaaauaagcaaaacacuaauaaaugcuaaagggaaaaaagucaauaaaaaugacauuaaaguuuuuguauaucauccaacuaccucagggcaugagagacauucaaauccuacacagauuuaaucuagauggagucauagcccugaggggaagugaacauggggucccaccccuaaccaagaagccaugcaguugauuccagcuggcaaaggggaaaaucaguuuucucccauaaacugucacuuguauaucaaccacacuccagggcaaaccccaugcucagguggauugccaacuuaucaaaaguuaguucuauauucuuagccaguuaaagccuguuuguauuauguaauuuaguugggacagucccagauaggugaaacaugcaugaaaugggaugaugcuacaguaacuaagucgaauacuugggaaagacccaaaggcaaguccuacugcagcucacgcagguguuggugaaacaacuaggagaugugaauugaacaaagacaaaacuggauuauguguagugauggcuuugcuugguaauuugaaauaucugcuuugaaugcauagcuaaagcauuacaggugugggguuuugagguuuuuuuguggggguuguuuguuuugguuuugguuuuuguuauuguuguuuuguuuuguuuuaagaaaagcaccauacuagaaacaugcaaagaaaagguuugaucuucacuacaagaugaguaaauuuuuauaaauuaucuauuugguguggaaggacaugagguuuuauaaauguauuguaucuuaugguccacugucgguugggggagauuaccauguaaaugcuggucuugauuguauugauauaagggcugguagauguuuggacuuaugcuuucuuaaagacacuagauuauggaaaguaucagguacagcaugcagagauuucuaugcuguaugaauuuguccuucaguaggguacguauuuaguccaauuuguuagggauacugucuuugacagacuagggaggaggaacaauuaacuagggcaggccagugagauuggaagugauaagaaugacucacugccccccccccccauaggaaaguagaaaggaaacucagaggugguugucauggugauaauaauggccgacauuugcccaguguucacugugugucggccguuucucuauuuucaacgcuuuaacauaauuucuguuggcuuuaucaucacaugaaaauucauuuucacuauccuauaguugccucauucacagucccaaaucccugaaauuccaaggaaaauaaaauucacaacuuugguauagaccuuggauauaauaaaacauggccacaaauggugcagccuuuccucaucccacauaacuguacauuugcuguuuauagaaauacuauugaguuuuaauagaauguugccccaaguuugugaauauguaacuuaaucuauauuauuuuuucugagcuaugaaauuuagauucugaugaauaauaauauccuuguauugauaaauuuuacuuaauaaguaaggaaaacgagucagaaagaagucacauguaggaagugacagcuaguguuuugagucaagauagucuggcuuuucaaguuugcacuuaaagccaaaacaagauugugccucccucuugcguuuauaauugggggaauuaagguuaaguuuauuuagguuuagaaaguugauuuuguugaucuccuuugaggucccagugagagguacaguagcagauagaauagaauuuuauaauauacauacuggauuucaagucucauaugucauccuuguaacuaacucaguguauucuuugcucauugaaacaguacauuuuaaauguaggcuuauuuuuaucugaaaggacuuuucacuguuguccucuguauggaagaguguuacagcuuagcuugaucuuguccauuggcucacuuuagcucugcuaggauucagcauugaugauaucuacaaaagucuuaggauacagaaguugggaucacuauagcuaccacugaaacuaaccagagacuuuaaugugugugugugugugugugugugugugugugugugugugugugugugugugugugagagagagaaagagagagagagagagaauaugaaacuaaugaaugucaaacagguauuacaguugagagccaaacucaaauucuguaaaacauaaagaguagcacuuuccucugcccggccaacuuuuaaaucauaaucaaaauuaaugccacgagacucauuguaaguauuuauaguuguaaaugauaguucuagccuagaauccuaucuaguuuuaucgagcgugcugaaugcgagcauaucuaccuccuacccuggacuuuucacuuagccuugggccuacugauucuggcagcuauggaacuugacuuucacuagguucauuaguuuccuuccagcaugcuugugugcuuugacuguuugguuuugaugggaauuuuuguuucauaaagcucacucuucaaacacuucaguuauaccacuuuauuuuuagucuuuauguccuuugagugacuucuaacacuccaacagaagcauuuuuaacauaaguauucuuauuuguuugauugaaauuugccuagcaaguugauuuucuugcuaucuugaaacaaaacacaguuucucacucuaccuucguauuuucugcuuuagacucaucuuuuuucaauauuuaagaaaauacuuucuuaguuuucaguuacauucuuuaaagauauggaacuaaaaaaaauaccugaauucaaauauaaucucuuuauagaauuuccauuaaaaaaguuugggauguauuuacuuuaaaaauaucagguacacugacugucacguuaaaagauaaauaucagaaagccuguauaacaaaaaacuuuccucaucaauacucaaagcaaccaauauggauccuuccuacaugucccucuuaggcguaguuccuguuaaccacauguacauagucuucauuuuuuucuauggcuauuaauguguauacgugugauauagguuuaagagggccgaacaguggugugcaugccuuuaaucccagcacuugggagguagaggcagguggauuucugaguucgaggucuacagagugaguuccaggacagccagggcuacacagagaaacccugucucgaaaaaccaaaaaaaaaaaaaaaaagguuuaagaggaugauuggucuuuucaguuacucuaagaaaaugucuuugguccccauuucucuagauaauacuuuaugcuauacaaugcuggugccuuuuauucucuuuuacccucuggugauaguuuguucauuuuguuguugguacuuacacagucaucagauaaucuuuucuuuauugccagucagauuucuuacuacagguagaacacuccaaaucuaaaauccaaaauaauucucuuuacaaaggaaaaaaaaaaaacucugaaccagguacagaguucacacugaccuuguguucagguccaggucucugaauagccaugcuaaagccaugggauuugugagucagugaugaguucuguguuuagccuuaugugcauugucauaauaccuucuuagauauaaugcaaacguuuucaaacucccaaaguauguaauucaaaaccacuucuaauccaaaucauuuuggauaaggaauauucaacuuauucuuuaaauaacacaucauucuaagacuuaacacagcuucacgguuuguugcuauugcuuauuucuuuacgacaagguuuuauuguuauugcugacauauaucagacuaauguaauuuuuaaauuauugacaaccuuaaaaauacaaggaaaauauguaaauagagcauuucacagaagggucaauacaaaugccaacuuuuagccuccuauauaauuaggaauacaaaucaaagcaaagacaagggauuguaucuccauguuggcaauagugggaagauugguaauaucaagugcccauucaagagcaugcucauuaaaaggguaguauuaaauggagacacgaucuuacauucccuuucacuuagaauaguuucauuaauuuuguuuuacagaaguagcuguguauaaauguuuacauacacauagauucauaacaaaaguacugaaagauuuuugcauauuguugauagugguuauauguaggggaggaugguaaggaacauuauaguaauggaagguguaagacgaaugguuuuccccucucccaacguacacauguauuuuuuuuaaggcuccuggcacugcgccugagaaaauaggacaauaaccuagaaugcucauggcccuagcacauuaucaaaaaaacuuagugaguauuuauuuauauguagugagaaacaauaaguuaaauuaguugaaaacagaaaaaagggcuauuuauauaugaaaaaagcaaaaguaugcugcaagaagaaugagguuguguaagaaggcaaggguaaagcauuggaggacauucauccuugcuaguugagcuguucagaauuuuaaguuggauggugacaugagugauaaugauaaauaaagaauucuaggaaguaugcauuugauacaaggaaaauaauaaucuuuuuacaucuagauucccuuggcaaguuuaaggacuucuguauuuucuuaaaaauaaguuuuuguugcauaaaauauacaguuguaaauauuagaauccauuuaccaaaauaauagaaaacuaauagauuuauccuaguuacguuuguuuguucuaacauguuaggugccauuguagugcuuaucuuggugacagcuauaaauuuuaaaauaguaauuagccuuacauauauauuuuucuuuuuuaagacuaaaaaaauauuuauauggguauuuucuuuguguuauaucuuugcacuacaugaguggaggccagaagaggucacugauuccccuagaacuagaguuccuauggauaugggggcuggcugcucuggaagacagauaguguuuuuagccuugagccaucucaccagccaucaguguuuauuuuauuuuaaucuuuucuuucccaggaguagauacuaagcacugguacccuuuaaguccagaagagagcauuagcucucuuggagcucccuaguuacaugguuuugagcuuccuaaaauuggagcuaggaaccaaacucuaguccucuaugagagcaguaccagcucuugacuagccaacucuguucuuuuuaauuauuuuaauacagugucucauuuuagcccaagcuggccuugaacuugcagugauccucuuuucuucaccucccuuaauuaaucugcaucagcugacuuuuuaugagcuuacugaguucuacuccagauuauuauuuacuaacaguaacuauuauugcuuauuaauaaauaucaaaccuuuucuucaucauagcggaauauacuucaaauuuuaguaacuggguaggugaggcuagauucaugguucaaggucagucacauaguaagacucucucaagggaaaaugcccaacaaaauaaaacccaccuuccauaugacuggugacaggagcaugaagcucaguuagaaaagcagaacaaaugggaaaguggaagucucagcggaggugauggugagcacuccaaugaugcugugcugggaaggcuuucuaauauuaaaacuugacacuuuauuaguaaagcaaguguguacuaaacuuaagaaguagaaauuuuaaauuucugugauaauuuuauacauuuaaauaauguguauauuuauuuuuguugccguuguuguuaugacauaagaacuuuauucauuggaugcauguuucacuucagagauacuccuuuaaccagccuuuucauuuugcagguuuuugauuggucaaggagcacauguaggagcugucaacagugaaggagacacaccuuuagauauugcagaggaggaggcgauggaagagcuacuucaaaaugagguuaaucggcaagguaauaaaaaaagcaauauaaagggaauguguacagaacuauuucagaauaucauccaugacauuccugggaaagguauuuguugccauugcaugacagucauaauuaaauaaauuuuagaguuguuuuaacaacuguauguauaagauucuacuugaaaaaaguaauuccucucuccaucuuuauuauaguguuuuuaaaaugaguguauaucauaaaacaugggccauaguaauauauagaauagcuuuagaguggaguagcagguaaaaggucagaauacauaccagauagaugugucgucuuguacauaugaacaagauggcuguaaacaccuacuaauauaggaggugugcccugagauaugauagaggguagaaaaugagccaugaucuggcaagagagaauucuugguggaggaagcaaggagcacaggguggggaggagcuugauguguucaaagcugcagcagacgagcauguuaauuuugcugcgccuguuugacauucagguaguugaauaugugaguuuggagagagguacaagggagauacacaguuagagguaucucugucuaagggagugguugcucauggguacagagcugccucaggugucaugaggauuaucuauagacuugauucuaguaacaggugcaccacuggauuuucuaagaauacugaacuguauacaaaaugaugugucucgugauggaagguuuaaaacacauauauaauacuguaauucugcuucuggaaauagguccaaaaacaaaagaaagucccuaaagauaaauguguguguccccaugucuguagcagcauuguucucuagcuugacugcgauuaugccuccguaaacauguguaucuauuaaaacuaucucaguccuacacaaaaugucugccuugugucaggugugcuugaauuuaaaaauaauaauuuuaguccaaaaagagaacggaagugcagucagggauagaguauucacuuaguauaucaaacauuccagucucuguucucaccacugcaaaacaaaagacagacgcguguuuaagagggaacuuuugcuauguguguuuugccauaauaaaauauuuacauuuuuuaaauguaaaauauguauuuauaaaauuacuuuguaugguuuccacauuuaggcaaugaucauacagguuuuaucaaaacuguuauacuaaaguuaaauaauugagaaaagauaagggauguuguuuuaaagaguuggcuuaugcugaaguaugcuucaucaggaaguagaagauaaagauuauaaaggaauagaaacuagguaagucaagagaaauggaaucuucuugguccucagaauaagagaaauugugugacuacugguuuauugaaaaugagggacagagcuggcaaccgucccaaccaguuaggaaauuagucugaacaggugagagggugcaccacagaaccggacagcuucugggacaggcggagccacagagccucugaggcagcacccuuuucgggccucagacagccagccaccaucccgaccagaggacagguguccgccuggcucagaaggccucagccucaggagcagcgggcaccaccuugaauccgggccucugccaaacuuaggaacuuagucugcacaggugagagugugcaccacagaagcugacagcuucugggaccugccaaagcaacacagcuucugggaaagguccuguuuugggccuucuucuucggccaggaggagguccaaacacaagauaucugugcaccuucccuguaagagagcuugccagcagagagugcucugagcacugaaacucagaggagagagucugucucccaggucugcugauagacgguaacagaaucacaaaaaaacaaucucuaaacagagucaacuauaacaacuaacuccagagauuaccagauggcgaaagguaaacguaggaaucuuacuaacaggaaccaagaccacucaccaucaucagaacccagcacucccacuucgcccaguccagggcaccccaacacacccgaaaaccuagacccagauuuaaaagcauaucucaugaugaugguagaggacaucaagaaggacuucaauaacucacuuaaagaaauacaggagaacacugcuaaagaguuacaaguccuuaaagaaaaacaggaaaacacaaucaaacagguagaaguccuuacagaaaaagaggaaaaaacauacaaacaggugauggaaaugaacaaaaccauacuagaccuaaaaagggaaguagacacaauaaagaaaacucaaagugaggcaacacuggagauagaaacccuaggaaagaaaucuggaaccauagauuugagcaucagcaacagaauacaagagauggaagagagaaucucaggugcagaagauuccauagagaacaucggcacaacaaucaaagaaaauggaaaaugcaaaaagauccuaacucaaaacauccaggaaauccaggacacaaugagaagaccaaaccuacggauaauagggguggaugagaaugaagauuuucaacucaaaggaccagcaaauaucuucaacaaaauuauagaagaaaacuucccaaaucuaaagaaagagaugcccaugaacauacaagaagcauacagaacuccaaauagacuggaccagaaaagaaauuuccucccgacacauaauaaucagaacaacaaaugcacuaaauaaagauagaauacuaaaagcaguaagggaaaaaggucaaguaacuuauaaaggcaagccaaucagaauuacaccaaauuuuucaccagagacuaugaaagccagaagagccuggacagauguuauacagacacuaagagaacacaaauuccagccaaggcuacuauacccagccaaacucucaauuaccauagauggaauaaccaaaguauuccacgacaaaaccaaaaucacacauuaccuuuccacgaauccagcccuucaaagguuaauaacagaaaaaaaccaauacaaggacaggaaccucgcccuagaaaaaaacaagaagguaaucccucaacaaaccuaaaagaagacagccacaaaaacaaaaugccaacuuuaaaaacaaaaauaagaguaaccaacaauuacuuuuuuuaauaucucuuaauaucaauggucucaacuccccaauaaaaagacauagacuaacaaacuggcuacacaaacaagacccaacauuuugcugcuuacaggaaacucaucucagagaaaaagauagacacuaccucagaaugaaaggcuggaaaacaauuuuccaagcaaaugguaugaagaaacaagcuggaguagccauccuaauaucugauaaaauugacuuccaacccaaagucaucaaaaaagacaaggagaggcacuucauacucaucaaagguaaaauccuccaagagaaacuaucaauucugaauauauaugcuccaaauacaagggcagccacauucauuaaagaaacuuuaauaaaucucaaagcacacauugcaccucacacaauaauagugggagacuucaacaaaccacuuucaccaauggacagaucauggaaacagaaacuaaacagugacacagugaaacuaacagaaguuaugaaaacaaauggaucugacagaugucuacagaacauuuuuuccuaaaacaaaagguuauaccuucuucucagcacuucaugguaccuucuccaaaauugaccauauaauaggucauaaaacaggccucaacagauucaaaaauauuaaaauugucccaugcauccuaucagaucaccaugcacuaaggcugaucuucaauaacaaaauaaauaauagaaagccaacauucacguggaaacugaacaacacucuucucaaugauaacuuggucaaggaaggaauaaagaaagaaauuaaggacuucuuagaguucaacgaaaaugaagccacuucauacccaaacuuacgggacacaaugaaagcauuucuaagaggaaaacucauagcucugagugccuccaaaaagaaacuagagagagcauacauuagcagcuugacaacacaccuaaaagcucuagaacaaaaggaagcaaauucacccaagaggaguagaccguaggaaauaaucaaacucaggggcgaaaucaaccaaguggaaacaagaagaacuauucagagaaucaaccaaucgaggagcugguucuuugagaaaaucaacaagauagacaaacccuuagccagacucacuagagggcacagggaaagcauucuaauuaacaaaaucagaaaugaaaagggagacauaacaacagauccugaagaaauccaaaacaccaucagauccuucuacaaaaggcuauacucaacaaaacuggagaaccuggaugaaauggagaaguuucuagacagauaccagguaccaaaguugaaucaagaucagguuaaugaucuaaacagcccgauaucccccaaagaaauagaagcagucauuaauagucucccaaccaaaaaaagcccaggaccagauggguuuagugcagaguucuaucagaccuucaaagaagaucuaaucccaguucuucacaaacuauuccacaaaauagaaacagaagguacucuacccaacucauucuaugaagccacaauuacucugauaccuaaaccacaaaaagaccccacaaagauagagaacuucagaccaauaucccuuaugaauauugaugcaaaaauccucaauaaaguucuugcuaaccgaauccaagaacacaucaaaacaaucauccauccugaccaaguagguuucaucccagggaugcagggaugguucaauauacggaaauccaucaacguaauccaguauagaaacaaacucaaagacaaaaaccacaugaucaucucguuagaugcugagaaagcauuugacaaaauccaacacccauucaugauaaaagucuuggaaagaucaggaauucaaggcccauaccuaaacaugauaaaagcaaucuacagcaaaccaguagccagcaucaaaguaaauggugagaagcuuaaagcaauuccacuaaaaucagggacuacacaaggcuguccacucucucccuaccuauucaacauuguacuugaaguccuagccagagcaauuagacaacaaaaggagaucaaggggauacaaacuggaaaggaagaagucaaaauaucacuuuuugcagaugaugugauaguauauauaagugacccuaaaauuccaccagagaacuccuaagccugaugaacaguuucagugaaguaucuggauauaaaauuaacucaaacaagucaauggccuuucucuacacaaaggacaaacaggcugagaaagaaauuagggaaacaacacccuucucaauagccacaaauaauauaaaauaccaaggcgugacucuaaggaagugaaagaucuuuaugacaagaacuucaugucucugaagaaagaaauuaaagaagaucucagaagauggaaagaucucccaugcucauggauugggaggaucaauauaguaaaaaauggcuaucuugccaaaagcaaucuacagauucaaugcaauccccaucaaaauuccaacucaauucuucaacaaauuagaaagggcaaucggcagauucaucuggaauaacaaaaaaccuaggauagcaaaaacucuucucaaggauaaaagaaccucugguggaaucaccaugcccgaucuaaagcuguacuacagagcaauugugauaaaaacugcaugguacugguauagcgacagacaaguugaccaauggaacagaauugaagacccagagaugaacccacacaccuauggucacuugaucuuugacaagggagcuaaaaccaucaaguggaaaaaagacagcauuuucaacaaauggugcugguacaacuagcgguuaucauguagaagaaugcgaauugauccauuucuaucuccuuguacuaaggucaaaucuaagcagauuaaggaacuccacauaaaaccaaagacacugaaacuuauagaggagaaaguagggaaaagccucgaagauauggguacaggggaaaaauuccugaauagaacagcaauggcuugugcuguaagaucaagaaucgauaaaugggaccucauaaaauugcaaagcuucugcaaggcaaaagacaccgucaauaagacaaaaagaccaccaacagauugggaaaggaucuuuaccuaucccaaaucggacaggggacuaauuaauauccaauauauauaaagaacuuaagaagguagacuccauaaaaucaaauaaccccauuaaaaaauggggcucagaauugaacaaagauuucucacccgaggaauaccgaauggcagagaagcaccugaaaaaaauguucaacauccuuaaucaucagggaaaugcaagucaaaacaacccugagauuccaccucacaccagucagaauggcuaagaugaaaaauucaggugacagcagauacuggcgaggauguggagaaagaggaacacuccuccauugugggugggauugcaaguuuguacaaccacucuggaaaucagucuggcgguuccucagaaaauuggacauaguacuaccggaagauccagcaauaccucuucugggcauauauccagaaaaugucccaaccgguaagaaggacacaugcuccacuauguucauagcagccuuauuuauaauagccagaagcuggaaagaacccagaugucccucaacagaggaauggauacagaaaaugugguacauuuacacaauggaguacuacucagcuauuaaaaagaaugaauuuaugaaauuccuaggcaaauggauggaccuggagggcaucauccugagugagguaacccaaucacaaaggaacucucacaauauguacucacugauaaguggauauuagcccagaaacuuaagauaccccaagauauaagauauaauuugcuaaacacauuaaacucaagagaacgaagaccaaaguguggacacuuugccucuucuuagaguaggaaacaaaacacccauggaaguaguuacagagacaaaauuuggaagugugacgaaaggauggaccaucuagugauugcauauccagagauccaucccaggaucagcuuccaaacgcugacaccauugcauacacuagcaagauuuugcugaaaggacccagauauagcugucucuugugagacuaugccagggccuagcaaacacagaagagggugcucacagucagcuauugaauggaccacagggcccccaauggaggaacuagagaaagcacccaaggaacuaaagggaacugcaacccuauagguggaacaacaauaugaacuaagcaguaccccggagcucuugucucuagcugcauauguaucaaaagauggccuagucggccaucacuggaaagaggcccauuggacuugcaaacuuuauaugccccaguacaggggaacgccagggccaaaaagggggaguggguggguaggggaguagggguggguggguaugggggacuuuugguauagcauuggaaauguaaaugagcuaaauaccuaauaaaaaauggacaaaaaauuaauuauucggcuaauaaaguauuaucuagaaaaguccuuaggugaccuuccugaauuaauagauaaggucccuuacaauauuaauuauugcuauguaaauaaauguuucucuggagcuucaaaaaaaaaaaagaagaaaauaagggacagccauuaaaacugaggaauauaucugaaguaaaguacaaagcagugguuucauagcaugccuucuauaggcaguccuauacacguugucuugaguccccacacacuuacaucuccugcacuucccaccuucucauccuuuauuccauuaccuuccccagacuccuuccauaaaugccuuucucccuccuagaaugucgugacccauaccuguacauaccaugcuuguaaacauguaaaacuuaggcuacgauccacauaggagagacaucauauaguauuugcccuucugaagauaucucaaagcuuaauauaauuuccagaucugccuauuuuccuguaauuuuccuaauuuuacuccucaguacagcuaaauaaaauccauauauauauauaugcauguauauguguauguguguguguguauauauauggcaaagccccucaggagacagcuauauaaggcuccugucagcaagcucuuguuggcaucugcccuagugucuagguucagugguuguuuaugggauggauucucaggugaggcaaucucuggaugguccuuccuuccgucuuugcuccaaacuuugucucuguaacuccuuccauggguauuuuguuuuccuucuaagaaggaucgaaguauucucacuuuagucuuccuucuugagugucauguguuuugcaaauuguaucuuggguauucugagcuucugagcuaauauccucuuagcagugagugcauaucauguguucuuuugugauuggguuaccucacucagcaugauauccuccagauccauccauuugucuaagaauuucauaaauucauuguuuuuaauagcugcguaguacuccauuguguaaauguaccacauuuucuguauccauuccucuguugaugaacaucuggguucuuuccagcuucuggcuauuauaaauaaggcaucugugaacauaauggagcauuuguccuucuuacaaguuggguccccaaugaaagagguagaguaagugcccaaggagcugaagggguuuccagccccaugugaggaacaacaauaugaacuaaccaguacccucagagcuccugauacuaaaccaccaaucaaagaaaacacauggagagacucguggcucugcugcauauguagcagaggauggucuaguuggucaucagugggaggagaggccauugguccugugaagguucugugccccaguacaggggaaugccagggccaggaagugggaguggguggguuaggaagcaggggaggggauaggggauuuucggaggggaaacuagggaaggggauaacauuucaaauguaaguaaagaaaauaucuaauaaaaaauagccaggcagugguagcacaugccuguaaucccagcacuugggaggcagaggcagguggauuucugaguuugaggacagccuggucuacagagugaguuccaggacagccagggcuauacagagaaacccugucucaaaaaaccaaaaacaaaacaaaaacaaaaacaaaagcuggagcacacagaaaggcuguaggugucugugcucugcaugaguauuuccaucaugugguuuucucgagcugaggaaucugaaugaagagauguguaauaaauaaccguucugguuugguuuugcuuuuuugagagaaggccucacuuuguagcucaaguggccucagcucacagcccuuccucugacucgugaguacugggauuccaugugugggcuacaguaugcagccaagcaaaaaugacuucauuguccauuuugccaugaggagaauucagauggaaaacuguuauuuucugccaaacagugauaauucuuuaaauaaaguaagucuuuucauguuguuguuuguuuaacauucguuagcaguuacuacagacaacugguaacacuacugacacugcuagugagcucggcaguggaacugaugcugggacuauuaucgguuuccuuuggcauccacuagguuuguaguacgcuccaggacguguagguaaaggugugugguacccugaugguacugagagaugucacgguggcucuagagcuggaagaugcaugaggaauucugggaacaggucuugagauggcaaaggaaaggaacagagaagcuaacagugaccaugcagagccaugaaccccugccggugcagaaguuggcugcaggacguucugcacaugcuuucauuucauccucaccugcucugggguguuuguuuauaguuccugcuaaccccauuguacagaugaggaacugaagcuugguugcuggccaaggugcaggcagaacugauaaugcuauaggucugcuccaaacugugaaaagguacauugaauuugagaugacucagcagguuaaaguccucaucuggagaaccagagucuguucccgucacccacaccaggcaucucugagcuacgguaacugcagcugcuuccauggguacaugugcaugcacaugugugcgcacagcuuacacuuacacagauauaugcacaguuuacauucugccauuguaacauacuguguuuuauuuagaauauguccaagaaaguaauuuuuggugcucauuuuauucuuacagugguaauacuauguuuauauaaaauaacaauucuaaagaaacaaaauuauaguugaaucuuagguuuuaauaaugucuaauaaaacaccuuaaacauaccucuaucagauaaacuuucuugaauuaucucuucaugccucuagucucuugcccuauaucccaagcugaccucaaauucagcauucuucucccucggacucuugagcaaugacauuauagauguauaccaccguaacuugcgcaaauuaccuugguaucagaauucuuauacacaaaacuuaaaaauauuaaaugggggggggggcuggagagauggcucaguuguuaaaagcaccgacugcucuuccaaagguccugaguucaaaucccagcaaccacgugguggcucacaaccacccguaaugagaucugacacccucuucuggugcaucuggagacagcuacaguguacuuagauauaauaauaaaucuuuuuaaaaaaaaaugugugugugguacgagcaugcauauccucacguguaacaccucaggcacugucaaucauuucuuucuuuuaauuuaauuuaauuuuauuuuguucuuuuuacuuacucacuuuuacaucccccucacugccaguacugucagucauuuuuaaggcaggguguuugguuggccugagcuggccaaaaagguuagcuaggcugacuggcugugaagaacaagggacucauuugucucugcccuuccagcuaggauuaccgaguaccacuuuaacagcugagccucucccuggccccaccucaaguuguuagguaguucuugaacuucuuaaugcuauaagaugggaucuuguuauagcucaugcuggccuguaucucacuugguauguagcccagucuggcguuacauucuuacacauacgauccugucucacccuucagaguguagccuugugccaucuuaagcuacuguauuugaauaauaaauaauagugcucaaguaaauugucuucaaaacuaguaaugauuaaacacacgcuaaaagaauuucugcuucauauuucguguaauuuuguucuuuuuucagugaaguuuacagaugggauugguuuguuuuguugacuagucaguuguuucguugguugguugguugguugguugguugguugguugggucugguugagucuguuuuguuuugagacaggguuucucuguguaguccuggcuguccucgaauuuagagugccucccaacuacugggauuaaauaugugcaccaccaccagccagcaaagaucaguuuuuuaauguuagcuaucuuauucugcuugagaggcuugguugcauucuuguguaacuucacuaccuuuagcuugcugugaccgcuguuagucuaaucacuuuaauauauccuacuaaauuuaucuucuacuuggacagaugagggaagggccaguuacauagauaagauuuuguuucucuuaacugcuaaggcaauaaaagaaaagcagagucaggguuuuagaacuguugcuuuugccagcuucuuuguguuuauuccuggucuaaaaccuggcgaguggcuuucagaauuggcuuucagaauaacccugugaguuaggugcugugguuaccucaugucaugaaucugaagcauagcaugcauugcuuuccccuccagcuagugaaucccaguucagccuggguucauuucuaguccuuauccuuucgaacugauagccaaagaaaguauggcuuucccagcaucacuagucagcuugucaaagcucugaaauuugcaaacaggucuccuaaguugcauggcuuauucauagauuugguuuaaauguugaugaccuaaacauaaguuacauuuaaaguauuuuuuaagaauaagggcagcgagaucuggacagacugcucagugguuaagaagaacacuggauguucuuccggaggccugcguucaguucccaggauccacgugguggcucccaucuaucuggaacuccaguucuuaggcuccaucacccucuucugacuuccaucgccaccuaccacacaggugguacacguacagucaaucaggcacagcacccacguacauaaaaacauaggaagggguuuucuuuucugucuuuccuuaagauauuacauaagguucccuccacagcggaccuuaaccuuggauuguuuuggcaagauuuggaggcagaagagauguugagugagaaauguauucacagggagaugcagcacacacauaucuacucacuacagaaaggaagccccugucagaccaaagaaagaacugcacagugaccagccagugagccagggagcuucuauuggccuugcuaacaggagcauggcugagggguugcuaacaggaacaggaaugacucaagggcacuuuaucacugagaagccuguccuaacaagggugacacuuaagaaagcugaauuuugggggcagugugcacccuucacagguaucuccauuggcccccuggacuugccucucacaacuuuucagucucuucccugagcagcuguuugccccuguaaaacuggacacggaucuugagaauugugcugagaguuucugcugguguaucuccucagccuccuggauucucaauucugaggaaauugcugaggagcaagggaguggucgauuuguaaagcuagccauagagcuagaugaacacuaaaaugaaucugaaugcuuugacuuaguaaaagaagaagagauucuaaaaacagguauauccugggaaguggucauuuccuaggcaaucgaaauaaagaucugauuugugcaggagauaaucgcuuagagggagcacgguacaccugggaaccuaguuggaggccagauuguucacaccgacugagguagaggagggagacuagagaugaaguaaaaaugcaagucuagaccuaaggcuuucaucugcuaccuaacagacguguaccugugucucauaggagauagucacacacugauacaguuuaagaggaaaucaucagaucugggcuauuucaguuuggcaguagugagggguugaaccagaaggaaggaaugaguuaaugaucaaaguacaguguaaagggagcuagugauaggaacugucagacaacagucuaggagauggcaccuccgcgucuuuuagcuaaugaauggggacuaggcgugcaguaaaggggcagugacugccaaggagcuggauaacagugacacuggaaauggaagacaggcagcaagcagcaagcgaguuccaggcaguuggucggcuuuccucacugagcuugaggugcgcauggcgcaguguugcacuacaguauuucuucucaugguuuucuguaucucuaacuggguuucuauuaggaaggacacuuauacauauaaaauuaacuuacaaaaugacuaaaauagaaccaggucuuuaaaaauaaaucucccccacggccaugaugcuaaccuaucacuagguuuaaaaguaaagccuacacaauuuuauuuggcccuagcaccaauuaaaaucauuucuuucuuaaauauauuuuauuauuuuguguaugugugacaucuuuuucuucuguaucugaauucaaaucuguguucaaacuaauagcagauucuguugcucugccaugaggcaaccagaaugaacccuucacugccuuuccuccuccuccuccuccucuuccuccuccuccuccuccuccuccuccucuaguuaaauacccuauccugguugaguuacaguaauagccuccagccauuccauaccuucccuguucagcuuaagugaacuuguaaauuaacauagacugggucaugcagcucacugucuucauuauagaaagucuggcuuccaugugaacagagccuccuguguagauugccaccccagagccugaguacuuucuucccuuuuuuccaaacagugauguggcaucccuugauuuauuucuugcuuuaaugucauuuauuagagacuauuccuuaccagcaaauaaaauagcuccuccucauuaaugucagucaccuuugcccuguuccaguuuucuucacagacagaacauuuucugccuuagaaaagcagcucccacuccucauaaagcaccugacucacaaucggcacuuagcacauaucugauggaaaggagggagggcgggagaugcaugggaagaucacauccggacaguuggguauauaauaaggauugugagaaagauacuggcuagggggauaaaaggcuuguuauguuuuacucauuuauuuauucacucacucagaaacuauuuucuuaccaagcuuguuuaagcuuaucugagcuuaccaaguuuaagauuauuuccuauauccugccagaugguagagguaccaaauaaggaaauauaucuacuuuuuauaagcucagucuucuggaguacaauagcauauaaauacauuguaauaucugucauauauuaaauaaccauuaauuaaaacuuuaagaaaacauaagaucauuuaggaguuucaccauuaucuuuaauaauuaaauuucccccucaaaguauagagcucuuugaaaauuguaaagaaaaaauucuauucauuuuuguauuuuuccugcuuuuaucaccuuagccaaggacaguacuuauaauacuuugaaaugaaauaauuucucuaugacuuagacaguacugauuguaugaagaaaaugccuacuaaaaaagaaaaggugucuagagagaaagagaaagcaguuuagggccugaugcauucacgagagcaagcaagaggagagagagagagagagagagagagagagagagagagagagagagagagagagagagagagagagagagagagagagagagagagagagagagagagagagagagagagugugugugugagagagagagagagagagagagagagauuugguaaaauauauguuugagaauuauuuauauauaauucuucaaaaaccuuuuuauuuugaccauaggaugcuacaccuuaauaagugcuuagagcaaucagaaggcauaaccacacuugaugugguaucacgcauuuaaucucagcauuaaaguuaacucuugaguucaagaccagcgugguuuacaaagcuagguacagacuguuagaggcuacacagugagacccugucuuaaaaaacaagccaugcacuccagaggcagaggcagccggauuucugaguucgaggccagccuggucuacaaagugaguuccaggacagccagggcuauucagagaagcccugucucaaaaaaauaaauaaauaaauaagccauaaccaaaauaauauuguggaucaaaagcuaaauaauugacugagaaggcuaaugaaauaucuguuguauucacauuccuuuauuaaacaaauaaucagcaacuauucuuuuuaaaaccaugguuuguuaggguuuuuuuuuaacauuaauuuuuugguaaucuuauuucacuguguagaacugggaagaagaauauucuccaguaaggaaaaugaaaauaauguuuauauggcuuuuccuccaaagguguugauauagaagcggcucggaaagaggaggagcggguaaugcuaagagacgcgaggcagugguuaaacagcggccacaucagugacguccggcaugcaaaguccgggggcacagcacuccacguggcggccgccaaaggcuauacagaaguguuaaaguacguacuacuuuuuacaguuucuauacuucauuuuucuuaauuuuguuacuccuuuucuuaaaauaugugcagauacuauuuggaagacgauguugaauagaauugauuugguuucuaaaguucuuucucaaauuuuggauauuucuguucucuugguuuguauguuuuaguuacaguuuucucauaaucuggacuuaagugucaacaaaccauuauauguuaccugucacacugauaauuauucgagucauuggcaguucccauguugagaauaaaaacaauaugugaauaguuugcuuuuuuauuauaaaaacacuagaauucaaauugcuaauacuaugugucuuagucaggguuucuauuccugcacaaacaucaugaccaagaagcaaguuggggaggaaaggguuaauuuggcuuacacuuccauacugcuguucaucaccaaggaagucaggacuggaacucaagcaggucagggagcaggagcugaugcagaggcuguggagggauguucuuuacuggcuugccucaccuggcuugcucagccugcucucuuauagaacccaagacuaccagcccagagaggacaccacccacaaggggaccuccucccuugaucacuaauugagaaaaugccuuacaguuggaucucauggaggcauuuccucaacugaagcuccuuucucuauaacuccagcugugucaaguugacacaaaacuagccaguacacuaugauauuaaauuuuaauccauaaacaucugugacuauaugacacuguacagugaucagcuaauuucuuugcaacagaguuccuuuauguuagugugcacaugcacacgcuugugccuagaugggccuuccucucaauacaaauaacuaaggaacccuucccagauugccuggccauuuuaauuucaccuucaguaaugcaggucucucuuagugguaaagagcuuuaauuagucuucuuaucccaaccuauuucuuucuagucuaaaacuuuuccauauuuucccaacuccauuaacaagugauaugacuaugguaaguuaccaaccaaauaacauacuccuuaccucagcagaucuacuucuaauaguguucuuacagaucuucuuacacacauaagaauaaagguguaugcuacauaacuaguaauaagaggagaaugacuuaauaagucaugguacacaauucccuggaaggcucuguagcaauuaaaacauaagugagaaauuuucuuuuauauuuuagaaagagugcuaggauuauuaugaaauaacaaucaagugaagaauaaguaucauuuuuaaauauuagauuuguaaugaaacaucucaugggauuauuaaaaucucuagugucguuaacgugguaaaguaaagcuaauuauugacguucauccugagaaaauguccuccuucuguguucugugugucucaguguguguuuguguucgaguguguuuggugcuuagacaaauaaaaugcguagaguggagucuugugcguccccucccugccucccuacgcggcuccuuccagcugaucuuggugcccuuuccuccucuccagcguuguaacuccguagcccugcccgcagggcugcugcuucucacucucuccgucgcagauacuccuugaguggaggugcucuucuuguccuuucuucuuucuuucuuucauuuugguuuguuuucuuucuuuuuuccuaaguguccucauagaacauguaaagaauguguuuguugaagaagauguauacuccugcuuaagucuucccucuacauauccucccaaguauguguugcucaggagauuaauauuauuaaaguucauagucccuaauaaggauauguuuuuaguaucuaauagucuaguguuauucccgcucuauuaauaaaaucucaggucaugcauacaauaguggagaugugcuuuaacauaaaucucuggguuuguuagccuguucuuuagaucauugcuuuuaaauacuagucuguagacagguaccaggcaguaguauaagcagcauauaggauuauuauaaagauuauuuuugugccgauauccuguguauaaaaguagcuggcauagugguacaucccugcauucccuccacuacagaacggaaggcagggucaucauuggcuugucagauauacaaagacagucucaaaaccaaccaaauacauguagauagacagagccugaauguacggauucaguaguacucuaguuaagcuagagaauaguuuuuauuaaaucaaguucuuaggauggcucuguuacuaggcuggguuuguaaauaacugcugugacuagauauuaauaaguaagcugauuucuaugucucaugcuuuggcuuguuauaccuagucugacucuguaacccaggcuggcagcagucauccugccccugccacauaagugcagugauuacagauaugagcauucacacacaaccuucacuucuuaacgguaaacaaauagaggugacuauauauuagcugucacuaccaccuccuguagguaagaagaccuucucaaguucaccaucuuggacagucagguaaaaguguuccagauuucugauguaaagcauuguuugccugugugugggcugugcuaugugcaguuuauagguucauuaugagaacauaauuuuugagugaaacaaagguuggugccauauacagauagaagggcaugcugauuuauguaacuuugcauuguauuaaaauuuauuccuauuuuauagcuuguuagugauguggauaucugcuuucuacugcugcaaaauuaugacucgaugcccuugaaauaugugucuugcuuuguuuguuucuaaccgucagauuaucuuucuuuugaaauuuuugauagcggaucauaaagguucaccaggcuuccauaaaccauuucuuccagugcaaagucaccgagucuuacaaaauaagccccuuggauucugguguacuucuaggccacaucuggccugagaugauauuuuaucuggacaccuaaagauagcucuugcaguaaauaagcuuuauauauacauugauccauugugcuuaagcuuaaaacugggcuuuuccaugaaauuuuuuacuugcaagugauacuaacaaaaauuaaucggugucauaucaaacuauaaguuaggaucacuaggaauuaauuaaaaccuccuuuuuguggcagugacucaagagugucuucuguagauuacuuaccacuugcccgaguuaauucauuaagaggcagaggaauuggaagucucaaaagaauuaaacugcaaauugugguuaaauugcaugguagaaagcuucugacuauguuuguuaauuucuagauuuuaaugauuaucuaauucacuguaauuucuuuagacuuuuaauacaggcaggcuaugauguuaauauuaaagauuaugauggcuggacaccucuucaugcugcagcucauugggguaaagaagaagcaugucggauuuuaguggacaaucugugugauauggagacggucaacaaagugguaggccuuuuaaacauacuuuaaacgccacauguaagagauuauaaaucaugugaucucuaucuacuguccaucauuaauucacuuacuaacuuuuaagcaguuuuaucuuccauaugaguuguuuaugguucuguucugcagaaaacagaguuuaggauucuuugaguaaucguacaaguaucauacuugugcaaagcauuugaguucuugcauaccuacuauauuuuuagauauacauaaauuaagaaacuaugugugucuguaaaugcuugcugucgucuguagaagcuagaacaguguaccaggguguuucugauagucuuuagggcuugggcuuguuugcugguugguugguuuugagacagggucucauacaaagcugaccuuaccuuccauauguagcuaagguuuguauugauucucuugcuuccagcucccaaguacugaaaugacaggcuuucaguaccccaccuggcuaugauagauauucuuauagccugcacacagugauuaaguggcaguggauagugaaaagagauuauugagguucagcguuuauaagaaaauucaaugaguaaauuauuuacuuuaugauccauaauuggauaaaggaaaugagggaagaaauacaugcugugcuauacaucauauuucuauagaauuaaguuaccaaauuuuuuggaucacuuuucccuuucuaacaguaucuuuuuaccagaaaugcuaguuagucuucuacuccauauugguaaacagguuucacauacucacaauugaaagcuuaaaguauguguucugucuauuaccaucugaacucuggccugcauuucagcuuuccuccaguauccuaacagacugccuauucacucacauugcuagugcugauaauugguugauuuaguuaguaucagugacuuuccaagaacacuagaggggagggguaggagcuuuuuugauuuuuguuuguuuguuuguuuuguuuuguuuuguuuuguuuuaauggauugaaauaguuuuccaaaaagaauauauaacuucugauuaugagcauauuuucuuucccuggcuggauugguggucuccuuagacauauuuaguacauaaucuguaugagaaaaauaauuuaauuuugccuuuggccuguauuuguuuucuucuuagguauaacucauaauuaugcauugggagacaagaaaauaaaaucauuuuauuucauaacauugaguuuucuuauuaguauuagagcaguuucuuuaaucagcauaaacuuguaugugguuaauggcucucuauacaugacuuugagaucagugugucacguguucuguccugucccacccucuccagaucuauuauuuaauguuccccucucaccaguuccccagagauuguguacugaaugauuuccuuaaagccucccugugagggguuuucuuuaguuuucuguuucucuacaauguuuauuuuuauuuguaccaauauuucuuuuauaaaauauucaaacucuuaucguaaauaauuuauuuuaaaaauguaagacuuuaaaaacauuauaauagacauaagauagaauucuaaauguuuuguacuguauuuaaucauaguuuuaaaguuuuuauuaaagaauucaauauuuacauaacuuuccuuugugaguuaaacugucuucucuguuuuuucuuuuugcuuaauuuuuucuuauuagauuuucauuuuauuuuauauauauauaaauguuuugccugcauauauguauauauguacaccacacacaugccuggugccugcacaggucagaaaauguugucaggucuucuggacuggaguuagagaugguugugagccaccguguggaugcugggaacagaagucagggccucugcaaggcaacaguacuuacuuuuuuuuuuuuaagaguuauuuauuuuauguaugugaguacacuguagcuguucuucaggcacaccagaagagggcaucagauuccauuacagaugguugugagccaccauguuguugcugggaugugaacucaggaccuucgcaagagcaguuggugcucuuaaccacugagccaucucuccagccccugcaacaguaccaucucgcuaaucagucugcuuuauuucuacugauuggacuuaaaaauagcaaacacagaaguggaugcucacagucagcuauuggauggaucacagggcccccaauggaggagcuagagaaaguaccuaaggagcuaaagggaucugcaacucuauagguggaacaacgauaugaacuaaccaguauccacccccccaccccccacuccacccccccacccccuccccccugagcucaugacucuagcugcauaugaaucagaagauggccuagucggccaucacuggaaagagaggccuauuggucgugcaaacuuuauaugccucaguacaggggaacgccaggaccaagaagugggaguggguggguaggggaguggggggagaguaugggggacuuuugggauagcacuggaaauguaaauuaagaaaauaccuaauuaaaaaaaaauaguaugucaugguguaucuguuugucucccccuccucuacuuuaaauaggguuucugcauggcuguccuggaacucaauguguaaaccaggcuggccuugaacucauggagaucugccugucucugcuucccaaauccugggauuaaaggcaugugacaccaauuccagaaccucuuucuuuuugagaaaauguuuucucuaauagcucaagacuaucuuccacgcacugugucuaggcugaccucucuucuaccauagacuuucuacugccaggauuauagaggugaacccccauacuuggcauaucuuauauuuaaguagaaaaaacucauuuugagccaauuguguaagccuacuauaugaauuuaucaugucauuucauucuuuaguuagugccuuuuaaagaauuaccuuuauuuucuaugcauggguacucugcugcauguuugucuguacacguguaugcacagaguacaaggaggcccgaagaaguaguuggaauuucuggaacuggagcuguagauaguugagucaccaugagaguucugaaauuugagcuuguuucccaucagagcaaucaguggucugaaccucugagucaucucaacaugucccauuuguuaguacucuuuuaaccaaaccuuugaaaacaaaguaaauguucuuaaguacuaugaguauuuaugugaauuaacuaacagucagaaacauagguuaggaccuccacacacgccaacaugcauguucaaaccauacacaaggaauauaugauauguggaaauaauauuaauauagaaauguauaaauucuauacaaucaauaaaaacuccuacauggaaguugauguucuagaaguaaauagaauuuuuuuucucaacuuuuuaacuuguuggcaaacuauaaauuaucauuuuagcucuuaauauugauuuuaaauauaaaagcuuuuauuuugcuuuguuggcuuauuaaaauaauucuuuacaaguauguaccuauugucucuuccuuaauaucaaggauaauacuuuucuuauuggaauuucuguuaaugcacaaugauuagaauauguuacuagcuugaugcugugcagguuuaaguguuucugccacuacugagcagugguguuuguuuuccauuaugacccugccugaccucguuguuucuugcuaugaaaucaaauuaaaggcuccagcaguacagagcuagaucauguuccccguucucuaucagcuagacacucgggcuuuccaucugaacgauggaaagcaucaucaguucuguaccagcugccuucacuacuaguuccaccaaagacuaaaagaauuaggucugcaaaagcaauucauuuaaaacagcugagaaaaaacugcagcgagggggaaguaaaucaagccauguucuugcuagaucuguggcuucgcuaacuuguagguauauugaacugauguucaagcagcuuguucuguucccuugcuuugacacgagcuccuacuucccagugucucaucacugcguccuugguuguuuccagcugcucuaccugacugagcugcuuuccugugcuugcgucccaguagugaagccagagcccguggggagaguuacaguguucagucuccuuccgcuucuuagugucuuucagauugcaugacagucgugguuaugugauugguacguguggcugggugguagaggugugcaguuuacauuggaaauuuuucucuguguauaggccacauuuuacuugaguuuucauucucuaugagcugcuguuugcaaagcagagucauuaaugaaaggagaaaaugaaaagaaagguuaguaagggaaccccguuucuaacuauuaaaagagaaauuccuugguuauuaaaagaacccuuucuuauuuaacugcuucaaaaauguaauuacaauuuaaaaguucagggugguauuuuauuuguacgaguugguaaauuuuaaggaguaauugaguuauuugaccauaagagcaugaucuugagucuguaauaugauuuuagauaaaaguugcauuaaguuagaagaguuucuaaaauuuuugaauuguacagaaauacaaaauugaaauuaacauacuacguuaaaauuuggaucaguuguuuuauaacaggauuuuuuuuuaacucaauuuaauucuuagcuuuuaaggcagaaauggggaauuuuguuaccacggggaauaaaaguagacugacaaaugauccuuugaaguaauuuuaaaacugaucauugcgguugcugcauaugcacacacacagugcauguacaccugcacguauccauacaucuuuagucaaguuuuagaagauaaucaagucaaaaggccucaaauccuagaguuaccacaucgguccacuuugaacgugggaguagcccacaaacagaauuguuuuguucgugguggugcuucauuugccuuuauuauuguaauuugugugugcaguugagugcaggugcgcuugaguguaggccgcagagcccuuagaccuggagcucuaggcagucaccacucugcaggagcggccugcucuuagccggcagcagugcuuacguuaggcggaaagccaaagcaaaugauuuacauuagcaaaaugagccgaggcagggaauuguguuucccaguaaaagggagugaaguagucauacaugucauuacacagaugagucucacagcaugugagguaaaagaaaccuaucccaaagaguucuagcagagaguuguucaguuugauccauguaaaguguuugaucagcauauagauagauagauacaagguggcuuaaguggaauggaagaugguacaagaaggauccacuuauucuuuugaggguggugaaauuuuacuucuaaauuguagcaagggaguugcagcuguugauacucucaaaacaaugcacgcauucugguccuaaaguauauggaaggcauacucacaugcguuucucauguguccuuggaguccuguauagucuaucauuuuuaacuuccaucaaacgugauucuuggggcuggagagauaccugaagucagugaagugcuugccuugcuagucuuaugauccaaguucaauucccagaacucauauaaaagcugaguguggcagccugugcuuuuauuuccagagccggggcgcagaggcaaguggaucuguuggguucacuggccuagccuagcuuacuuggugaguuccaggccuacgagagacccugucuguaagauagagcacacucauacacaugcauauauaccuacacaaacagcaaugugugaguguacgcacacuuaccuagauagcuguguaauuaguaagaauuguugaugucauuuuaugguauauugacuuuuuacuguggcuacuucucauuuccugucuagggccaaacagccuuugauguagcagaugaagacauuuugggauaucuagaagaguugcaaaaaaaacaaacucugguauguuuaacugcuaaaaauacuuauauuaaugaguucucuauagcuuugaauuucaagcguuuucgguguucugguaauguuucuuacuucuuaccuucguaaucaaacacaaugacagugggcuugaaugcgggcugcugcugcugggcgcucauaauauugguugccuauuucucugucuugcuuucuaaaaaacugaguauuuauagcaugcuuuucuaauuuccuaagacaacaugcuuagugguguuauaguaaacugaguuuauaauagcaggcccaaacaaauaaggaacuucauaacuaggaaacggauucuacauaaguuccugucaacacccaccuuacguagucagugggcgcugacuucuuugugaacugaaguuagacggguuaagcuuuucuuuuuauuauugguuagaauuacuggguugugguguuguuuacaaauugccaaguguuuuucaagcuuuuccuuugcagcuaaaauuuagaucuuuuuauaaugccacuuuuuaaaacucuguucuccuuguacuuuguacuuugcuacuucaugccacccuuccuguuucuucacauaauugugaauaaagcuccauagugagaagcgggauaagaaaucuccacugaucgaguccacagcaaauauggaaaacaaucaaccacagaaggcuuuuaaaaagugaguaaaguagggaaggccagggcugggaaugggaguggguggguuggggagcaggggaagggaagaggggguagggggguuuccaaggggaaacuagaaaaggggauaacauuugaaauguaaauaaagaaaauaucuaauuuuuuaaaaaggguuuauaaagaagaaaaaagugaguaaauuauaagcagguuuucucacuguuaugaacggguuaaugcuauugaaccuuucauguuugaaaucgcagcaaggaaacguugauuauugagccagagaaaaaugcaucucgcaucgagucucuggagcaugagaaggcugaugaggaggaagaaggcaagaaggacgagucgagcuguuccagugaggaggacgaggaggacgauucagagucagaggcagagacaggugagaugggaagggugcauugauuguaguuguacugagcuuguaguugggaguaagauaagaauaggcuucggguuuaagcuuugguguagguuugcuucauaauaccuguugcgucucuauugguaaccuguaaauuuguugcuguggacuugucaggaggcuggggcuccucugcuucuugccgugguguguuuagacuugaagaaggugcagaggcucuucagaauguucugggacuccuauaggauggcgcagauagaguguccggguuucccucagcucaagagcacaucuucuguucacugugauucaccagccuagaaggcuggcucuguaaacgucucacauuuucccuaagguggccaaggagaggaggagggcugcugagacaagccuuuccugaggggcuauggaguaacuuguuguuuuaagacaguugaagauacugcaaaguauauaaaacaauaaauuucauauucuaagacuucacauguaauaguucuugaagcucaaucauacuucaaauuuuuauuuuaauaaaauaugaagaagauauuguauacaguuuucuugaacauguaucuuagcuuuccuuuccuuccuuccaaagaggcaaugaugaggguuuaaaguggauguucaauuuguauauacuccuacaguguacuaaaguacuauauagcaacugggcugugggacaagaguccuagaauugaugauaguuacauaccaagcuggaugguugcaugugaguucaucauuuguccuagaaaggaaacucaaugcagcuaagauagcugauacuuuccuucauugacugauuuauccucagugccuacaacagggcuggaaauagaggcacagaggguuuuuuuuuuuuuuuaaugacaaccauauuagcugaguagguuauuucuagaaagaugaaauuguucauauuuaacuuuaaauuucuuagaagcaagaaagucauauucuuuggaacacuuagccauauugacaugaccguaaguuaauugucaaaaguauuuuuuuagguuucuugaaauaauggucuucaguaauaguuacuuacucaauacuuagaaaauucauagcuauuguaggguuucuauugauauugcuaagcauucaaaguugaaaugugaguuagacuuucauccucuaguuuauagaaguuagguucucaaauggguuuuggguuuuguuuuguuuuuaagguuauuaaaaguuuagcauacauaggcagauuucuaaaaacucuuuuaaaaccuucugcuugggcugaagaaauagcucagcagaucccagcacuugggaggcagaggcaggcggauuucugaguuccaggacagccagggcuacacagagaaacccugucucgaaaaacaaaacaacaacaacaaaaaaagucagaguacuaggauuucgagcuccacagcccauaggagaaaagccaggcaggcaugguggguacuugggaugcccggcuucaggaggcagaggcagauuccugggacaaacuagcuagcuaaaggaacuagaguugguaggcuucagauuugcugagaaauuugcaugguguuggcuuugggccucuacauaugugaacauauacucaaacaaauaauuuuuuuuuaaaucuauuuacaaaaaguaauaagagccacagaaaccaaaauccuguaggaucucacugauaacuuugguuuuguuuugaauagauaagacaaagcccauggcuucuguaagcaaugcucauacuuccagcacgcaggcagccccugcagcuguuacagcaccuacucugucuuccaaccaggggaccccuacaucaccuguuaaaaagguaagccgacauucugguguuaaacauacguguguucugcuuaagugccauuuguacucacugaauaaaauaguucucaauguuuauaguuguugucaaaacauaccauauuuuucugcucuuaauuuggaauuaccucugagccaugguauagugacuuuuuuuugccuuuuacaauugauaguaauuugguauuauaaugaauaguuaauaaauguuaguuacuaaaguauggcaggaaaucaaaaaagcuucauaguauuuaaauuggugguugugguaguuuuuauuuccauuaggcuuuuauuuugagaaauuuaaguuuuauauucuuugucucuuuuaacuagacguguauacugauaauuucucaccccagaaaguacagcauagaaagucaguggagacccacaagucaggggaaaauaagaaucuagauuuuuucccccaucucauacaaggugccugacaugccucucucagaccaguaaaaucguguuagaacgccagcccuuucccuggguuagcuguucucacuuugggcaaauuaguugucuuuccuaccaaacagaacaaagauagaguuacuauuguacaauuugguugagagauagagcacagcggcuugaagggaaucccaaaugcugccuuuggcucccccaucccccuccauucuaccccaaagcugguuuuucccagugcugcgcugcucuuucucaagcgggugaugaggagcuguuugcuuugcuuuucuuagccuuccagucucuucacaaagcuuucuccucuguggccugacuuaccuuuagugagcuggcuugugccucucugaauaugcaggcauuguuuuucuccagaacauguaaaaauguauugcggccaccauuaaaccucauccugacugugucaguguguaucuccuagguacaaaugcauuaucccuugcuuccaugguaaaguaauggugcuuaggagaguuaacuuugauauagugcauacuguauaaucuacauaacaguaauuuaaucugugcuaauuaauauauauguaugugugcaggucuuccaguuugugcuucaaauaguaucggacgugguguuggugguuguaucucuguugcacaucuagcaguguuuagauugaagggauuugagauuggacuuuuuuucuggcuguccuggaacucacuuuguagaccaggcuggccucgaacucagaaaucccccugccucugccuccugagugcugggauuaaaggcgugcgccaccaugcucugcuuucauccccacuguguuucuacccaguauugucauaugcaaguugguuaaaaugugguuuuaauuuuuuaauuguaacuauaggagauuuuuuuaaaccugaagagucaguauaacucucuccuaaaacucugagguauggggcuguaacucaguaauagaguauuuguccaggagucaugaaacccuggauucaauccccuauacuagcaaaaaaauaaagcucaaccuaagaaaagacguggggugggguggagugggaugugcaacagucggaggaauaaaagucuggacuauuaaaagaaaaaguuuaaagauuuagagagagagagagauuuucaaugcuagaaauauauggaugucacuggugcauaguuugaacaucagaaagcuucugacaggaguugccuucuuuacucuucuagaacucuuguucucaugacuguaauuacauagcuugauaugaaaugaucucacagaguugcagcguuuugaagacuauugucacauuauaaccacuacuaggaaaguuuaucugaacuauauuuauauucuauuuuacuucuaaaacugucauguacucuuuccgagaauacuaaauuugugucucuuucauuuagcucuugauuuauugucuauuaagauccuagguuuauuucaaguucucauaagccccugcuaaugucugggcaagaaaccagcucucuuugguaauuugacucagcaaucccuuucauaaagaggaaaaaauuuggcaguagacuucuuguguucuguuaucuucuucucgaguauagccuuggacuuagcucacuucucagcugauacuuagucaccagcugaaaguaaucuguaucuguguuaccuggauggcauaauauuacuccuguaaagaaagaagcuucaugcaaaucuuaggcaugagucuguaauuaaacugaacuagacacacacgucuacuucuauaauuuguauauuuagaaaaucucuguucucagauuucaaccaucaugugacuucuuugaagaucauucuuugaauucaaauucuuaagauuuuauaaccaauuaugucaaaacuaaagacauuagguacucaaaaucugaauuauuuuugcugauagaagagucuuacaguaugauaugcuuacauauauauauauacauauauauauacauauauauauguauguauacauaucaauauuuagacuucauaacacuuuuaauuuagcacuuaguguuuuuucacuuuuuucuauaaacaugaagagagauuuagcaaauucacauuuacuuaugagugaguuuacaaguacaucuuaaagauuuucagcagaguuaucuuaggcuguccagccuugucugucagagcccagacuauggauuugggugcacucacuccaaggacuagaucccagauggacgcauauaacacagcauugcgugucacuucuauucuuuuaguauacaagguuaauuuagcuaaagauagaugugcucaguuugcuugccuuaaauuauaaacccaaacuaaaagagaaaaagccugugaguaaugcccagcugauaaucugugggcaucuuaggauggaaaccaucagcuuggucuaggacuguagccuaguaacagagcucuucccagugugcaugaugcucaguauuucacacacacacacacacacacacacacacacacacacacaugcugaagguaaacaacaacaaaaauucagcuugauuuuagaccuuaaaucgucaguuaauaauaaauugcgacuuucucuaguuaaaguaaguauuguuaggauuccaacaacucacaguuucaaguaagugugaauuauauuugucuccuagcuaguaaaaauugagaauuuucucagaguugguuauucugguucacugacuacuuaguuugcugagcagaacacuaauuauaugaagacugacuuaggcuguggguuauauaccauccgccauauaaggguccugguguagaaagcuauguaaaggugaggaaauuacauucgguuuuaagucaugaaaugaaagcauuugagagagauuaagggaugacuagccagcaccuugcuaccaaguuugcauaacuugacaagagaaacagugaguaugcaggcauggugucuacuagggagaggaaguuuagugucaugguacauauauacagaauaaaccagaaaaugggaguaaaugauggaaugccuucauuuuuagaguaauaauuuauaaauuauuccuuguaagaaaucccaguaaaugugcgaacagugcugcgagaguucauucucuauguaaggcugcucuggagguuccugugugaggacgggugauggggaugagguccugaggaaacacugcccacaaugauagguauacaacuagagauaaaagauacagccuugagccuuaaaaacacagaaggacagugagagacacggucacuggcuuaucaauaaaagagaaugucaaaagaacauuagugugaagacacacaggacauugaggaaauaacaauagcacuguuacuaguaauagagcuggugaaguuuauaaggcaaaguaugugauugauacauguuaaguuuaagguccaaaugcaauuguaaguagucugauagauagauagauagauagauagauagauagacugacuuaaggcuaguaauuuaaggguuggguuagaguagagaauaggaaauuuuagaauaaguuuaauaaauuuaauauuuaguuugaaagaggaaacuaauuucaauccuuggcagaaaaacaaagguagccuagucuaccugggacuagacucuuggaguaguugaauugaaagaguaggcaaaggcagguuguuagccagaaaaaaaaccagacguggucugaagacuaagaaaguguagauaggguguccuguuauaaaagcaaaagaagaaaaugugcaagcagaggauuacaguuaaguguauucaguacauuucuucauguaucaaucaaaaugcaagguacuuuuacauauuugaaccaggucuuggaucuaaauccuuaauguauauaaugggagguuaucaaaagugaguuaaucaacugcuaaaauauagcgaugucauuuuuaaaauugcuauuacugcucugguuuagucaagucuaaaagagcaauaguagcauuucuuuuuugugcuuguaauauuguuauauugagauaacucauacagaguuaugagaacuuagcuuagaaauaggagcaggcaucucuuacaugcuggccuauguuacacacguaaaugguaucugcugucugcuuagucacaguggaaaaacauuucaguuugcaggagaugcaguuggagcaggaauucacaaaauaugccuauuuuuacauagcaaacaagcagagaauguuuuuaacaucuuuaaauacuugggaaaauacguaauaugcuacuuucugacacauuuugauuucauugccccuaaauaaacuuuuauuagagcauaagaugcucauuuacauaugaucaauguuuugcaaagcccagaguguagcuuggugugcaugcguguugccaaaaugcauagauagcuacuuguggucaaacauaacagcacacacucugaugauccagcaguagagaggcagagacaggauugugcacugggauguguacuagcuacuccaguaagauuacaguauaccuucuguacaauucuuguuacuuuguuugacauccugaaauaauuccagaugcauuuggggucaugugaacuaaguagacucuugauggaaaugauuacaagcuaccagaaauauuguaaaaaaguggucccuggcaccaugguacuaucacuaaagaucugcuaaccugcaguuugagcagauuuugaccaugcaugcaaaagauuuuucuuuuuaauuaacaauaccuuguuauauuuaguugauauagucuucucucugugcauugagcauuaaaauucuugaacuggaaaggugaaguugauaaaguaaauuauuuaaugauaauaacuaguguauuuuaagcaugauagcuaauauauuggugaaaacccugggaaguagaauaauuaugcauaaaaauauguuguaacuaaaauugcagauuaauguuuauuaggaagaauaaacaguaaauuuaaaguuaaaauauuuuaaaauacuacuaaauuaaguuuacuuagaaaauuaaauuuucaccuaggguguguaaaucacugaaaacaaaguccauauguacuaauuuuucacucaugugcuauauugcucugugugccauuaacuggguaagaauuuucuuuauuagauucuucccaauuaccucuugaggaaacuaggacuuguuuuaguggcuuucaauugucgggccaccacacuccuacuggauguuaguuuauuauaaaguugaaauauaggaaaaaagugugguugauuuuuuuuuuuuuuucuuuucaccucccuuuucugucuucauacuuucaaucuguaucucuugcccuucuuauuuuaauuggcuuuaguuugaucucauugcuucucucaugccuguggagucaguagauccugcaucauggaggcagggcuugcgcaaaacuggcauugugcuggugcccaguaagggcgaaaaauccauggugaggcacuucuaugugcaagagugcaaguaucuggguuacggcauaacaagcuucaugaguguggguuccaaagaugcaugggucaaguccuuacagugugcucauuguucucuguaucugcaucaucaucuucugugugauaugaaguguguaguguguguuuauaaagcuaaccucuagaaaggcgaucuguuuacucucuaagguuuagauuuuugccuuacgaccuuaaccuuaguaaauguguuuucucccaaaacuaucacuuaaaauuuuagacauuaucugaaauuaauuaucucuaaauuaaggaauaauugguuuuaguaacuuguuuuugucuuuuaugaaauaaaaaccaguuuccaauaucgacuacaaaaauuucucccaaagaagaggaaagaaaagaugagucuccugcauccuggagguuagggcuucgaaagacuggcaguuacggugcccuggcugaaaucagugcgucuaaagaagcccagaaggagaaagacacugcaggggugaugcggucggcuuccaguccgagacucucguccucuuuggauaauaaagaaaagguaauagagagacgcucuaguaagcaccauuagauccuggguaucagcuucacucaccgacucuagaauauagaaugcuccuuccugucuugugaguaccuggaagagcaguugugcuugcauaaaacaagaaauuugaggagauacuaagccuuuaaaacuucuugauauuuuuuuagauuuauuuauuugauacaugugaguguuuugccuguauguauggaagugcaccgcaugcgugccugauacucacacaagucagaagauguuggauuuccugggacuggagcgacacaugguuguaggcccacugugugggugcuaagaaccaaauccaguuccucugcaagagcaucgaauguuuuuaaccaccgacccaucucuccagcccuccaaaucaugcuuuuugaguagaaugcucuagggaaugaacagguuuauauuauuuauuauugaguaaguuucccggaguuaaggaacgcaauuuuuuuuucuagcauguaagcaugaucaaguuaaauucaauuauuauuugcaauugccaagcuaccuuuuuuaucuuauacaaguaugucuuaaugacuuuuaacuauauuuaacuauauuuugaaagaguuuauauugcaucaaacagguacaaccaaaauuguucucuuacugaauugccugugauugggcuacuuaaguuuuuucaauacauuuuucuuuugaauguuaccuuauauuagacauucuacuaugagguuucuuucccacucacuuuaaugcuuugcuuucuuauaacuuuauugccaaguauauuggcaguguggaagugucgcuaacacuacauacucucagccacacgucgcaguaauacaauuucgauaaugucuguuuagaauaccuuaauauuugaaagcauggauugucagaguuguaaguggcuccuuguugaacugcauuugaacuuuaugucuucaacagaaauaaauggauuuuaacuuacuacauuagcuuuauacaaaccuuagaaaaagucauuaauaaaggaucuuucuuccuuuccugaaguaagugauuuucuaacuuuagccuaggggggcaggaaagggagcuggcggagcugagcuguuguucauugcuuuuggaggaccucgcugacuuguaugaguauuaaaguucaggagcuaaacugggaaaggacugcacggucacagacguguuaaagccucuucauguuuucaucgcaccuuuugucauucaugacuuuccuguugucaggagaaagauaacaaaggaacgagacuugcguaugucaccccuacaaucccgagacgacuagccaguacaucugacauugaagagaaggagaacaggugagugcagagaggcggcugugugcaucccugcagagucugcaguguucgcauugguguuagaugugaggacugaugcgagcuuucaggaagagagagggcuguccgggaccagcagaacaccagguacacaguccugcgggacaagagcaugcaggcuuaguguguuccugaauggcaaggaaagcaaaagcagacgacacacaaauagguucagacacauacaaaaggggaacccagccagacucaggagacaggagcaggggggucucucaggguucuggaacagccagggccacacagagaaacccucucuugaaaaaaaaaaaaaaaaaaagagaggcggggaggaggggggaggggaggauggaaggaaaagggaaacacugcauggucacugucuggguuuugggguguuuuugguuuuguuuuguuuuuuuuuaauuucuuuuuuuuuacucucaaguguuauagaacuuuuuauuuguagucaugcuuuagugucuaauuauguaucuucauuuuuuucagcuaacauuuuauauauuguauaggcucucaacauauuuuugucauuuuauaauauaugccuacauaucugucuuaugcugugaaucacaguauuuugucuuauaaauaauaugcuucuaaaugcuuuuauuuaggauuauauacugacuccuagaacuaaaauuccucccacuuuuugguaacuauccugaaguuucccuaugggauuuuccuuacaucuacucuuuuucacuaguacauaccuuucuuauccuucuucuaaaauuaccuaccagaaucugaaggcuguuguuuccacagagagucuucaaguuugcgaacaaguaguucuuacacaagaagaaaaugggaagaugaucuuaaaaagaauaguucgaucaaugaaggauccacuuaccauagaagguaugauguacuuuauaaguggcuucucuauguccuuauaaaaauagccgcugauuuaauaucaguuaugcaaaucuuuuuaaaauauuacaucuuuuuugugugcuaaauuuaauuuagagacacaguaaauauaaagaugguguggauuuauucuaacuuauccucugcauauauauuuaauuaaacuuggaauauuaugaaaugucuuuuagcacuuuuaauggaacuucuuaugauugacuaaauugucugaaaugggauauugucauaaucgauuuagcuauugucuaugaucuggaacauuuguuuggacuacaacucagcuaugaaagcauagaaucuuaaugcuguuauaauggagacuaggagaguucuacuucuuuguggaaagcaagaauaagauaugaacacauacacguagacacgggucgcuccugaggaguuaacccauugcaaaaaacuuuucuucggaugggccauaugccuuauuucccuugaaugaauccacuccacaauuuuuguuagaaccagcuuggcaugaccauuuuuggucuaucauauucugaaaauguucaguguugacuguuauugaaggcuuugggaggaggaggcauaaaauucuacaccaucaaaucaguaaaaugaaucuauacucuagcaauuguagguccaacucuuggugcuggagcugguggucugaugaggagcacaguuuguuuucuacugugugcaguugugugauaucugagauagugaauguagcguccacauacagacacauccuacauagaaaugccucuuuccuuuaguugcuccuuugguagaagacaagaugauuugauuaguuguaguguuccaagcaccacaucaacaccaacaguuaccucugcagcggggcuucagagaagccucccuuccagcacaagcacugcugcaaagacucccccggguuccuccuccgcaggcacacagagcaggugagucacagagacggucuguguccaggucuacugugugcuuaugugcgugcaugcaucguuguguagacaaaugugggcucuggauuuuuuuauuuaccaugucaaaauuguuuuuaagcaaaaauugguuccaaaaaaaaccaaaaaaacaacaacaaaaaaaaaacaaaaaacaagcaauuaugcaugucuggggaaaaaauauuaaggucuuaaaucauauugcuuaaaauaaaaauuuauuucuuuggcagcucugcgugagcuguuugauuacuaaucuuguguuuuuaaaaaauccaucccuguggucaccuguuuucagcuucuagaaauggcuuucguuguuuagcuguuuuccuuuucucuuuuuguguugcugcuuaugaugcuauaguaccucaaaucguuugugggcugaggauaguacugagaaagaaaaggacagugcuccuacugcagugaccauuccuguggcuccaacuguuguaaaugcugcagcuccuuccaccaccacccugacuacaacuacugcuggcacuguuuccgaggucagggagagacgcagguguguacagguccucucaguacuaguuucugcugauaugcuuggccaguuucugguauuuuguguucuuugcuuguuuguuuuguuauucuuggaaaugugauauguauuaguaacuacuuuucuguuucugugcuaaaauaccaugaccaaggcauuuuauagaagaagggggugggccagagagauggauggcucagcaguuaagaugcccuuccagagguccugaauucaauucccagcaaccacaugguggcucacaaccaucuauacagugugcucacauacaaaaaaaaauaauaauucuuuuuuaaaaaaagauuaaggggauuuugcuuauagguucauagcguuagaguccauaaaugucuggguaaaggcggcaggcagcuguggcuagagagugauucugagagcuccuuacaucuugaacugcagcauaagaaggaggaagagcugggaaugguagggucuuuaauaucucagagcccaucaccaguggcauacuuccuccaagaagggcagacuugcaaagcccccucacgcagcucucccaacugggaacggaguguuaaaauaugugauccuaagaggcauucucauucaaaccaccacaaugaccaaucaucuuaauaggcuaauaaaugaaaugucauguauugacuccagccuagggaaaugggcacagcuagcaguuauuagcaguuaggcguuuuagucaucucugaaagaauugaugucugggucaauaaaggcaaagccagacaacugucuuccuagauguuaauuaucuuaguguugugugugugugugugugugugugugugugugugugugugugugugugcgugugugugcgcgugcgcauucgagagcacauguguugugaagacuugggagaaaauauauuacaacauaccaagauuaauuguucuuguuacaaaggaaauagauguauuuuaaacaguuuuguguuuaauuuucauuguaagauuauauaagguuagccguguagcuuagugguaaagccauugcuucagguaucagucccagguucacucuuuuugucuuccccuuucuucccaguucuuucccccuccagcuccuuaccuccucccuccucguccuuccuuuugcuuccuuccucuuuuucuucacugggggucaaacaaggggcuucugucuaccauugaguuacacuggagacacuuaucuuuuuuuuguuuguuuuuuuuguuuguuuguuuguuuuugguuuuuuguuuuuuuucgagacaggguuucucuguuuagcccuggcugucguggaacucacuuuguagaccaggcuggccucgaacucagaaauccgccugccucugccucccaagugcugggauuaaaggcgugcgccaccacuccccaacccccccaaccccccggcccgagacacuuguaucuuaauuacuuauaaaucagcaguuggaaagaaagguccagacuccguuuuaucucuuaagauuccaugcuuuuaauuuaaacaaaagucucagugacagcaugcaaugaauauccccucagaaucagcaauuauuuuagaaucaaauaugauucucuccucccgucuuuccucccccgucagagcuaggcucaaaaccagugccuuguguauuccgugacagcuguaguacucagguuuauugauugcauuuaagaagagaauugaggaggguauggcuuuuaaaaauuagucuuaauuuuaguggaggauauuaaagauuaaaaaaauaaucuuugggcuagagagauggcucagucguuaagagcaccgacugcucuucagaagauccugaguucaaaucccagcaaccacaugguggcucacaaccaaccauaaaaagaucugacucccucuucuggggugucugaagacaacuacaguguacauacauauaauaaauaaauaaauccuuaaaaaugaauaaguaaauaaauaaauaaucuuuauuacauucaccaaagauuauuuuaguggcauaagaaacaaaauguuuaucuuuuuuucuguuaaaacugaaaacagucuguauugcuuaaacacuaucacaguucugccuuuuuuuuuuuuuuuuuuuuugguuuuuugagacaggguuucucuguguagcccuggcuguccuggaacucacuuuguagaccaggcuggccucgaacucaguacugccuucaaaaaaagcuuuaaaagagucaucuccguguaccagcaucguuacuaggguggaauccuaguuaugguuaaagacauggaaguaaagccagguuccuucauagagaauuuacagagccuacuacacucuggcuuucuagguuuuuucauuugguuuucagacccuucaucuaguucccacguuuucugcugccuggcaguccugucugccuucgggccucauccaaucucuuccuagauuucuuaucugucucuggguguuggcaguaguugccccuuggcugucaccaucuguauggugacagauaaagacccaccgacaucaucugcgucaaugggagaggucuggagaggugcacagaugauuaacaccauguugaccacuggcuuaaguccuguauucccugugccauucucacaaggguuuguaagagucagcagacauagcaguuccuucacugugugugucugcugugcugucgucuccuggaugcuccgcuuucuuuacucuugccugugcuuaaaucccauucccgggguggggccuugcccagcugugggcuggggaaggugcaucuggccacucucacagaaauuacaggagauaauagcagucucauauuagccuugcacccugaaccucucuuugcuguaaacuccuagguauuauauuucugagacaccuuccuacugaaggcuggcuuggaagugagucuacugaaggccuuccgugguugugucuuuuaaccuuguuucuguuucauauuucuagagagucuguccuuuuucaguaauaccuaaaguaauuuuagugucuggacuuucuuccacaugaaauaguuaacuggaaauuuuuauaaauuguuugcuuuuucugguuaucuuuucauuaaauucuaccagagaaucugaaauacauauuuuuuugucuuaaaauauauacacaguggcaaaaauauauagugggcaggguuaggaguuuggcuuagugauggaaggacuacuugcuggcaggugugcaguccuaggguugguaaucagugcuaggaaaaaaagauaauaaauugugacugaaaaaauuucuuuauccuauuagguacuuuaagaucuaaugaaguuauguagcacacuauucaguugucuucguugaucaggguuguaucgaauuccuccuuucuuuuuaguuaaaaauuccaaugccuuaauuuuuuauuaguuuauuugugggugggugggguguaguauaucugugguguuuguagaugcaugcauacuugugcacauacaccuuucugcaugcuuucuuaacaguuuuucugugaacacgcucugucuuccaagaucugccucucucaacucuuaaugcuggaguuguaagcauguguggccauguccagcuuuuaugugggagccaaggauuugaacccuggcccucaugcuuacacaccaaguuuucuaacccauaagucaucuuuuagcccccugaugaauaaagguuuuuuuaacaguagagaaaaacuaccaucagaugguagacuauaauagcagaugaucucagagaaagugcuuguuacuuaccaucauuugaaaugcacaggagcaccuuacaguaauacugucuuuacauggaaccauugcuuuauauaguuauucucuuccauugucuuuuuauauuuccuccgggcuagacaggauggaucauccuguaaucccagcacccaggaggcugagacagaaaagccacaaaauuaaggccagucuggauuuaaauagugauuuccaagccagucuggacuacauagaaaaauucuauuaaaagaaaacaaaacaaaaauauauuuucucugaaaggaaaaaagcuaagugugaaauaagaaggcuguuacucaguuuuuuaaauauagaguaugguugacaaauuaaaauaccauuauaaguaaaucuguuucaauuaaugaauaaaacuuuguagaauaaaucuaauuaaaacaaaaacauugaauugauuaaaaggccaugguuuuauacuaauuggaaacagauauuuugcauauaaaauuaaagugcacagauuuuacaagccauucaacugguaguuuaucuccuuaacaaacaguuaugagaaauuaacauucauggaaauuuggaagugaauuuaaaaaauaauccaggcuuaugaaauaaaaggugaguuugugugaguuugucaaauuaacugcugugguacaauuuugcccuucuauaaauuugcucacugucccaaaaaaagugaccauauuugacccauccuaauugacuugcucucaguuucuguaaucacagaagcaacaagaaagcagucuucucacccuaaccuuaguucaaacuaaguuuccccuaacugccgagauugaaagccccuguaagaaauuaauuugucaucugccaguacuuaucugagaaaacagaugcuaagaacaauuaaucauauauucuagucucagcagacuucagaaacaaucagaaauauggacaguaaugaauacauucccaauguuugaaaggaauugaggcccucuaaaggauuuagagggggaacccacugcagauggagugugaaucugcgcuacuagauucucugaguuuaaagggcucguagaagagagacaaacagcauaaaacccacagcugacugcagagcuuguuaaagaacagugacuaacaagcugaggugagcaggaaagcugacagagccccuguaaagaggagcauucaaguaaagaaagcuggcuagaccauaacuggucuuggagagcacggcgggggugcacuaacccuuacagagaaaguagagaauucuguaaugucuucagacagagcugaguucagugacaaaagcggucaugguggaacuaccccaaguaacccuggcuacuagaggcaaagcuucgucuccuuuugaaauuccuaggguuuuguucaaaauguggacaaaacuaugauuucuacucuaacuguaaauaguaauaggacugugaagaguguccccaugucauugcagacauuccgacauuuacaguaaagacuuuaagucagacauuugcacaagucauuuaacacuguuacagcaaagcaaaacaggccaaaauggaugucauaagggauuuggagucagguuugugaaggaagauguacuuaaaaauauuuuaguuauagaaaagauaaaaccuucacucccaguuuuuguuuguuuguuuuuugguuugguuugguucgguuguuugaaauagccucuuucugcauagcccuguugaccaggcuggucucaaacacacagagaaaugcuuccuucugccuugcaggagcugggauuaagaacaugggccaccacauguccagcccuccuuuccuuuuuuauauaauaaaaaauaacagaacuuggcuuguuaagugggcagcgcuaguaguggacuugugggccacuagagagguaacauggaaugaggugauucuuagagguuggagucaaccucucuguuccugugaauugguucugugccaaugaagugcuuguaucucuuaucucuuuuaauggaguaaaacauaaucuucaguccucucauugcuucuuuaaaauuaagaccauuaaauauagaaagggagaagucaacaugcuauacuaaguauaacugguuccuguucagaaagaaaugagcugaaaagcuuacucagugguugggagcacuuauucuucuugcaggcccaguugcaauucccagcacccacguggugguucauagcccucccagagggacccaauggucauguaagcaucaggcaggcaaguaguauagacguacauauagauaauucaccuauacacauaaaauaaagauugaaugagaauggucauaauugcauuagugaguuucaaagccagguacaaacauuuucugaagauacuuuuuuaacccauuaaaaacugugcuugcuuguuuuaaucacaaacauugauaaguauuucuacucauaaauauugacucuccaacuaacaguuuuuuauuuauuacuguaggucauaccucacuccuguuagggacgaagagucugaaucccaaagaaaagcaagaucuagacaagcaagacagucuagacggucaacacagguauaucuaauguguacaauauagagagcauauacuuaauaaguggguuuuucauuuucacucugggggaaaaaucagaagagauaaggaugauguaguaauccucuuauagcuuuuguguauauacuuuagguaucacauuacaucuaaucaguauccuuugucucuuugaauguuguuuuuuuaauccccuauuccuaauuugguuuuuggcacagaacauauucauagguguuagcauguauuauaagguuucccuuuuuuuuuuuuuuuugguuuuugagacaagguuucgguguagcucuggcucuacuggaacucacucucacucuguagaccaggcuggccucaaacgaucccccugccgcugccacccagccauaugguaccuuaugauuauuaaagucuuaugaauguguagugaugauggagaagaggccuagugcucaguauagaaaacagcagaugggagaugugagaagugucucucuggcuaguuacuaacucgcuuccuacucuucauugugauuaugauggcugccuuuccuccucaugagaucucaguagcacgggcucagcuguuuggacuuggccuguaaagcggugugguugcuggguccuaagcuacuucccauccagccuguucugaggaguccaaccugaacacugaagauugugucaaaccucgaguuaaugugugaaaaugaaugcauauaguguauuaucuaaauucuauagauugacucuuccucuucuaaaauuagauacauguauugagauuuuuccaucucuuacuauuuuguuaguuuuugaauacagauucuuaccuauaauuauaacuuccccaauuccuaugauuauugugauucauaaaaugaaugugauucacuauguaaaaauaacauucauauuugcugugucaacuuguaaagugcucuuuuuaaauggccacuaauaggcaucacaaugugugccuuuuuugagugcaggggguaacacugacugaucuucaggaagcugaaaaaacaauaggaagaagucguucuacgagaaccagagaacaagaaaaugaagagaaagaaaaagaagaaaaggaaaagcaggauaaagagaaacaagaagaaaagaaggagucagaagcaucuagagaagaugaauauaaacaaaaguauucaagaacauacgaugagguaaugcugugggcagcacagcuggucugcuuggcucuuagcguucucacagugcugagauguauggucucauaagcaguguggcgugcaugagaggcguaggcuggagucugacagcuuuggcaugaugagaacgauauuguucuuuugaaaucaguuuguguuuuaugugucuuuaauauuucaaauggguuuuaaugcuucccagacuuacacacguuauagaccugugucaacuucaaguucaagcgcuccgucgucguccucacucucuacucuaggcagcacacucuaugccucaagucagcucaacaggccaaacagucuuguagguauaaccucugccuacucccggggauuagccaaagaaaacgagagagguaagaaaccaccuuuucuuuccaguaauccugagagccggucucucuaauuaguaaugcagcugacguccaucguaagcugaugugcugagcagaaacagugugcagucguuaguguucuguuccugucugcauugcuagcacauucaaaguccucauaauccugcagugcagaggccauuuacagaugagaaacggacaucuuaagacuaacguguuuauguugauuugcauuuaaugaaagauaacuuuucagaagaaagcaucugcccuuaggauagcagugaggugcuagaagacaugguggaggcuggaggcugcaacagggcuacugcuacauggcccauugugugcuucugugugcuuucuccucuugcacgggaguucugcgaguaacuuguuaacaaugacgagccugccugcccaucagccgaucagccauuuucuacacaacaaauaugucucuacggaugguuuauuuugaacaccaagaauguagagauaauuuguucucaugaucauuaaacgugugccauaaugggaaauuaaaaugcaaguuuauaccaaauauacauauaggaguacugauggggacaaacauuauuuuaauugaagaaaucuaagcuuuacaaaagaggcuaacaaaauuagagcacuauuuauuuuguacaugcuaggcgggggcauauguguguguaagugcgaugacacaccugcagaggucggaaggugccuugucagagucuguccuuccgcugcguggguccccggccuggcagcauucuguuuucccacugcaccauccagccggcucuagagcuguuuugacguaugcuuguaaaaacauugucaggauaaauugcaaucaugccguuuguguaauccauaaauagagggagagaaaaaagaagaggagaaagaaggggaagauaagucacagccuaagucaaucagagaacgacggcgacccagagaaaagcgacggucuacuggagucuccuucuggacacaagaugugaggcccucuuagaaacacuaccucccagaaguacuugcucacaauuccuuacauugcugagaggauacaugguuuaaaucagcagucuauugaguuuuuaaugcuuuauaaacacagucaccaaguagcuagauguguguguguguguguguguguguguguguguguguguguguuuacuaccugaaucagaaauuuuauuccaauuuuggaauaauuaaaauggcuauugguuaugguguacacauuauuuuaaaaugcuaauagaccuucaaagaaaaaugcuuuccguguuguacauuaaucuuauuuuuauguuauaaguguacauaaaagaaccuguuuuuuucaaacaaugcaagauuacagucauccugcgaaaaggaaaauuuucaacauaggguuauaggccucacuugcccagugggugcaaaguuguaggcuuaauucccaguaccacaaguaaauaaauuucuuuuucuagaucucagauuauaacccuaauauuguuauuuauuagcaaauggaauaaugugggguggcacuguuaaugugaauauuaauacauauauauuauaacuguuauuaauauaacaguuuuaagggaacaaaauuauuuuuaaauguagcuucuugguaguuuuucuaauuuuuaguaauuuauuuggcaagaugaggauuacauuauacauucuaggcaaauaaaugcuuuguuauuaauagauguagagucucaauccaaaaaugaaguuuaucuagaaacauaauuaguaaguguauaguuucaugacagcauaaaauggcaguacaaagucauauuuucucucaguuuuugucauucuuauuuucaagaguaagcgcauuugaguauacaacuguauuauguuuuugaaguacaccuaugcuguuauaucuagcaguacauuucuuuuaaaugcuauaaaaaauguuccucuguaaacuguauauauuccuccacugaaagucacccaguugaaauaaccuacacaucuccacagguugcucuuacccuuaacaaagucugccuuuggggcgggggagcuauacaguacauuaggacaauagucagggauguauguggcugguuuugauuuuuugguuuugcuuuuagauucauaaaaccagaaauaaagguuuaggaaauuauacacguuuauccuaaaguaaccuuauaucaaaaguauaacuuccagcuuccaaaguacaggcagaaauuaaaaguagauuaaaaaauuuuuaagggcuggagagauggcucagcgguuaagagcacugacugcucuuccgaagguccugaguucaaaucccagcaaccacaugguggcucacaaccauccauaaugagauccagaagaggagaggggucacccucuucuggagugucugaggacagcuaugguguacuuacauaauaaauaaauaaaccuuuaaaaaaaaauuuuuuuaaacaacaaaguuuugaaagcugggagagaaugaugccucagugagaaugaaugguaaggagccaacagggaaaaaagcaaauugguuuguuuccuuuaaaacuucuaauuugggcuggaaagauggcucagcgguuaagacugcucuucugaagguccugaguucaaaucccagcaaccacauggugguucacaaccaucuguaaugggaucugaugcccucuuuggugugucugaagacagcuacaguguacuuacauauaaaauuaaucuuuggacaggagugaacagagguccuguguucaauucccaacaaccacaugauggcucacaaccaucuguacagcugcaguguacccacauacauuaaauaaauagauagauagauagauagauagauagauagauagauagauagauagauaaaucuuuaaaaaaaauaaagcuucugauuuaaaauagauuuaaagauuuuaauauaggaagguuugaacacacauaaaagcuuuaugguauaauuuuuuuuguuuuguuuuguuuuuguuuuucgagacaggguuucucuguguagcccuggcuguccuggaacucacuuuguagaccaggcuggccucgaacucagaaauccgccugccucucaugguauaauuuuugcagaaucauuuuaaauuccaaaaguuaaaaaaaaauauauauaaagcuuucagugugucugguuucuuuguuuuuuguuuuguuuuuuguuguuguuguuguuuuucgaguguuuguuuuuguaacgcaaucugacaaugugcuuuagagugaugaaaaugagcaagagcggcaaucggacacugaggacggcuccagcaagagagagacgcaggugagcagcuggagugcgugcgugcgugcgugcgugcgugcgugcgugcgugcgugcgugcgugcgugcgugcgugcgugcgugcgugcgugcaagcauugccuuaggcucucgagaguaugaagcaguguaaacuagcagcucuuugccuggcucaggcgacugaauggacauugcuucuaggcccaaguauacuuauuuugacccaguucuuuugcuccuuaggcaagcaaguagacagccagcacaaugagaaaguuaguacugaggagagaaguggagcagagggacucgcuugccacgugggccugguagccugacccugauccauaaaacccaaagggugggagaagagaaccccaccacuaccaucacacacacaaagcagcagcauugguaucagauuuuaauuuaaagauacagaucagaagccuucaaauguucagggcuggagagauggcucagagguuaagacugcugcucuuccagagcuccugaguucaauucccugcaaccacaugguggcucacagccaugggcucugaugcccucuucugcuguguuuggagcagcaacagaguacuauuauauaauacaugcauacaucuuuuuuaaagaaaaaaauguugagauuuuuaagcuuauuauuuccacuucuagauauuuauucccaagguuguaaaugaaauauauaaagauaacuuuauagaaaauacauugcaacauugcuuguaaaaauaaaauauugaaaauagagaaagucaaugcauaugcaaagguuccuaugauuuuucuggcaguuugauguacagaaucauuaccagucauugucuagggucugggggacuggacgagaggcacagaagcgcacauacuguaguuauuuaugucaacuucucaaaaagcuauaaaggauauuuuuauuuuagagaaaguuuaaauagggacuaaggucaugcuacaugaaguaagcaagacaaagaaaaacauaauugugguugcacuugcgcagucuaacaaaguccaacucgagaaacaaacucagcucgugcucuccaggacggggaggagcagcggggagguggucgugugugugcugaaucucacgcacgacauugcaaacguacguaauacuaguauucuacaucauuuaaauaauuuacaauuuuuacaauuuuauggaguuuggaaguuacaauuuagcuuaaaacauaauuaaugguaacaccgugauucuuaaagacauagaauuggagugauuuuugauugcaagacucagucagcaaaacuaguaauaagugugccguguacauauuuuaguugucuggauuuuauagaauuuaauaucuuuaaauuuuaagguuuuuuaaaaguuguuaaauuuuuuagaaacugaagaguuaagucaauaaaauaaaaauauaaguaaaugaaagcaagggcaaaauuaauuuuacaaaggaaauuugaacagacuuuaguaaaccauuuuuuagucugaaaaaaauuaaacauuucugggggaacauaguaauuuuagaacuuguagaaaauuacaaauauugaaacucaagaguuuuaacaaaccaauucugaaugguuauuuuauggaaaauuauacauuaagugauaagggaggaaguuaaauuccccccccccccccaaacaucuacauucaucucugucuuaggauuccuguugcuucagugaaacccaugaccaaagagcuagcuggggaggaaaggguuuacucagcuuccacuugcacagcacuguucaugauugaaggacagauacuaaagcagagaagcugauacagaggucauggaagggaugcugcuuacuggcuugcucccccaggcuugcccagucuacuuucuuauagaacacaggacuaccagaccagggauggcgccacccacaguggacuguaccguccccccuugaucacuaauugagaaaaugccuuacagcuggauuucauggaggcauuuccucaccugaugaggcuccuuccucucugaugauccagcuugugucaaguugacaugccaaaaaaaaaaaaaaaaaaaaaaaaaaaagccaguacaaucccaauuauuuaucuuagcaaucauuucuugauaggaagauaggaacaucagugauacgugcuggaaauagucauauuuaauauaaaucuaggaguuuagaaugucaaauaguguauauauacuauucuauagaaaacauagccauuuggcugccucauuguaaugucuuuaaaaauaagaaugaaucaagugcuugccucaaagugucacaaaguaaacuuguacugcuguccccuucuccugcugauuauaagcaauggauaguucuucguccuuuuaguuuccuguuuaaacaguaaguacacucaacagaaauguuuccagaugagauuguaucguuuuaaacaugcaaaaauauaaagugagucuguguucuaaagucucccuaagagugagcauucuaagaguaagcaugcaugcugaaugaguuuaauagugugaacaucauuguuaccuuaguuguuccuauaaaucucaguuaacaguuuaaugaaagaauaaaguuuaauaugcuuuuuugguuuuuguuuuuuacuuucuagacggauucuguuuccagguauguuuaaucuuuuuccugauauuuuuuucucauuuuuacuguuaauaaaagaauauguugcugggugcuuaaugauuuuguagauuuauagcauuaaaugggcaguauaaaucugaaaaaucguagguggccuaggcuggcaagauggcucagcagcugaagugcuugcuaccaagccuaacgagcugaaucaauuccacacgguggaaggggaaccaacucucucaaguugucuucugccugugcauguaugcaguuguggcauguacacacacacacacacacaaaagagcaauuuuugaaaauacacaauuuuuuuaaaaaugaaguaugaugaccuaaucacuguugcuaguuuucuguguuaggggcgugcgucacuuuuaauucauggucauuaugauaaguuccugugaacaaagcuuguucccgaaugagcuccuuuucuuauuucaucacuaacaaucucacuguuaacaucagagacccaugaaaauccacaccuggccagaaauauauugaauuaguguucaacauccucuccuuuaagaaaauggcuaaguggagggauuuuucacaucaucuagcucacagucacucuagccuugauuauaaucuugguccauuucccuugcccacagcuggugaccaaaggccuugugagacugagaauaaauuuuauguacugaugauucuuugaacugaaccaaauaacaaaagaauucacaggucugauagcacacuuccuuuuuaagacaaacccauuaguaacacuuagaaaauucacugauuaucucaucaaaucuaagaugucacuaauuuuaaauauuacuauauaccaccaaaaaaggaaaggugucgccagcuagacuguagugaaucaugguauaaauuguuauagcaugauaaaauaugaaaaugucauuuaaaacguuaaauaauuuagcauaaugugaaaaguuuugccuuuuguauguagaaagcaagaauaacuuugcauuuauuauauaucacaaauugauaauaccuuacagagaccauuacuuaucaacugggaauaucaaggauauggauacauaaucaauguguacuaacauaauuuguagaagacuauaaugaagucucuguuuucaacucaacuuuugaagguaugacagcaguuccacaucaucaagugaucgguaugauuccuugcugggucgcucugcuucauacaguuacuuagaagacagaaaaccuuacaguagcaggcuagaaaaggaugacucaacugacuucaaaaagguguguggguuacuuaguuuguguuuuguacauuguguuuguguauacuauuuauaauuuaacaguauucugaaaaacuugcuuauaaagaaaucaauauuuugaaauaacuuauuuuuuauuaguuucuaacagcuaauaguagguaacauauaaauagccaugucuuagagagggaaaaaaauaccuauggcuuuguauuuguugugucugucuugcuggaaugagcuuaaaagggccauucggaaggacgaaguaugagucuaugcacacacauccuuuguuucauuaucuuuucauuugauguuuuguuuguuuagauacagucuuccuauguauugcuguuuagacacagucuuccuauuuauuguccucaaacuugcaaguuacuucuaagcaacuuguauauauuuaaauaauuagaauauguugucagcauauucuuuauaguaaacaucuacauuaauuuuucauuuuaauauuguagucauugaggucucuucagcauaacaacaaaaguaaucuguucuucauuaauuuuucuagcuuuaugaacaaauuuuagcugaaaaugaaaagcuaaaagcacagcuacaugauacaaauauggaacuaacggaucuaaaguugcaguuggaaaaggcuacccagguuuguaccuuuuucuccagauaacagggugacuuagggugaccuaaaagcuuuacaucuaauuuuuguguaauauuaguucugaguauauuuguuauuuauaaugcuuuauuuaggaauaaaagggaaucaacauuauuaacaguuagcugauuucuggaauauaagaauacagaaguaaugucauauagaaagaauucaaaaguuuuuugugaugcaaaaaauugaacccuaaagacacuuaaguguccucugucagagcugcauacaucugcaaccucccauauuucuucauaauaauuaguauaugaggcugaagagauggcucaguagguaagagcacuggcuacucuuccagaggacucagguuuggguuccaauagcuauaucagagguucucaaccugugggucgcaaccccuuuggaggggcuucaaauaacccuuucacaggggucaccuacagccaucagaaaacauagauaauuacauuacaauucauaacaguagcaaauuacaguugugaaguaacaacaaaaguaauuuuaugggugaggguuaccacaugggaacuguuauauauacagcauuuggaacgcucagaaauacuaaucuacaugguggcucacaguggucucugacuccaguccaugagaucugaugugcucuucugaccuuugggcacagacauacaugugcagaaaacacccauagauguaaagcuuuuuucaaaauuguaaagaguaugugcuguaaagaguuccuguuguucaaguaaaggugaucagagcucgucaauuaaggaaauuuccugcuaaucuagggauccaaauucaguuccuaauacugaaggucucacaguucaguucacgcacaucuguaaauaccaggugcaguaucugauagccucuucugaccucugaaggagcucagacccacccuucuuucugugugucucuuucucccucgcccucucucuucuacccccucucucccguuagaaagcucuucuaugccugauaaugucuacucuuuucugacuucuuucuguggagcagcuuagagaugacaaagcucagauuuuugugccuagaaacuuggaauuaagccgggcgugguggcgcacgccuuuaaucccagcacuugggaggcagaggcaggcggauuucugaguucgagaccagccuggucuacagagugaguuccaggacagccagggcuacacagagaaacccugucucgaaaaaccaaaaaaagggggggaaaaaagcaauugucugcacacaacagaugcugugcuaaauuccagagucauuuaaaacaugcagucuuuugagaggguuuauugugaagauaaacagaaaggaagacagaaagcaguagcacacuucauaguaugguguugaaauaacucaaaugcccuucaggcugcauaaguaccaggccuuugagcauauagcagguacauguuguuauaauucuagggauuugguccuguuuucucaguaaagucaccaccucuguuuaccuggacugaugacgcucucucuguugcauggugaaucaguugaggcggguuuucacugcugaccuugcuuaccucucucuguuccuccuuuucuguguguccuuuugucaccucauuuuucuggucggcuuaauucugauuaauccuauuucuuacucaaacucuguaggagaggaaaaucgauaauaauuuucaugccgucuggaccugcuugguaaaauaacuagcuggacauggucuucugcauaguuuaggucccgagcugauagaaaaugccucagagcuggggcuugcagguauugaagauguagcucaguagugcaaaguguguuuaagucugccucugaaagaaaagaaaagugguguucugcagucguggauacauacagauuucugauucugaagucagagaggcaaaucucagagugaccggcugaggcauugucauccagcugcuuccuacagagccauccagccugcuaauccgccuccuaugcuggggggcuggaauguggucagucacaugugcuauuccugauggcuuaggaaggcagugagcaugcgcgggaaggcugugguacuugucaugcccuugaaggugcuccuucucacacucuguguaaaaugaccauccguuccuaaacgucacuuuuaucauuucagcacauacccuuuuuaaauuuuuaucucuuuacuuaaauuugccuauuauaccaccugaauauggauuaugccaccugaaaauuguuacuuuuuuacaacaucucaguggagaguuacauuguaucccucaucuuuauugcauguucaucuguuuucuuaauuucuuuauuacagagacaagaacgauuugcugacaggucacaauuggagauggaaaaaaggguaaguguccaucuuccugaauuaguaguguuuggaugagcagcaguagauuugguuuugucucugaggaugguaguuggguauuccaaacaagaggaaauguugauagaggaaguccuucuaucccuuucuuuuuucuacaauauuuugguugguuguggucugcacuuguacuucucucaguuguuaucauugcucgggguccagacacgaccguagcaauagucugaaacgugagacuaacagugauccagauguugaaaggaaccuauauaaugcagcacaugugaguggcagcuaggcuugcagguguggaagaacaagguguaucacaggaaccgugauguucauuccguaagucaaagaauaaguagcagaagcaguugauguggaagcauuguucuuccccaacauuuuuauuuaauuaccagcuugacuuuucacaaaaaauacuaaaaugguacagaauaaaauaaaauauacuacauucaacaucugugauauuuauugaauuguucuguacaguaguucgccuuuuauuauaauuuuagcaaaguuuauaaauaguauuuagacaccuuuuuaaagauugauguaguuaguaguugcuaaaaguucagaaucauguauuuuauuaaauauaauauuauuggauauuguuuguauugcuguauaucuacuuaaauguaacacugaauuuuaucccuaaaacagauagagugacuaagaucaguucuucuaacuguauaaauaguugauauagaaaauauugugaaauagaauagagcaacacuuuuuaaagaguauuucuuacaaagucagugauuauuaaacaaauuuaagcacaagaaagaacacacaucagugauauggucgaguauacaaaauugcuaauuucgugccugucguugggaugcgcauacauuuauauucugcucuucucaccugaccuuguugcugcuugucaaaugcagauaauuacagaguagcucaugcacuccugcuuagaaggccuuggugguuuaauuagcaugcagauuaauguuagagguggccaacauguauuugauguccuccacguguaaggcagauucgaugcuaagcaguuuacauguaugguuuuuccuuuaacaguuuccuugagcuuguaggauaggcaauuggaaagagugucccaggcuuacccuuuaauugacuuaaaaccuuaaauauaccuaguaaaauugagguuugcuggaguauuguuuaucaguccagacaagauuuagauagauagauagauagauagauagauagauagauagauagauagauagauguauauauauauauguauguauguauguguuuuguauauacacacacauauuuuacaaaguuguaaggaucaaauaugaagcuauuuugcugguguuuugagaaggacagugguuuaugugaauuugucauuguuauguucuuagcuagaaggucuuuaauaaaguaacacaugcucuaaacacauugacauuauaauaaguguaugacauuacuaaauauuaacauuaauuguuaaucugggaaagaaugucauugagauaguuucagugcuguuaaacuaaauguaaaugguuuguaucugaaagguggccggcaagagucaguaucuucugggcgguaugaccugaccagucuuacaguucauccaugacugcugcuugcuuucgcuuaacacuuuacaaaugcuucucauauaagggaaaauaaaacaggacacugcaauaauacauuguguguuggcuuugccugccacucuuugaaaugaauugaaaaauaaauguuguaguugcuguccuauauucaccgcauuaaugcuacacacuguaucaaccucugacuaaaucuguauagcuguagaguaaacugaauaacuaacucacaguaaacauugugagcagaagagaugagucucugagaucguuuguaaguguaaagcgcacauaguuuaggcacgguugcuucuugcuccucugcuccugacacuguaguauaagugcaucuuugugugugcguguucuuuucuauauagccuucagccuugauauuggcuuacucuaucccuaaguuuaucugaacuagaaagacaaccauuuggauauguuguauaacacccuacuagaaagacagagcguuaaugaaagccugugggaaguaauuucaaagaucugcagcuuauuccccaguucuggaaagcuccuacacagcaccagcaucacaucucuuguucacugcucuugauuuuauguuuaaugcucaagugucaccaugucacaguacacaagacagugugaguauaauugaguaauuacuggucucuucauugcucuaggaacgaagagcucuagaaagaagaauaucugaaauggaagaagagcucaaaguaaguaagccgugcugugaagcacugcuagccuccuguucguggucuccguucugacggucacuuguaaauucucuaggucagguuuaucuuccuaagcccagcucuuaauaaucuacaagaggaguuaaaaccuaaaacauuuuuguuacguuucccacuuacuuguuuauguguuauguuuauauguguauggaugugcacgccaugcgugaguguugagucagaggaaggagucggucuuccccucccaccauauagguccugggcguugaacucaggccauccgguguggagcaaacccuuuacccccugagccaucuugccagugcaagauguaauuuugccagugcagucguguaauuuauauuaauuuuuugacaguuuuauaccuguauauaauucauucugguuacgaucaucccccaccuucuuccugcuuuuuuucucuacaaacucccuuaacauucaugucuguuuugucaucucaucuccugaaacuagccagcaccaucugugugugacaguggguuugguuugguuugguuugguuugguuugguuugguuugguuugguuugguuuggguuggguuggguuggguuggguuggguuggguuugguuugguuugguuuuuaaaggcagugccucacuauauagaucuugcuggccuugaacucacagagauccuccuuugccucccaaguacugagauuaaaggugggagucacuucauauggugaucauggguuuggaauuacuaaccaauuuguaugaugcuucuaauauccagauauaaaaaacuuaaauaguuacaggauguaagguugauuugcguugcacauuuccuuuuguaguucaauauuucuuugaggguaaaccauagagggggacaagaaaagauaaaaaucuccuuuaaaaagaaaccuuuaaaaaaaagauacugaggcugggaauauaacucaguuguagaccagccagcccuaaagggucauucagucuucgggguuaaaguaaaaucaugagcugagagugacagacagaagaaucaaacucaccucugguugugaguuuugggguuuuuuuuuuuuuaauguugaacagugcagagggauaaaaaggugugguuaauugauuaacuguuaucacuuuguguguguguguguguguguguguguguguguguguguguguguguguguguguacacauauauaacaugucacauaauuaauaguauaagauaaugauacccuuaucagcaccucagaauuaugcuuaugaaauuagaauuucaaauuuuaaacauuucacugaaauaguuuguaauuagaccauuauuuuuaauuagcuuugaaaaauagaagcaagucucuuguauuuugauauauauugccuagcuugauguggaauuuuagcaguaaauuguuuacuguucuaaauguguuggaguauucuuuuaaauuuucaguuuuuuagcucauuuccuaugauucuaucuguucuuauuguaccuuugaguauuuccuuauuuuuuauucuuauuucuuuauguucugauuccugcagagccugcaccaaauaaaccaaauugagccucugagggagcuaaaugagaggcugcuggcugagaauagggccuugaccagagugguagccaagcgcucaggguucuguaggcaucugcagccugugagccuguaauucauagucucuucauugcuccuugguagaccaggcgggugugucuguuaguaagcguguuuucguaaaagcucacaacuacaaauuaauacauguguguagaacuaucacauacauaacuguuuaacucugcauggcuucucagaacuuuaaaauuaucacuaauuguauaucacaacugauaaaccacaguaaaauuagggacuggguuaggaauuaagacuccucugcccacucagauuucuuuugcuucaaacauaauuuagauauaucuacuauuuauugucauuuaugaaauacaaaguaacauccaaauuaaccuaaagauugggccaacuaugucugccuuagaaaauagugucacuugugcucaguucauccuaucuucacuguccguuacagucccgauggcagccucgaggcucuggauuaccccuggacacugagcucagggagaacuauguguggcucucuguaggggucacucuucucguagguguggcuggcaugaguaguguugcaaguuccauuuuugcucucccuaauauaccagugucacaggacauucugaaaacuaaaaaaaaagaaagaaaaaaaaagaauuaaauacuucuggaaaauacaucuuaauguccaaaauaaaaacuauuucauuuccuagucagucugccaaagugcauaguuucaguugcccucaguagaaaguuaauguaguuucuaacaucacccucgccuucaauuugucugugcagcaagagaauauugaauuguuuuuuuuuaaauauauacuacucuauauacauugaugauuuccauuuaaugcgugccucucuuugaucagacacuauuaggccaucagacuuggguccuguagaugaguucuuuaagaaaugcuauuauauucagaaggaguccuggcuuuuguaguuaagcuggggucuuuguuuagugguaguguccucuggcuuagugcugucaggagcuagggaaggagcuuacgauacaauucugccuaacaacaggcuccauuucacggcugcucuaauacaacaugcuugcgagucaaaauccaguagucuaguggacucaagcggauaauuuugagaguuaaacuuucaucccaucguuuaucaaacuaauuagcuuauaagcaguguuuucuccuucugguauaugucuuaggcuuuagaaacacauuaacugacaaagcuuggucauguguuuuguggugacuuugugacauuugugcagaagcucgcuuuguccuuuguacugaaauggaacucuucccuuguauuguuugucuccucauagauguuaccagacuuaaaggcagacaaccagaggcuaaaggaugaaaauggagccuugaucagaguuauaagcaaacuuuccaaguaggacaggaggcagagaagcaaagcagcaggacuugcacacuccccaguggaccacaguggcagucacuggacgccggaggaaagaacucacgggagacugucauuuuccgauauccugccaaacgcccucuuaucuaggaguuuuguuucguuuaauuuucugcccaccccguugguuaucaagaccauuguuucauguuaaagcagcugcugagaagauuuuuuuucaaugacugagaaaacuuguuuacagcuccagcaaauaaagaaaguguucaaggccagauaugccucagauauuuaacccguaagccuuaguuguauauaaauacuuuugugucaacaaaaacuuccagcucucacagaagacaguuagucaacagguuuuuuuguuguuggguuuuuuuuuucuuuuucuuuuucuuuuuucuuuuugaugugccacaguuucuaguuucucaauauuuaaauuguuugcuuuccaucugaguuuggguuuguauuuuuuuuuuccuucuaacucuucaugugucagagucucucuauguucacagccuucucauuuacagaaaacuuggcucuucugagcgucuugucacguguuaggcugacguguucucucccaccuggaacugaauuguggugggacacuugcugucacuguuugugcaauacgcauuuauuucuuacaugagugcuuuaacguccauugaaauuugaucuuuccaguccuaucuucugcccucaucugucacuuuuuguuuuuuauuguaguauaagaugcuagaugcuguacuuuucacauucauuuuagcagguacugagugacgcuguauauauaaauaaguguauuguuuugauuuuuagaccaccacauggcaugcuugacuauuuucuuaauucagaugucugcagugcacagugggcuacuccauaaaggucuuuagagcagagcucgcucacagugggcaggaggaccugaaagauucugcgguuuaugggaccuccccuuccaagcuuuucuacuguaaacugcuuugcuuuuuuuuucauucgguaguagucagaccugauuacaaaguagagaaucgcuucacauuucacacgccuauauuuaucugagugcugucugaaacuguugugcuagccacaguagugcuaggagauccuuugcagacuuaaaucugugagugguguuaagugcacuguuauugccaugugagggggcaucaacucugaucccaccaccauguucagaccguuuuuauacauuucaguggccuuuuuuuaaggaaaaaacuaagcaaaaugaaguccauaaugaaaguggcuuuuauuuggacaaauaacuuuuauauuuucaucaaaccaugcaaaaaauauauauauauuacaucuuccuggcacauaacugucuccuuaaccauugaacaguucagccauucgaauaaauuguacauuuaaagcguauaguagcugacuguauuauugaguguauuguauacuauauuaaaugugaauuuguacccuuccauuuuaaaaggucauuguguucuacugccuauuuuagauuacuucggggaugggaaaggguguuuugguaaguagaauuuaaguccucucucuugauugguuuuaugaggauauaagguuauacucuuacuaccaagcucaggauucuuuuaaagguacaaggauaggugugaggauuuauuuuugguuauauuugaacuguaugaauggugggucugaaaacagaguauuucacggucuagugaggagguaaacuaugcggcuaguugaucagugugagugacugcagcguguucugggugcacaacaguuaggcaugcugugguuuguaucugugaagucuggaugccugagaagaaugaguaaaugcguguuucuaauauuuuaguguuuuguauuuagguuauuuauucuuuguaucuaaaguugaacagcuacugugcuauauugacuuuauugguaggacugagcagaccuuauuucugcaugaaacuaguugcaaaacccacuauuuuggaaauaaaaauguauuuugacauauacaaauaaaaugaauaaaacuauuuuaaaugugugaacuuuuaaugaaaacaguuuaaaucuuguucugagauauuuaaauucugcauggguauuuuuucacuaaaugcuuuacuuggauaacaguuugaauaauuuuugaaauuguaauauugugauaauuugcacagcaauguacaugcucaucuguaaaugcgaacuuaacugccauauuuaugcaaucuguguaccaauuuggacaaauguuuauguauuuuacauaaagcugucuguaugcagaaucugagagcuaguuuuuuuaugccaaguggacaaaaauaaugguaauuaagauucaagauaguugcuuuguagcaugagauuccauuuccauaaacauuugcaguguuuaaaaacuaaacuucugguuuuuuccuuagcucuagacucaggcauaagaacauacacaaagauacuauuccacugaaauuuuaaauccuuuccacuaccauuauuuuccaucuuggguuucucgaggguucaguccacccgcacagcucgagguggcugaguugcgcuuuuaacuucucaugugggccuuugggcaggaaccugaaguaaaccauguucuuuucucuggauuuccagcacuuuguguauuuuuguucacagcauugucuggguugcucuuguuuuuaaaaugaagaaaaacauuucagauacgacugucuugaaagccaagggaaggggagagagaaucugcagacgcaucucagagaagaugcccgugaagagugaugugggggucgcucaucacugggcuucuuuuacccaaaacucuauuuccacggccgggccuggaagcacgugccuacaagcugagcaacugaacaguacaggcuggaagguccaucgaguguucaagguuuuucuuaacuacacagcaggccugaagccagccuagacgacaggaggcccugucucagauaagcaagagagaaaauacauuguauugccauuuagucuuccuggcuagucuuccuuaccugagacagccauggcuucugaugccaagagaaaaugugcagaaagccagauucuucucuuugcuuuacguucuuuuuaacuuuuauucuuuucucauaaauugaaacugacauuaacugacagucaguuuccccucucuccauuucccccagucucucccuccucccuucuccccaaggucagcuccucuucuguuucccuuccagaaagaaaaaaggagcagaggucccaggcauauccacugcgcgaggccuggcaguaagacuaguuacauauccucauaucaaggcugggugaagcagcccaguaagaggaaagauuuccacguuggaaauaccacagaacaccaagccacacaaccaucacauacaugcagaggaccuagcucagacccauacaggaucuuguguuuuucauuucagucaucaugguguccuugaccaaucuggcucccacaguccuccuuccccucuguggagucucccuggcuccuccuuguguuugguugugaaggucccucuuuccuaaaggccacauagcucuguggacuuucuuugaccuuauauguagcacacaaagcaaaugcuaggagcagguauuaacuguccaccagaccugucuucccauagaaaacuuauuacaaagguaaaagauagcugauagucggggcuggugagauggcucaguggguaagagcacccgacugcucuuccgaagguccgaaguucaaaucccagcaaccacaugguggcucacaaccauccguaacgagaucugacgcccucuucuggagugucugaggacagcuacaguguacuuacauauaauaaauaaauaaauaaaucuaaaaaaaaaaaaaaaaaaaaaaagauagcugauagucuuuucuaugacucuguuuucugcuauguaaguguuuccugaauacagaugugcagcagggauaacauacauauaaguaauacugugcagaaauacuaggauuagaaugacauauuacuuauuuucuuccaguaucaccauacuaaauuguuugguuuuggaaagcaucucugccuaauuuccauguaaauggcagugucuuuucuggaguaaauaauacauguuacauugcuauuuugugccuacaaaauaaccagauuacaaaguacuaaaacugugugccuguguguguguguguguguaugaacccaaaguccagaagggcuaaauuuuauuucuguaaugugauaaccuauagcauuugagugguagauuuauguguguaguacucaaacagcuaguugauuccuugaugcagauucugaacuuggccaaaaguaaauaaugcuuguaaaagauuucauauuccuguguaggggaaaaaaaagauucuugauuuuuuuuuuuuguuuguuuguuuguuuuugguuuuguuuuuuuucaagacaggguuucucuguguagcccuggcuguccuggaacucacucuguagaccaggcuggccucgaacucagaaauccgcccgccucugccucccgagugcugggauuaaaggugugcgccaccauaccuggcaagauucuuuucauagucuuccaaaagaauuuuuuuucagcugucaguugaagcuaacguuccaugguaagaugggcaauuuugauagucgugguauguuuucuugucagugaccauguguguagaaugccaaauauauaaaaagaaaaauagcauuucuauaagcucauaggagacacacauacacacacacuguaggacucaaaaccagccucccugaggcuguguuagacaacaucaggaccuuuggccuacuuugucaugguucuuggacugugaucagaucguuccugaucagauuguaccuagcccguaguuuuuaauaaaugugucuuacuugggcucuagcguaguuauagugcaccugaaagaauguguauuaaccuaauuuuaaguguauugcuacccuguccaacaaugaaaagagcuacugugauaacucuauaguccagguuagugcuuuaaugucccucagcgguuagaauguggaccagagagauguucagaggguaaagugccucacaggcaggaacaccugcguucuaucuugagaacccacguaaaaggccaaauauggugccacuuguuaucucagagcuggagaggggacuucagggagagcccuggggcucacuggcccgcccgucuagccuaaucgguuagcuucaggccucaaagaaggcacuugacauuuuugagggugacacuuaagguggucaucuggccacacacagacauugcacauacaugaacacacaugcacuuaaguuuuuacaacuuugguccuguguuuauaauuaauaaaaaauaaagcaguuuaagcgggucaaauuugaacuaaacuuuaaaagcuuuaaaagacuuaaagagagcuggcuugcaaaccuuugacauaauggauuuuugaauugagucaucucuacaugcagauccuagccucccuugagaaaugucaguguuagauaucuuguaguauuaggagguuugauacaacucuuucugacuggaauauauugggagagaauuuugagauaauacaccaugaacaucuguuuuguucugagacugguaagagaaagauggcaagaggcggguuucagagaacuuccuugagcaccauugcagaaaaguggagagagacccuguaaccauauuaccacaccugucccaaaggauuccaaggacaccaaccugaccugugaguguuuguaugagccccaguagcuugcugucaucagagacacacaaggacuuuucuagcugucacaugcaaauuggcaugguggguagaacaggcuguaguguuuuauuaaucaucguuugccacucuucaaacucaaaagagaaccugccugucagugcacaccuucaaucccagcacugggguggcacugacagguagaucucuugaguuugaggccaaccuugucuauauagugacuuccaggucaggcgagacuacacagugaggcccugucucaaaagacaaguaauuacucauugcuauuccguguccuauuuuuaauuaauuuauagauggaauuggcuuaucaaaaaaaaugcugcuuaaacuaaaagucauuuugguagccuucaagucagccugucccauaggaacugcuugccuccuucauuaccugugagcucuccauugucuggacccugagucccgcccaccucauucuuacccugcacugucugauaccuggucauugcuuuacugaggccaagagcagaaagggguaggaggaaaugauaguuuaguaguuuucuauguuccauaccauugacauuuuuuuuaaggugguuucacuauuuuuuuucuaggacuugaaugucaauauuuagcauagucccuugauuagaucuuuuaagaaggaaguggcuuaguuugaucccuggucccaugguggaagaaaaaccagaagcacaaacacacaggguggugacaaaauguucuaaggaaauagugaagcuaaauaauucaguuauguauguuuugugggagaaaaaaaaucuuggcuggccuguguggaugucugugcauucgugagccgaucaaggacuucccaugcacuaaaugcuuugucccugagcuauacacccucugcaguggcaucuagaguuugaaaaaugauguuaaauguauaugaaacaagcuguucaauuaaaacugccagcugggaguauaacucaauaguagaaugccggccuagcacguacaacaccccagauucugucacccaaacugcaaggcauacauaaaaauaagugugcccugcagacuuuguuucagccauucaauaaucucuuguuacuacuuacaggccaagcacucgccugugugaugaggauacauccaaggcuaaaugggaaacaggaagaucgagaagcacaugguguuuuagaaguaugguuaacuucagaaguaaacggcccaauaagagguuuuguaauugauggggaaaguagagaagagccuugccgcgaauauaacuagaauuaaaacugcaaggaauuuaauuca

SEQ ID NO: 5730 - RNA, 1528 nt, Mus musculus
ugaggggcaaaagggcaaccaggauuugaagccauugguucuuuaacaacggcuaaggagccuggucuggaaacuggcuaacgagguugauaaacguugaaagcugccugguaagacuugccaaaacaaaauaaugcagcucugaaaaagagcaagaaauaaaggaagaaaccucacacacaucaaauacacaaucaucuagcuuauucucaacuagucaacuuaacauucggaauccuuucggagucaaaucauuuaugacuuccuguccagugaagugguuugaguaaaaauggcccccgcaggcccauggggagugucacuauuaggagguauggccuuauuggaguagggaugaccuugccgguggauguguaucacuauggggacaggcuuugaggcuuuguguguucaagccguacccagaguggcacacaaucuucuguugcugccuuuagaucaagaugcagaacucucagcuccuucuccagcaucaugucugccugcuaugaugauaacggacuacaccucugaaacuguaaacuagugucagugaaauguuuuuccuuaucagagcugcuguggucauggggucuucgucaaagugauagaaacccuaacuaagacacccgguacuuguugaaugcccauuguaccagcagcugccagguaguguucuaaauguugggauugcuuuaaugauuauguuagaggaaagcuucaguucacauggauacaaacagcugcucaccccuggaaagacaaacaacaggcaacaaaacauuagcacgucguagucuuacccaggaaagcuggaugggggagagaggagggaauuaugggcugauaaucugguauuuaaucaaaaacguuaauggaguaaagaaaagauguuugcagcucucuggacacccguauuagagugaaagaaauaucaggugcaaagucccaaagaaggaacacauuuggcacauccaaggaucacagaaaaguaaaaacaacaugagaggcaugugucauccaagaugugucuuaaaguguuuuauucgucacacaaaaauguuccagaaagugagaucaauuuaauaaugugauuuauuuuacucaguguggucaugaccuugaagauguccaaggucauuggaauauggaagucucucacaugcauuuaagauuaucugaaugggggcagugguuaagagcaccgacugcucuuccaaagguccugaguucaauucccagcaaccagaugguggcucacaacuaccuguaaugggauccaaugcccucuucuggugugucugaagagaacaaugguguacuauuauauauuaaauaaacaaacaaauaaauaaauaaauaaauaaauuaccugaauggagcugcuggcagugguggagcauuccuuuaaugccagcagaggcggaggcggaggcggagguggaggcagguggaucucucugaguuugaggccagccuggucuacagagcaaguuccagaacaaccagggcuacucagggaaacccu

SEQ ID NO: 5731 - RNA, 3500 nt, Mus musculus
ccuucugcgggccugaccuaacggaagcguuacccgugguuccuuacccauggcgucccaggggucggugacggcggcuuugcggguggccgaggugcuggagagcaucgcgaaccgcugcguggggcccgagggcggccaaguguuguguacgaagcccaccggcgaggugcugcuuagcagggauggaggcugccuccuggaggcgcugcacuuagagcaucccuuagccagguaccucacuucuccugcccuccacuaggcgcgcaucucccucaaucucccaucccauccugaggccguggaccuggauaaaaccaguguagacaucagagagcugcccaaacuacuagucccgagccccaaaccucaucacgugcacagaacacuucuuacucuuuccccaucccugaaugaaguaguuaaaggaaaaguaaagcaaagccuauaugucaaaaggacaaucugugugccuuauagcuaugaaaauguggauuuaacccagaaaaucugaguuauuuuuuucccuuccuauacaggaugauaguggcguguguuuccagucaccuuaaaaagacaggagauggugcuaagacauuuauuauuuuucuuugccauuuacucagaggacuucaugcaaucggagaaaaaggaaaagauucauucacuucugaaaauauucagagccaugaaaggcauuggaaaaacuguugucaguggaaaucuauuucccaggcucugcaaacguuucagacacaaacccuagguuguauuguagaccggaguuuaagcaggcacuaccugucugucuuuucuucauccacugaaggaagaaaacugugcaggcacucgcuagaguugcuccuggaagcauacuuuuguggaagagugggaagaaacaaucacagauucauuucacaguugaugugugacuacguuuucaaguguauggcuugugaaagugggguugaaguauuugaguuguuggaucacuguuuugcagaguugaauguuggcgugacaggccuuccuguuucagauucuagaaucauagauggccuugugcuucccagggacuuuucuauguacugcccagcagauggugacauuaggauggugauaguaacagaaauccuccagccucaguuuucaucggcuggcucggaguuuguucucaauucagaaacacaguuucaggcaucucagugcuggaucacggacaggacaaaaacaguaaugaaccacuugcguggucagaauguaaaacugcuccugaccagugugaagcaaccagaccugguuauuuacugugcaagacuuaauagcauaucagugguggaguguuuaucagccgaagaaguuucccuuguccagaggaucacuggucuuucuccuuguguccuaccagagguugcuucacagugugaaauuucugauaguacuuuggugaaguuuugcaagccccucauccuuagauccaagagguauguucaucucggcuugauuagcacaugugcauuuauaccucacucuaugguccucuguggaccgguucugggucuuguugaacagcaugagagagcuuuucacggagcauuuaagaugcuucggcagcuauuuacugaccuugaucuaaauuacaucauacaaaccaaacagcaauguaacccaaguccucuugcuuaugacaauagcagagagcguaaucacucaccagaaacugauaaguaucaggacauaguagcaaagagcaaaaauaaauuggaaacucaaacacauuuagaaguauauucagguuugggggcuucagauacagaauugagagcagguaagccguggucagcacacaagaagacaccaauagcuccaucccaaacagaugaaaugcugaagugcuugccuccagaaagaagcgggauaauugauaacugugaccugucaauugagaaucauuccacuggaaauccuacagcagaagacacuggaacagaaauuucuuucgaacacuuacaggucucagauaaugccggaaaggguuacacgcugccagugaugcgcaagucacuagauaccuguacuugucaggguuauuguucauccacugugccagcaggcugugugcugccaguggguggaaguuuugagauuuugaugaguuacuaccuucucagcuaugccaaacaaugccgacaaucagaugaaacugucaucaguauguuaauagcugaugcucuucuaggcaucccuaaaauccuuuauaagccuaagaagggaaaggacaguuucccacacauauacaugcggucucuccaugcacugcaagccagucaacccaugguaaguggucaaucaggguucgagucaguagcugguaaguaccaauuacuaacuucaguucuucaguguuugaugaaaauauuaaccauugauuuaauaaucaacaucaagaggcaaccucagaaaacugcugaccaagaaucagaagacgaauuuuaacacucaguuuucuguugcucgaacuuucagucuggggccagagaaauggcucagugggcaaaggcauuuaauggcaaaccugacugacugccugcggucaucacccaggguggaaggagagggugaaguccugagacauguccuuuguuguacacacauguucgcagacaaacacuaaacguuaggaaaaaaauguauucagcucaagcuaaauauuaaaacaggcuucuggcugacugaagucaacccaguccuuaaguccauugaguccaccagaccauucagacaacagguaucagcucuauggaacaaaaacuggcuaaaucugucuccuugucucuggucugcgcuagucugucuaagggagcuugccucuauagcucccucuucuguaccuuuucccacuuuguuuccuugaacuuucuguaugucauagagucguguaaccuccccacuugaacgaggucuucacaugccaucuuacauuguuugugaacaugaguauaaaauguuaucucuuauguaaagcaguaaauaaaagucaauuuuucuuuguaagaagcauguaaguuaauuguccuugugguugucauuugguuuauuucuaguuauugaaaacgguugguugggggcuggggagaugguucagcaaguaggaccauuugccacccaagccaggcaaccugaauuggaaagaaagaaccaauuccacaaagcuccacacguacacuguggcacugcacaugcacaugcaugcacguaaacaguaaauaauuccaaaaucugcaccuuugaauaccuguucaaaaauaggacuauucauugugaauucaccuuuuauaauuagaaguuaaugccagaaaagauggggaauucguuccuuucguuuucuccuggcuccuaagucuuguaaggauucuguacaguugcuaguuguucuuuguuucagugcuugccagauuucaguagcaacaaauaauuugacaguuaucucuaguguagau

SEQ ID NO: 5732 - RNA, 4964 nt, Mus musculus
aauguuuggugucuaugaugaaaguccagagguaaccgaaauacauuuuuauacccauguuuguaacuacagacagaauuuauggguuuaucugaguuaacaggcuucccacuacaauuuauuuggaaacuaucuugcuaugcagaaguaugagaucuaauaaccauguacuugauuucggggcuuaguuuaagaauaaagucuuuuacugggcaguggugaugcacacaccuuuaaucccagcacuugggaggcagaggcaggcggauuucugaguucgaggccagccugguccacagaguuacaggacagcccgagcuauacagaaacccugucucaaaaaaacaucuagauagauauagauaucuagauauagucuuuauuagucuaguacaaguuuuaggcuuaauuuuuagcuuuaaauuaaauguugauuuagauauacaaaauauaauuuagaagaagcauaauuuauagggaguuuggaaaacgugcugaucacuuuaaaaauucauuguuuauuaauuugguaguuauaaacucaauuuuuaaaguguuagguaauuuaacuaugcaguuaauuaaguuaauuaaguuaauuaagcaagcguauguaccugucagugacaagcugugcugauagugagaggugggguuugugucugcugguuauaaacucagacauuaaacuagccugcauuaaaaacggagacucugggacuaauuaugggcugucacauuguuuuagagagaugaaaacauuguuggaguagaaauuuucauuuaaagauuuuuuucucagauuuuuacauacuguguagacuauucauuuugacaucuuacuguagcuucagauuuuucaucuuucaagaaguugacagauguuuugauaucaaagaaauuggacacaacaaacaggaagugaguuauugacuuuacuuuaaaauccauauaaagcucaaguuguuuaaagguaguauguugaaacuacauuuuuaacuuaaaaggaauugggaacagugaucaaaaaugcaagugacaagcccaacauuuauucugugguuugguagaauaauuucugccucgauaaaaacuugggguagggauaagucgggaaucuggcauuuggcuaaaggaaccaaaccaguguucccaaggggagguccuaggagagcgagccugcgugugacggcucaggacagccucagugcgcaaggaugugagguggugauccaguuugugcugcacuucauauguuuaaaaauauuaaauuucaacuuauuuuuuuuaaacacaugaucacaggcuugaugggcagugcuuuuggcuuuguauauaguagacuacauuaaggaggcuucaaguuuuucaggcucauuauaguucucauuucuuaaaagugcuggcugacuaucguugagaaacuucuuuucuugaaguggggagugaaugcuauuuagaaauguagccugggugggccuggagggauggcucaguaaaaaguguuugcugcucuugcagaggaccugauccuuuuccagcaccuacacagggucuuugcauaacuccuguccaagggagauggcagauaccccucaagcauacagucguuaaagcauagucuuuaaaacaaaacaaaacaaaaaaagcagccuuugugcuagguaagcuuuuucuugggagguuuuaaggugucggauaguacauuacaaauacagacuucuggauuguccccuacccucuaaaugguauuuguugacaucuaggaaguuccucuguuagaauaauaaaaauuuaugcaaacucgaauaaucuguaccauaaugcuuuuaauggccagguauaaacacacaagauugcaguacauugagcuccauagagacagcgcuuguggaagaaaaaaguagauccuaagaagccaaaaggcaaaauguccucauguguguucuuuaugcaaaccugccaggaggagcacaagaagcacccggaugcuucugucaacucagaguccuccaagaagugcucagagagguggaagaccauguuugcuaaagaaaaggggaaauuugaagauauggcaaaggcugacaaggcucguuaugaaagagaaaugaaaaauuacauuucacuuccaucccccaaagggguaaccaaaaaagaaguucaaggacccagugcuuccaagaggccuucgccuuguucuguucugaguaccgccccaaaaucaaaggccagcauccuggguuauccauuggugauguugcaaagacacuaggagagauguggaacaacacugcaguggauaacaagcagccccauaagaagaaagcugccaagcagaaggagaaguacgagaaggauauugcugccuacagagcuaaaggaaaaccugaugcagcgaaaaaggggguggucaaggcugaaaagagcaagaaaaaaggaaggugaaaaggaugagcaagacaaagaugaugggaugaauaaguugguuuuaggacaguuuuuuuccccccugucuauaaagcauuuaauccccuguacacaacucacuccuuuuaaagaaaaaaaaaaaaacuguaagucuguguaagauuuguuuuuaaacuguacagugucuuuuauuuuuguaguuaacacacuacugaaugugucuuuagauagcccugucuuggugugguauuuucaauagccacuaaccuugccugguacggucuagggguuguaaauugguauggaaauuuaaagcacggcacaaauuauguauggggacaguuuuuuuucuuuuucuuuuuucuuuuuuuuuugguuuuaucuuuuuuuguuuguuuugucuucaguugucucugaugcagcuuauaugaagauaauuauucuguuaacggaauaccacucugauugcaaaaaaagcagcuguuuuguugacauguugacugcuaaguaaauacaacuuuuuuauuaaaaaaagauacaucauaaguggguaacaugauuaaacuugggcuuuggagcccaccucccauuugugagcaauagucaauacuuaauaccugacauuaauauaucuagaaccugauguaacuggauuuguuuguuuguuuguuuguugguaucaaacaaguauauuuaaauuugguugguuuacuuugugagcauacuuuggaagaucuuaggugguucuaaauuuuuuacuucgugguuucaaaggccagagucuugcuagguaacgggggcauaaguacacauaaauacuauuagacuggguaauggcacaaaagccauggcccuauugaaagcuuuccauguuugcuacuuucaguuuuaaggugaguuuagcuuagccuguuucuguguaauuucuuugguaguauccugagaagacagaaggaaaauaaagucaguuccacuguccuaucgucagccugacaccgauagucuccuggccugugacacuaucuucugagaugccuauucuguguguaucaguccugugugauuuuggacuuaguacuugauguuuucaguaucaugcggagguugguuguucaaauggauaaaaaaacacagaguagaaucugguaugaauugggaaagaauuuauaaugacaguaauaauugcugccauuuagauugaagaaagcuuaagcaguuacuuggguguuuagugaagugcaguuuguuaacuuuuuuuugaaaauucccauuguguaggucugacuggccugggccucacuguguagagcagguuggaaacucccaggucucccugcccccaggagcugcacaccgaggcaugccuggugcuggucaaacuuugauaggaaauaaaauuaggaagggauuagcugcagccuaaggugaaguuuuaaagcuuugggugacaaaagguugcaggguuugggaaaggcaguggcguuagcauugcuuggaggccguugaaugcugugcugcccaguauucaaggcagccgccuagagcuccaguuugaagaugccagaugcugauguguucugugccgugugcagaugcacuucgacuuucaccugccuaccccuucugaaggguugccugcaaggagugaaaacuaaaggcuaguuugcaggggcugagagucucauggggguccggguagaagguaauuaaaaaucuucucuaguacuuggagcugggcaggugggcuagagaugaguauuuacaaggcccuaggucccauggccagcauaagaaaagggaaagaaaaggugcuaugggcacuguuuguuccaugaaacagaacgcuggcaggguggguguugccagagagcaaaccucagucacuguaggugcuguuaggugauuuaagauuuaccuccuuugaacgccucuugaggcguucaggugcacuacauaaacuggucacuagggggcaucagcucaucagccuguacugcaaaaagcuauagcccugagaagucuauuaaaaauuaauagacuuuagaaguuagaaauuaauuuuugaggguuccccccaagaaaacuaggaaauaguugggaaaucuuggguuuuaucaaugugggugggacuauuuguguuuuaaacacugauaaaauaccugauaauuucauuguauaguagcuuuuuaacuuuuuuugugcauauagugggguggcaaguaugccauagccuuuaagaccagcaacuguaacaucugagccauuuuguccacucuuguuacucuugcaggcauugggaugcugguauaggaauaccuaacacuauugcuaaaaaacuccaagccccaugggauucaauguauaugguaauuagggaauaauaugagucaaguuuagugcgugcuguaguacguuuuaaagauacaccaagugcagauaggguuugcuggcuagguacugagaggaaagaauggugaaaggcacguguucucaacgcauuugcaaucuuuaugacccauguguugaaguaguua

SEQ ID NO: 5733 - RNA, 2366 nt, Mus musculus
gaaacugaaaguaauaucagaauuuaauuucaacgucuucaaauacaaugaaagagucgacuuuaugagaauguccugggaauacugaacccauuuuuuuuucauguuugccccccuccaccaccccuuucccuuuuucucuuccaagaucagggcuuacuaagaaaucuguuucugaaaauaaaguuucuuuuuuuuuuuucuuuuuuucuuuuucuuuuuggcgaggagggggaggagguggccuacauucagaaaugucuuagauuaggcauaaaaaaacuaauaaauaaucauaauccaaaauaacauuaaaauaaaauuacaguacauaaauuguuccuacaaagguccauuacguuaggugauccuuccaaagguccauaaauaaagucaucucgacgcaaaaucugcuuccugcaacugugaugaacauuaugcagaaaacuacgagggaacugcaagcgcgcguuauccgucgggugaaguccaaacuacuugaucaggcgcgggguggggagacucuguugguuuugauccaagugaacugaauagcaaugcacucuucccacuuuccgaaguccucaaaaccuggaaagaaaggacacggaaugaaaugagugacucaggagucaagacccuguucccucccggccaguacaaaggaccgagugcccagaaggacaccaaggucuuuacguuggugcggaggcacacaauaaagcagcccaaaggaggauggcacugaacaagagugaucaccacggugguggguaggugguccccgugcccugcucccuggcggaauuccuccggcucuucucuccccgcccugccucuacaagcuccggcuugcccaucuucuuuccaccucuccagaaacuugaaacgauuuuuuuuuuuaaacuuugcuucgggagcgaaaucggucaacaagcuuccuacucuucccaacagccaugcuggcacguuucuaggugucccagguugccaggaccuuaccuugaguggcccgggugccgcccucuucaggcagaguuggaggugcugcggagaagccggugacccugcggcugcgagugaagaggcuggugcgcgugcuggaguugguacgggugagggugagggugagggugcgggugcgggugcgggugugggugcuggugcgggugagaguaaggaugaggaugcggaugcggguaggaguggagcuguugggguugggguuggggcugagguuggggcugagguuggggcugggguugggguugaggcuggaucugcggcuggggcugggguuggaucugcggcuggggcugggguuggaucugcugcgucugcggaggcugcugcuggaccaggugcugcugcuucugccugguagacuugaccgccaguauggccuggcgauuuuuguacugcaccaucugcaacgugaucucggcguuccagcccugguccugggggcaccgaaagucgaucucuuugcccuccgucaucaccacagugaaguacauguacuugcccuugcgcuccacgcagucuacagucuucauauuggaaaagugcaauuccuucagcuugacugguggcucaaggcuggcgacgguggggccacuagguugggacgguucggccguccccugcccgggcuguugcugcugcugcugcuguuguagcugcuugggcgguaugagcaguagcccuuccucggugaggaugcagcacuuuuucuuccagagcugcagcagcccgucgcuucgcuuuuccagcacuccuuccuucagcgccuugcagccgcuguucuccagcauccuuccggcauaaggggugcugcugcuccgcucggccuucaggcuuccagacgcuccggcuggggguagcaguagcagcccugcgccguccucgccccagcggcuuccgcggccgcccgcccggagcgcgcagagaaggcugacucgcaggagacagagcgguggcggcggcggcgguggcucggggucccggcagagggacaggcgcguccugacucgccacaagaucccggagccgugagcgggcugcucucugccguccuccggcgagcgcucacugaagggcacuggccggggccccucgcggcgcuuuucaaugggccacccuccccacccccgagugacacccagcggaaaaggcggcuccuggcgcccgcgccgcgggggaaaacccagcuccgagaggcgcucggcagccggcguacgccucauuaacuuggggccuucccagagcccgccgcggacacgccccccgccgccggcuccgccccagccccgccgccggcuccgcccccgccccgccccaccgcccacggccgcccgcgccgccug

SEQ ID NO: 5734 - RNA, 1240 nt, Mus musculus
aaucuaauuuaccuucuguaagacuuuuaauguaguaguuuaugaauuuaaacacugccauguguuuaaaauguuccacauuuuaggauuaauagcaacgcaauggaaaauacuugaccuuuacaggaacuuucaacuauacugauggcuuuucaauagugacagacuuguauugcuacauacauaguuuuuaguaugcuucuguguccuugcuacucagucacuaaauuuuauuaacauguaaacuguuaugccccaaacuaaagaccaacugucaaacugggcaguuuuauuuuucuuuacaacuuaguaaaugcuugaugacugcacgugggguaaggcugcucggugguucagaaagaccccagggacaguguuuccugacaggguguggucuucaguagugaguagaaugacguguaugagugacugucagaccagcaagaccgcauucaugcucccgucguucucaggauuguugguaacuugggcguucuuuccccaaaucaccuugccuccuugugucacaaggcccagcucgcucacauucacuucaauaacugugccuuuggugaucacccccaggguuguauauaauggggaugagggauucuuuuucacaccgagaauaggcaggcaaaagguagcuuucagcucagggugugugacaugggcuuuuuggaaacguagacccauaggccuaaugaaccuuucauauuucggugguuuucuuguaaagccaucaccaacagagcagacguuaguuaccauucucuuccaugccuucuuuuuccuuuuuccuguucgaauaacuuucaauacuucuguuucuccuugggcacgaacuuuggguagagggaccucccauuucccugccuuuucuuuccguuuaugcuuaaucauguuagaaaguccuuuugcucuugacugccccucccuguccagcagauaggcggggacugcucccugcggagucuucucaucaucuuucugcuugguguuucucuucucaugcaucuuaauagucuuuuucauuuguauuuucucggcauggggcauggcgcuguuuaugguagagcuuagccuucaggccaaucuuuuuuuuuuuuuuuuuuuuuuuuuugccuucuuugaacguucaugggccucccgaccuucuuucuuucucuuuuucucaugguaguccaaacgauauccauaucguuugcggugcaauucaauauauucauuuuguggcaug

SEQ ID NO: 5735 - RNA, 7568 nt, Mus musculus
cggaagugggggggcgggcccagacugucagcgagaggaagaggcccgaacggcugggugaggcgccgagacgguuuucgcggcgagccgggcucgggugcagcucagaaucccgaacuugggugaucgucgcagccgagcgagcguuggggcuccggagcggcgguugcugucgccgcggacgccgccgucgucgccguugccgucccggaggacgaggcccggagaggccuugcaggccuagcggagcccgagugugccgugaguaaagccagcgcccuccgcacggucgcuugccgguuaagauggaggagauuucguuggccaaccuggauacuaacaagcuggaggccaucgcccaggagaucuauguagaccugauagaggauuccugccugggcuucugcuuugaggugcaccgggcggucaaguguggcuacuucuaccuggaguuugcagacacugggagcgugaaggauuucggcauccagccaguggaggacaaaggcgcgugccgccucccgcucugcucccuuccuggggaucccggggacgggccccagacggagcugcagcguucaccuccggaauuccaguagucaccaccugagagagggcgacacagugaccaggacaauaauagagacugguccccguggcuuuggaggaauaagcuaaguuggagagaaaaaaaauuaaaucaacaaauaaaggaaaagcaaacaaaagucccauuuaccccccuucaagaucuuagcauuaaaauacaaaaaaaaaaaaaaccgagaaggcguaaaacgaacaaaacacccaaagaggagaauuuaggaaucccgguccauuugaaagggucucccaugccagcucugaaauccugggcagaagaagguccagaggcgucgugcuguauuuugagcuguauaaaauacauguggaugugcaaggacccugaacuguccucgguacacaggugagcagcuguguacccagccuauacaauucuauuuguuucucagauucugcaucugccugaugucaugggccuccuucgaaguuuuagaugguguugauggucaggcccugaucagucagcuucgguggacugcuccucugauuucuaagccuccaauugggccucuuugauacaaauagaagucagguaugugacuuaaauacuaaaaauauuaauauucccguuugaauucgaugggaagcccuugugcccuugucuucaagaaguuccaaaucaccuguuuuccaaagguccagcauuuuguggggacaaggccuugccuuuggcucaucagaagaccugucuuuccauccuacugaguggcaaagguuuggcaaaggacaaggugguuuucaaacagcugaagauuuucuuuugaugcuaugaggaugaaguguaccuccgcgacugcacaucauguccaacuggaagacucaugucuugaauuacauacugcggacauaaguuuggugggacgguuuuuuccuacuuuugaguuacuggugauguaaccagcccaugggucugacuugaucauuaugacaggucgcugcccuccagugguaccacugaccuacagaaggacaucauggcagagcaggaggcuguuuaaaaauugagccaggagggaacuuuuuuccaucugccuucaauaaugugaaugaguuuaaugcuaagagcccugaaacaggccugguuuaccugguaugguugcagaauuccuucaucaacugggcagucagaccucugcugugcugauugagacugucuccaccuucucugcccucacaaacagcaguucaucacuugguccucagaaccuccuuccagcaggggcuguauauuucuugauggaaaguuggaggcaggguuagaaguaaaggggaagugaguggcauaucaaaacuggucuguuucagucccuaaaaugggggguuauggagggugggaguccugaggugagcagaaaagaaaggugcugcuuuauuugaaauguuuucuuaccucauucugugccccaguaaaggguccagccucaucugucuggcuuggccauguuccugucacugcuccacugccucucuggugcagcucaugauuccaggugcugcuugccacacuagguuuucucucgaccaauuucagcucaucuuccagugcugcuccuccgaagccuacacaaguuuccuuuuuccuuuuguugucguuuucguuuucuaacuuuaaauuuuuauguuguuuuguuuuaccuguuuuuauggaagccuuagaggagaaucucucauggcucccucuguuuggauuggaaugggaaaauaacaaaaaaaaaaaaaaaaaaaaaaaacaaccuuuuuuuaaauuuacaaggcagugucaugucuaaguguuucucuuauauaaggcugccuugcuaguauaucucccugccugucaugaguucuuucuucccauugcuacuuggauacggccucuuaggacuuacugcagagccaggaaugcuggcauacacaaggaaggaguugguucugcuccacauuucuaauccuauuguguauguaucuuccuucucccaggagcuauuugaaguguguggacuaauuuggauuauacucaaagaguugaggcaauuauagugcuugagccuugagacugucuguuguugccuucucagaguuuugcagcucaggguuggggccuaguuacaguuuggauccuuaguccaagaauuuugagaacgugaguaaaaccuuggcaggagcuaaaaaauacuuaaaagauaccuugcuacaugaguucuuuaaaaaccuucagugaauuguggaaaaacaaaaaagcagugugagauuccugcuuauauaaaguacuugggaaacaugaaagggagaaaggccauggcccacucacucuugccuucagauagggagcucaaaugugacuuuaguuuucuugccuuuucugguuagaacauaaagauguggguaguaguuugggguaauggguuugcucauauuacuucccuucuuguuacugcuuuuguuuucugucuccaacauuuucauuagggcuguagcuccccacucuguguagauaaaagguggguucaguccagcuauuauugcccugagggaacaaacuacuuuuuugggagcaaauguucuccagcauauaguugacagugguuaggagcccuccccuuccccugcccuccuguaacagcagaauccuauccuuccucuucuguucauuguauugaccaaccaguaauccuauuauguaucugaguguguguauagggggaagggguucuuuacauuuucugugguuugugcuuuuuucuucaguaaauuaguucccaccaucgcaugcccaggggccacuaccuggcauuaucgcaugcugggaucauugggggaggguaguuugaaauucaccacuguccuuuguuuuggagauucuuauuuuuuaauaaguaauccguccuauacaaauagcuaauuaacucuuguguucccccugcccauauggcugcugguguaaauaaauugcauuuucccauugcuaaaugauaauaaaauuuaaaagaaauauuuugacucaucuucuuaauggcauguuucccagggguuguuggcauagcaaaauauuuuaccacucuugaaucuagguacuugaaugggagguacaucaaaauccacagaggaacucugucuagcuuuuauuucucauauaauccuucaaauuuggcugucuauuaaagaaaaaaguacauaaaguucccuuuuucauaugagguaagaagacaguaaaauauaguccgggcuacuaauaauggugcauuguaguaguuuaacuuguacaaaauuuguuauaguauauacgucaucaucaaacuaacuugacaaauguuaaguagcagaaaaugcuuccuaccuacugucccuuaguuugucccacuccuuuaggguuuuuguuugcuuuugaauaacaucucuuaauuguaaucuacaguuugagcauuuccuaggaauuguacauaaaauuuaguucuguccaaagucaccauaguucaaggugggaaguagacaagacagaaggcaugggaaaguaccagaguaggaaacuucuaguugaauacuccaaauagccuucuuuuccaugaucaugaguuguaauuaaaugcaauuggccaccuaagaccuacagucaaaucuguugagaaauuguuuuaaaagaaaaugggaaggcucuguuaaagagcaugugacaaguuuacuauacaaaguccuaaaaauaaaucucgauuuuccuuaaauuucuauuaagugaaaucuauaugggaaucuaccauaacauuuuauuuaaauuacuugaugcagacauccuauuuuguagaauuagauuuaauauaguccuuuguuuucuaaaaugacaaaagaccaacuauguccuauagguaguaucuuuauuguuagaaaggauaucaaauaguucauagcucugcuggauuuaguaauuucaaguuauuugaaguauggauucaggaaaacuugcucugcaggcauuaaugauaacugcccucugaaccugaguuguccauaucuguuuuguucauuuaacaaguaaagagcugguaucuaccugcuuuuaaacacaaugugaaacaaacaauguuucacauuaacgcugaaaaguuuaacacagugucagcucuccgcuuaccuugagauauaauacuucuuuaaaaguuuacugugcuggaaaaagugugucauucauaguacaacagauacaugcucuugauagaacuuuggaggagaauaguaauaugauguaaucauugaaaauauauggcccagaaaacugaaaagccuugggauuuacuuccaguuguuuccccaauuuuaaaacaguucuaguucuaugugaaccucauuggaaauaugugugcuuaaaaaaaaaauuguuaaaauugauuuuagaacugaaaauggugugcaucuugcuggcaccugaaaguuauuaccaggacuaaauccugaagucauuagaugugacagaaacaaacuuaaaaugcaaauagugugacucuuaagccagcacucauuugcugaaauaauuuaguaaaaaauuaaauuucuaaaacuguguaguuaagaaaaagaaaagaaagcaugauucuuaauaacuuuaugguaguggauuugagaaugaaaauaaauguuuaaaauacaacuugucaaaguugauugaagccgggcaugguagucuuggcuguaacuuagcuucugaaggagaggugaaauuugauuaucaggaguucaaaggcagccuuaacuguauaaugguuucaaucacucuagguuaagauuuaugugaaagugguguguaagaauagauaaccauguaacagauuuuaauucacacuuaacaaauauuucauauauuaugacuuucagaaucucauacuguugucauucugaucagcugauauaagggaauaguauuaaccauaagcgauaacagaaucucauuacaauuauaaauuuuaucugcacauuaacaacuuaguguagaaaaguaacuuuuuuuuuaaugcagggcagcuguauaaauguguauagggagaaauauuuaaagguaacaaaauaaauauuagauuuaaaaucaaaacuuguucgugaaaucagaaauaagcaaacuaccugauaucacagguuugcuguccuuuuaagagauagguauuuuguagaaauaauuauaaauauuauaauuauaaaauuuacaaauguccagaguacaagaacaacucauaagaaaauaucuaaaugaccaaaaggauaugaaaaguuaaguucagaaaaauguaaccuagaaucaaauggcacagcaguuuauguuauucaaugugauagacuaaaauggcgaugaccauaugagcgcauucccacuggaugccaaguccuacuacagagaugcucacacaguguauuacuacgcuuuucacaguagggaggaaaugaaacauuacaugcccaucaacagauaaauggagaaggaaaguaugcuguggaguggaauuuauugagcuauguaugcaucaagauaaauuuguuauaagaacuguaaguuuauugaagaaaaauauggaauuggcauagaaauggguagagcuggaaaacauuaaaugagguaaccuagaaagugucucauugaugagauaaagguuuuagcagaggugggcuagggagcuaauagccauuauggcuuauaaaguuggaggaggaauguugagagcaagagaauacaaagaagggagagaaaagaguacgggggggcagagacucagcagaaauggauaaaaggauaaucaguucucagucauauggaacagauuuaaaccacagcaaguguacagcaaaggccuuccugucuucaccacaaaaaaugcaggugcauacugccacauucagcuugcaauacaaaguccaagagacaagugaaaaacaagaaauugcacuauaaaaaauggagacaccauuuugaaaguggcguaauagacccuguugaaauaccuacauccauguggaaaggaugggcaggcaugaugcagugaaguagauaaguagacuuguaccucccugucuucagagagaagagaggagaaacagaaaaaaaugacagcccagggugaaauaaaugaaaucucucaacauuguuguuccuuuccauuuccuucuacugaaguuaaguguguauuaacaguuguccuuugugacagcugacucugucccucgguaguuucacuaaacaagaacucauaacagauauucauuucauuaggaauuucaucuguacccucauaccuaaucauguacuuaaaggauuguuuucuguaguuaauuauuucaccuaaugcuacugaacuaggaucacuuucuugugaauauuauuggguacagaauaaaauugcuauaagugaaaaaccuuccaugaauaacugaauuguaacaugaagaagaaagcaccagggagauaauagccauuacuucaguucuuucuggccaguguguguaccuaaccucagaucuccaguaaccucauaaaaagugagguauagugacaccugugaucuccaacaauaaaauggagaacagucaaggaaagacacccaauaucaaccucuaccgcacaucccuacacuagcagguaccuauacugcacacaacgcaauauauacacacaaaauugaauaaaaacuugaaaagaguauacugacauaguauugaauacaaaaggaauagaacuucuagacaagagaaauguaaauaaaaauaauggagaaaacaguuuaaucaaacugauaaaagaagggacaaauuaaaaagagacagcugucacagaacaauaacaguuuuuagugucuugucucccaaugauaaaccuacacacuguaguaacagauaaagaaguguguaugggaagggagggaugggagagugagaaaggaagagagggaggaaaaggagaaacuuugaaaagaaagauugaaacagga

SEQ ID NO: 5736 - RNA, 809 nt, Mus musculus
cagagagaguugagcaacacgagagccaccauguagcccguggugcugggcuccccaaagggcaagggcaggcagaggggagaggcauuguacuuacugccuccuagcaaggggauuguggcaauggucagggccaacaggacacauagcaaaacgaucgcucucaggcuaaaaaggggagcuuucacuucaaacuucgaagagcacuugacagaaaaaccucguuccagcgcugccagagugagcaggaagaucgacgauucggaagcaaaaauggacaggaagccaacgauuuggcagccgauuccgucuucccaccacgcaccgugcugagcaaaacggccaaaagugaaugcauccacggcagccagcacagcacuggagacccccaugagaauguccacuaccgcgauuaccccaauuagcagcuuuauggaagagauguacagaggaguucugaacacggucaaagccaccaaggcauugcaggaaagcgccaguacugccgugguccacaccccgauucggaucagccagcuaccaaauaggugcucacagggcuugaagggaccugagcagggaaggaagagagagagguuguaucagauuggacuggcagauguagcaaacuugccaagagacggaggucaguaaccaccauuguaaccacggugcccgcgagccucgcuccucuuucuuaaaccagugggagggucugccuuggagauucuguggcacugacccacugaugccccagguucuuguguuuccagaagauguauagaaaaauaaaaaggggaaaacuucac

SEQ ID NO: 5737 - RNA, 1380 nt, Mus musculus
cauggcgguuggcaagaacaagcgccugacgaaagguagcaagaagggagcuaagaagaaaguggucgcugauuaugggguggaucccuggauauggcagucucuacaugguccauccuugcauacccuagcaagauuuuauugaaaggacccagauguagcuaucucuugugagacuaugcuggggccuagcaaacacagaaguggaugcucacagucagcuaauggauggaucacagggcucccaauggaggagcuagagaaagaacccaaggagcuaaagggaucugcaacccuauagguggaacaacauuaugaacuaaccaguaccccggagcucuugacucuagcugcauauguaucaaaagauggccuaaucggccaucacuggaaagagaggcccauuggacacgcaaacuuuguaugccccaguacaggggaacgccagggccaaaaagggggaguggguagguaggggaguggggguggguggguaugggggacuuuugguauagcauuggaaauguaaaugagcuaaauaccuaauaaaaaauggaaaaaaaaaaaaagaaaguggucgauccauuuucuaagaaagacugguacgaugugaaagcuccagccauguucaauauuaggaacaucaggaagacacuagucacgaggacucaaggaaccaaaauugccucugauggccucaagggucguguguuugaagugagccuugcugaucuacagaaugaugaaguugcauuuagaaaauucaagcuaaucacugaggacguucagggcaaaaacugacuaacuuccauaguauggaucuuacccaugacaacaugugcuccaugaucaagaaauggcagaccaugauugaagcucacguugaugucaagacgaccgauggguauuugcuccgacuuuucuguguuggcuucacuaagaaacgcaacaaccagauaagaaagacauccuaugcgcagcaccagcaaguccgccagaucuggaagaagaugauggaaaucaugaccugagaggugcagaucaaugacuugaaggaaguaguuaauaagcugauuccagacagcauugggaaagacauagaaaaggcuugccaguccauuuguccucuucaugaugucuuuauuagaaaaguaaaaaugcugaagaaacccaaguuugaauugggcaagcucauggagcugcauggggaaggcggcagcucuggcaaagcagcuggagacgagucggaugcuaagguugagcgagcugacggauaugaaccgccaguccaagaaucaguguaaaauccagauuuuuaauagugacaaauaaaaaguccuauuuguaaaaaaaaaaaaaaagaaaaaagaaaaaaaauau

SEQ ID NO: 5738 - RNA, 96679 nt, Mus musculus
cagcuccaggcguggccgcagcagcucccggcguggcggcggucuggcuucgggagcccggagaggccgcccaggccccacucuccucggucaccgccacaagacagcgccgcaccuuccgcgggaggcggcggaagcccgggaaggcuccaggcgagcguugugcuucucacggucgacuggcguacgggcggcguuccguccauucggcgagccucgcucgcucgccggcuucugcugcugcagccgccgucgccgccgccuucgagcggagucggagcgacgggggucacggcgggggucagaggguaaaggucuugcucccagcagccuccgcgguggauacgucgccaucuuggauccgcgggacaagaaaauucaugcggugaguuuuuggccaauuuucggaagucuggcggcggggcacgcggcgggggaggcggauugggggcccccucaaggcgggggaaugccucggggcugguccggucgcgcccgggguccgcggguagcgucccggcccgccgcuucccguugcuuuugucucggcuccaaucgagagagggaagagcggagcgggcgggcgggcgggcggggaggggguggcggcgcuggaggagggaggggguguguggcgggguggacgggacguaaagcgucgccgugcucgggccgccaccgccgccaccaccgcagcuaccgcagccgcagccgcuccggagcuuaggcccgggcccccgcugcccgccgcggggcuuccccggcucccgccggcgcggagcagccgcugccgccgugcugcuuccugggcuaggagagaaggcagcggcggcgguggcggcggcagcagcauccaggagccccggccacuggacacggcuccugccugccacguucccagcagcugcugguccuugaagcuuuacguuucuggccauacacgcgcauccuccgccacuugugugguuuucuuuucuuucuuucuuuuuuuuuuuuuauuuguuuguuuguguaagauggggacaucgcacuggcuaacgggccucgggagccuccaggcccugagcuauaccgaaggggccuuucuugcaagguggaaaggcgagagagaaacucagaugcugcuucugcccccgugccuggagugggaagccucucuagugguguagccucuugaguuccgaugguccuggggcggcggaggaggaacccgagccacucuugugaaguugcaagcccugguuucuacuuccgccgggcccccucuaccuuuugccguuuuguuuuaggucuucacuucaaaguuucauagaagaaauaaguuggguuaaaagaaacccgguaguucuuaauugagguacuguuugcuuaggagaaaagcuuauaauucuuguuaucuguaggcccuucgggaaaucuaauuguaauuuuauuuuuguaaaauuauuucuaagguuuuguuauuugcauuuacguuagauccaaucaguacgcuuuuaccuccaaaagaaaauaaaaauaaauaaaucuuacacauagguacuuucuuggaaauccuagggggacaucuccacuuuucaacaucugggaagacaaguguuaagaguguuuugcuucauuuucauuaaauccuuagucaaagauuucucuuuaaucaucuggacaguuccuaauaaaauacagcaauaugauccuuagauuauuggcaaaugguagaacguuaaccagaucuguucacaagggacacacuuaauguucaaaacugaauacauuuucuauuacucucuauagugagaaguuuuagggagauggaaucguguuccuauagauuucccuuuccaaauaagugggugguaacuuucacaacaguuuuauguuugggaaugcuuuguauauucaacaacaguuccuucucagaagucaccuuuguaguuuuguaagguaauuuuauuccaaguuggaaguguuuaaaaauccaguacacugaaaugguugucuacauucaaauauuugucuguguucagguuuugugucuuuaauauguuuucuaaauggucccuugugcucugccuauccagucuguugucaucuuaaagcuaaaggaaaaguucaaaaugcacagacaacuucuuccacuuuucacuuuugcugacuuugcaagauccuuaauuuuaaagugaaaccuuuucauuuuuaaaaaagugccuguuuuuguuuuuaacucuagaccagaaauaaagacuguauuugacuuuuauuuuuuuauuuuuugcauuccuauuaaugcuuuauugacacacauaagguagugcauguguuggcagagcacuuugguucucagaugcagucuagagauaccuguaaccuuaccagaugcuccaggcugagaguggccugcacauuaacguaucaguaaauacagccuuucuaaagugcuuacaaauaaaugguguaugguggaaaaugaagcagauugaugucugugagugguuuauagccuagccaucugagaacuauuugauuugaaaaugaaaucaaacuccaaauaauaggcucccuaaaauaauaauuaccuuuaauuucccuauauaaagguaggugcuuuuugguuuuucagagaugccuuagguuuauuuaaaacuucaaaaauaaauauuuuauacugcuggcaaguuagaaauacuaguaaucguguucugcuuguuucuuuucuccucuuucuuucuuucuuucucucucucucucucucucucucucucucucucucucucucucucuuucuuucuuucuuucuuucuuucuuucguuuuguuuuuuccagacaggguuucucuguuuagcccuggcugucuuggaacucacucuguagaccaggcuggccuggaacucagaaauccgccugccucugccucccaagugcugggauuaaaagugugacgcccggcagucugcuuguuuuuaaguaggugcuaauauuagcaaaacuuaaacuuuaauggaucauuauagaauuuuuuuacacgacaugggauaguauagguuuuuuuuuuuuaauggccaaauuugcuugauuagaaaauuugauuuuuguaucuaacuagaguaugaguagauaguaguaaaccaguaaaaauaaguauacaauuuuguuuuguuuuguuuuguuuugaagugauauuaaguuguaguaucuuuugauuaaaauuuuaacugucaaaugaaugacauagcugacuggauaaaggcauuugacaccaagccuaaugauagaaguuugaucugagagacccauaugguggaacaagagaaucaacuucccuaaauuguuuucuguuauccacacaaauagccacauauaauaaaacauuaaaaaauguacuauaggguuaguuuuggugucacacauuuaaaagcaggcuguagauccuguauguuuguuugagcagacauuggaggaaggcuuaugugaauggugauaguuuuaggaggagauuuucuuacccagacuguagugguauuuuuaagaauuauguguaaauuauguauaggugugugcucgcauguggauaauguguaugugagugcaagugucuucugaggguccagaggcucugaagcuggaguuagaguuaugaguugccugacauggaggcuaguggaggcuaggagcugaacccagguccccuggaagagcaguaagugcucuuaccugcugagccaucucuccagucccucuaguggauuuuguaacacaaaacacaauaagucaagguaccagagguugggugguuuucgaggcagaauucaucagaguuggacuguaauuucaguggauuugcauauagugaugggucagaagauuuacugauaugguagaaguggcucuuguuuagguuccggugacugucuggaccaaaaaugauuucuguuuugauauuugaaggaauuuaauuucauucuaacauuuucaauauggggaaaagcugugcucgaguugguaucuauuguagaaauuuacauuuaaggaacuauaaggaaaauuuggguuuaagguucuaaaauuauuuuaauaccuuaucuugcaucaguuuauugagcucuuuaguauugcuauuuuuucuuaugucuguaguuauucugugugguguccuucaauuucuauuuaaaauuuuucaacuauuaggacaaaucaugccaauaacaguuuacucaucaauauuaucaaggauguucuagaaauagaauuuauuuauuuauuuuauggaugugacuacaguguagccguacagaugguugugaacuuucauguggugguuggggauugaauuuuuagggccucugcuugcucuggucugcccccacuugcucagucccugcuugcucuggcccaaagauucauuuauuaucauacauaaguacacuguagcugaucugaugcaccagaagagggcgucagaucccauuacccaugguugugaaccaccaugugguugcugggauuugaacucaggacuuuaggaauagcagccagugcucuuaucagcggaaccaucuugcuagcccuagaaauagaauucuugcuguuuucugacagguuuuuuuuuuuuuuuucugaaaugaagcugcagauacuugguaucuaacuucagggaggaacgcugcauuaugaagugauaaaauggucugcguugucuuuaccuuugggaugggcgcauggcuuauacaacauacaacauacaaaugaaaaaaacugaacuguguagagaaauacaaaguuuuccuuugguagacacauuuuuauauaugaucaaacucaggguccaagaccauuuaguuaacuguuuggaacucauuugcuccuuaagucuaaacauuugccuuuuuauucauaagccuguuugcauguguggcucuggguguuaagugucacuuucucucuguuacuugguaaacuuauggccuaugucaguuucuucaugaaaucguuccugacucccccaacccccaauacucauuacugaguaugucaccauggaucuuaauuuacaucucaucucuccuccaccaugaucccuacaggucugagugugagcaagacucuugucuugguuacauuuacacacuuucuguaauguauaggaguuagagucucaagaaauaagcuucaagcaaaccaguugcuggcuuaguuguuucuuuucuuuucuuuuuuccgagacaggguuucucuguguacauuggcuguccuggaacucgcucuguagaccaggcuggcccugaacuuagaaauccaccugccucccucugccucccaagugcuaggaucaaaggcaugcgccaccacguccauuucuugaaucuguuuuuugaguuuuacuuuuuuauucuuuaagauuuauuuauuuauuuuauguaugugaguacacuucagcugaacagaugguugugagccuucaugugguuguugggaauugaauuuuaggaucucugcuugcuccagucagccccgcucacucccgucaauccugcucucucaguuccugcucacucuggcugaaagacuuauuuauuauauguaaguacacuguagcugucuucaaaugcuccagaagaggacaucagaucccauuacagaugguugugagucaucaugugguugcuggaauuugaacucaggaccuuuggaagagcagucagugcucuuacccacugagccaucucuccagcccugcuuuuuuauucuuaauuuacugcuuugccuuuuggaaaguagguaacuagcuuuuugagaagugucuguagagucugugugaagccuugagaagaaaauuaggaauacaguauuaacauuguuuugcuuuugaaugagguauuuggaucuguauuuuuagcuguacuuugcauggucacaggcauuaguggaaggcaacugucaguacuuagaagguaauuuauuuacaauacuuagccaugaccuacuacuuuuaaguuauuugauacuagauucuuuuuauuuuucuucuucugucuacagugguggaauucucuagucuuuguuucguuuuugauaugcugagaaucaaacccaggacauuggcagguacugggcaaguguuguguuucugagcuauauggaucauauaaucaucuaucuugacuaucauaguucuuaggaaguuaggugagaugcuuuaauacaucuuuaaaucuuguuuuaaaaauauauuuggcacauuucagcuagaauuguccucuugaccaaacaacaucucccuggaauuuucuuauacuuggauguuagaaauguuaccauaugauguauuuguucugcauuuuugauacaaggucucacuauguaacccugguuguccuauaacuugcuuugggaucacaggcauguagcaccaugucugguugagaggcuaaaauuuugagaacuaguucagccuuccaggguuugagcgagagccccuuaaagcugugagccagcuuuuuuuauggguccguuuuagagaugcagaaaacaaaaacaugauaaaugauuuuuagggcaguucugagagaugauaugcuggguagauaggcucugagcucugccuuaacuuuguauucacaaaguagugcuuugaggauguaguuuuuuuuuuuuuuuuaugauuuuuguaugaguaugcaugucuggugagaaauuaaauaagcuauaauuguucaggucucuauuguuuuagaggguccaggcuuacucuuagacauuuaguggaacauagaaauccaucucuugcuuacuuaguaucuuccagagacuugaguuccuaaagauauuuaucuccuuugauguguguguguguguguguguguguguguguaugaauuuugaucuaguacucagggugcucucucucuguuuuugcuagauugaaagauauuaaugugaaaauaggucuccacuuagcuggggguggugauaaaaaacaccuuugaggcaggcagaucucuguaaguuugaggacagucuagucuacauagcaaguuccagaccagccaggauugagaccaugucucaaaggggaaaagaaaaguacauuucuauuuaguacauuuuuugcugugccaaggaaugauaaacaagcuuuguuguauauguaggcaguuuggguggcauugaacagacuugccuuuuuccucaccaaacauccugauaaaccauuucgaaauauggcuccauuguguauaagcaucuggacaagcuggaguacugacauguaauagugcgcuuggagagggacaguugggugugugucaugucugccaggaaagagcuuuuaugucuuauuacauuguaaauuuugauucuccugcauacagauuuuaguuuaguuuaguuuuuuauuuauuuagauuucauggaucaguaaaauaguaucaaguuuaccuugucauuuaaaaugacaagguuuuacuauuucauauuuuaaaaauaacagguugcaaagcacuuuuacaguaguuuaguuuuguaugcuugucaccuugguguaaaaguaauuuaaauuuuaacauuggcauuuuuagagacagaacagucuguuuagacuaguauuagaaauaaggaaaugcuaaggucuuuuucaucagucuggacucaaaaaucucuuuuuuucauuuguuuuuaguauuacuuuaagaaaaaucuggucuauuaaguuauguacauguaaguggacaguuuaguuuuuauguggucaucuuguaaauuuuggguaagaaguuugagagugccagcaaauuucuguuucaaguugaaugcccugacaagauucagccgcugcucagguuuuaaaaaauuaugaacaugcauugacaagcacugaagguguauaguaauauuacaaugagacuaggcaguaguaaucaguccuugaugacauauuuuacacauuucccuaguguacaguucugagagaugauaugcuggguagauaggcuuggagcuuagccguaauuuuauauucacaaaguagugcuuugaggauguaguuuuuaugauuuuuguaugaguaagcauacgauccaaaaccugggugaaagaugcucaaggaagacggaguagaaugucuuccagugggaucaaguugucaggcuuugacaagaacaggacauuucaugagcaguaaugcuuuuugcauaaaugaggugaauucucaccaggaaagagugcccaagauaugauccuguuguaagagauguaaaguagagccuguaagccuuaguaaguuuuagcaggauguaugaggagugggcaguguuuuccaugaagaggccuuggaaaaaugucuagaucugacagaacuggcaucagucuguguuagagaaaauuauauuggaggacaaauauaaaaugaccugauuugcaucuccugagaguaaugaaaacauuuauuauuauauauaggguuuuaauuuugugguauuaggucaucgguguuccuuagaacuuagugguguuuucauguuuaauaaggaccccuuguguaguaguucagcaacuguuacugugggccccacaccauuaugcuuguacuguauucagccuucaugggucuuguggugcaugcuuuagagacacuguaggauggagagaacagccauguuaauuaaguuggucucagggacaugaugcuugccuagguucugaagggugaguuggcuuucauaaaaugggggagagugguaggguaauccucuguaguucuuaauggaauuuugggaucacauauagauuagcugaagguacgaugcagucaucaucuaagaggcuuuuucuuuuuaaaaucuuuaacuucggagcuuuggacucacaaaccaauuuuuaaauggucccugcucccucucccccuuaaauagugggagugauuaaaucucuguuucaagcaauuuuagauucuacaucugacaauuaaaauuacaaaauccauaguauaucuuucagucuugaaggauuguauuaucucuguuggacaaauuauuuugugcuaauguuagcaaagguuuuguuaaggaguuuuaaauuugguaguuuuuaucuuuccgagaacuuacugugauacauaaaaggcaaaaacacaauucaaacuuuauauauaaguggaaagaacacacuuuaaguuuggggcacaaaauaugaauguuauuuaacauaacauaacauaacauaacauaacauaacaggauagucagcuguccugugacuuaaccucuccaaauuucaguuuucuaauuuuucaaaugaaggcaagcaacuguuaccucauagaguuaccucauagaguugaagaaaggacugaaaguuccuaugcuacuuuugucuguuuuuuuauuuuguuuuuuuguuuuuugguuuuuggguuuuuuuggaaguacuuguuacauugaagaauuuucugaaacagaugugaacuagcuacaauuacuuuagauuguaacuaaacuguauugaguccucaguaguaaacaagaagaauacagucuuacuuuuaugcucuugacaaaauuuuucuccugcuaggaauuuuguuuagaugacacuugaugaccugagauguguagucuuugaggaaguacauuuuaauuuaauuuuagcauugcucacucugaagcacuuugcgcaauucagggcacauagaagauguggaaaaaguuucuaauguuguugacuugugucaggagauaguauauauacccauuugaaaugaaggauauuauuuggaaagauucuacacuuagaagauagguucauagguucuagcccggcaugguagcgcacgccuuuaaucccagcucagcacuugggaggcagaggcaggcagauuucugaguuccaggccagccuggucuacagagugaguucuaggacagccagggcuacacgaagaaacacuaucucaaaaaaaccaaaccaaaccaaccaaccaaccaaccaaacaaacaaacaaacaagauagguucuagccuuggcucugugacuuucauuagcuauggauuagagcaaauccauuaguauuaguauugaggagccacaguuuaucaguaggguguugccucccaguauugcugauggcaacugggaagggaaggaaagggaagggaagggaagggaagagaagggaauuugguuaacuugaagcagguugaauguaaugugaugaugauuccugaguaaacucuacucagacuaguuuucuuaugugagugacgacugacuguaugacccucauguuauucugugaugcuguuguauucauuuaguuuuaccacucaagaaccuuguuuauuuaaauauccagcagauggacuuuggaagaggaaaauuuagagauuuuuggagaggcagagcuauuuagaaguauucaucuuaguaagccacuugacaguguauguguguuuuuguaugcuaaagugcugguacuuuguguuuuuugcuuuguuuuguuguuuuuggugcugguacuuuguauuugaauguuauuuagcacacaccuuccuucuucuuccuccuuuuuuuuuuccuggacagucgguuucucuguguugcccuggcuguccucgaacucacucuguagcccaggcuggccucgaacucagaaacccgccugccucugccucccaagugcugggauuaaaggcgugugccaccacugcccggcagccuuccuucuugaggaauauauuuucugacuauucuuuggguuauucuaauuuuuuguaacugaauuuguauacuuuaucguuggccacacauuuucuugugcuuguuuuuuuuuuuuuuuuauucccaccccgcagaagccaucauuuacacauagagcauugagccucucagugaggugguuugaaacuauuguguacauuccucauauguauauuaauacauaugaauaauuuauacugccuuuuauucuuaaaucgugaagacuucuuucgggugcugagaguuugggaguauuaaaaauaaauaccauauaagggaaacagaguaguaccaaauagcuguacuagcaaaguaggcagaugagccccagagucuggaaagugacgguuaugaguugagacaggccgccgcuuccacucgggucuuggugagaagcugguuucugugcucauuaggaccuucugauugucucauccuacaguguuagaagaagagauacuaaaacuucagaaacagaaaucucaccagguuuuguuuuauuuauuuauuuagcucagaaagagaauauaaaauaaaaguaaauacgucuaaaauuuauuuauaagauauauuuauaaaacaguauaauuuuaccuguaaauccugaucaagauacaccuuuuuauaauuuugauaguuuuuuucuuuuucuuuuguuuuucugagacaggguuucucuguguagcccuggcuguccuggaacucacucuguagaccaggcuggccuggaacucagaaaucugccugccucccucugccucccaagggcugggcugggauuaaaggcgugugucaccaugcccggcuuaauuuugauaguuuugcuaaugacugucggugugcccaaacaucuguuuauguagauccuauuuagucaaagaaaagauuauuggacacacuuuucuuuuuuaaaaagguuaaaaggcuuuuuguuuaauucauggauauuaacuagaaauuaauucuuuggauaguuuaaggcccacaguauauuauuaacaaugagguuuaauuuuuaauuguauaugccagccuaggauaaauaaucucuauguuaaagcguuaagacauaaaauguuauuuuaaaaaauuguauuuuuugugagucaggaaaagaauacauuuccaaacuucaagcuuucagguugacaguuugaaguguccuuauauauuuucuccuggagaggcugauuuggaguugugugguuuacuuuuaaagagaaguuuguaauuccucugucucauaagguuagaaguuuagaggucuuuuuuuuugggggggguaugggcagagguguguuauugcuucauuaugaauugauaacuauucugcauugauuuuuaaaauuuuacauaguguaaauaacugaggucagugcugaagaagccauagaauaaaguaaugauggcagcacuucuccuagaggagguggaagggaaggauuggaagagaggagaaguagacucucucccaaggggcaacuuaguuguuuagugggcaagcaguguuuguuaccaccaaguaugugugggugcuguagucuuguuuuuccugccugauuauauaauacaggguaauauaggcaauuuggaaaaugaguuaagaggaguaaauaauguaugugcagcauugaacacacuccgcagcgugcauguguguauuauaccuuagauaagguacaucacuuacaccuuaagaaauguagcuaacauuuccccagggcaucucuuuucccuuuagcacucacuguugagcgagcuccccuuauuccagaaugccgggguucugaagugcuugugauucuguguuuggaguacuaacacagacuugagcaauugagcaucuuuuauuagaaaagccuaacaugaaaguuagucauuaccuucaaguuuuugcccugcaguguacaacuggaucauacguuuagggaccaaguaguuuauuuagcauuguuuagguauuugaagugcuggggaucaaaucaaaggcuucccacaugcuaggcagguauucucuacuguggagccauagaccacaacccugaagcggucuuaugcacugauggauggguuugaaaccucagaaggacccaaaaguaauuuuuugacuguaugaaagguuuuuugacaaaguuuuuaauaucguccugacaucaauuuuaucaauucauaucauaccaacuauguaugaauugccuacugaauaugguuguauaaaguuauccuaaauuuuaaaacauaaauuuuaaauucaccuuuuuaaauuguuugaauuuuaaauacggucuuuuuccuccuugugcucuucagcuucaccaacagagcauaaccacacugggcuguaacccagcccugcuuccugcugagagagggagcuaagccauaugugauaucacacaaauauguacugaaguuaauauacagaaacacuucuccaacauugcucaagugguuuuaaugggaaaacuuaacuuuauagaaauuuaaagaacauuuuugaguaguuuucuguaucaacuauuaaugcaaaauauagugaagacaguagaugcuaaaaucagaauccaguuuuuauuauuaagcuuaggguuuuuggagggcuuuaaagccaguuugauaccugcuuguauuuggaaugagugacuugcuuuguaggguuaggucaaggccaagugacuuaacucuguguuacuaguuuauuaauucauuugauaaauauuauuuuaacuccuuuucuuugucagauacuguucuaauagaauauaagggugcacagcauagacuguggugguugguggucaaguuaugaagcaaaagaaaucaaaggucuauggaggauguauggcuaacaggccaguuuuccucucagagggugaauggggaagccuguggugaaggagugguuuuguauuuauccaagugaaagaccuuuuaggaagggacagcaacgaagaacagauaaccguaccacaggaguagucuagaugucuuacgauuaaaaaaaaaaagaaucacaagacuuauugaaguguaguaagagaggaagagaccgauuagauaguacugggaaaacuggggacuagcaggugaaagaccuguaagccucuguaaagaccuuggcuucucuaugaguaaaauaaucuuacaucuccucuuuauaguuaguugucuacaaaguuaguugaauucuuaguuucacaguuagcuaaggauucuacuggaacuagcagaaauauuccuccguuuuuaaugggguucuguaucagcaagucuaaguugaaagcauuaagucagaaaugcauuuaagacacuuaaucuacugcgcauccuaguuuaguucucugccacauauuagcucuuuaguacugugaggccaugacuggcugggaacugccccugggcuguugccagagaacacuguagaacauguugccugggaaagauuaaaagucagauuuuggagcaugccuuuugguauaaugugugcacuuuuagaccauugugaaguaagaaaagaaacugcacaauagaaaggguucaaacaaagaagcaagauauaaugcgauuaaaaauuguaguaauuguauguguguauguauguguguguguguuuauguauguauguauaaaacauuuuagaguccauaccugauuuaaaucccauacugagaaauuacagguuaguaaagaaacuaggugauuaaauuaaaauuuaaacuacgaguaccaaguagacaaagcaauuuagugcugauuucugacaaaauuaccauucuaaagcuuuuuaaagaugaaguuaguguuauguaaggauauaguaagaugucuuuguacagguucuuaagcucacggcuucuaacucauaauccuuagggacugauguuuuuaguuuuauauuaaauuucuuaagggaguuuacaaauuauaucuggcauuauuuaaaugaucuuuuauguguucuuacacauuuauauauaccuguguaaauaucgcuguggcucauauacugaaccuuucugucaccucuuaagcugacugagucggcaguacucauucauaagcuaggaaaucaguacuuugcuccuaguugcugggaauuaguuuuguuuuaagaggcuucaaacagaugaaguuguagcugauauauucuuucaugucugaccuuuugcuuaacaaacuuuuuuuuaauuaauauuauuccauauuguacucacucacuuaacguuggauugcauuuuguuaguacuguuuuaacuagucccugaaaugcuuuucaaaugaguuucuguuugaagcaguaaauacuuggaaaaaaaaaaacuuuaaaaaaagucagaaguauguuaaaauaucuaggcuuuguguuacuacaccuaacaguuaugcguaaguuaugagaaagggauuggguaguaaaaaguguacaagggggcuggugagauggcucaguggguaagagcacccgacugcucuucugaagguccagaguucaaagcccagcaaccacaugguggcucacaaccauccguaaggagaucugacucccucuucuggagugucugaagacagcuacaguguacuuacauauaauagauaaauaaaucuuaaaaaaaaaaaguguacaagguuuauagcauagauguauucacacaaagauaauuuuucuucccaguggauuauuuuggcauuuuuuccaaaaugaauugaauaugaacgugaagguuuauauuaaccaucaauucuauuuuacuguacucuuacguaugcuaguaucuuuugcuuccaugcuacaagcuugaaaacugaaaaugaaaauucuccaacuuuguccuuuuucuagauuguuuuggucaauauaucuuuugaauuuccaucugacucuuaggauucgcuugucugcuuuugccgaggagccagcugcuguauaacuuguagcucauugugguguauugccacuucucaucuuuagacuugggugacuuucguugauauaguuuuuuaauuucuuuccauuauuuuguacagcuuucacaguauaauuuuuguguaugaaauuuaaguauuuuacucucugaugcuugggaaauggaauugcuuguuuucuuuaugggguucguuauugcugcaugaaaaugugauuuuuuauauauugguuuauaugccuuguaccccauugaacguccucauuuaagccauuuugauaaguuaaagauuaugaaaauccacacugcuaugaaacugcuauaaaaucauuauucuagugagcgccuuaggauuuuuuguagaucuaauaaugucaucugcaacuagaggcuuucaccuccucuccagacucagcacuucuuauuucauuuuguugccuaacgauucugucuaggaucuucaguacaagaucacauguaguggcaagaguggacagccucaucucugcucuuagaaggaaaacauucacuauuucaccguucauuaugcuucuauguuuuuuuuaaaccauaacuuuaaagaagcacauuguuuauuuguuuguuuauuuguguaugugggcacaccuaagccuucaggcucaugugcagauuagagcacaacuuuccugccauagggaccuuuucaaacuuggcucuucaggcuuagugguaagcacuaccccucaccccccacccccacucaaaccuaucucugccuuccguucguaaauacuuuuuacugauuuggggaugucccuuuuggauggaaauuuuuuguuguugguuugguuuuaggucugguuucgauuuuaaaaaguggaucuuguguccaccgagggugucccuucaccgccuuugcuuuacaaguguuaggguuguaguuguauauccuuuaaugaugugcgaguuuugucccuuauuuaaaaaugcacauuaaauugcacaauauuguauguugagcaaguccugucucugggauaaccccaucucauuuauugcucauauuacgucguaguuguaguuucuuuccaugucauggcaguggccgucuugacgguagugaugcuagugagaagguuucuggcuagucguuuguuuugaauaguuugaagugaaacuaaguuuuuucuuccagucuaucacucaagccuucugggcgcgugccuucccucuugaaaauuuucuguuguuaaugcggucucuuuacuugugaugggucuaguuuugacugucuuauuucuuuugucaauuuugauagccugauaauguuuuaguaauuuguccauuuccucaaguuucauaguuugcuagcuugagccccuuucuuuaccuuucucuugucaacucuguuaccuuuuuucuuuguuuuuguuuuuuuuaaauguugaauuagguguuuguuugcuuauuuguuugguagaacugggauuugaacguggggauugaaucuuagucuuuacacguugggcaaacaccccuuuaugaagcuauaucuucagccuucucuuacuuuuuuuuaaauugaagcaagguuucauucgguugcucagagugaccaugaacucacugccuagucuagaaaggccuuuaguaugucugggccuccucagaacuggagucagagucguccucaaggaaacuucucuuuguaauagacagaaaccacuacagaaaggcacagcucgucaaaguggaaagcuguggaaucagucccaauggcuaccucaaagcacucccugaccuaaggcucagggaacauuuuagaagaugggacagaaagauugacuguaagagcuuuccuccagugggguugugucucccgguaagguugaagcuacaauacucaccaacaugacugccuccacaugagcugagaagggcagcaacaauagacaugcaaagucugccagacacagaacuacaagucaccaaggaaugccgagagagagagagagagagagagagagagagagagagagagagagagagugugugugugugugugugugugugugugugugagaguguuaguuuucuccaggaagagcgcacuaauuggcucccaauaccagauggucagccgugaaaacauacaugugaguaguguuauauagacugagcagguuguauuuaggaaauauauauguguauauauuuguacacauguaugcacauaguagcaauugaugaaagaagaagccaugaaguugaaagggcaaggaggggggaugugggaauguuggagggaugaaagggaagaggaaaguguuuguaauuauauuacgauuugacaaaauaggaaaauuaaggacucuucuauccaaaaagcaaccacuaggccugacuuaagaucuuuuugaaagauaauuauuugaugggguguugucauuauuucuaagccuuuauuuaauggguccccugaauuacuggccauauuuaugaggguuacuuggaagucucuguugagugacacugggcugcuuuuuaccuuguguauuacucucuauacuuguggucuguggagggccagguauugaguauauggcagcaucucugcacacacugcuccucuuuucugggcuucucacugcuuuaauggcuuugcugugcuauuucgaugaaauuguauauauuuugcauuggaaagaauuugaugucauacucuggaggauaaagccuuggagauauuggcguggcuaagaugacagugauuucuuuuaacagugaaaucugugugucuuucacuuguaggucuguagaauuucuugguaucacacccagguaucuaucuucacuaguugugcuaauuacgcuguuggcuuugaugguucucaagagguguguauugucugucugauugaaguuuggccccuguaaugggcuuuuucuuuuuaccgcugcccagucuuugguguuugaacccaagaaggcucuuacuagcuaucugucccccuaauuuucuuuauaguaaaccaacugaccuugaguucuaguccuuuaaguugccaccaugcucuguguuuuugaguguacuguaggcuugaauuucccccacacuucuuuccaguugaguuaauuucuuuugaggaguuucaaagcucucugcuuuucuagaaucugaaccaguauacaggccuaugccuauuuggcuccuguggugugaguggguggguugaaggcagguggaguguauguaaagacaugccucuucauguaugucaaggcuauucaaagaccguggagaggcaggaguaagaaagucuguucaccucuuuuuggggaaguauaaaauagaauugcacuuaucccugccuagcuucaaaugaaugagaaucaaacuaugauuuauuuauuaggcucugcaaaauuacuggggauuacccauaaucuaauucucuaauacuagucuggcuacuuccccaacucugcuccccaaaugcucgcuguuugaaucuugcuagguuauuucuguucgagcaaucugguguucuggggaggcaguucacucuggcacuugauguuggccagucaagacuuauggagaccucccagucuuucuucucucacucacuccguuuuccuucuccacccucacccaugucccuacccaggacccccagcggaguagcugaaaacccgccuacuucuauucuccccaguagucagcuguugccuuuuuuuuuuuuuuuuaccacugguuuuaaacuugggagcaagguuugcacaacaaaagcugguguuugcacaacaaaagcuugucuugcagccaccagaucuugggguacagauuuagcauuugaauacuuuagcagcaccugaccaaccuccuguagggaaguacuuuguacacaggggagugaaaagagaguuaguagauggucugcgguaauuauguggcuaguuucuuuugcuauauucauuacaaugacacaugagagaacuauuucuuuguuuaaaaaaauuuuuuuugaauaaugacuuuuuuccauuaauugaaauuuaaauauuaaaugagccucguuucucugaagaccuccuuggcauuuuguuuaguuuuaugugcagacauuuuguugaucuuuuuuguguaucugcuccauagguguauuuauuuguaucugaauuuuucaucaucauuuagugucuuugguuugguguaaacaugauaaaaaugagguauuagcuccuuauuugcuuuguggauacauuguaucuuuaaauaucuuauacacccuugagacuccuugagccuaggaggguagugguuguuuucuuagucaauuaaauaauauuagcagaugcaagacuguucagacucuuaccagugaaccuaaaggacaaagccaucucauuuaaauugucuauuuguaagaguucuuguauuucuuauccuucuuuuggugccugggggcucaggagucauguauuuucugcauuccuaauauugauauuucugacuuguuagucuaccuaaggugcauuuauuuuugucuauuuaaagcuaagcucuagaugcuguuuucuugcuaguuuaacuuguuuuagugugguggcccccgacccccaucuuuaucauucccucuauacuugcuuuggauguauuacgccaucuuaguuuuaggaggugugaacuuugaugguuggcuugaucugucuuuuaaauauaagcacuuaaaauuguacauuuccacaaaguaugaguuuaccugcauuucacauuuguuauguuuuuaauuauugaucuguuuauucugucuuucauuaugacuuauccucuguauacccuagguguauuucuuuguuuggucuuuuagagauugauuuaggaauuacuuugcuuuuggaaguuaguuaacuaaagcugugcauucaucagaagacauccuuuuuacauauucaguucuuuaaaauuuaucauuaaaaaauaauauacaacgccuuuaaucccagcacucacuugggaggcagaggcaggcgauuucugaguucgaggccagccuggucuacaaagugaguuccaggacagccagggcuauacagagaaacccugucucgaaaaaccaaaauaaaauaaaauaaaaauaaaaaaauaauauacauuagugugaucagaauuucugccccaccucccacuccccacacccagcuuccuagucauuguaauccccauggaaagaauugcagaugacacauaggugccuagaccaauggggaacaugcgcuuagcaggauugagaguggacacugaccuaaggguucaaguuguagccugcacacugcacaccgcaguacaaacagcuuuccccaggagcuuuauucaguccacgugguugacaguuugauuuggauuuguccuuuaucagaaggccuagggcuguaaguaaucuuaagguuuugauagauaucuagugaccuuaagggcaguucagaaugucacuucuccuggguuagagguaugauucaaauuucacucuucugugguacugggagucugcaggucaguccuugguuuuaccagcugaugcuuaugugguacggcccauccccaguagccuccacgcuugccagggucuaacucgauaccugaugugaacggggcuguuaguuuaguugagugguguagaacacuugcuaugcccacagucuuugauaaaguccucagcaaacgcgcaugcaugaacucagauacacacacuuuuuuuuuuuuuuuuuugguaauuuauaguauucuuuaaauaucuuguacaugguaguguauggcuuuucuauuucugauuucuguuuauguggccuauuauaacugagaagaauauugaauaaucaauuguaaaguuguauguguuaguuucuaguuucagagcuacuauuuuagauagcuugaagcucuuguuaguuacauagaagacuaugucuugggcucaguuggagaggugcuuaaggaccugaauuugaucccuaaaacccauaguguuuuguuuuguuuguuuuguuuugucuaaagccaggugcagugaugcaggcuuguaaucucaaugcuggagacaagugcuuuucuggggcugcuaguuggucagccagccuagccugccucuugaguuuuaggcuaguuagagacugcguuccuccuaaacagggaaguauucucuuucuugcucaaagaugauauagucuggauuuugagccagaaaucucuugauucuauuuuaccuggcugccacuaguuaguuauauauuauuuaauuuuuuagauuuuuuuuaaaguuuauuuuuuauuuauaugaguacacuguagcugucuucagaacacacacuagaagagggcaucagaucccauuacagaugguugugagccaccaugugguugcugggauugagcucaggaccucuggcagagcagucucuuaacagcugagccauugaaacaagauguuuguguucugagaguuauccccgaguugucuuauuguaaagauuuuaaaccuuuuguuucuugaaugggucuuguguaaaacaugcagacucuucauaugugcaagauaaauaugcuucugaaaguucuauuacauuagaauauugguuuaaaaauagugauuguauauucagagguguuuuaucacaaagucuaaugaaacauuguaauguuuaugcuaauacugguguuaagugauaguuugagauuugaagcagcugaacugauuggauauaucugaguuucaguggugaaaaaaaaugacaguugaagacagcuguuagcacugugggcuuuuuagcuguguuucaguuaaguaaauaccacauuuccguuagugccuuaggaaaauaaagguguaaguucuccuuugccccuuaguaagucaguuacugacaaggaagguaggauuacucuuggacuauauugguuauuauuucuucuuuucuucuucuucuucuucuuccuucuuccuucuuccuucuuccuucuuccuuccuucuucuucuucuccuccuccuccuccuccuccuccuccuucuccuccuucuccuccuucuccuccuccuccuucuccuccuucuccuccuucuccuccuucuccuccuccuccuucuccuccccuccuccuucuccuccuccuccuccuccccuccuccuucuccuccuccuccuccccuccuccuucuccuccuccuccuccccuccuccuucuccuccuccuccuccuccuccuuuuuguuuuuuguuuuuuguuuuuuguuuuuucgagacauguauugcccuggcugucuuggaacucacuuuguagaccaggcuggccucgaacucagaaauccaccugccucugccuccccaagugcugggauucaaggcgugugccaccacgcccggcuuugguuauuuauucuuaaaugauauggggaauagaagaaaggaacaacaguaguauucacaaggucaacgagauugaggagccaaccggaagaucuguauggccuggcagcuguuacgauaaggagggaaaaaaguggagucugguauuuaaaccuuuaagguauucauuuuuaagugaauuaaaauuggaaaacuugaaaggaaaaucuagucuucucagaaagccugguccuaugucagaauaucaagggcaguaaaaagacuuuuuaagauuuuuuuaaaaauuauuuucaguaaccaauuuuuaaaaguaacuuucugauugcuguucuuacucuugccauauaaaauguuaguauugcauuccuuuuaaggaaaauauuguuuggugcaguugcagucaguauucaguguaauuugugguucauuaauucagcaaaguauuuaugcaaugugugauguuuuugguuauugaaacaagaccggcaagcacaauagacagagccucuguacaggacuuagauagauauuaaggcugugcagacaaaacaacugcacacaacucagacauuggauggucggggcaggccuuugugaagacggacaacuaaggagaaaggucagugcuaggaaggugcuuggcauugaaaaacugagcugagaucauugggacagcaacaacugcagagacccugaguuaaauaaagacugccguggaggagagugcagcaaggaugaccuccucuucuuccuccccuuccccuucucucccuccuccuccuuccuuucuucucuuuucccgcuuuucuucuuccacaugucauuaucucugccuacacucuuuguucucucacuugucacuacacuuauuuugguuuaauagaccucugucuacacuguucuuugaucccugagcugcccauguuugagggauccagccucaacugccugacauuucugcuuauuuauugccuccucuaucuucacuaucaaaaccaguuugcaugucuucuccugcuucaaccucugaccucuccuuucauaucugugcuuucagcugauagcuuuguuuuguauuuuagcagaaaagguaguaagcagaguuuugcaguacauuuccaauaaugucuacuuacuuaaauuuacuccugcuuaacuuucuuguagcaauauacccugugucuaagucuagucucuaagacauuccacccacauuucaaaaaaaucauguggauucuauccugccaucaguucuuucuaugguuauuuuacuguugcugggauaaaacgccauggccaagggaugaguccauuaguugugucagggaggcauggcagaaagcagcaggugugggggcuagagcaggaugcucagagcucacauccuguauuauaagcacagagagugagcuggaaaugaaaugagucuuuaaacucacaaagccuggcugcagggacauauuucccccaacaaggccacaccuuugauauuuccacaaacagugccacuaagugggaaccaaugaugagauuuaugagccugugggggacauuuccauucaugguaccacauccacucuaucagacuuuugugucuuacaaacuccacuuuagcuauucuuucagccauuccuuaguucucuugcucuuaguuucucuguuccuacuccuugugacccugcucuguagcaccgcuucaguccauuguccgaccaaaaguauugcuaugaagugaccaucaaaugucuucugugcaguuaaauauguagguuaauacucaaguuacuuauucuuaaugaagaacuuuggaaaccguugcuuuucuucaagcugguuacccaguuuuaagaauaacuacacagcugucuuucuuuaguguugcuggaaccagagcacaugguuucuguccucaucuaccgugaggaagagaggcacacccagggugugcagguuguuuaaacuuaaagcagcuuuaaguaguagggacgcuacagaggggcuucucccuugccgcacauuccagugcauuaauuugcaagcaacgagguucagaaaggguuggcauuuucucauuuaaguuugguaggacaucuuuguuguguuucauuuuauuugaguacaguuugaguauuuugaaaugcugagccuguuaaauacauaaaucugaauauuaguugaccaaaauuucuuaaaauauuugugauagaacuauauaguuagauuaaaaggauaucaggaaagcuaccacugcagagauacaaacacuaaaguuaugaaacauuaaauuaugauaaccagacaauaauuugauuuaaagggaacauuguugguuaauucuggcuuuucuuugucaguaaaagcaaccuuucauuuuacauauuaauaauuggccuuugaaaucugaauuacuagauauuuagaaaacauuuucaguguugcaguuuugcuagacuugauaugcugcaacuaaaauucagcuuuucuuuugucugaugauguuuuuguauguacuacuuagucaucaauuuggauuuugaaaauauuuaucuguauaggcuauaaauuagucgugacaacaaggaaacuuaacuuuuugagaaagaguucuugaugaauaccccauguaacuguauaugguucauuucaacugucaacuugaugaaauguagacucaccuuggagguggaccucugaguuugugaaguaccauguggguagugggaaucggacuggaguccucugagagcugccgaagcucuuaaccacggagcuauuucuccagccuccucugagcacgcuuauguuuuaauuauguuaauugagaugaacccuuccccuggacagggaucucugcuguugacuuuuggauauaaugugaccagcucucucaagccuuagaggugacuuccuugcagagaugaacuauaaccuagaauugugagccaaauagcccuuucuccuuuaaauugcuuuuugucagguucuuaacauagcaaccaggugaugucuauuuuugauguuaagguguguuucuuaaugcagcagagggaugaaucacauuuuuuaucuguuuugguuugucugcgccguauuauuggagaauugagagcaucagugcugagagauaucugaucagugcuuugguggugcugguguguucauaaagugugagcuucccucuuuugucugggguuauuuauucuguucuuucuugggugugguuaaacuuucaguaguaaauuuucuuguagcaccuuuguaaggccagauauguagauagugcucaaauuugguuuuaucacggaaugucuuauuuucuucaucuauuguaauuaaaaguuuugcuggguagaguguucuggacuggcaucgguggucuauuagagucuguagaccaucuguccaggcccuacuggauuuuagagucuccauugagaugucagauguuaauuuuaauaggucugccuuuuuauauuuuacuuggucuuuuuucuugcagcuuuuacuauuucuuuguuuagguuuuuuguuguuguuguucuuuuguuuuccccaggaauuucuuuucugguccaauauacuuuuauguuccauauguuuauacuucgauauguagcuccuuuagguuaggggaauuuucuucuaugauuuuucugaaaguauuuucucuguuuuugaucuggguuucuucuuccuguauuccuacuguuuuugauuuggucuuuucgucaugucccauauauccuggauauuuugugucuucucaguucuuaagcugauuuaguuauuuccuucugcuguuugugcuuucauggguauuuuuuuaaagggacuuauucuuuuucucugucaggaccucugucauauucacagaggcucuucuaagguacucgucuugcacugcagcuguguuucaguacucggggccugcugugguaggguugcugggcucugguggagaccucccguccuggcugucacugauugugcuuuuagaauggcaucuaagcuguaguucuaagugcugauaucuggacuuuguuaguugggugcuuuguucuuugguuucuguuucucacacucucugguucuugggaaaauguguagaccguauguuuccagauauuuuuaugggauccugcuagguguggccacuaggggguuccaggucaaauguguuucuagguguagguagcugacacuuaggaaugggaaacaacuaggagguggagaggaagguugaggggggucacaggagggaggaaagcaggguguuccaucaugaucugcuuagucccuugggaaugagcacagagaauaaacagaggccacagcagaaggucugcuauagagcugggauuagaauggggauuggauguggagaauggagugagcagugaaucuuguuuucuaucuguuuugguuugucugugccauuuuauuggagaauugagagcauuaaugcugauaucugcaguuagccugucugcuuagagccugcagguucccaggcaguaacuauuggaguuccgggcugggauauagccauaguaggacgaaggaaguuuggagguuugugagccacaggaggugggcuugggauggggguuggagguguaggacucuacuagggaggaugcagaggugguuuucuauagagcuagagaugagauuggaggagauucuaccuguuugccagguuaguguggccuguggcuucucaaggaguuucagucugaauucauucucauagaacgaugcauugaagauuuguccauguugccuaaauuaguaguuccuuuuuauuguugaauagcauuucaucauugaaauaaucauuuuagcauuuacuaagaauacuacccuuauuaauaugagcauucacguacugguuuugaugugaacacaaaguucaaucugauaaaucccuaggagauaaaaugauggagcuauaagaagccaaugucuagccuuucauuacuaaaacugucuucuaaauugacuacuuucguuuuuaaaaggugucuuaguugaauuuuagagcucucugaugguaauucuuuucuuucuguucuuaaaaugcugcuagaagucagugggggccgucuuccaggugucugucuuacucuggcccugggcugcuccacuuuauaucaggagguuuugucauaguaucagacagaccuugcaucgacauguuuauuugaaaaccuagauuauauuuagugauaccugcuuuaacauccuugcguaguaauuccaccauuugucuaauugcuauauuuauuuucacguguucuauuucagcuucuuaugaguuagagguuuugguaagugcuguauacuugcuguugguucuauuaugcuagucugucaguuuggucaugcacuguuguacugcuugaggaugcagauauguuacuuagaaucgggccagucuucuuugaguuaggugucuccagaguguuuuucuaaagcuuacuugauuugaugguugaaacucuccuucuuuaccuucugaacuugaaaccucagaggccuugaggauugcuuccacuguugacguuuucagaagacuuuucucuagacugaggcuuuuucaucuguagauacaaaucaccacuuaaaucuauuaaauucccauuaaagauauucucuguucggauccuuggguucuuuauugcugaagccuuggucuauauuuacccugcagguucuaguugccugucuccccugucuaacuuggaacuuguguagccucuuaagaaccuugaacucugcuuggcguccgcucugcccuccuacaaugaucugggagcacugacagaggucacuucauugauucuguucucuucauguccggaaguaacuggugcuuacaugucaaaguggccguuucauauauuuuguuugguuuaaaguagaugaauagagccagucuuuuugguuuuguuuuuuuuuuucguggaagauaaucucugcuuaauagaaaauuucccuguaguuuggcaaacacauacuuuuaugacuuuaaacuauuuauagggcuuugugggcaaacagccugcacaccugcuuuaggagcaguggcauccugcuccugguuguccccuuucacagacagucuuagguacauauguguaaugugcauugcggauuaguucuuuccccaugucagcuaucaccacaguacauuaaucaguauaacacaggaugaagauaguggugacaaauguuccuuuuucauacuugcuaagaauuuauuaaaguauuacuuagcauauacauuuuuaucauaauuguccuuuuuuguauaaguaagaugugcuauuuaaguuaccuugcuuaauuuuagauuuuaaacacaucuuuugauuaaaauuugcacaguaugaaaguguacuacuauaugggauuuuaccuaaacaaaaucuuuuuguuguuuuuuuuuuuuuuguuuuguuuuguuuuuuuuuuuuuuguuuuguuuuuuuuuuuuuuuuuugcuuuuucgagacaggguuucuuuguguagcccuggcuguccuggaacucacucuguagaccaggcuggccucgaacucagaaaucugccugccucugcuucucaagugcugggauuaaaggcguggaccaccacugccccccggcuuaaaauauuuuuaaggagaaaagcauucuuauucuauaacuagugacucaacuuuuagauuauuguccacuggauucaguuagcauuaaaguaagauagaucuuaucuuaaaacuuuuuuuuuuuauauuuuuauuagguauuuuccucauuuacauuuccaaugcuaucccaaaagucccccauacccucccccccccacuccccuacccacccacucccacuuuuuggcccuggcauuccccuguacugggacauauaaaguuugcaaguccaaugggcaucucuuugcagugauggccgacuaggccaucuuuugauacauaugcagcuagagucaagagcuccgggguacugguuaguucauaauguuguuccaccuauaggauugcagaucccuuuagcuccuuggguacuuucucuagcuccuccauugggggcccugugauccauccaauaacugacugugagcauccacuucaguguuugcuaggcuccggcauagucucacaagagagagcuauaucuggguccuuucagcaaaaucuugcuagugugugcaauggugucagcguuuggaagcugacuaugggauggauccccggauauggcaguuucuagaugguccauccuuucgucacagcuccaaacuuugucucuguaacuccuuccauggguguuuuguucccaauucuaagaaggggcaaaguguccacacuuuggucuucguuauuuaauacuauuguacacuaacauuacaaacaagaguacugguuaggagcuauauaaugaaaaaaaauugugauagccaagccaaauauguguuacacuauuguuauggggcauccaguucacuucauaauuuugucuuuagaauacccuaauuucugacucaagaauguaggucuaugguagagugguugcccagcauuuacaaggcuuuguucacuguuaagcacagcauaaauuaaauaauaaacacaaauaauuuaaaugaugacuauacacacacacacacacacacacacacacacacacacacacuaaugguuauuauauggagucuuuuuaaauacuuugucaguaauguuagugaccaagccaucucagccagccaacagguucuccagggcaggaaugaggauaaaaagagacgacaauuagacaacacuguagccugaccccagccaguucugaggcugaggcagguugacuuuuuuccagucugccugaagccuacuucuuuguucuagccccaaaucagauuccugccugagcuuacuuccuguccuggcccaaugucagauuccuaccaaggggcccaaaagcucuccacauguuaguuuuucauuuaaaaauuauucucuuaguggauugugucaauguauauauauuuguaauccuucguauuuguccuuuuuaguaacacuugugugagauuucuguuguuguuuuuaaauugcuggccuuauugauuaccaguaacugcuuuugcagaggacuuggguuucguuacuggugccccucucacauggcucacaucaccuguaacuccagcccuaggggaccugguguucuguucccaugaucacaaaccuguucacguacauacgugcuuauacauaauuuuaaaaauacauaaaaauuuagagaguuuguauaugggguuaauguauguauuuaguguguggguguggaaagugucuuuaggagccacauggaguuuccgcaguuagaguugcugucauugaaccugcagguuauugauuggcuaugcugcuugccaggucagugagcggcagggaucugcuugucugccccucuuccacccaaggcuccuuccuacauggggucuagggauggaaacagguccuaagucuugcacaguaggcuccuuaucuacuaagcccucuccauagccuuuaccuaaccgaugcauuauaaaguagaugcuuuuagcaucucauccucauguacauuucauaugauaguaaauauguuuuuuaaaaauuugaauguagaauuauaacggauagcaacauuauuuaguagcuauauauacuacuauucaagguaaauguuuuauacuauuaaggcuauuuguacugaaaugugucuuauacauucuuuguagaacuaucuuuaaaucuuugaacuuuuugaauuuuaauuuuuauuuuugaaacagcaugauaauucuuaucucaguuucauuuuuuaaccugacauguacagugcauauuuauuuuguagguauuuacccagguuaagaaguaaacaucauuaaaaauccuuuccccccagugucaaaaagugaauccuauuguaaugugcaugaaauugguguugcaguuaggcugauagaacacugaauuggguuuuuaaucuaauaauuguuuuaaaaauaccauauauuuacauccuuuagcguggaaauaaucuuugugagcgacaugaaucaauacauauauagcuuacauuccuagcaucugaguauaggcaguggggugggccaucuaguuaaugauugaauuugaauuaacuggucauuuggagaauaaccagagaauauuuaagacacacaaaaaagcuuggggucagggggugggugguuguuguuguuguuuucuuguuuuuuuuuuguuuuuguucaucuauguuucuuccuguuguguguaaugucugguauugugacaaaguaguggaagcaggugugaacgaacaguuuucauaucugauaaucucuaccucagagcccagugcuaguugccugcucucaauaccuagggggagaaugggacagagucuaagacaguuagcugcuuuuuagguuuguucucauuguauuuugugugcuauguugaauauuuuuguuaauguuauguauauuuacauguuaguaauuuugauggcuuuuggauaauuccacucuagagggagaacuggugggcgguccuuccugugacacgacccuugagugacaguucuauuugauugccuccaguacugugaggaaaggacacgacucuauggugaggacugauggacauacauuaucugagaaaagaaacuaccagguaagauuuuuuucccucccuuuucuccauuugucauaaguguauugagcuguuuuaaaguaauauaaaauuguaacuaacaguaaauacaaucuccugaaaauuugugguauaaguuuaaauauuacauaauggaauugacagcuugaaauaauugugaauguuuuacaaaaugacauguuuauaauguauauuuuuaacaccagaacaauuuucugacauaugccaaaauuuuggauuaucugauauauaauauaugauuuuuggcuggauucaaaggcaguaguucauaaaguauuuuacacacauuccugaaagaaggaaauguaaauuuuggguuauaguuucuauaauagagugauagagaaauguacauagcauugaguaggcuauagaagaaauauaaauggaaucuaggaauaugugacccagauccuguuuugucacuaauaugcuguccuuacaacaucagauucuuguuucgcuccuuacuuaacacuucuuaacacuauccaaucuuaauuauguaggaaugcucaaaagguaauggaacuguaacauuccuauuucuuccugagcuuucaaaagaagguaaacuuuaaagguaguguuauuaaagugauuuuuuuuuuaaaaaacagaacagguaguguuugaaguuaaguucuaaauggaaacuuacuucauaucauuggauagugaauccaaugaaguaauauuaaauacugaguaaguucauacaggaauaagccguuagacuuccugggcagccgugguuccaccccguugcucccucucaccucaggcgguuguccuuugagacuaagacagcuacugugacacaccagcuacucacaggcucauuugguggagugcaauuaacccuuucuuuccaugcacugaggcuugagcaguggagagaacugaaagugaguuuaugcugugucagccaagagccuuugguuauaagacuuggguucugucuuguaguaccauccccaauagaagaugcuucuguaucuaaccuuccuagagcuuuugucuaacuugauugaugaaguuucuggccagaucuuuauuauuuuaauaagccagaguaagcugcgauuaugcuggaucaguucucccuauaacacuucucugauuuguacucauagacuggacuagccucugcuaaugacuaauugugcuugcuauauagcucuuccuaccucagaaccacuuccagcagcuuguacuuguaagacuuugauugguuacacuuuuugggguuuuacaucuuuguuagguuuugcucaaucacuacaagaauauuguaauuauggguuguguggcauuuuagugcucacaaacauacuugcagacugugaguauagagcuuuuguuugauuuacacauuagcuaauuugugucauggaacaauauucauauacacuucuagaauuuauacuuaugaaaggaauaaagcaguuauauuuugccaaaagaguuucuuauuucugcuuauacuacuagaaaagugcuuuauucuagucucaauaugcaaauaauaaaaguuuuugagcuugcaugaagauacuuucuugacuagacuuuugcuggaugaaauaauuuuccacuugccuuuuacuguuacauagugguguccaguguauauugaaacaucuuuggaaauaggucuggaucguaaaauuauuucauuuugaaaacuccucugaaaaggacauaugcauggaagacugguuucauaucuagcauuaacaugaauguauugagaguguaugggacagucacauaauguugaaucaccaaaguaaaaaacuguauguuuuaguagcucuuaggagcuuguauauucuaaagugaaaguaauuuggaguuuauaaguuuuuauuuuauaagaauuucguucuuuucauuguuaaaguagacuucuuugugucuauauaacuucauuuauuugagaccuuuugguuuuguuucuuuaagcaucuugauaacugacuaauauuugagauuaacaaaaaauauuucuccaaauuucauuuccauauagaccuuauagacuuucaguuacacaggaguugaaauacuuauuuuuguaguaguauuaacuucguauguuuugucugucaguaagccuaguuaggcauuugaauauagcagaugaaguuuguuugcauaaauaaauuaguuucggaaggcaguccuuuaugaaagggucgucaagcuuuuuauaagaaaguagacauuaugucaguuuuagauuuuuuucuauauucuuccuauaauuuacauuaauuuugccacagcuaugcacauacauaaauuuaaaucaucuuaauuaucacuguaauucaucaauggcuuucucuaauacucaagcucuaaacauggcaccugcuugacuucuugguugcguuuuuaugcccucaauaccucuucucuaacugccuuugcuggguuugacuauuuaguaauuaaaagcugcuuuaacgcuccaugugccuuguaccccaagcuuuuaauaauuuggaucucaugccucaguaauuugauuucuauuuuuucagaagcuuccuuaauggacucaggacuauuuuucuguugcuucaaguccucugcuugcaguuaguguuggccuuagcacagagcagccaucuguuuucuuuuauuucccguacacuguucguuccauagauaggagcuaccaauggcugcuuaaacucaguuauguuaaauaauauuaaauuuuuauuuugcugaccaugcaagccacauuuuaaauguuuaguguauacugcuaguggcuccuuuacugacaacugcaggacagugcaucuguguggacacagucagcuuguggaagacugcagccacguucgcuuauucuggcaccaccagugucuaaugugguaccugcucuauggggagauguucagugaauauuguuugaauaaaauuccagugaaaaccugagaggaagaaacagggaaaugugcuggcagucuacuggugagauucccaagguuuuuauaccgaaugcaaacuuccuuucauuuagcuuguagcuuuuagcaauaaauuaauuuuuuuccucauaaaaaauguugaaggaaaacacuaagucccauaugaacguugaccauccuaaccuuuuucuucagugcuuuugcuuuguaaucuuugguuguuuuuuuuuuuuuuuuuaacaaauauguauuuucagcuuguuauauuuauggagauauugccauaucucauuucuuguuuuauuuuucagaaguaaucauuaauuugaguuuggcauuucacucguucuuauguguaauuuuuacuauguguguagguuuugauauuacaggcacaucuuucuuucuaggaguguuuugauaaguuaucccuuacauuccacuguuuugaguaggaaaaauaagcuuuuagcccaguuaaccuucagacacuuugucaagguaaacacguaacacuugguagucuaaaguacaaguuaaucuacuuaguaaccauguaaggagucgggaaggaguguuucuaccugguaaguucuaagcauuacuguacacagacuagcauuuuauacugcagggaaauggaaguguaagcuguggaagcacccagcuucacuuuuauaagucaguaugaaaagucuguaugcaggccacagcaucuuaggguaguugauguuucagagucauaguuguacuaguuagcuugggaccuccuuuggguacuuguaauguguuuagaaacacaaacauuugugcaucuuugacuaugucagauauugauaaguagugaauaucagaaaccacuuagaaaaauuuguagggauuuuuuuuaagcgaguacuuagcagucgauccgugguagaguauuauuauucucugggauaauagaggcuuuaguaggcuuuaguccuuguugcuguuugguguagaaugaagguaaguaagaguaagcagaugaaaaauugaaucacacacacacacaagacuuaaucuagagaacuauuucauaauauucucuuagcucuugaacaucuuguuaacaaugggaccuaaguauuguccuuggucagagacacaaagcagugggauaaaacucaaaaugaugacuuuaugcuuggcuucuuugcauguguuagagcugcuaauggaggggugcagaacaauaagaaacgccagcaguguaaggcugcuugcuguuucugccacagccacuguuucccuaucagaagccacuuggaauuuauaaccuagauuguaaaguaaagcuugguagguuuuucuccaccugacccacuuucccauguuucccuggcuuacuaacaucagguucagugacuucccaaguuccucaagguuggcccgcugcuacauuaugcuagccuuccuuuguguucaugcaaaugcaguuuuccuucugaaaucauaaaaugacugcaagguuguuuucuuaaauuguuuuuauuauauuuguuuaauccugcaugcuuguugcaugcgugcacacacauaccauaaugcaugugugguggaggucaggggacagcuugccagaguugauucuuuccuuuuaaccugcuccagguuauugcacucaggcuguguggcaagugucucuacccacugagccaucucaacugccgcacaacauuuguuuucuagaaaacauguuuacuuguaauaaaaugcauguuguggcccacccuugguguguguauguguguagguguggguguuaaauagggaccaaaauauucugcuaaguaugucuguuugggcaaacaucuuacagugguaguuuaaauaguaucagauaccauuucguuucuuaagauuaaaaguaucagguggcauaccuuguauucguuuugugacuguggcuuccuuuugggaauuuagacccuaugcuuugcuaaauagccacaccaaaucccauuaaaauguuuauaauaaaauuggugugauagcaucuuuagaagccccaggaugaaugcagaggaaaacaaucaaaaccccucauuuauccauuuuuuuuuguaguuaaaaaaaaguugacguaaaagcagcucagugcugaucaguuguagaacggacacaguguuuagcagaugaucacuggguagugugaguagauugacaucagaauagauuuccccccucagaucugucacauagcuguaagagauccagggaagguuagaguaaauggugcagccuagcuuguuaccugccacgagaagacucuaagugccccucaccuuuaaagacuggcaucagaguagugcagaaugugcacaacagcuugggaagagaggcucucagaaacgugcagagagaacagagccagcagcgucucagaagacaagcugugcauuuuucaaacauugaaugaaaauaauaaaagagacuuuaugaagcuagggaaguuaucugauaaaucaauacuccaaauucuugaauagucaguuucuaagagaucuucuaggaguacguuugagaguauaccaguuuugaguucauccacacaauuaggauuuguuggacauuaacugucacaauccauuaagcuaguguuugagacacauuacccuauauugagaauagacauaguuucacauagucuucuaaagauuuuaaauucucccuuucaaguuuaacuuuaaaucugucugaaauugacuguaugaguuaggaauucaguaucuucuccccccagucagcuccgcuguaacuaaccacaaccugccuucugucugucagaagugauguuguuugugguuacucugauaacuuuguccaugccuguaaaugauguucuguuuucaaguugucauauuuauguuugguauuuaugcuauuaaccuuggucucagucuuaacuuugauaauucacucugugacacauuuugaauauuuuaaaagacuccuccaacuuaaaaaaaaauccaaguuaaugaguggaauuggucugacucuggguuggagagagugauccuuucacaauuuucuuccuaucugggaauucuuuauuuuucucaaauucuuacuuuuuaaacaaaacuuuaaauucacucauauuuacacuuaaauacuuugauuucugguuguaaaugguauagcaaaagagucuauuguauagauguuacuauuaaucagaauagccgauuuuuuaaaauuagguuuuauauccaucacgguugcaaaacuuuuauucuuaaaauuuaucaguaguuuuguguuuucauagaagugucauuuggaaaugaugguuucauuuugugacuagcauugugaauugcccgguucuucugauaacucacugagagcgguuguugggaaguagucuuucucuguuuguugcuuaccuuaaggggggcuuuagguggucaccauuuugaggaugcuggugugguguuuuauagagacauauauugauguggcagagaauuguugcaaggguauuucauugguuuccccugcuuccugcccaccuggacaguuauugaucauaaguugucucuguuguuugugagacagcuuaucacuaucuagcccuguuggccucggguaagcaucaggcuucccucguuaccuuccuuccaguuuuccugcagucccuuuguugcuaggacguacguauaguuaguaugaugccaguuacugguuuauaaguucaaaauguuuugggguucucuauuuuucuauuucccuuccauguucagcaguccauuaauuuuggaaauguuaauuuuuacuguuuugcucauguauuccgaucugagaaugcuacugacacgagguugaaacccuaaauaaguaguggaguguggccagguguuguuaagagcucagugccugcugggcugacgcacacacacacaugcuuguugucugggguugacuacaagcucacgguuaaguaacuaccuugcccuugcaucucuguuacauacuuucauuauuuauugcuugagggggagaauuuuggguuuuugcuuuuccauauccauaauuugauacuuuggcuucuuucuuuuuccucuauuuucuaccuuucuugucuauucuuuuuccuuuucucuuuauucucccccauuucuuucacuuuacccuucucauguuuuguuugggguauccuuuucuuacuuuuacuuagaugcauuucuggugaugaugaaauauguuaggguucauccugugugugaaaaucuauuuuacucucauuuaaaaaauauuuuugcucaguaagaaauugaaaauugguaguuucucuuuuagcaucuuagaaauaggaugccagccaggcaugguagcacagaccuguaauuccagugcuugggacugaaccagguagauggagaguguuagguguaccugugcuguacgaccugaucaauucgccaaccaaacaacauuuaaaaauggcacuccacuaucuucugacuuauuucuagugaaaaaaaagugguugguguauaucuuucucucuuuggauacuauuaaggauuaaggacauuguuuguuuuauuauauuuaauguaugguuuugguucugacauaauucaugacuccagugcuugggauuuuuguuuguuuguuucuuucuuuggguuuuguuauguuuguuuguuuguuuguuuguucauuuugguccucccucaaauguucuuuauacucuguucuauggaacucaauuacuuacaugcagaguugaccugaaagucucccuccauuucccaacuuaguacucuucucccuugccuuuucucgagacaggguuucucuguauaucccuggcuguccuggaacucacuuuguagaucagacuguccucgaacucagaaauccuccugccuccugccuccugccuccuccugccuccuccugcugccccccgcugcccccugcccccugccuccugagugauuaaaggcgugcgccaccacgccaacuuugccuguuuucuuaagugagucuuugagcccugcauuuucaugcucugacuuagcaugcugguuagucuucuguugucacuguccacuaauucugccaucugucucauuggagucaauagaacauuucuguugauuuuuggagauuucccugcauguucuccacucugacugacuucacugcugcuuggcaugguugugcgccccccccaccccuccauagcuuuguuuuguugucuuauauauuuuuuaguauuuguguuaaaauucuugagguuuacuggggaugggguuauauuauccuugugagaccuuucucuugucucugucucuaccuuuuuaaaaaccauucaagagaaacaauagauuuuagguagggcugguuuucuucaacuacaaagcuaguauuuuuccuugaguuaguguuuccugcucuggcuucugggaacauaagugacauuuacuccaguggcagguagccguaggaucgcuuucucuuucuuucacgugguucucucccuaccuuuuauggcuuguuuccaugcuugcugaucuugacugcauugaagacuuaugggaaccgucuccaguuuuccugagcuguuucucugugcaacucauccugucuagcucuuuagccugcuuucuuugauggcuuagacuacccugacugagcucuaaucuucugauuugggaacucuacccaccaggcucccuccucaugagagccugaaagcucauugagucagcuaggaagguugguuguugccccaugccugagaacuauugcuagaauauuuucucuacuuuuuuuuuuaaagcgagagacgggccuugaccuaccaauauucuugucucuguauuuuauccauuuuaaaacuguuugugagaagaaauuuuuccuuuuaguccauccuagcuggacuggaaguuugaauauuucauucuuugacaugacaaauucguugagaagcuaaaugaaucauucugaauaguaggaauaagauuuuguguuaaugcuuuugauucagaugcuuucuguuguaaaagacaacauauaauaugcaauucaaaauugucacaccagaucugaacacuuaaaaauaccuuuuggaaagaaacauacuacagauugacaaauaaaauccaaguugucauguccugaucuauuuaaccuaaagcaaaaaaccagaccauuuucuuugaauuuucccauucuauauacucuaguauauauaauaggcucauaaacaguugucauuugcucuccuggcugaaguuaacaguguuucuuaauuuuuaauugauuuagucuugcauauauuacauugggaccacaguuucuuuuccuuccugaaguucuacuuuuuaauaaaaaucagauuuuuuuuuucaaggaaaaacuguaaaggccauauuucagacaagaaguacuaagguguggaguuugaaaucuuuucuguccgaugacaguccugugguaaugcuuuaaagguaugcuagguagaguaagugugccaguccucucaucucugcuggugucuguggccugccuguguggggucaucuacaauguugagauuuaagagugagagccucuaaagauacuuggcuuacuuuacaaaagcacucacuuuaacaaauguagcgagaggggugguuaguagcagggacacagcaugcauggguggacgacauccuuaguggaaaguccucugaacaccauugcuugucaccaugaugauguuauccuguaugccuuaaaugcuuugaaauucuaauucaaagguaaaagcuauaagagaaaaccuaugugagauuaagugccucuuuucccguuugucucaaauaaaauugcaguuuacucuuuaauuacaccucaagguuuguuugcuuucaguacaaaacaguaucauauacaaaugauaugcagauauauauauauauauauauauuuuuuuuaaugcugaaguaguaguuaacaguagagaaagcugguugauggaccaauuuaaucaaggucaaggcuaacaccaccuggaauaaauguuagcaucauacauuagcauauuggaaacacaagaagggcauaacacuuuugugaugaugaagcauucaaaugcauauuuuagucaaaaucaggagacauuuuccaguauauaugacauggcauugguauuaugaaagacauaaggacuagguaacacaaaauaacagcaacaauaaccaaguaaaacuuaaugaaaguagacaagugguugaacaacugaaguaggugaagcuggcucuauuugugggguucuccucuaagugucacaucuuuacacugggauguuccugugugugagcagccaaaggagagcaguguagcaggggcauaggaggaggggaggagcagcaaagggcaggcaggccacaggccaggggcccgccugccugucagcgcugcucuacugccucguauuuguaggguccucuguuuuguagaaagaaugcugaagugugguaugcaucgucuagaacuugacauugcagaugcugaauaaucauuugcuaaaugaauuuaugugaccaaauauuuagauuaauuuuaaaccaucuuuccugauugaaugaaugcuacacauuuuuaacugcacuacaccuaauccaggauucugaugcagcuaucuaccuaucuaccuaucuaucuaucuaucuaucuaucuaucuaucuaucuaucuaucuaucuaucuaaauacaagaauuuuagaauaacaugaucuucagugauagccauauuaucauuuugaauuugaaguagcacacauauaauagaaugcauuuaucucuaaaucauuuagcuucuauauuauuaaacaaauauacacaugugagugacaauguaaauuuuuacuaggaugggguauaguucagugauaaagcacuugccuagcgugugcuggguucagucucuagcacucauucccccaagugaguagauuuauuauuuaaaaaucucaucuucugucaucagauugcuuuaaaaugcuggugucaauuuacagugacuucccuacagccucugcagugcuggggcuacaggugugcaccaccucacccaccuuaauacuuaacauuuuauuauuugauuaaagugacucucugguggacagguccuuauuuguuucuuuaucaacauagaagcacuugaggaauuaauuucuucccaaagaauauaauuaaaccaaaaggucucucauuuuuaagaguucacugguucugucuguguaauccaacuuucauucuguugacugauggugcuaacgugacgagagcagagaguuaauguugaguacucaagagaacaagaguauguaaggaguggcuaggcagcauacuugaacauacucuacuagcaugauuucaugaaggccagguaagcccuauccuugcauauuuugggaaaguguucagagcuuugcccuuuuuagguuguuuuaauaaguauuuugaagcagucugaaagaugauucugggguugggaauaugaagagauaaacggagucauaauguugauacuggacauucagaucuuuauagcaugauuuccuuauuuuucaaagagcagaagaaucccaucguuuaucauguucugguuggacuccuuucuuaucguuugcuggaguuugaacuucagagcuauggugucaacccugcuguaauaucucaggggagcuccuaguguggggcuggugccauggcucacccuccaaccuuuccuucuucacuucagccuccagcucugagcuuucccauccccagaguagcaaauguugaaagaaguugcacagguaaguagaugcgggaaagcugggcucaacagugcucucuuauucauugguguuuugaggguggguggggccaucuugccagugagucauuuuguuuagaaaugguuuuuuuuuuuuuuugucuuuucuucauaaagcuaugguguaaauuauuagauaaaagucuaauguugaaaaaggaagcuaagaaaacaggaaagacaaauucacagaccacuaguuuguccuacaagucugaugccucaagugugugcugucuuuccuggggcguuaaccagguagcugugguuugacuccccacaagagaaauuccaaacaugcuuucuuugcaaucgugacaggaggccugggacauucugccauucaggguuugaaauauuaacaaaaguaaguagggugcagugcaguuacagcauggcaucuacacacaggucagcaaaugcuuuucccuguauucauauuuguucccuguaaguccuagcuugugaugugcaccuccuugagcacacagacguuugaaauuaaacccaggaaaacaaauucuuccucagaccuaggggaguugaaguauuuucuagguguuacgaucuuuaaauugcuaacuuucucaaugguuucucucuguuaaguucuaaaguuuuacuuuuucugagagccauguagggacacauaucccucagcaaagcauuagauuaguuuccucauuccuuuuaagaaaugccuuaacauucuugaaacagaacagcuuuuguugaguagaggguuugucguguauucuaaacgcagaagcuuuucugcugugaacuuguucucucauuuauauuuuauaguuuuaacucuguguuuaagauggaaguacuggcuguccuaggagguuucaaauccgcuucuuacagugcugguuacgagaugauucuuuacuggguagauggaccacaccuuuucucccauagauuaacauuauuauaugacguagagcuuugguuauagaauguauauuuaguguuuuaugauuugaauuugaaccuguauaaggcuuauugauaaguaaaaauugaagaacauguaaaaaaagaaacacaagaugaauuuauucacuuugagucaugaccaaauuuucggaggacgcauuuugguuaaugcuuucuggagcacaugcaguucucuggcagagcugguuggaaaugcuguccagaaagcgcugcagacccuagacgccaagucucagaugcagaagacugucucuuuucaccuuugcguucagacauuggacacuuuccauucguauuauuuauucaaaaauauacagacucuuucucaaacccuugggaaggacuauuaaggcacggcauguucuccgaaacacugaaucgcgaguguuugcaggcccuggguuuaaaacccuuguccaucuccugucucuucccuuguccauccuguccccugucucuucccuugucuacccugucccccgucucuucccuuguccacccuguccccugucucuucccuuguccauccucucccccaucucuucccuuguccauucuguccccugucucuucccuuguccauccuguccccugucucuucccuugucuacccuguccccugucucuucccuuguccacccuguccccugucucuucccuuguccauccuguccccugucucuucccuuguccauccuguccccugucucuucccuuguccauccuguccccugucucuucccuuguccauccuguccccugucucuucccuuguccauccuguccccugucucuucccuugucuacccuguccccugucucuucccuuguccacccuguccccugucucuucccuuguucaucuccugucucgucccuuguccauccuguccccugucucuucccuuguccauccuguccccugucucuucccuuguccauccuguccccugucucuucccuuguccauccuguccccugucucuucccuuguccauccuguccccugucucuucucuuguccauccugucuccugucucuucccuuguccaucuuguccccugugucuucccugcccgcaucagcauuuacuugcccacugucacuuacugaacagucacauugucagcuuugauuucuaggcuauucaugugcauuagaaauuagaacugauuuuuggcugaaauuugggaggggguucucagaaauuaguagaacuauuuauaauaauugagaaucaacauagcugguugaaaaucucaguuauguugcuaaguaaaaaaaucucuuagauuacaauauuacaauauugcaaccguacaauauuucacaugguuuuaaugaccuggaauuuaggcaccccugcaguaagauuuaaccugacagacuccccauggauaguuuccaaugcuaauuaauacuuccugguaaaguuggauaaauuuguuguuguuuguauaccuuuucccuacuugguagacaggagacaaccuguguguuuguggagaguauugaacugacaaagaagguuaaauucuguauuaucaauuaaaguaacuugccaacauaccccauaaaugcuaagaaaggggcagguuugccguucucuccacacccugagcacucccagugcaaauuccauaguaggaggaacacaagggugccccggaaacuguggagcaugcuggugcagaugugggcucugccuggcucugcuguuugucggaguuucugguccuugcuggcuuuuugucuguuuugagacaaagccuuucuuuguuaguuaggcaugccaaaaacucaaagccuggugcugcagaaacauccacagagcaggcucagcugccucuuguacuguuauaggauggaugauuuuaugacagcaaaaggaagccauaggagauugccuccacuuucuagaucugucuuaccuauugaucaucaggguuuggauuauuagcuucauaaugaaauuuaguguuugcuuauagucaucuuaauuucuugaaagauuaaauucaauucacucuagaaaguaauauguuaguuuauuugaaacgaagaaaauugguauacguuaauuuuuuuguauuccuuucuacuugaaguucuccuuggguaauauuuuucucacauuuuuuuuccuucacauccucucccuauccccucccucacccuccuauagucccacagugcugagaaucaacccuacaaccuagcaacagccuuagcucagugguuguuugaggauuuuuggucaaauucaggccuccuuuuucugcuuccugaagucuaugcccagcaacaguuacuuuaaauuaaugcgcugcuguuuguucaauuauuuuuaugcuaaaauuaaugugaauuucuuuaaaauagaugugauugguguuguauagauuguugucucugguguauaaucagcccaugguuuugcacaguggucucuguaguaccgugugaucauagcugccuugcuuucuuuguugcucaucgcaaaggaaggaccuuuuuuuguuguugauaauuauguugacacccuuaauauuuuaugaagaaaacacacuauaaaggauaaguuguauuuauguuugauugugggucgacuaaaugcuuaauagauuaggaucaaagccugugugugucguuaucaaaugcauacauagucuagagcagguuacuuaacuuccaguccugaguuuuucuugauaaaaaauaugggaugcuaacuguuugcuagcuuugcauuguaaugaugguacaaauaagcuuugcuuguuugcaacaggucuucacugcguagccccagcuauacagcaacuugccguauaaaccaaccaggcugcucagacuuagagcuccaacugccucugccucuaaaaugcuagggguuagauaugagcaccaccuggcuuuuccugaaucagagcugagaaaagagucauuuuacaauuaggguuauaauagauaacgugcuuucuuuuuacugauuaagaagagcagaccuuguaauuuagcauuaaaauuucaaagaagagugagugagcagugggcaagaacacuugacagccagccacguguacagaggcugggguagaaaggaauuugagcaacugaagguuugcccauaguguaauggugggagggaagacuuuuuugaagagaggucagagagauugauuacagagcuuauuuauuuguugaagaaauuugaucagauucaugaacauaaauuuucauuuaaauugcuuagauggaggaaaguagauuuaaggagaaugaagaacaaauagauaaauaccuguuuggaugcuguuggaguaccuugugcuaguagacuacagcagagagaaaacuguugacguuguagaugcuuagaguaaguaaguguuuggaguuugaguaguguagacuaguugcugagaucacagaggcaggaggaauucgugcugucguuaccuguacucugcccuguugaccuggcacuggagggccugcuuuucucacccagcacuuuccucagaaccuguucugcuugccauagagaaaggguuuuguuuggcuuggaauuuguggguuuuuuuuuugagggggggggggugcuguuuuugaguuaagcuucauguauccaaagcuggccuagaucaaucccagaacuuccugcuucugucucccacggcuuggaauucugugugcugcaacaccugcaggaaucgaaagcuguguuucccaggucucucccugcugagcuuucuccuagggguuugucucugaagcugcucuucucccacuuuacuauaauugguuaaggguuuguucaggcauugcacucauucacguuuccuuagacaggcuuaugaccuuguauuugaauuuccuaguucauucacaaaugugucuaaccagauugucagcuuguucaagacuacagcuuuuauucaagcuuugucauucgucaaguaggguuuuucagaaugcauguaguuucuugaacauuaacuaagauacauguaggaaggaaaaaagcagucaguuagaaagcccugguaccauaaaagcaagacaugcuggaugugaagagaaaauggaagaucaugaguuggugcaucaguuuuaaauuugucuccauugaugaaguuauacuuugggaauacaaaugcuagaaccuuccguuaagauuugagaaagguuuuggaaucauucuguauuuguuaccaggaaagaaucccuuaguccugagaugaucuuuucucagggaucagucacacccaguccagcauuugcguccucuggaucucagggaagaguggucccagagcucuugauggaaggcaggcuguuugcucaguauuguuauucuuuggauauagcuacaccuaggccauccuacuuuuucuauuuccagcucuugcuucugguucuauaugaagccacaaguguauuuucaaguuaaauuuacaaaguaagccgagcaaugguagcgcagaggcaggcagaucucuugaguucgaggccagccuggucuacagagugaguuccaggacagccagggcuacacagagaaacccugucucgaaaaacaacaacaacaaacaagcaaacaaacaaaaaauuuacagaguauuauaguguuauuuuccccaccauuuaaaaaccuuagagccuugccaccaccccuuuucuccaucauagucuuccuuagauaauguugucucugaaauuguugguuagauuaucuaaacuugaagaguuuucaaaaaaauuuuauaauuaugcagacuuacugaggcuggcuuugaauuagugcauguaaaauacuaagaauaccacaggaagggauuugagagauggcucagagguuaagagcacugacugcucaugcagaagucccaaguucaauucccaucaaccacauggugacucucaaacauuuauaauaggaucugaugcccucuucugguaugucugaagacagcuacacucuacucuuauaaauaaaauaaaucuaaaaaaaaaaaaaaaaaaaagacuaucccaggaaugugaauuggguacugugcccuccuaaguaauagcauaguacaguuggacauccacgccagcuuagcgccuccauucugccccagcguaguucucuguacuuucugagacaaagaauucuuuuugaagaaugagcuugguagagaaaauuuaguauaagcuaaccuaucugugugcuuuuaaaaauauauaacuuauuaagucaaaggaaugaugaaaauguuuugauucaaugucucccauaugaggaauauuacauuuugguauauaacaucauuccuaggggaauguuugugcauuuuauaaucuggucugagauucaagaagucagucaguuuguaguguaaguccuugaucaaagaauguagcaauccuuguuucugauauaaagaggaaauguuacuuaauuuaaacuauuuuuuuuuaaaaauacuuacaaaauuuacuuuuuauuuauacaguauagugaggcguuucauuauaacauugacacacacacuuuuucauugacagagugugguuucuagauuccccuuauucucugcagaaaaaaauauuuuucuuuuuaauguuacacguauccacuuauccuuaucugcucuucuucagaguauucagucaucuuuuaucccaucaucucucaccacaucugccuccuuuguagccuuaaccaucguccugcaucaccacuuuccuaacuccuccuccccuuccauccucacacaguccauuuucacacacaacucaggaucaguuguaaacauaugguaaguuauaucacucuucugagccucuucagauaccagaacucuugauuuuuccaucucacauagauaaaauagaaagucugcaggcuuccagcguucuauuugcuauauaguggcuuacugguggauuacuuaaauuccacacaguauggaaugcagccuauaauacaucagucauaccccagagggauuugucucuguauugagggcucuuucuauaagcauugcccuguggcuuuuuauuuucccuccuuuuuuuuuucuuuccauuuuuacuaugcuuacucauuguaaaaaaacauuuugcuauccuggucccucauguguagaaugaaggcccaccuguucuuuaaaauaaaucuagcuuuaagaaaaauaauaccccguccccuuuguauucugccauggaugagaagcucgucaucccugagccuaacucucggcaggguucagcggugauuguuguuaguuugcuguuagugaagucccgucagcggucagucuucucggugacaugugcuuuucccuucucuucucccucugccccacuugucucccuuuauacccgaccccuguacucaguugagaaaaggcagaauugguaggaaauaugcauuccugcauuuuaugggagacauuuuauuuucaugguauuagggugauuuauucuauauaauuucaguuuuggaauuuuaggaauuccaggaauuuuaggaauuuagaacuggccuuaaugauauuauguaaaacauuucacaacaaaguugaccguguauuauuuuaauucauucaugaguauaaguuuaaccuggauguugagcuaugugugcuacaugcuguuacccauguuuacucuuucucagaaguagagcucauuagcaaagguccuguaaagacaguuuuaaguagauuuguaauguuugcaaagcaaauuaaaauaacauauuuacuggaucuaaauuuuuuguaacuguuuauuuuuugaaauuaaacccaggaaaggauguuuuugccuccguauaagaaaaagcaccuagaagucuuauuuaggguuuuacugcuguaaacagacaccaugaucaaggcaacucuuauaaggacagcauuuaauugggacugccuuacagggucagagagucaguccauuaucaaggugggaagcauggcagcauccaggcaggcauggugcagacggagcugagaguucuacaucuccaucugaagccugcuagcagaauacuggcuuccaggcagcuaggacaaggguauugaagcccaggcccacagugacacaccuacuccaaggccacaccuaauagugccacucccucaggcaagcauaggcaaagcaucacaagcauguauggcccuucucugaaaauauguaguuuuuguuugaagagaauaaccuuagcuauagugagugacuaagacauuaaauuugauuugaguguacuuagaaaauauacuuaggggcuggagagauggcucagugguuaagagugguuaagacugcucuuccgaagguccuaaguucaaaucccagcaaccacaugguggcucacaacccuucguaaugagaucugacgcccucuucuggugcaucugaagacagcuacaguguacuuagauauaauaauaaauaaaucuuaaaacaaaaaaaauauauaguuacguuauucaagucucugaacuugaguauaugguaggaguuagaagacauccugaccuaaauuuccucauguggcuagacuaagugacaccuucuuguaaucccagagcucugaggugaggagauugggaauuggagaccagucuggguuguauacugagagcuuagauagaaacaaaacauaaacagaaagccuauauagaaacaauacugaaacagaaagcucauguuggccggcugauaguuuuggaaacuuaaaaaaauugcauagauuuuauagauuuugguauaagcuuauaauuguuaaaguuuuaauaaagacauuagaagcaaaagaauaagcaguaaacaaaacauaaauuuauaccaauaugauaaguuuguuuuguuguaugucuagguaguugugacuugacauaaauuccagaaugccuucccauggugguuaaaaaaugcugcacccccuuaagcccucacacucuucaacguucuaaaguagacauaguauugacacacaguuucauaugugaagacuuggaaauuuuaaaagaaaaaaacccuguguuuggaaaaauuguauuuggagcuauaauuauucaucaauaaguaauuugguuguauguggggccgugaaaauauaccauauagucagauuuguaucuuuaucugagucccaucacccuuaguuaaucuguuucaggaucguagcaguacguacucauuuuguuucuguagggguaaaguaaagccagacuuccaaaauacuacucuugauaaaaguaauauuuuugucuaggugacaaacagcauguuuggugcuucaagaaagaaguuuguagaggggguggacagcgacuaccaugaugagaacauguacuacagccagucuucuauguucccacaucggucagagaaagauguaaguuacgcugucuuuccucagcagcgcugcuguguucccugaaggaggagcgugugagcuccaggggauugucugugcuaagcauagguguagguccuggggacaaacagauaaaccuugcuuugccauggggaccauuaguauccugggcuucuuaaacaguaguaaugcuguuauaggaaguacucacggacaugcgcuaaagacuguaacuuugggguaaucugggauuuuuguuucaugauaaguauuuuuuuuauaauaaagcaaguguacuuacaaaguuaagcgagcacauuuguacgucuuggcuguaauucuugcuugcaaguuaagaauauccuucuccacagcuacagagaccacagucaaaagucuuugguacuguguagauucuacagcauagguaugcuuuggaagaguaguggaucaauaauuccuuccacaugaaagguuauuaaguuuauaggcuauuuuaaaaugaaugaacuuaagucauuucacucuaguuuaucccuucauaaagccaguucuauccugagcuguguaucugcccgacugcucuuuuccuucccgugcuuuauacauuugcuauuuccuaauuucuuuagcaguguucucaguucuguuuuaaauguuuaaaauagugacaaauguccuuuuuaaauuaaagcuaauuauuacuaauucacucaccauuuuucagaaggucaaccuaacuuaacauuaggaaccuaucccauuuccucaggcccagccuuucuucauuauuguuauuugaaaaauuuguuguuuuagaaaugaauaaucaauacuguauuuuccuuccaaauuuugugugcauuggcauuguuuauccuuagugugccuuuuaauaccguauggaguagugccaccuaguuuuauaauguuucuugacuaucacgcuauuucuauuugcugugcauuauauugaaguauuauuuacaugugucugauuuaagaguugauucugaagauuaaaaaguuaggaguauaguugggugguagagcaaguucuuaguaugagcaaagccuuuggcucaauuucuaguguugcaaaaaugguuggguguaauauuugauaguuuuauugcagaaauuauaauuuugugcacuuuacuguggauauguaauaaaagcaacauuuucuagaaaaguguaauggauaugcugauggaaggauguaauuaagaacauaugaagauucaaacugaaauucagaauucagcuuauguagacaaugaauaacaaaaaaaugucucugagggcuagagagaugucucagcaaugaagaucacuggcugcucuuuugagagggcccagcuucuauuccugacacucacauggcaauucacaacaaucuauaauuccuguuucaggaaauccaaugccuuccuuugcucuccuuggcacuucauaccugugguacauagacacacacucaggcaaaauaccuauauucauaaaaauaaauacuuagaaaauaaaacgugucugccuuccaggacuacugugaucuuaaaaucagagucagcauauccacuuuacccagaggcucacauauauuaacacuauuccaacaguugauugucacagaaaugauaauauuuuccuucaggaaauaauagggcuaauuaagaaguaguauaguaggcagaugaagaaugaacucaaaagcuuguuuacuuuacaaagugcuuguauucugacuuugccuguaagcaagauuaucucaaaacuuuuguuucuuugcauggaaaauuguugcuauugcuauuaccuuuuucuuaucacaaacauacaggcugacuguaacuuuuaaaaguauaaauauauagaucaaaagaucucaaaucuaguuaggacuacuucacuguuagaauuauaauuuuauacuucagauauuuucaucagaauucuuacagugaaaauuccuggaacauggugacgucuuucaccagaauguguguaauaacuuuuacucucaucagcauuugcauccuccaugucuuuaagaguaccagcccauaaaucuuggcauauagaccaaaguaguuuauuguuuugauguguaaguuuccuuuuucauugcuguuacagaauaccaaagagaauuaaccuaaggaagagaggauuuauucugacucaacaauugugggagaugacucugucaugucagggaagguauagcaucaggagccaguggugugaggguagagguuggcagcugaucccagcacauucacaaucaggaagcagagcgugaacaacagaaaguggcuauaaaaccucaagauucacuuguagaaaggcuccacucugaggguucuccgaccuuuccaaacagugccauccguugaggaccaagugcucaaacacaugagcccauggcagacaguucacuuucagugugucaaaacaaugugcguguaucaaaguucucuaaauguaaaguacagauguaauacacauugagcaaacggucagugaccacacgcauuugcugccucgcuagugucugugccucccugugcuucucuggugucugugccucccugugcuucucuugugacugugccucccugugcuucucuugugacugugccucccugugcuucucuugugacugugccucccugugcuucucugugucugugccucccugugcuucucugugucugugccucccugugcuucucugugucugugccucccugugcuucucugugucugugccucccugugcuucucugugucugugccucccugugcuucucugugucugugccucccugugcuucucugugucugugccucccugugcuucucugugucugugccucccugugcuucucugugucugugccucccugugcuucucgugugacugugccuccuuguauuucucucauaucugugccuccuugugcuucucuugguaggaucuuggccucuucuuuuauugcaaguaguuuuugcaaauucuccucuuuaguuuauucuuuuuauauuacauaguuauuaaucauuuuauuaaaaugauccuuccucuuuaaaauaucauuaugguuaauaacaaaacauaaaaguuauagauauuaagggaguaccaugugauguuuuaauaugucuacauuuuguaaugguuaaaucagcuuaaaucauuucugcaguuuucauuauuuugaggcuuucuguuuguuuccaugugugcggacuauugaacacggggcccggagaguacuagacaaguccucugccacugagcagcaucucuagccaagggauuuuugaaaacuguuuucugguuuagagaauccuaggacuucccuguagccaggcuuuuacuaguuuauggguucuucuuccacuuccacccuuuuuccauccuuucaacccucuaacgcuagauaagagaaaaaacggauagaaagaaaacggggcuaugucaucuuuagaaauccuuccugcugaguagggccuccaaguuccuuggggcuuguuugaucucugccaucaagguaucugauuucuuccuauuuuucugaacaugacuacuuaaacugugaccaacagugacuaaccaagaacagucaacaacccccaccccuuuuguggcccuagcguuuauaugcccucugaaaaguccccagaauuccaaaugucacacagucgcauuaucaucccugcuagagcacgagacaugguagauaguuagcuguuguggacaauauuugaagcagccccauaucccacaccuagcauuaaaaugaagacauauucuuauaacauuucucuguuuuuuuaagauuuucagaauucuuacuauauuuuccuguuuuacuucauaaccugauucauaacuguuagaaauguacccugauuuaaggugugagcagugagguggcaggcagguccuugucuuuuguggugcuauccaguugucuuuauaccuuuuagauuucacauuguggaccagagaacuuuuuucuuuaaaagccagguaguaacucuuguaggcugagaggcagaaugaaggaugcuacagagcuauaauguuaaaaaacaaagcccaaaacaaacccacucuuaguuaugcaaccuacauaacaagcagugugcuagguuuugaucauagagaguaaguugcuuaucuuugacaguauuuacugaaugacggagugaaacgguccccuuuaguauaucaauguuccugaugcucuugggcauguuuuaaaaucaugcugagucuguaucuagacuacauuagauugaauuguuuuggcucuauagaccauuuuuaaaacguggauaaagucaccuauauuucuuuauaugaagauuuaugucauuagugcacaucaguacuaauuucaauaccaauacugacuuccuuucagaaggaucuuucuugaccaggaguguagcucaguagcagaauauguugcucuuuucauuccagucuuaaggagggcuugugugugugugugcagggucaggggagucuuccuggugggauugaauuuauguguuuacuugugggggucagaggucaaccccaguucuuccuggggagccaucuccuuguuuucugagaccugggcauacagugcaggguaggcagauuggccagcagucacuguguucuacuacccaucacacacucugacaacagugccccccccccccaugccuuucucuucaugugcuugcuagcaucuuugugcagcaagugcuuuaccaccggacugucucugacaucaagucaggcuuuaccacugauguuuucaugcaguguugaauugcucuuugcuguuauauauauugugaauuuuuguauagucaccugcuuuuugcaaaauguuuuuaauugcuuuggugacugaauaugggcuguagaaacccuaauauauuagaguuacauuucagcugcaugauuuacaagcagaguaagcaguuuguauguauauaccucaacuggaacauaggaaaaguagaauauaacuagcucgugguaguguaaagauugaauggauaauuauuaaacauuuaaagaaaaauaacaaguguucuucaggugcucuuaauaugacuauuaguauuaccccacuugguucucuggauuuucagauaauuauguauauccuugcaauuagugacuauuuuguguuauuuguggaaaauuuucagauauaaaaauuaaugagaacauaacaauaaaugaacauaauuuaauuuuuaauaacaauuuguaauagcaaaaaucuggcuggugcuugagugaacguuggcgucagugcagucucccuuaaugacgcuuuuggaggaaaugaugcaacuuugaauuaucucucuacgcagaauuccuuaagccucuaugaugucuacagaaacaauuacaguuauuuuaaauauuaaucuuagacugucgcuuuaaaaagauuaaaaguuuuuuuuuuaauuccaaauuuugguggcgcacaccuuuaaucccagcacuggggaggcagcuagacuacaccuugucugaaauaauuaauuaaacgaaaauuuuucugcuuauucuauucauagagcacaaauauaguaucuccaucugcauaauuuuaaaaguaucuuuauuaacccuuugcuggucaaauuacaagccgguucuuuugaauguccucuuucuaggccuuugauuuuuuuuuuuuuuuuaaagcaugaccuguaagauauaugugauuuccaauagaaugaugaauuugcuauuauaauaccacaucugugguauuguaauagcagugaguagaguuugcuguguacuuaaucccauaaaccauuaugaacucacaccuagcccucagagcacauuagccuacagccuuuacagauaguaauacuuguuuccaugccaguaagaauaguuugucacagucgaguauaaaguaaggauaucucuugugacugucacucucaugauuaguauuaacuacauacaggaguuagaauauuugaaucucugauuauuucuuccccucccucucuccucuugccccauucccuuccccucucuacccuccacucucacuuuuagaacuuucauugaguuuuauauuuaaauacauuaugugagaaggcuccccuuugaucacugucucauacguuaauuuacacugccggcauuguucccauugucuucugaauucucuggguuucuaaacuccauaguacuuggauuauggaaaugauuuagcugguaaaagugccugcugccagugggccugagcaccugaguuuggacccacagaauagagagagccgaucccccacaaauuguugccagacuuccauuugggugcugugggguauguauagccacacauguacacauauguacauaaaauaaauaauaaagaugaaauuguaaacaacuuuauuaaggauaaaugcauaacauguaucauugccugaaauaccugguuauuuuauuuuauuuuuuuaagaauaaugccccaugauuuuguucuauuuauuuauuuauuuauuuauuuauuuauuuuuaaagauuuauuauuuauuauguguaaguacacuguagcugucuucauaugcuccagaagagggcgucagaucucauuucggguggcugugggccacaaugugguugcugggaucugaacucaggaccucuggaagagcagucggugcucauaacugcugagccaucucuccagccccugguuauuauuuaauccacuagaauuuaagcuuauuagcggcaaggauuuuugucuauauaguuagacacaugcuuuuagaaucuauaguaguuaguaaauaauacauugcuuucauugaagaaaaugggaauagauacuguugaaaauuauuggaagauagaauguuaaaaaucuuuaaaaucaucuuauaaacuuuaauagagaauauggucuggguguuuaugucaggguuuuuuuguuuuuguuuuuuguuuuuuuuuugcuuguuugguuuaaaagacagggucauugugugccucagacuagcuugggacacacuauauaagaauaacaagauuaaagaacaaguaguuucuagaauuuauuagcaauccuaucuucaaacaguauuuuaaaguuaaaauguaaaauggagagaaaaugauaggucuaugaagcauccaguuucacuaucuagagaaaauuauaaaauauuuaaucaucaauuaguauuaaguauuucucaauccaaaacaauacaagaaguacuaaguccccaaaugcccaguucuaaaacuuauaacacaucaugacugugauaaaaaauuuuucaguuauucgaauuuuggguuguuucuguugagaaggacacuuggauuuggaguauugaauuaccgaaagaugguuaauccguaauagcaaaguuuuguguguguguaugugcauaugcaugugugugggggggguuggaaguaugauauaaauuggcaaacaguauuuugagagaaaauuugagugacuguguggaaguguccuugccacagacuugauaugagugcauaugaggaaccuuuugauuguagaacccaguccugugucuuccuauaaauguauacuuuagcacuagcggggaaggaacucgauagcaucauauauagaaacuuccacugacauccuuuuuucuuuuuaguaagaacaauuuaauaaucuuaguugucguugagaaauucauuauuuuaccguuuuuaaacauguaagcgcuuacuuuacugucucugauucaaaauugucagcuuuucuaacuuauuaaccauuuuauuucuguguuuucugucccccucccuuccucuugcuuauuuuaguguaauaccucuuccuuguucuuuggcuucuguuuauuagauuuauuugguuuuauuuuuuuaaaccauugcuuuuuaauuuaaauuuuuucuuuuagauuuuuaugcuuguguguuugugcacagauguaugaguaugcuuuuuuggucucauuuuuuuguguagauaagauagagucaaaagcugauaauuuuuuuuuucuugaaauaagaggaacucucaccaucccuuuaaguaaauuagaucagacuuaauuuuaauuuuuuuaauauuuguuagagaaguuuuaucuuaaaauuuuuaauuccaucaccaaacuguguucagugguuuguauguuaaguacuuuuaagcuagcguucugaagccuccaucauaggaaacggugaaagaaaaccaugaguuugaggucagccugcauugcaaggugguguccugacucauaaacaacagccaagguuguagucugaugugcuguugggaaaggggaaaaauaaccggggccacauucuuuucgcugcugcuuuaaguuuucauuguguuguuugacugcacaauauaguccuugagagauguagacacugcauaguauaauuuuaaacugggaacaugauagucugcgugauaguuucaucauucuguagguaauguaacacuaucuuuucccaccuuuuacuguuuuggagaugguaaagcgggggugucuucuuacacugcauucuccacuguaauggcuuucuuggucuuaaguaagauuuuauguucuucggagaaacugguuuuucugauuaacuuuuaccauuucaauacguaacuuucuugaggucuuuuaauaguugauauuuugccaggauucguuucuaauuuucauuaagcuguuguguucgugagaagcacuguuuaaugacuucuguaguaucggugcagaaggugggauuuacugucaugcagugugguugaguguucgccccacagcguccucugcuuuauacugugucucacagguccccagggcucacgcucagcauacacgccauuuacuuauuuauuucuagccuuugugagaaaguacacuaaggugucuguuccuuggcauuaaguauucaguaaguauacauuauaagauguccaugugaagauuuuuauucauaguaaguuauguguuuauauuggccaaugucuuacaugugaaaccucugaaagugccucuuuguuuuauagcuagucauggcaacauucacgauucuuaaccauuguacauagaccuucugucacuagcuacaggguuauuaaaaauguacgucauucauuaacauguggauaaaauauuuauaguuaauaugguaacaguagugccuauugccuaaacagaagaauuuggucauguuuuaaccuauuugacugauuaaagguuauguaguuuaagugcuaauauaauugucuaggauacacacccuggauguaagaaggaauuuuuguuugacauuaaagaagacccuuugggaucuucuccccaacauucuuuuauuucccguuuucauauccuccucucccuccgcgucaacuguuaucucgcagcacuguuucuuaccgugcgcuuugauuauggaauuaacaugacaauuagcuguguacuguuggccuucaucaaguguuaccccuacagaaauugacuaaucaaucaaucaaucccuucaucucugggcagaggggucauuuccagugaugcugcacuucugcuauagcacuugcaguguaauuacauaauguugccucuuuccccacuagauuauaaaccucuugauaucauggcccauguuuugcuuuaaaaaaaaaaaauguuuggaugguuguauaagauggaauaaugaggaacugcuuauauguccucauguauucagcuuaaauaucuguuuauaaauggcacgccugcaucucugucuauaaagaaauacaaaaagaaacagcuuuuuuuuuuuuuuuuuggugaauguaccacagcauugaagaauuuauauucuaccaggcgaguaaguucuuguagcuugaaggcaucguacagcaaguacugacugagaaacucugugcaucagaugacacaucuggggguuauuuguauuuuuacuucuuuauuuugcucugcugaugguuuuucucaacuuacauagcuguaugaauauaaaaaucaacaaguauuuuuacauuauuuuacaacagguugaacuuagaauuuguuuaaauguguagacuaacaucagugucacacauaaauuaagcuaacaaggaguuuagcuuuguaauuuuuuuuuuuuaguagcgucauuuuucuuuuauaagugaaguaauaguguuguuauacuuuaguguaacuuaaaaacccucauaguauuaaguauuucuauuugaacaauuugguuuccucugguugugguagucuuuguaagaaauguuuauguuugacaaacaaggacuuggguugggucuuacauuuaugguaugaaguauagacuuguaagauguucuauaauauucugucuuccuuuaugcucuaauaucauuaauuuguuucuagaugcuggcaucgccaucuacgucaggucagcugucucaauuuggggcaaguuuauacgggcaacaaaguaagaauuuuguacuuauucugggauacuuuauauuuaaggaaaagaggaggauuaauuucuaccuuuguggguuuacagaaggucuuaacagaagauaguuaauuuucaaaauuauauuuuacuuguauagaaaaccucauuauguaaggacuuacuaauucucaauuuguuauuucuugauuauagcauauguuacaauuuauuuugacauuauguauaccuguacauucuuucacaguuccucagaaauuugcuaaacaauuaaaaguagccauucuugugcuuuuaauaagaggaagucaaagauuuuuuuuccuuuuguugguuucauauauuguuuagaacuucaccuguuuauuacuguaagcccauaguuuggcagcaguuugugaaauagcuuuuaugugguagaaauauauuuauuuauuuugcuuugguuuguucugauuauaacaccuaaauuuuuacucauaguucaauuuuuuucuuuacguaagauuuuguuuuauaaaguauuauacuuuuaaagcgcuuagcacagugccuggcgcauaguaagcgcucaauaaauguuagcucuacgucaucacauaaaauuuuauaaaauuaaauuauaaacuuuuuuauuuuuuucaaauuaaguuaccaaaauguuacauauuaauaagauuuuaucaucuuuuuuaguguaaaacaaucugcuuaguucucauuacuguuguuaauggcggcugggauaaaguguucuaauuuaccaucaaauaguagaggauaguaucuaaucacuuuaucaguuucaaguaaaaaucaguuuaguuuggaacuugcccugugugaagagaaccagguuuuuguaagugccagacuaguguguccuaccacucuacccugugcacugaccucaggguuugggcaguggguggggaauccuuauuuuguauaggaaaguguuguuuuccucuuuauuuuccccuugucucuuuuaugguuuucaucuuugcuacaagauaguuuucuaaugcagaauugguaaauauuaauuucauauuuaaacaagaacaucuuuuaaaggguuuuuguuaaaaguugaguuccuuauuuaucuacaaauguuuuuuucuaccugcuuaggcaacauuaaagccuucuauuauuaaguucuucuuaucuucuguauggugugacuuuuaccccuuugggaagccuucuuauacaaauccuuagcuguuuaaagcucucuucuauuucaguacagcaucugcauuagccuguuuucuuuuuaaaguccacaguuuaucauaguagaacgaagaucuaaaauggauaaaacauacauuugaaaaagugggguuguuuuguaacagugauuguaaccgcugucuagaccuugaaguuuuuaagcugcagauaugauaugcuuugggggauggaucugucuggaggauagugacggccuuggcauggcggacguggacugacggcuaacuguaguuugcuuuguuugaugugggaaugcauacaaaaauugaugagugagcaaauuauuuuucuuagaaaaaauaucuuaaagauacuaacuaguuuuaaaagaagccauuuauaccaaacauuuuuguuguugagacuugggaguuucacguguauguuaaaaugugaggggcuaacuuuagugagugauagaaagacuuaacaaaggacuggauuggagauacuauucuuauggcaauugauuauaacucgacagaagauuaguagaacuuaaaaguacuuuuucaccucaguuuacugaugguaacucuguauuuauguuuuacaaauucguuagugauuuacgcuauucaaauguaugcucuaucuggauuuuuauuaucguuuuuuguuugucuuuguggguuuuuuuuuuuuuuuuuuuuuuuugcaacauagucuuauuacacacauucuagccaaucaauaguauaacaaguaaugaaguuccuguuuuucucagugcugacuuguaaugggcggagacaauaaacugugccuucagugugcuaggauuaguguggcuuguuuuuaaauuugggugcuguauauugagcccagccaggccuugcacaugcuaggcaaagcacuuuaacacuuaccuguauacccccaacuuuuugcuuauucuugauuuuuuuuuuuuuuuuaaguuaagaauaaaggaaguaaagaaagaaagauauccuucccagaacuacgacuuugugaaauuaaacagcacgggggcguccuggaauggauauaggaguacuugaaccuacauuuugccagauugggguagaagugauuaugcagucaguguacgagguauccagaaaauacugaauuagagaauuguaugauuucaggccccuagaguaauauaauuguaucacaauuguaaacaugagauccacagaaacccaaggguuuguguggauacugcucagcaguugauaacagccaggaggcauacuguauucaaguugcaugauguuuucuaagugugcuaguaagauuugagucagucuuacagccuuacauauuccugggcccuaaaauuacuggauugaaauagauaaauuuccaggaauccauuucuccuagaucuucauugcauugaaaugaaguagcuguauaguuggaauagucuuuucuuacucggcuaaguauuuacaaucuuggaagugggauaaggaaaaguuuaucuagugucuccuagugugugucuuauauguaggcaguuaguuaaccagcugucucgaugaaccauagacauuugugucuggauucucaaaggccccaggcuacuuggaaacagaaauaagucuuccuaggauuuagaguccugacucguguguggugguauaguaccuaguucuaacugauagacaucugagauugcaauugacuuuguagagcaagagagcauaacugacacgauuuaaaagugaagauccugacguugggaugcccaggcaaaguaacuucuaguugcuuuaggaauugagucuggcgugcuuguuguaugcacuggagagauguauguggauaggaccauucuccuugaugcugugagcuuacuaucuaguaaacacacugcuguuuuuuauugugugucuugauugucuuugugccauuaggacuuuguuuaugagaagcacuuaguagauauuugcuguuauauaaugaagaagauaaguuucucgaacauacuguugguauaugcccuuagauaguuuaaugaugaaacaauuuagggaaugaggaacuuucugguuaucaauuaguuucagcuauuaguaaaguauaaucuuuccuuucauguggauuagagaucaaagagaucauuaagcuuuccuguauaaacuuucuguggaaacucaguuaauuaaacugccucauuuuucuuugacauuaagaucauuuguuggguccuucaacugucaugugcacauuaaaaaugagggggaagcugguauuccaguauuuacuguguguuaaucuucacaacuccaugaaauguuaaggaacuuguaaggucuuguagauggcaagugauggagccaggauuaaguuccuuuguaagaguagugcucugaaucuaacacagugugugaaacccaagagcugaagucaugauccuagugauaguguugccucugcagaucccaagaagcuacugaagguguugugacauuuaugcacucaucauguauuauugaugagggcugcccugaauaacguucuguaccaagacccaaucaauaguauaacaaguaaugaaguuccuguuuuucucagugcugacuuguaaugggcggagacaauaaacacaaccgaggaaacccugcaguucuuguaacaaguaggacaaagccucccagucaggcucaugagaugugugaggaggucaggguuacgugaaucagcaaaaagccucucugucuuaggaauuaagaguuaguguggaacgugaguacugagaauagaaugauaguucccggaaugaguggucgugacugagccuuuugaguauaggaaagcuagggcgcucuaguaagucacuuccugacaaaggagcagucaacaaguccauguaaugaacgagaggacaucagugaauuauccaagggauaucucagaucauaggaagccuuguaaacaucugcuaaagaauucagacugggcuggagagauggcucagagauuaagaucacuuggcugcucuuucagagcccuccaggaucuguucccugcacccacauggcagauuacaaccaucagugacugaggggccagaggauauaacauugucucuggcuuccucaagaacuucuauuuacacgcgucauaaacagacaugaacaggcaaaacaucuuaacacaugaaaaaauaaaggaagaauccggcccauguucuggcccuauguaaggugccagccugaugacccaagcuccaccuuagagcucacgcacagagcaguccuaccguuguccugugaccucugcauacacacaaaggaaaugcauaaauguaaaagaaaagaguaauuugaauacguucugauugcuguuguacaugaauagcaaagguuuuugaugccacuuccucuuuaaccaucacuuugcuuuguagaaagcgggcugaauggggaaggagugagagucaagcaggagcagggaauugggcuagagaccgagaagcaguuggauuuggguaguuuggaaauacaguuuacacagcuuguuauauagcguuuggaaagaaaauugccauauuuacaagauuggagauuuaugugacuggguacuaauuaauaaucuauacuggacauuuagguugggggagcgaacaaaguuugcuuacggaaacguguggcacugcgugcaccaugaaaauugguccugcagagcuucuuuugucugcuauugucugguucacaauagcuuuuuguucuagguuugaguuuugaaagcaguuugcuuuauccauuuucccaucugauacauccuuaauuugcggaaggcauguucuccuguaggucuguaaucagucuucuuccauuucucuuccccuuguuuccuaggcucaucuacccugucaucugccugcauucucauacagcuuggcagacucgccugucaugccaucucuagccacuugacuuugaaacauuaccuccaccauuuauggcccgacuuagaucauggucauuauugcauugauauagucuccaggagacuguuucuagucccaagccugcgaaguauugugcaugcccccaacagggucuuccuuagcccuuagcucuaugauguacucuauaaucuugaucccuguuguuccagggaagggaaggcauucuuagucagagaaugcucaguagugaagguccagggacaaauuugagaagagaggggaauaaaggaggauuauuaaucauacauagaguaucugagcaaugaaauguuaguuaaggcuagaacuuucuucuuugggagccugacagaguuguaaagacuuaaguuguggcucuacuuaauaauauccccaaacccuggcuguaccuuaaaaaacacuuaauggaugguuuaggggcaguaguuccuaaauggguuggaugacccucucacaggagucacauaucagauaugcugcuuaucagguaucuauaucaugacucauaacagcagcaaaauuaugauuaugaaguagaaacaaaaauaauuuuaugguuggggaucugaagaacuguguuaaaggguugcagcuccaagaaggcugagaaucaguggcuuaggguaaagcuucuacuacuaugaguuccccaaacucagaguaaguuacagguuguaaagaagcaaaaguuagcaacuuacucuaaaaaaguggcaaguaaugucaauugugaaaguacuuugaagucggaacaaaaacuggauugauggcuuccugcuuuguuguguaugaucugguuuucaaaagacuuguuuaguuuuuuuauguguauguuuauguggcuguaaguggaugugcucucacauguguguaacuugcagagccagagggugucacaucuauuggaguuggaguuagagguuguuguaagcuccugauugugugugcaugcugagaaccaaaauuaggucguccucucugagagcuguacuaaccccaacaugucucuccaguucugccgcugucauguuaaagagguuaauggcuuauuugacuucuuaguuuauaauaugguggaucucagaaauuuuuuauuuuguucuaaauucuuuuggauuuugugauggaaauaccagaaugaaauaguuuuaccgggaaccuuacuucaugcagggaagguuguagguaaagugauggagcucaagcccugccucagccugugucuuugcuuaguucgggcaugccagggaguuucuacagaagucuaccuccuugguauaauggaaaggaaggccucacacaggugccagguuucaggacuuggugcuguaacugaacuuucucauuagguuauuaauacuguuuggcuguagaaaggacgucuucagaugguacaacuugcuauaaguauuaagacccuggggugaagcugaucucuuaacaaaaagucaugguguguuuauaguuuucaucaguuacgaaaacaguguaugugcauucuuguauuagggcacauuggaagacaguuugcaaacggcaguuuucuuuguaccacuuagauucuaaggauagaauuugggucagggggucaggccuggggacaccuuuaccuacugggccugucaccaacccuguggaaugcuuaaaucaauuuuuuuuuuuuaggauuucugaaaagaggauccaugaagaauuuaauucauuacucagcaucaugucaaaaagagauaggaaucuauuuagaauacguacauuagucuuccugaaagaaguugauucagaacuauaaccuuuuaaaucauauuuguaucuucauuccuuauguguaaaaauuuggguaaaagaauaaaugucuuccuuauaaaauuuguuuagggaaaaaagggcagagauaauuuuggauaggcaguccuugggugucauugugucccccagacacucacaaacacggacuuguccucuuaccuuuugucguucacuuaugccaccaacagucgcuaaggguuuucuguuuguaguguguaugcucuguucuuguccugagauuuuagagaugauuuucuguuauuauuuauaauuagaagauuaaauccccccaaccuguccaguuagucauaguuugacugaguguaauaacuuaguacauuuugucuucuaaaaauaacucuguguacuuucauucaauguuucucuguuuuaaagagcuucaauuuuuaaguaaaauuucagcuaacccuauuaaauauuuaagaauuggugguacaauuuguaacauguauuuucuuuucaucuuucaugaauauuucaauaaaaugaauaaaauuuauuaaauauauucuguuuaaccaagaugaacuuggaggcuaaaauucaaacauauuguccucuuccaccacauagcaauauaaauuaauuagaauuguccagucuucaauugaauaaaacacauuacccauuguuguuuucuuggccagaauauuuacuaguauucagauuauguacaauauuuaaaguaguucaaaaauuagacacuuuucuuacacagucagaaaaauacacauaggggaaguuuuuguuucuguuuuguuuguuuguuuguuuguuuguuugguuugguuuuucgagacaggguuucucuguauagcucugguuguccuggaacucacucuguagcccaggcuggccucgaacucagagauucgccugccucugccucccaagugcugggauuaaaggcgugugccaccacugucccgccauaugggaaguuacuguagacaaaacucagucuuuuuugagggccuacuaauuucuuuaaaagggcaaaaagagugaaauuugaaguuauaacuuagagcgagugaugaaaauaagaagaaugaaaaggaaggaaagggugaagcugaagggagacagacagacagacaggcaggcagacaggaaagagaggauggugggagaggagagagcgagacagccaacaguacagacaaaaggaggcuggaggcagguggaggaaaggucuuacuaggcacucacgauggugguuccuucuguguuguucugcccucuuauuaacugcccucgagaacacagggguuaagagauccaaauucuagcccuaguucuuuguguugccuuggagaagucaguuaacuuaucuggggaucagauuucuuaucuguaaaauguagacagaguaggggaucuuuaacaucugaaagugugugacuuuggcuaugagugacuggcaaacacaccugccugcuggaaguuuucaucuagaacgacuuuaagacacuguguagagguagagauuaagcagcugagcuuaggagccuuuucaguuuuacugcuacuuguccuagcagcuuguaugauauuugccacauccugggcaacuaggaaauguguguuaggaaaauuaccauuuugauggguuuaugaugggaggcacccacaguccuucuaggaaaacugugugauugaagaaggggcauaggcugguuuuuaaacucuuuucuucuuuauuuuugucccagauuuagauaaaaugacaguaggcaguagcacuccuaaagucacaaacagugguguauagacacaaauagugacaagaccauauguacgcuauaggccagucccuuccagguaccuuaaacugugagguugacagcccucagcucucagugcagucucucagcuccuugugaugccaaaagacaaauuuugcagauguuuggccaaaguacagaauauacaguacucuaugugaaaggcauagaccgagagaaagugcaguguaugcaguauuguauugcugugacgggagagacucagguucuucaggucuuugaaaugcucagaccucaaacugcgauagaaggaaaaacgucuuaagucccuagcaccacagucauuaagauuucugaugaguuacguccuuuuucuuuaauucaacuucuaaaauacauuuaaugaccaguguaucaaauaguuagcacacugaaaacaaagcacuaaaaccuguggcucagaaagauggagggaaggaggcauucacagauggauaggauggcaacugaaacaaugcuguagaccuaccugugagagaagaaggaggauaaacauggauagaauauuaacucuccauucugaacuucaaaauaacucacauuucacaccaucugaaaauagugagcaugucaaacauuuaaaaaauuaaguuuguccaauuugauuaauauuuuugaauuuuauaccugaauggcaaaacacaauagucuuaaaaaguauaccuauagaacaugucuauuccuguaucuggccccagaugugcuugaaaaauauaggaucauuauacuuugaaauauuuuuaaaucauacaauuuuuaaaaaauauuauaccuauaucagauuaggguuuucuuuuuaacaauugcuaaauauuuuauguggguuuguaaaaauuguaguguuacaaaauauguauuaauaauaaauuucucuaaaaugcguuuacaaaggauaauauaugaaagauacuaugacaaaaugggaaugauugucuuuucuauguacauuaauuguaaguuaaaacacacaauauugcagaauuucuuaauggcauauuugcaugugcuaguuucacaaauaugcccuuaaugaaucugagaacaagauccauuuguauuauguaacauuuuauuuguuauaauuauuuacauaauuuauuguaaaaucaaaauaugaaaaauagaaaaacaaucaaaauacuaaauuucagacuaaaacuucuguuuaaaauucgaguccauuugcagugaguugaaugcuaggucauuuaaaauguuuuaaaucgccaacuccagaagauggacaccaauuucauucccgauggcaaugaauuuccuccuucugaauuuucuuauuaggugcacuaggccuuccaaugagggggaugagcaacaauaccccucaguuaaaucgcagcuuaucacaaggcacucaguuaccgagccacgucacgccaacaacagggguaccaacaaugucacuucacacgccuccaucuccaagcagguauuuauuaacggaccagaaucuucucagaauguauuuuuguagaguaagcaagcuuuuaauuuuuuaauauggucaugaacuacuugauuuucugguucagugccuugcacucagaaaacaauaccuaugcucauuuuaugucauugcagugauagcauuugaucuugaagcuaagcuaguugucaucuggauggaucaggguuuaauugccuccucgggagcuuuuacaaaaggcugcacuccucuuccuuaaagauguucaauuuaaaaugcuccaagauaacugugugccuugcuugcucccacacuauacaucuuuuguuuaguuacaguaaaaggaaauagauaacauagauuuuguauauuauuaauaucaagaggacagaauaauuugaacuuugaaugaaauuauucuaaauauauauguggaaaacauuuguaauuuauaucauaguugucccaguaguucucuuuuaugauggcaccuuuuuuaguuccacuauaaaguuaggaauacagcugaauguuuauuugaaauuguagggguuagagcaauugauugauuauagagaauuuuaaugagugauuguagagagcuuauuuaguauaauggacuucuuuuucagggguauuuugccuaugaauccuaggaauaugaugaaccacucccagguuggucagggcauuggaauuccuagcaggacaaauagcaugagcaguucaggguuagguagccccaacagaagcucgccaagcauaauauguaugccaaagcaacagccuucucgacagccuuuuacugugaacagguaagauguuuacugauacugcauauaauugucuuuugggguauccucagguuugcccuuucaugugcaacgcuuuguuuuugagcuguggcuucugucucauagguguguuuuaauuguauauuugugaacagaguuguuaccuaucauaauucuuaacgcucugaagacucagaacauauucucuuagaaaagaugguuuuauuuuacauaacacguuaaaucuuuuuguugaugugguauuagaaaggaaauguucuuggguugucaccaggcaaauuuuuuauugauuuauucuuuuauuauuaaguagaguuuauccauugugugauucuaagaguucuggguuaggaguaugacuggaggagagcaugcugcguuaucgcugccaugcuucaggcaggcacgaucuggaugcccgcugagcuacggaaaaccuuucacaauugcaugcagaguaucucaaaacagugcuccucuaaauuuuaugucuagagauuaaaaacaaacaaacaaaaaauuaagcuaguguuuuucuuuccauuuguacuguacaaauaagaacagugauucaacuguuuggguaacaugagaguuauaucugaaauguaaagcuuuguugcaaagcaacauaaauuugagucacaugucauauguauguuauacuuaguuucacaccguccuguaguuguugcuguccuggccaccucacuuccucuuugucaaucuguacucagaugggugcuuagcacacuuccugcuuagccucugucccacaacuccaguuguucuguguaggcucuaucuauaguauccugucauuuuaaucuaaguuuuuaagcaauuauuuacaacaugucauuauaacucuuuuugauagcuuaacuguauuguuuaggcuuuauggcaucauucugcauucuuguucauuaaauauuuuuacuuucuuguauauuucacauuuuaauuagucaaaaaauacuuugcauaaaaaugucacuguaauaaaacucuuaacuucuacuuauguauacuacuuauaaauuguuuuugcuaugaaauggcuucagcugaauauuaaaucuguauuugaggggacuuauauaaccaguagcucuaguauaauaggaacaaauguuuguugacacucuaccuuugcucuagaauguuguuccacuagcugcauagcuuaaccaaagguggcuaggucuacuggaucaggcagcgaaguuacaguugucaucuccagaugcuuagcucugcuaugcacuggcacacuaaccuacaagaagacuauuucaugauaaaguuucuuuguagaaucuucauuaauaauccuuguugacauucuuaauuaucuggucuucuuuugaaugcaguuccuuuuuauuguuuugcuucgguuuauacaaaagaaaaagggggguuguuuauaauuauuugcagaaaccaaguuaugcauuaauucaaaauugagaguacuauguggaacuuuuuuucuguuuaguagaugaaaacuaagcucuauuuaagauaugaaugaugaguuuuaaaacauuaaauucaguuuuuuuaaaaguaaccggucaguuuaauucaggucaagucaacauuuauugauuaccuuguaaaucuaaacaccagggggcagagaaugaauaagacauagacucccaggaaagaauaguuggaaaagacagguugcaaagagaagacuugcacugaaaagcaagcuuuauaagucaggaacaaaagcaaguguugagagggguaaucuuuaccuacuguauacuguugaaguagaugcauuuauccagaaagcuagcacaccagcacacauuaaaugauacucuucaucuccguucuucaccacucauaacuaaguuucuuuuucgguuuuuaaaauuaauuuguuuaaauuguuugauucuuucuuguucauugaagaauuuuagagaaauuuuuaaauuaaaauauuguagucucaaauuagcauugguuuugaaacauauuauuguuuuauaugaggagacccaaaauauauacuuuuauuuuucuacaucucaaaguuaguguucuuacuguauaucuaaaauuauuuucuauguacccaguaugucuggauuuggaaugaacaggaaucaggcauuuggaaugaauaacuccuuaucaaguaacauuuuuaauggaacagguaagcuuacucuggagcuagugcccuaaugaaaguacaguagaauucugcacugcaagcaaaucagcacccugcucucuggaugguagcaggauuuuacucuuuuacauagaauuuaguuuagugggaaacugucagugguaggauuuaauuaaacagcagagagucguuuaaaugucccccuaacuuggccuugcaacauaguauuuugcauuguaacaucagaauuauuucuaacaucuaaagagaguaaauacuaauuuggacuauauuugugucucagaaucuugguguuuuucuuuaaaauguuuccuguccuuugcccugucacugaggaagaguaguauauccuagguugggugguaggacacucugguuuuagauacucagacugaagagaagaaucgaaaucguaggaagcacucagcaguuuuaaaaaucacuuaaugaaaaguuucacauuuaauccuuaagaauuuugacccaguauuaucuauaagauugagcuaccuggaaaguaacuugauuuuugacaaaaacuaaagucuacugguuucuuaaacagggagugguagguauugcugguuagccgugccucucagugcuuugguggugagaaaauaagggauguugccaugauuagugcaucaguaggaccaguauuaguguuacugggcgcucuguaugugaggugguggugagaggagaggugugagguauaguaugcauaugcugcagaagaccuaaaagggagcccuuuuuuaccuauagguuuuuagcuucugggcauucugaugguuuguugaauaacuuaaguggaccagccaagauuaaagccauugaaagaaauggaagacuuuaagcauuuaaauuguauauccauuucuuucaauggaagauuuuuaagcauuuaaauauuauaguuuucugggugugacuuuaaaaccuaucaacuuuguaauucuuaaaacaaaguuauauacuucauugacuuuaaagaguucacuuuuucauaccuagcaugugaagucuggcuaccuuucacauuuccacugaauaauguuuuuaauaugcuacuauaaaguuucagaaauuuaaaauucuuagauuuuauacugagaaaauuauaaauuguugguuaaaauauauucuaaccuaauacaugacaauuuuaaauuagucauggaaauaucuaagaacauguauuaaaaguuaauuuuuacuuggagaaguuuauaauuaaucauaauuugagagauacuaacuuauaaauuaaaacaguaaauaugauuuuaauuucuuauacuuuaccgauacuguauuuuuaguggaaauuuaaagaaaaauuugugagaaaugguuuaucuuuaccuuuauacuuauaguuuuaaaugaucaccuuuccugguguauucauacaguccuuuugucuuaauaaaugaaguuacucagaggauaguaauuauacuauugggaaaauuuucagaaaagucaaaguuaauugaaaaacggccucaaaacuauacaugcuuauaaaacgaggcaaaauauaaagaaaaugauuucauacugcuaaauuauagguaggaaauuaaguaguucaaaauuagaauacagguuaagaacaggaaagguugagggaaaaauaauuuaaaaaaauagccagaauaaagaagugggguuaacuguuuaugucuaaugguagcgguauaauuuaaaacaaaacaaaaagaucuuuauucaguauauuuauugagcgccuacuguguaacaggcaguauaaacuucugggguugaugauugcucuauuccccaccuacuccugacacauaagaggaguccauccuugcguggagcucacaaacacaugcacauguacacauuuuugucucauuuuaaaguauccugggcagaaguccucagggcuucucuauuugccguuugccucaaagucuuuguggacauuuguaagagguagugucaucgucauaucuuuauaguugaaguuccaaguaauguagaucuugcccuguccaguguuaaugaagagcucaacagugcagcuccugcuccucacaggcucuguguuucauugccaucuuccaucaagggcaaaaaaugcccagcccucuccuuuaugucuccaccuccagaccuggguaguuugagacacuggcagcaugcugcuuuccucaguuauuagggaaugaaucccaugaggcaaaaccaguccacagaguccacagcaugcacgcccacugucguguaccuaccacaccacucuaccuaccacaccacagcacgcacgcccacugucguguaccuaccacaccacucuaccuaccacaccacagcacgcacgcccacugucguguaccuaccacaccacucuaccuaccacaccacagcaugcacgcccacugucguguaccuaccacaccacucuaccuaccacaccacagcaugcacgcccacugucauguaccuaccacaccacucuaccuaccacaccacagcaugcacgcccacugucguguaccuaccacaccacucuaccuaccacaccacagcaugcacgcccacugucauguaccuaccacaccacucugcacuaggaaggaagaagacgcuguuguuucacaugagaugcuuggcuuuuauaaucucguuguaaauguuuguggagucaguaacgagcauuaucucuuaucauuuagauggcagugaaaaugugacaggauuggaccuuucagauuucccagcguuagcugaccggaauagaagggaagggagcggcaacccaacuccauuaauaaaccccuuggcuggaagagcuccuuacgguaaugcauguucuuaguucuuuauuuaccaaauaaaggcuacagucauguguacuacacacguaugugucuguaugugcaugcuuguagguauuuauguugucagaccagguuaacauuauuuugucagaauucauaauuugaaaauugauuuuuuuucuuucuauguauccaccauagcaaaguugagugguaaacuuuaguacagaaaucuaaauacuugauuucauugcuauucagaaguuauuucuuccguuccgcaugcuuuaguuuaauauaugugauuaauuuuguggcuuagcuuuuguuaguuggcccuaccuuuaagagaauaugucccugguaauuaauaauaacugcauugagguaugucucucuuaagugaagauuucucuaaauucacacuggggcuggaaaguucauuucagaagucugcgggugcuuauuuagguagaacauuuagcaacacuuugaacuuuuggcuucuguguaccagcauaggcucuucucccauccgugugauguggcacacguuucugcaaacuggcaaacgcccucuugccaagccugugagaaccaaugcuuacgguuuuguauuuuuacagauucuuggcuaugauuacuauacccagucacucuuuuuacagucucuauaaguuaagagauuuggaguagagccugaauaucaauguuaagaaaaccauaugcagugacagaauagcagcugagacaaaaacuuuugugauaucagcauagccaaacucuuguuucuugugggugagaucucauauagacugguaucaaggcaauaauuagauggguuuauucaucauuuauuuuaaaauagagcuaauauuuucuccauaaucaaggguuucaaguucugaacuucuggauaugaguaaaaauaauguguagaggaaaaacuuuauugaucauaucuuaaaccuuucaaaucuguuuucccaaaauaagagaaugugccgugcccugaaguugcgugccuagcugcuugccucucaguucagaugcuaauguuguuaaccuuuccccauagguccuuucuuucaucccuuuaaacuuucccguugcucuccuuggaccaucucuaguuucuccauuuccuucuugaauuguggagccccaaacuggauuuuguucuccaauaagggcccgacuaaugacaaguauagugggaagaguauuucucaguccuugcauguuuuacaucuguaacauggaguccaagaacaugagaaauaaaguggaauuguuuuauaauugguugcaauuugcucacucuguaagucacuuuuaaguagaauacugacauguucuuuuacauuuuauuauauucauuuucauuugacagcuaacugguguuuauggcaucuagucagauauuuaaagcuagccuguaagccggcauuuugaauauuauuaccaauaucaaauacuauuuuaagcaccuauauaacauuagauuggaauuucaggauuaccacuuguuuuucuuguauugcuuuauauguugcuucuugucagcaguaaaucaaaauuucauucuuuaucguuauccugaauauuaauuuuugaguugccaguucacaugcuuuuuuaaaaaagcuuuugguauauugugaugagcaaaguuaguuucuuauauaguuuauaagacaguaucauagauucaauugcauuuucuggauucuuuucauuacauaguuggaaugguaacaaaaccugcaaaugagcaaucccaagacuucucaauacacaacgaagauuuuccagcauuaccugguuccagcuauaaagauccaacgucaaguaaugacgacagcaaaucuguaaguagcugagcaccuugugugugagugguguaguuuucucccuuuagaauugccugacacuaauaguuacugacuagacgcugcugcacaacuguuugagcacuguaaucaucuaacuugaagacuguagaaagcuuuauaacuuagaagguagcauuuuuuuccuauuucauguagguuugcaaauuucuguugaacuugugaguuaauuuagacuuuuauuguagucccugucagcuggaccccaugacguuugguuauauagacuucuaaggagcucucuuuuucuugaguaaguuuucuccuugaagaaucucuaugcacauuuuaauaccuguguugauucagcgaccucagcuucugauuuaaaguguguuuauuccuuccaacauucauggcagagagcugguuuuuuuguuuguuuuuuguuuuuuguuuuucuguauguuugauggguaaggauggaaauaaguauaaguuuugcaaggucauauauuccuaguuuaccuuugagguuucuuugguaauauuuuuaguacuguaauauguaauuacucuuuuuauauagaagugugcaucaacaaagcauaaaaccccaagaaagacagauauuuuucauauuuuacccccugugaucuaugacagauuuaaaaaaaacaaaaaagaaaaggcuaauuuuuucaagguuucuugccucauuuguagacacagaauuuauuuguauuucgugaggcaguuauggggagacaauuuucaaguagaaaacagauaauuacuacuaauuuagauauaauaguggauggcuagcaagggguugaugaauuuaaacuuagauauuuagcacaucuaaugucaugcuuuuuuuuuuuuuucgugcuagaauuugaguacaucggggaagacgacuucaaguacagauggacccaaauucccuggagauaaaaguucaacaacacaaaacaauaaucaacagaaaaaggggauccagguguuaccugauggugggacuccauaaauaugucagagauauuugaaaguacaguuuucucuacuuuccuuaauauaaaguaaaaauaacuguguuuuucuuaaccaggucgaguuacuaacauuccucaagggauggugacggaccaauuuggaaugauuggccuguuaacauuuaucagggcagcagagacagacccaggaaugguacaucuugcuuuaggaagugacuuaacaacauuaggccucaaucugaacucaccugaguaaguuuuucccuccauguuuguacauaucuucuagucuguaauagauucucauacuguuaccuuuuucuuuugaagacagaguaacccaggcaggcauuauagguguuauccuguauccugugccaccacagagagccucagacuuguagcuaaucucaucagcagccugcauacuccugggcuguucuuucuagcuagcccauagaucacugagaaauaccaaggauccaucuacaaggcauuuggguuaguccccaagccacaucuuuauccagcccauugaucuugucauuauucggaacuaaguuuaccuuguugcuugcuuuuuaacuaucacuguuucccaugccucucuuguggcugugacuucuauaucauuugauucuauugcgacuucucauucucuagcucucugucuuccucgguguucuugucuccuccucuuugaugagcucacauccuucucaccauuaaauuuuaugaugaaucauaauugcucacuuaggcaagcuugacugucugcccuucucacuucucaucuuaaaagucuguacccauuguuguaucuguuuguuugauucuugaccaucuucugguuggacuacagaaaaguguaauuucacugucugguccugcugcacacugaugcucaagaacuuaaacuugaguccaaaauuuugcaggcauacuucuuuuguuuuguuuuuuuuguuuguuugcuuuuuuuuuuguuuguuuuuuguuuuugguuugguuugguuugguuugguuuuuuuguuuguuuguuuuuuucgagacaggguuucucuguauagcccuggcuauccuggaacucacuuuguagaccaggcuggccucgaacucagaaauccuccuuccucugccuccccagugcugggauucaaggcgugcgccgccaccgcccugagcagccauauuucuaccugaugacauaauccuuucagaaccuuuuguuugcuuuuggauguguuuggguugguugguugguugguugguuugcugcuguuauccuaugugacuguuuugaauuucaucaagccaggaauagcauuuccuccuguccguagcucucauaaugaccuggcuucuauuucuacuuuacaaagacagguguaagcagauagaagaggacauuaaccugguccugccuccaaaucuaaugaccugccaccaaucuaaaucugacaugaccuugccaaaaucuuugguccaugcuuccuacuaaaacuucaucaaaacucaugagugggagucuuaauuuuuucuccuuuuccuggugcuggcauccaaaccaguguuggacacaguaagcaagugcugugcccccgagcuacacccucagcccgcuuccccccaggacuuuggaaauggucuuggcugguguaguguaguccaagguggcuccuuaaagcacuccugcuucugugugagugaugauguuauagccacauacaugccaugauuuccuuccaacuuacagcauuucucuuuucacauuucuagugccaaauacagagaaacuuauuuuucuauuuguauugaaauuacauuaucuugaucaaccucuuuugaguuauccucauucuuaauucuuuuuuuuuuuuuggaagcaaaccgucucaaaugagucauccucauuuuucuaaccugucuucuuucacucuacugaauccacuguugcgaggaauccguuccugugauuccaguaagcgcucugcagcauccccacuuucucuuggugcuccuuccucacuugacuuugaagauaccauucuuaccugguaacguuggcucaucccucaguuucccuugcucauaucaccuuuggauugucuucuugaugaucuuaucuagacuugugcuuuuaaggaccacauagauugaaaauuccaaacaccuacuuccauggcagacuuuuuuucuugaacuugagauuuuagaugccguuauuagcuaaauaucucuuuuaagauuuggguuaaaccuacaccauggcuaugcuuuuuugaucuccauuaauacuuccagaaacgacaucauccuuagucucuccuuuucucucagaugcaguccuuucaaguagauacagaauccaaucauagucucauuaaguugcuaccacccugguuuguugccugaauauucugccagcauaucacagcagggauucuugguuugcucuuuuuguaugguuuuguguagcacucaagauaauucuuucugugcucagccccaaguacagauuuguugcucugauuuaaaccucccugaguggcagcccugcaacgcucacaucauccugccuuucuucugacuccaccuuggaaguguuucccugccuuccucugccucucaugucacgcugucucugccucaguuguucuaauauuccccuuggcuaguacaguguucuacuagcuauugaccugugauuaucgcucuuauauccuugaauauuuguuuacaucuaagcuugucaaaucggacuuaaacugaucacccuauuuaauuauauaaccaguauuauucauuuguuaugcuaauuaucugccaguguccaguuagccauacacuuuuacagaaaguaaguuuuccaauaucagcagucuucguuuuuaucacuuaacuuauucagaacauagaauaggcacucacaauacguguucagugauacgaaaucuggcuccuccucauuucggcuuugagugagguggacauggaaaguacuauaauuggagaguaguguagaaaugaacuuagagcauuguuaguuaccgcuaauuuaaaguagacaauuuccauuuuguaccuaaguauauucugacuugcugugcuuuacacucuguuggugagcacuagaggaagcgaagcgcucuuggguuacuuuucugcuauaaaguugcaguaaauucaagaaagggaaccaagaaggaugcuuauuuuuuuauuugaauucuuuuuuucccauuuuccugaaauuaaguuagaaauacaguuuucuacuuuguucuuuaaaguggcuucuuuuuuacuuguucagaaaucucuaucccaaauuugcaucacccugggcuucuucaccuugucggccucaagacauagguaggagaaucuauuugugcucaaaauuguuuaaaagguauuuccuaaguaucaguuaguaacaccuuuguuuguuuuauuaugcagacuuccauguuccaucagaauauuuaacaaacauucacauuagggauaaggugagugaguagaccuuucuauucucaggcgucgauuuuagcuauuaucuugguaccacuuccaguucagacggcaugcuaauccacuagcagucuuaggcguaugugucuguauaccauucacauaacaauuuuauuucuguuuuuauuaauauuuuuauuaauaugcuguaggucuuuuuuaaaucaauguuaggaaugauaaaauauuucuuguaauuaauaauuguaaccauagugaauggaaauacauuaacuuggaaaauuuggugauucucuuccugacauucuuauuuuaugcccuuacuuauaagagauguuauucacauaaaauguuuuuaaugggagaacccacaaacaccuuucugaaguuauucgauauuuuuccacuguaugugucacaccaguacuguagaccugaggccuccucuuaggccagugugaaaaguaccggagaacuccaugcauucacagcggccagcagaguaggguaacaacacacugggagggagcugcacucacugaggcaggcauguggaaaagccaagugacugacugggcguggcucagauaggcccuguguuuaguuagguagaagcugcaggugcuugggugaacaugagaacuaagaccaucacacuuauccuagguuuagaguuuuguaggcuguguucuaccuugugggaggaaaugugaaaagauuaucuuuuaggcauucauuuaaacaaaauaugaguacugucucucauuuuuaugcuuaguccuaugugauacacuagaaagagaugcucugugaaccacugugcaugaagcuucagcuucaaaccuguguagcuggaacuccgugggguuccacauucucacucuuuagccuuggggucagcagauagccuuguuuauuuaaauguuaguuuucucugcuaaaugaaggauuucgcuuuauccuuccaauuuuuauuuuagugguaacaguuauuuucugaaauuuuuacauuuguuuuacaacuuagcguaauuuguuuuuuguagcuggcugcaaucaaacuuggccgauauggagaagaccuccucuucuaucuguauuacaugaacggcggggauguauuacaacucuuagcugcgguagaacuguauguucaacauauccuaucgcuuucuccucucgcauaucuuggauauucugaagguuuuuaaauaaugaugguuauggauuguguuuuuuaaauugaagauuguccauuccaugaaauuucaguuguuagcagggauguuguuggcuaggagcucuagaccuuagcuuuauuccugggucaucacaacaacaaaguacaaagaaaagaauuugaauuauuuucauuuuuaguaaaaugaauuuuguuuauuuugagagcacauuucagcuuuauaaucuuuguaguauaaaaagaauuuuaaaauugaugucagcuaucugaagugacaugcgugguaaguugaguguuuugaaugguugugguucuuguagaaccagaauuuuaugcagacuagacacagaaucucauuauuugauacacaucagugauuacuauguacacaagacccugcguguuugugccuuuaugccgauauuaaauugucaguuuuuaaaauuucucacuugagaaaauuuuuuuuucccacuucccucucauuuuugugaaaugagguuaacaccuauugcuuuuaaucuagucauaauauauaaauguaucaacugccuccuccaucuguaauggacuuuuuuugucguaucaucuaugucugugaacuagcgaacuguuugcagggaagcuuguauuuacauggagguucaucacgguggacauugucccuuuggauguuggcccaguuuauaagugcuguguaucacaugccuggcuucuggugcuauccucuuagauucuggcaauuuauuauuuaaauuuagaaauuaaacuuuacaaaauggauauucuauuaucauagcuauaaaauugugaauuuaauuagucaauucaaauggguguuuuacuuaauaacuuuguuaguaaugaaaaucaguggauuguuguuuuauuauguacuucaauuucuauuauucuguauauuguaucuuuguuuggucugcucaaguuuuauuauacauaucuucuaaaugcucauauaccuuuuaaaguauuaugucuacauaaaguagauucaacuuuaauguguauuaaagaauaugcuuuugguacaaaagaaaugaucuugcuaucuauaaauaagguuauauuuaauagcaaagccagaugcagaagccuccagacauauauauuuuauuauauaauuauuuugguuuugugugugucacaggagaaauuaauuauuucuuuuuuaaaaauugaaguuuuaaccgugauuggagauaccacaaggaggagcggguauggauuaccagggcaccaggcauggagccaacaaugaaaaccaacacguaugagcgggggaccuacuauuucuuugacugucucaacuggaggaaaguagcuaagguauaguuucccaugugcaaaguguauggacauagauuuaaagaaugucaugggugcgcucucucucucucucucucucucuacacacacacacacacacacacacacacacacacacuuaaaaaaaacgucacgggcuuccuaguauguaagaguaugucugaugcacagcauguaagauucuugccaacccccaggaguuuccaaaaccagcucaucuuacuaauagcaaaguuauuaaauuucguaagagauuucuaugacuuaggcuaauaauaucauuauuauuauuauuauuauuauuuauuaauaauuauuuaauuaaucaauucaaauugguauuuuacuuaauaacuuuguuaguaaugaaaaucaguggguuguuguuuuauuauguacuucaauuucuauucuuccguauauuguaucuuuguuuggucugcucaaguuuuauuauauauaucuuuuaaaugcucauauaccuuuuaaaguauuaugucuaaauaaaguagauucaacuuuauuaauuauuaauaauauuauuauuggaaauauuuuaugaaugccaaauuauaaucucacccagucacguauuuucaaauuauguaguuuuuuacacggggugaauuuuuuuaaagcagaaaggguguugacuguucaucugcagaucauuccgugcaggagaguugcagaggcucacuguuagucauuccugugugucaacauugaaggggaauggacuguagggaagguuaauuauuugguugcauuuugguuuguaacuuugccuuuuuuuuuauaaaaucaccuugucaaagaaaauuccccgcuuugaauuguguagauuucuuugucaauagauacucuacauuugaguauaguagcugaugcuuuucucagugagucugaggguaaauaugaccuauauuuagcuucagagaauugcaacuccauuucucugagugauuguuaguauuacaaaaguaugaggcagcuuuuaaguaaauuucaacagaagaaaaguauuucuaacaaauuucaaaacaaauuugggcagcacauucguuguugcuuugggguuaucucuucagugugcugaguugauaggauguuugcauuuuaagaagacaguaggaaguguuaccagauagaaaccaugggaagguugaccuucuggaaguucuuauaaagcugaaagacauggagaaagaugagcccaauagaaaauacagaagagggugacaagugguuuggguuuugguuuagguuuuugucuuuagguuucucagugguaaauguggcuggugcucagucuucaggcuguagcuggcauuucagcaguuagaauuauucgaaaugucuuaguuccaaagaguguauucuucaguuaccacuuuaaaugucuuguuugugaaugaguguggucaguggugauguggacugugucuguaagacacuaagacaaguggagacuguucccaguguguccugggugccuucgcagucacucauugucugagaaguggacgacuaagagacguuacagaggagauuauugacaucacaaucguuuuacccuaagaccuucagcucuagguggucuaguacuuauuuucagaauuucaguuaggaguguagcugggcuuaauguugcaugaauguaaugcuaugacaguugagagucaggcagaucucuguucuaggcugcucagggcuauauaguaagacccuaucucaaaaaaaaauagcaauaauaauaacauaaguaaaauuuugacauuuuauuugcucauucucucguuuaaagugacccuaaauaauuagcaagaugugguagccucuguaauuugcuuauauagguuacauauauaauuacuacauuuucaggugauggagccuuccuuauuaucuacauauagcuuucucagagauuuuaauuguaggcuucuuuuggcuuaacuuaagcugacgauauuguaggauuucuagugcauaauauuuuaugcuugauguaggugauuguuuucauuaacuuuacacauguacacaucaguacaguacacgcccuaauaaacuauauaugcauuuacugauacacaucaguacacgcccuaauaaacuauauaugcguuuacugguacacaucaguacacgcccuaauaaacuauauaugcauuuacugauacacaucaguacacgcccuaauaaacuauauaugcguuuacugguacacaucaguacacgcccuaauaaacuauauaugcguuuacugguacacaucaguacucgcccuaauaaacuauauauguguuuacugguacacaucaguacacgcccuaauaaacuauauaugcauuuacugauacacaucaguacacgcccuaauaaaauauauauguguuuacugguacacaucaguacacgcccuaauaaacuauauaugcauuuacugauacacaucaguacacacccuaauaaacuauauauguguuuacugguacacaucaguacaugcccuaauaaacuauauaugcauuucuccacauauuucuaguaacuaucuucaacauaguuuauugcuuccuaaaauuuaaguaugaacuuaauguaguuaggagaaaaagauauuuucugaacuuagaaacaaugguagcaucaguuuuauaaaugcuaagcuuugaguccaguguauaaagucaauucuauuuaguaacuuugugagaaagaaaaaaaaguguaucuauuuuuuuugaaauaauuaauuuauuuuaugugcauugguguuuugccugcuuguaugcuugugugaggggguuggauuccuuagaacaggaguuacaggcaguugugaaccaccaugugugugcugagaacugagcccugaguccuguggaagagcagccagugcucuuaaccacugagccucauuugcuuaauaggaaaacugagucaugaaaacauugcuguucauguaucuagaacucuucuuaagcuuuuaaaaaucauuauccuguaacaaaauuuuccacuaagaacauguauguucauggacccuauaacaauacauauuguuaaaauauuccuugaagaauuaaguguucuguuucuauaguccacaaagaaaaugucuuagaggcaccaugaucguggcaacucuuagaaaagaaaacauuucauuguggacuggcuuacaguucagagugaguccauuauuaugagagggaacauggcaggaggcaggcagauaagaugcuggagaaggagcugagaauccuauauuugauacgcgggcagcaggaagaaggagggacugggccuagcaagggcuuuugaaaccuuauugcccaccagcaguaacacacuuccuccaauagggcacacaccucuuccuucuuguccucucagacagcugcacuccuggugacugagcucagauagauggaccugugcaggcugcucccacucaagcccccagaagccuugcuguauuaacucacgagugcuaagggccacuuacuauuguaagcguuagaugugauagacaaggcaguuccuuucugcauucuguccauaguauguguguauaucacugacauguaaaagacaugucauugacauguaaaagaugcuauagauaaucgaguuagauggaagacuuuaagaauaaaaauauguggaaggcagaagacaaaaaaauuaccaauguaucagacaagauuugaccuauauaauuucuuaauaucacuugaauauuuuaacuauuaaaguauuuaugcucccuagaguuaaacuaaucuuuuuuuuuuuaaauacuauguaugggcaaacauuaacauugaugggguuaauugguuuagguacuaauaaagcaguguagcuugccaguguuuauaaaaugugacuuacaguuuaucauugguuaaaacugcacauaagcuuuuuauagcuuguauauuauagaagccaauaugcauuuucauuucaaagaaugguuuaacuggaagauuuuuguuaacuguaaauguggauauucaacuuuagccgugaguugggagggacaagggcuuauggggagccaaggacagcagcucuuguguuugcuccuccuugcugguaagcaaguagcccugugccuuucucagucauaggacacagacuucuuuuaagaaugaugucaccacagaguaccuuuauuaacccuuuugaaggcacauaauauuuucagaguuaauuuggagaggguguaaugaaguaaauuuguuuugagucuuguauuaaaaguauuaaaaccucauaaaaccaucacauguuauauuaagacagacccuuuugaguuuagauccuagucuucagugugucuuacggggaagggggggggauuuaaauaccuacuucucaagauacauaaaaaauuuggauaaacuauagcuuuuucuuuaguuuucuucauacuaggcgggcaaguuauaugucuaauuguuauugugaugucucugauuuugaauacuugauuugguguccaaaagcuugaucacuauggccuaagcuuucauuuuaacuauguaaaacuucauuuaauuuaauaauagaaacauccauuauagagucaguuuguuaccaagcacaguauuauuuaaucuucaguagccaguguauguugaggguuaaaaacuugagugagauuucagaauagcuugugcuaguuagauucgggucagaaugaguaauuuuagagcauuuccuuucugugguuacaggguauugguuuuguuuuaaguauacacuuaaauuugcauuucuaguggugaucgugaaaacuuguauucuuaaaucuuaaaacuugaagcaaagugcuggcacaaaccuguaacguaggaaguauucuggaggcugaguggguagaguuaugaauuuggagccagcuuggguuauguagggaguuucaaagccaggcuaaacuccccagcaagacuuugucuuaagcguggggaggggcagcaagauggcucugugguccagaugcucgccaacaagccaggggccugagccaagcucugaggggaaaguggaaaaccacggugcucucugccugcaaauaagccuacaaauaagcagcuacaguacagacaaaaccagcuugaaaacaguuugauuaagaucacuaauccacuuagcuuucagauagcuagacaccaaaaccacucuguggcuuuaaaugacuguucucugccaucugugaaaugggagcgcuugagauguguguguuucagcucuuuguuucccugagauuuuagugaaguuaaaguauaaccuugcuuuaaaaaaaaauugucauuaagggauauugggaagugccucauuuuaaacauaaacaaaacgucggggucguuccuuauuuugguuuugcuuuuguacuuuauuggaaugcuuuauuuuaaacauccuguaaucuucagucuuuugcauuagagcuguaauaauuucacuucuuauuucuaaguaaaauuugcacauaauuuuuaugaauacacauuucugaguuacugauccuacauucagaagucuauacuguguaccugccagauaguaggcaaagggcacugcuguugucuggacugcuuacuuaaaaggggaaagagcuaguaugugugugucucuguuuucuuuagguggacucguuuuaauuauucauauagaaaauauaucuugaccaaaggggaggggggaacccuuaaaagagacacuuagacuagugagaugccacagagggaaaggcuauuuccaaggagacuaaugaccuacccaaauuugauucccagaacauguaugguauaaguccuauaccuugcagauaguccucuggcccucacacaugacuguguuugcacacgcgccugugugugucugugucugucugucugucuucacauacacacucacaguaaauguuuuuaaaagagcacuaugaaguaauuuaaauucucaauuuugauguucuuuuguaggaguuccaucuggaauaugacaaauuagaagagcggccucaccugccauccaccuucaacuacaacccugcucagcaagccuucuaaaaagacuucccuuuucuugggguauggcugucucagcacaauacucgacauaacugcagagcugauguggcucaggcacccugguuuuaaucccuugaggaucuggcaauuggcuuacguaaagaaagggucaccauuugagguccugccuuaccaauuaugugcugcccaacaacuaaauuuguaauuuguuuucucuacuuugagcagggucugaauuuuuucauuuauuuucuuuuugccagcagacagacuugggucuauaaagacaagcaaguacacugacagaaauuaccauuuaguuucuuaaauguaaaaaaagaaaacccacaaaagacucaacaaaauuagaccacaaaauuugcauuguucauuguagcacuauugguaauaaaagaacagauguuugugcauuuuuaugugaagauccuucucguauuucauuuggaaggaugagcgaggucugcuucuuucuuuuuacuuccccuguguuucugaaaggcgguuuggccaggcuuacugcaggcauccgacuguagagaucgccacagucucuggggcuccagggcugcgcuguaacugagcuucauccagaaugagcaaaacacuguccagucuuuguuacgauuuuguaauaaauguguacauuuuuuuuaaauuuuggacaucacaugaauaaagguauguauguacgaauguguauauauuauauauaugacaucuauuuuggaaaauguuugcccugcuguaccucauuuuuaggaggugugcauggaugcaauauaugaaaaugggacauucuggaacugcuggucaggggacuuugucgcccugugcacuaaagggccagauuuucagcagccaaggacauccauacccaagugaaugugauggggcuucaagacgugaacugagacaauucacucuggcuguuugaacagcagcguuucauaggaagagaaaaagaucaaucuuguauuuucugaccacauaaaggcuucuucucuuuguaauaaaguagaaaagcucuccucacugcag

SEQ ID NO: 5739 - RNA, 74476 nt, Mus musculus
cggugcgacaggaugauuuaagauuuuuauugagugcauacaucuuuuauugagugcauacaucgucacguugagccaucaauacagccuuuagcaaaugcuaggacguucauggaguuuuuccuagcaucccuguuccacacauuaauuaagaaaauggucuuaucucaccugguaaaguccaagcauagcaauacucucagaccuuccccagugacagcaauguuuaaauuuugacaaaaauguguuuuuaaguuaauauacguaagaagaguaaugaauuagaauauuuaauguuacuuaaugugauaaugcuacuacauacacauuaagggcucccaauaacgagcagccagauuaaggugcucugcauugcaugcauucacgcacaugagcugcacacgccuagaguagccagucuuugaacacacuaccuuauggcaguagaugcuaacuugagaggaagagaaagcagacgagacaggaaggcacgguugggggaggggccauguaggacuguguuguuccuucuugaauuucccuaaagugaaaaaccaacaaaacacaaaacggugaaaaggaguauuuaaugaaaugaacaaccuagcaaaauaaaccuuuuuuuucuacuggcuacaccaguuccuguccgcauuuaaacaaauuugcauaucugcugauacugcauaucugcuaugucaaauuacuuucaaaaccaugacaaagguacuuuuaauuucaccguaggcuauuguauccuauuucuugccuuuagcuuucuaugauaaaaauauauaucgcuuccguuuaucacagaaucuauaucuaacuauauagacuggcgggcuggaaggagguaauuuauuaaacuacagcagaaacuuuauuuacuucaaaugaguaguaauccgcauuaguaagcucuaccacucaaacaugaacagcgauacguuaugaaacucgcaacuucaaagcacaaagaggcuuuuuagcaaguuaaguaaccguaaaacacgaaguuuguggauguucaaagguguaaacuaagaguauuacagcaauaaaaaguaauuucacuuucagggacaguccggcuuuggagagcaaaacacuuuaguucccaaccacagccaccguauuuucaaaaggucuaguggaugagccagcuggucacuaagguuuaccaagggcgcgccgggcgggaacuaaauaaagugccacaaacaccguucgguuagauuaaguacucccggcagugcuuuaaaaacacgcuucccccuuacuuccucucaccagguuuagaccggggggggggggggcagguaaaaaaaaggggagcaugaaaaggaagagggggcggcgaucaaacgccuagguuccagcggaggggaacucacugcucgggaggugcgggcggcgugcggcgggugucugggggagcgcacccagguagcgcaggcagcggggcggugggaggaccgaagcaccgcaggcaccgcaccgcaccgcgccgcgcagcaggcuggggacagcccggggacagcccgcaggaggugcucgggggcgggguguccgaggaaaacacaaacacaaacacgcugcgcgucccccggugggcggacccacgccacccucggcuucuccccgcccccgaggccgcgcucgcccgcucgcucggaccccaggccgcagcuccaggcguggccgcagcagcucccggcguggcggcggucuggcuucgggagcccggagaggccgcccaggccccacucuccucggucaccgccacaagacagcgccgcaccuuccgcgggaggcggcggaagcccgggaaggcuccaggcgagcguugugcuucucacggucgacuggcguacgggcggcguuccguccauucggcgagccucgcucgcucgccggcuucugcugcugcagccgccgucgccgccgccuucgagcggagucggagcgacgggggucacggcgggggucagaggguaaaggucuugcucccagcagccuccgcgguggauacgucgccaucuuggauccgcgggacaagaaaauucaugcggugaguuuuuggccaauuuucggaagucuggcggcggggcacgcggcgggggaggcggauugggggcccccucaaggcgggggaaugccucggggcugguccggucgcgcccgggguccgcggguagcgucccggcccgccgcuucccguugcuuuugucucggcuccaaucgagagagggaagagcggagcgggcgggcgggcgggcggggaggggguggcggcgcuggaggagggaggggguguguggcgggguggacgggacguaaagcgucgccgugcucgggccgccaccgccgccaccaccgcagcuaccgcagccgcagccgcuccggagcuuaggcccgggcccccgcugcccgccgcggggcuuccccggcucccgccggcgcggagcagccgcugccgccgugcugcuuccugggcuaggagagaaggcagcggcggcgguggcggcggcagcagcauccaggagccccggccacuggacacggcuccugccugccacguucccagcagcugcugguccuugaagcuuuacguuucuggccauacacgcgcauccuccgccacuugugugguuuucuuuucuuucuuucuuuuuuuuuuuuuauuuguuuguuuguguaagauggggacaucgcacuggcuaacgggccucgggagccuccaggcccugagcuauaccgaaggggccuuucuugcaagguggaaaggcgagagagaaacucagaugcugcuucugcccccgugccuggagugggaagccucucuagugguguagccucuugaguuccgaugguccuggggcggcggaggaggaacccgagccacucuugugaaguugcaagcccugguuucuacuuccgccgggcccccucuaccuuuugccguuuuguuuuaggucuucacuucaaaguuucauagaagaaauaaguuggguuaaaagaaacccgguaguucuuaauugagguacuguuugcuuaggagaaaagcuuauaauucuuguuaucuguaggcccuucgggaaaucuaauuguaauuuuauuuuuguaaaauuauuucuaagguuuuguuauuugcauuuacguuagauccaaucaguacgcuuuuaccuccaaaagaaaauaaaaauaaauaaaucuuacacauagguacuuucuuggaaauccuagggggacaucuccacuuuucaacaucugggaagacaaguguuaagaguguuuugcuucauuuucauuaaauccuuagucaaagauuucucuuuaaucaucuggacaguuccuaauaaaauacagcaauaugauccuuagauuauuggcaaaugguagaacguuaaccagaucuguucacaagggacacacuuaauguucaaaacugaauacauuuucuauuacucucuauagugagaaguuuuagggagauggaaucguguuccuauagauuucccuuuccaaauaagugggugguaacuuucacaacaguuuuauguuugggaaugcuuuguauauucaacaacaguuccuucucagaagucaccuuuguaguuuuguaagguaauuuuauuccaaguuggaaguguuuaaaaauccaguacacugaaaugguugucuacauucaaauauuugucuguguucagguuuugugucuuuaauauguuuucuaaauggucccuugugcucugccuauccagucuguugucaucuuaaagcuaaaggaaaaguucaaaaugcacagacaacuucuuccacuuuucacuuuugcugacuuugcaagauccuuaauuuuaaagugaaaccuuuucauuuuuaaaaaagugccuguuuuuguuuuuaacucuagaccagaaauaaagacuguauuugacuuuuauuuuuuuauuuuuugcauuccuauuaaugcuuuauugacacacauaagguagugcauguguuggcagagcacuuugguucucagaugcagucuagagauaccuguaaccuuaccagaugcuccaggcugagaguggccugcacauuaacguaucaguaaauacagccuuucuaaagugcuuacaaauaaaugguguaugguggaaaaugaagcagauugaugucugugagugguuuauagccuagccaucugagaacuauuugauuugaaaaugaaaucaaacuccaaauaauaggcucccuaaaauaauaauuaccuuuaauuucccuauauaaagguaggugcuuuuugguuuuucagagaugccuuagguuuauuuaaaacuucaaaaauaaauauuuuauacugcuggcaaguuagaaauacuaguaaucguguucugcuuguuucuuuucuccucuuucuuucuuucuuucucucucucucucucucucucucucucucucucucucucucucucuuucuuucuuucuuucuuucuuucuuucguuuuguuuuuuccagacaggguuucucuguuuagcccuggcugucuuggaacucacucuguagaccaggcuggccuggaacucagaaauccgccugccucugccucccaagugcugggauuaaaagugugacgcccggcagucugcuuguuuuuaaguaggugcuaauauuagcaaaacuuaaacuuuaauggaucauuauagaauuuuuuuacacgacaugggauaguauagguuuuuuuuuuuuaauggccaaauuugcuugauuagaaaauuugauuuuuguaucuaacuagaguaugaguagauaguaguaaaccaguaaaaauaaguauacaauuuuguuuuguuuuguuuuguuuugaagugauauuaaguuguaguaucuuuugauuaaaauuuuaacugucaaaugaaugacauagcugacuggauaaaggcauuugacaccaagccuaaugauagaaguuugaucugagagacccauaugguggaacaagagaaucaacuucccuaaauuguuuucuguuauccacacaaauagccacauauaauaaaacauuaaaaaauguacuauaggguuaguuuuggugucacacauuuaaaagcaggcuguagauccuguauguuuguuugagcagacauuggaggaaggcuuaugugaauggugauaguuuuaggaggagauuuucuuacccagacuguagugguauuuuuaagaauuauguguaaauuauguauaggugugugcucgcauguggauaauguguaugugagugcaagugucuucugaggguccagaggcucugaagcuggaguuagaguuaugaguugccugacauggaggcuaguggaggcuaggagcugaacccagguccccuggaagagcaguaagugcucuuaccugcugagccaucucuccagucccucuaguggauuuuguaacacaaaacacaauaagucaagguaccagagguugggugguuuucgaggcagaauucaucagaguuggacuguaauuucaguggauuugcauauagugaugggucagaagauuuacugauaugguagaaguggcucuuguuuagguuccggugacugucuggaccaaaaaugauuucuguuuugauauuugaaggaauuuaauuucauucuaacauuuucaauauggggaaaagcugugcucgaguugguaucuauuguagaaauuuacauuuaaggaacuauaaggaaaauuuggguuuaagguucuaaaauuauuuuaauaccuuaucuugcaucaguuuauugagcucuuuaguauugcuauuuuuucuuaugucuguaguuauucugugugguguccuucaauuucuauuuaaaauuuuucaacuauuaggacaaaucaugccaauaacaguuuacucaucaauauuaucaaggauguucuagaaauagaauuuauuuauuuauuuuauggaugugacuacaguguagccguacagaugguugugaacuuucauguggugguuggggauugaauuuuuagggccucugcuugcucuggucugcccccacuugcucagucccugcuugcucuggcccaaagauucauuuauuaucauacauaaguacacuguagcugaucugaugcaccagaagagggcgucagaucccauuacccaugguugugaaccaccaugugguugcugggauuugaacucaggacuuuaggaauagcagccagugcucuuaucagcggaaccaucuugcuagcccuagaaauagaauucuugcuguuuucugacagguuuuuuuuuuuuuuuucugaaaugaagcugcagauacuugguaucuaacuucagggaggaacgcugcauuaugaagugauaaaauggucugcguugucuuuaccuuugggaugggcgcauggcuuauacaacauacaacauacaaaugaaaaaaacugaacuguguagagaaauacaaaguuuuccuuugguagacacauuuuuauauaugaucaaacucaggguccaagaccauuuaguuaacuguuuggaacucauuugcuccuuaagucuaaacauuugccuuuuuauucauaagccuguuugcauguguggcucuggguguuaagugucacuuucucucuguuacuugguaaacuuauggccuaugucaguuucuucaugaaaucguuccugacucccccaacccccaauacucauuacugaguaugucaccauggaucuuaauuuacaucucaucucuccuccaccaugaucccuacaggucugagugugagcaagacucuugucuugguuacauuuacacacuuucuguaauguauaggaguuagagucucaagaaauaagcuucaagcaaaccaguugcuggcuuaguuguuucuuuucuuuucuuuuuuccgagacaggguuucucuguguacauuggcuguccuggaacucgcucuguagaccaggcuggcccugaacuuagaaauccaccugccucccucugccucccaagugcuaggaucaaaggcaugcgccaccacguccauuucuugaaucuguuuuuugaguuuuacuuuuuuauucuuuaagauuuauuuauuuauuuuauguaugugaguacacuucagcugaacagaugguugugagccuucaugugguuguugggaauugaauuuuaggaucucugcuugcuccagucagccccgcucacucccgucaauccugcucucucaguuccugcucacucuggcugaaagacuuauuuauuauauguaaguacacuguagcugucuucaaaugcuccagaagaggacaucagaucccauuacagaugguugugagucaucaugugguugcuggaauuugaacucaggaccuuuggaagagcagucagugcucuuacccacugagccaucucuccagcccugcuuuuuuauucuuaauuuacugcuuugccuuuuggaaaguagguaacuagcuuuuugagaagugucuguagagucugugugaagccuugagaagaaaauuaggaauacaguauuaacauuguuuugcuuuugaaugagguauuuggaucuguauuuuuagcuguacuuugcauggucacaggcauuaguggaaggcaacugucaguacuuagaagguaauuuauuuacaauacuuagccaugaccuacuacuuuuaaguuauuugauacuagauucuuuuuauuuuucuucuucugucuacagugguggaauucucuagucuuuguuucguuuuugauaugcugagaaucaaacccaggacauuggcagguacugggcaaguguuguguuucugagcuauauggaucauauaaucaucuaucuugacuaucauaguucuuaggaaguuaggugagaugcuuuaauacaucuuuaaaucuuguuuuaaaaauauauuuggcacauuucagcuagaauuguccucuugaccaaacaacaucucccuggaauuuucuuauacuuggauguuagaaauguuaccauaugauguauuuguucugcauuuuugauacaaggucucacuauguaacccugguuguccuauaacuugcuuugggaucacaggcauguagcaccaugucugguugagaggcuaaaauuuugagaacuaguucagccuuccaggguuugagcgagagccccuuaaagcugugagccagcuuuuuuuauggguccguuuuagagaugcagaaaacaaaaacaugauaaaugauuuuuagggcaguucugagagaugauaugcuggguagauaggcucugagcucugccuuaacuuuguauucacaaaguagugcuuugaggauguaguuuuuuuuuuuuuuuuaugauuuuuguaugaguaugcaugucuggugagaaauuaaauaagcuauaauuguucaggucucuauuguuuuagaggguccaggcuuacucuuagacauuuaguggaacauagaaauccaucucuugcuuacuuaguaucuuccagagacuugaguuccuaaagauauuuaucuccuuugauguguguguguguguguguguguguguguguaugaauuuugaucuaguacucagggugcucucucucuguuuuugcuagauugaaagauauuaaugugaaaauaggucuccacuuagcuggggguggugauaaaaaacaccuuugaggcaggcagaucucuguaaguuugaggacagucuagucuacauagcaaguuccagaccagccaggauugagaccaugucucaaaggggaaaagaaaaguacauuucuauuuaguacauuuuuugcugugccaaggaaugauaaacaagcuuuguuguauauguaggcaguuuggguggcauugaacagacuugccuuuuuccucaccaaacauccugauaaaccauuucgaaauauggcuccauuguguauaagcaucuggacaagcuggaguacugacauguaauagugcgcuuggagagggacaguugggugugugucaugucugccaggaaagagcuuuuaugucuuauuacauuguaaauuuugauucuccugcauacagauuuuaguuuaguuuaguuuuuuauuuauuuagauuucauggaucaguaaaauaguaucaaguuuaccuugucauuuaaaaugacaagguuuuacuauuucauauuuuaaaaauaacagguugcaaagcacuuuuacaguaguuuaguuuuguaugcuugucaccuugguguaaaaguaauuuaaauuuuaacauuggcauuuuuagagacagaacagucuguuuagacuaguauuagaaauaaggaaaugcuaaggucuuuuucaucagucuggacucaaaaaucucuuuuuuucauuuguuuuuaguauuacuuuaagaaaaaucuggucuauuaaguuauguacauguaaguggacaguuuaguuuuuauguggucaucuuguaaauuuuggguaagaaguuugagagugccagcaaauuucuguuucaaguugaaugcccugacaagauucagccgcugcucagguuuuaaaaaauuaugaacaugcauugacaagcacugaagguguauaguaauauuacaaugagacuaggcaguaguaaucaguccuugaugacauauuuuacacauuucccuaguguacaguucugagagaugauaugcuggguagauaggcuuggagcuuagccguaauuuuauauucacaaaguagugcuuugaggauguaguuuuuaugauuuuuguaugaguaagcauacgauccaaaaccugggugaaagaugcucaaggaagacggaguagaaugucuuccagugggaucaaguugucaggcuuugacaagaacaggacauuucaugagcaguaaugcuuuuugcauaaaugaggugaauucucaccaggaaagagugcccaagauaugauccuguuguaagagauguaaaguagagccuguaagccuuaguaaguuuuagcaggauguaugaggagugggcaguguuuuccaugaagaggccuuggaaaaaugucuagaucugacagaacuggcaucagucuguguuagagaaaauuauauuggaggacaaauauaaaaugaccugauuugcaucuccugagaguaaugaaaacauuuauuauuauauauaggguuuuaauuuugugguauuaggucaucgguguuccuuagaacuuagugguguuuucauguuuaauaaggaccccuuguguaguaguucagcaacuguuacugugggccccacaccauuaugcuuguacuguauucagccuucaugggucuuguggugcaugcuuuagagacacuguaggauggagagaacagccauguuaauuaaguuggucucagggacaugaugcuugccuagguucugaagggugaguuggcuuucauaaaaugggggagagugguaggguaauccucuguaguucuuaauggaauuuugggaucacauauagauuagcugaagguacgaugcagucaucaucuaagaggcuuuuucuuuuuaaaaucuuuaacuucggagcuuuggacucacaaaccaauuuuuaaauggucccugcucccucucccccuuaaauagugggagugauuaaaucucuguuucaagcaauuuuagauucuacaucugacaauuaaaauuacaaaauccauaguauaucuuucagucuugaaggauuguauuaucucuguuggacaaauuauuuugugcuaauguuagcaaagguuuuguuaaggaguuuuaaauuugguaguuuuuaucuuuccgagaacuuacugugauacauaaaaggcaaaaacacaauucaaacuuuauauauaaguggaaagaacacacuuuaaguuuggggcacaaaauaugaauguuauuuaacauaacauaacauaacauaacauaacauaacaggauagucagcuguccugugacuuaaccucuccaaauuucaguuuucuaauuuuucaaaugaaggcaagcaacuguuaccucauagaguuaccucauagaguugaagaaaggacugaaaguuccuaugcuacuuuugucuguuuuuuuauuuuguuuuuuuguuuuuugguuuuuggguuuuuuuggaaguacuuguuacauugaagaauuuucugaaacagaugugaacuagcuacaauuacuuuagauuguaacuaaacuguauugaguccucaguaguaaacaagaagaauacagucuuacuuuuaugcucuugacaaaauuuuucuccugcuaggaauuuuguuuagaugacacuugaugaccugagauguguagucuuugaggaaguacauuuuaauuuaauuuuagcauugcucacucugaagcacuuugcgcaauucagggcacauagaagauguggaaaaaguuucuaauguuguugacuugugucaggagauaguauauauacccauuugaaaugaaggauauuauuuggaaagauucuacacuuagaagauagguucauagguucuagcccggcaugguagcgcacgccuuuaaucccagcucagcacuugggaggcagaggcaggcagauuucugaguuccaggccagccuggucuacagagugaguucuaggacagccagggcuacacgaagaaacacuaucucaaaaaaaccaaaccaaaccaaccaaccaaccaaccaaacaaacaaacaaacaagauagguucuagccuuggcucugugacuuucauuagcuauggauuagagcaaauccauuaguauuaguauugaggagccacaguuuaucaguaggguguugccucccaguauugcugauggcaacugggaagggaaggaaagggaagggaagggaagggaagagaagggaauuugguuaacuugaagcagguugaauguaaugugaugaugauuccugaguaaacucuacucagacuaguuuucuuaugugagugacgacugacuguaugacccucauguuauucugugaugcuguuguauucauuuaguuuuaccacucaagaaccuuguuuauuuaaauauccagcagauggacuuuggaagaggaaaauuuagagauuuuuggagaggcagagcuauuuagaaguauucaucuuaguaagccacuugacaguguauguguguuuuuguaugcuaaagugcugguacuuuguguuuuuugcuuuguuuuguuguuuuuggugcugguacuuuguauuugaauguuauuuagcacacaccuuccuucuucuuccuccuuuuuuuuuuccuggacagucgguuucucuguguugcccuggcuguccucgaacucacucuguagcccaggcuggccucgaacucagaaacccgccugccucugccucccaagugcugggauuaaaggcgugugccaccacugcccggcagccuuccuucuugaggaauauauuuucugacuauucuuuggguuauucuaauuuuuuguaacugaauuuguauacuuuaucguuggccacacauuuucuugugcuuguuuuuuuuuuuuuuuuauucccaccccgcagaagccaucauuuacacauagagcauugagccucucagugaggugguuugaaacuauuguguacauuccucauauguauauuaauacauaugaauaauuuauacugccuuuuauucuuaaaucgugaagacuucuuucgggugcugagaguuugggaguauuaaaaauaaauaccauauaagggaaacagaguaguaccaaauagcuguacuagcaaaguaggcagaugagccccagagucuggaaagugacgguuaugaguugagacaggccgccgcuuccacucgggucuuggugagaagcugguuucugugcucauuaggaccuucugauugucucauccuacaguguuagaagaagagauacuaaaacuucagaaacagaaaucucaccagguuuuguuuuauuuauuuauuuagcucagaaagagaauauaaaauaaaaguaaauacgucuaaaauuuauuuauaagauauauuuauaaaacaguauaauuuuaccuguaaauccugaucaagauacaccuuuuuauaauuuugauaguuuuuuucuuuuucuuuuguuuuucugagacaggguuucucuguguagcccuggcuguccuggaacucacucuguagaccaggcuggccuggaacucagaaaucugccugccucccucugccucccaagggcugggcugggauuaaaggcgugugucaccaugcccggcuuaauuuugauaguuuugcuaaugacugucggugugcccaaacaucuguuuauguagauccuauuuagucaaagaaaagauuauuggacacacuuuucuuuuuuaaaaagguuaaaaggcuuuuuguuuaauucauggauauuaacuagaaauuaauucuuuggauaguuuaaggcccacaguauauuauuaacaaugagguuuaauuuuuaauuguauaugccagccuaggauaaauaaucucuauguuaaagcguuaagacauaaaauguuauuuuaaaaaauuguauuuuuugugagucaggaaaagaauacauuuccaaacuucaagcuuucagguugacaguuugaaguguccuuauauauuuucuccuggagaggcugauuuggaguugugugguuuacuuuuaaagagaaguuuguaauuccucugucucauaagguuagaaguuuagaggucuuuuuuuuugggggggguaugggcagagguguguuauugcuucauuaugaauugauaacuauucugcauugauuuuuaaaauuuuacauaguguaaauaacugaggucagugcugaagaagccauagaauaaaguaaugauggcagcacuucuccuagaggagguggaagggaaggauuggaagagaggagaaguagacucucucccaaggggcaacuuaguuguuuagugggcaagcaguguuuguuaccaccaaguaugugugggugcuguagucuuguuuuuccugccugauuauauaauacaggguaauauaggcaauuuggaaaaugaguuaagaggaguaaauaauguaugugcagcauugaacacacuccgcagcgugcauguguguauuauaccuuagauaagguacaucacuuacaccuuaagaaauguagcuaacauuuccccagggcaucucuuuucccuuuagcacucacuguugagcgagcuccccuuauuccagaaugccgggguucugaagugcuugugauucuguguuuggaguacuaacacagacuugagcaauugagcaucuuuuauuagaaaagccuaacaugaaaguuagucauuaccuucaaguuuuugcccugcaguguacaacuggaucauacguuuagggaccaaguaguuuauuuagcauuguuuagguauuugaagugcuggggaucaaaucaaaggcuucccacaugcuaggcagguauucucuacuguggagccauagaccacaacccugaagcggucuuaugcacugauggauggguuugaaaccucagaaggacccaaaaguaauuuuuugacuguaugaaagguuuuuugacaaaguuuuuaauaucguccugacaucaauuuuaucaauucauaucauaccaacuauguaugaauugccuacugaauaugguuguauaaaguuauccuaaauuuuaaaacauaaauuuuaaauucaccuuuuuaaauuguuugaauuuuaaauacggucuuuuuccuccuugugcucuucagcuucaccaacagagcauaaccacacugggcuguaacccagcccugcuuccugcugagagagggagcuaagccauaugugauaucacacaaauauguacugaaguuaauauacagaaacacuucuccaacauugcucaagugguuuuaaugggaaaacuuaacuuuauagaaauuuaaagaacauuuuugaguaguuuucuguaucaacuauuaaugcaaaauauagugaagacaguagaugcuaaaaucagaauccaguuuuuauuauuaagcuuaggguuuuuggagggcuuuaaagccaguuugauaccugcuuguauuuggaaugagugacuugcuuuguaggguuaggucaaggccaagugacuuaacucuguguuacuaguuuauuaauucauuugauaaauauuauuuuaacuccuuuucuuugucagauacuguucuaauagaauauaagggugcacagcauagacuguggugguugguggucaaguuaugaagcaaaagaaaucaaaggucuauggaggauguauggcuaacaggccaguuuuccucucagagggugaauggggaagccuguggugaaggagugguuuuguauuuauccaagugaaagaccuuuuaggaagggacagcaacgaagaacagauaaccguaccacaggaguagucuagaugucuuacgauuaaaaaaaaaaagaaucacaagacuuauugaaguguaguaagagaggaagagaccgauuagauaguacugggaaaacuggggacuagcaggugaaagaccuguaagccucuguaaagaccuuggcuucucuaugaguaaaauaaucuuacaucuccucuuuauaguuaguugucuacaaaguuaguugaauucuuaguuucacaguuagcuaaggauucuacuggaacuagcagaaauauuccuccguuuuuaaugggguucuguaucagcaagucuaaguugaaagcauuaagucagaaaugcauuuaagacacuuaaucuacugcgcauccuaguuuaguucucugccacauauuagcucuuuaguacugugaggccaugacuggcugggaacugccccugggcuguugccagagaacacuguagaacauguugccugggaaagauuaaaagucagauuuuggagcaugccuuuugguauaaugugugcacuuuuagaccauugugaaguaagaaaagaaacugcacaauagaaaggguucaaacaaagaagcaagauauaaugcgauuaaaaauuguaguaauuguauguguguauguauguguguguguguuuauguauguauguauaaaacauuuuagaguccauaccugauuuaaaucccauacugagaaauuacagguuaguaaagaaacuaggugauuaaauuaaaauuuaaacuacgaguaccaaguagacaaagcaauuuagugcugauuucugacaaaauuaccauucuaaagcuuuuuaaagaugaaguuaguguuauguaaggauauaguaagaugucuuuguacagguucuuaagcucacggcuucuaacucauaauccuuagggacugauguuuuuaguuuuauauuaaauuucuuaagggaguuuacaaauuauaucuggcauuauuuaaaugaucuuuuauguguucuuacacauuuauauauaccuguguaaauaucgcuguggcucauauacugaaccuuucugucaccucuuaagcugacugagucggcaguacucauucauaagcuaggaaaucaguacuuugcuccuaguugcugggaauuaguuuuguuuuaagaggcuucaaacagaugaaguuguagcugauauauucuuucaugucugaccuuuugcuuaacaaacuuuuuuuuaauuaauauuauuccauauuguacucacucacuuaacguuggauugcauuuuguuaguacuguuuuaacuagucccugaaaugcuuuucaaaugaguuucuguuugaagcaguaaauacuuggaaaaaaaaaaacuuuaaaaaaagucagaaguauguuaaaauaucuaggcuuuguguuacuacaccuaacaguuaugcguaaguuaugagaaagggauuggguaguaaaaaguguacaagggggcuggugagauggcucaguggguaagagcacccgacugcucuucugaagguccagaguucaaagcccagcaaccacaugguggcucacaaccauccguaaggagaucugacucccucuucuggagugucugaagacagcuacaguguacuuacauauaauagauaaauaaaucuuaaaaaaaaaaaguguacaagguuuauagcauagauguauucacacaaagauaauuuuucuucccaguggauuauuuuggcauuuuuuccaaaaugaauugaauaugaacgugaagguuuauauuaaccaucaauucuauuuuacuguacucuuacguaugcuaguaucuuuugcuuccaugcuacaagcuugaaaacugaaaaugaaaauucuccaacuuuguccuuuuucuagauuguuuuggucaauauaucuuuugaauuuccaucugacucuuaggauucgcuugucugcuuuugccgaggagccagcugcuguauaacuuguagcucauugugguguauugccacuucucaucuuuagacuugggugacuuucguugauauaguuuuuuaauuucuuuccauuauuuuguacagcuuucacaguauaauuuuuguguaugaaauuuaaguauuuuacucucugaugcuugggaaauggaauugcuuguuuucuuuaugggguucguuauugcugcaugaaaaugugauuuuuuauauauugguuuauaugccuuguaccccauugaacguccucauuuaagccauuuugauaaguuaaagauuaugaaaauccacacugcuaugaaacugcuauaaaaucauuauucuagugagcgccuuaggauuuuuuguagaucuaauaaugucaucugcaacuagaggcuuucaccuccucuccagacucagcacuucuuauuucauuuuguugccuaacgauucugucuaggaucuucaguacaagaucacauguaguggcaagaguggacagccucaucucugcucuuagaaggaaaacauucacuauuucaccguucauuaugcuucuauguuuuuuuuaaaccauaacuuuaaagaagcacauuguuuauuuguuuguuuauuuguguaugugggcacaccuaagccuucaggcucaugugcagauuagagcacaacuuuccugccauagggaccuuuucaaacuuggcucuucaggcuuagugguaagcacuaccccucaccccccacccccacucaaaccuaucucugccuuccguucguaaauacuuuuuacugauuuggggaugucccuuuuggauggaaauuuuuuguuguugguuugguuuuaggucugguuucgauuuuaaaaaguggaucuuguguccaccgagggugucccuucaccgccuuugcuuuacaaguguuaggguuguaguuguauauccuuuaaugaugugcgaguuuugucccuuauuuaaaaaugcacauuaaauugcacaauauuguauguugagcaaguccugucucugggauaaccccaucucauuuauugcucauauuacgucguaguuguaguuucuuuccaugucauggcaguggccgucuugacgguagugaugcuagugagaagguuucuggcuagucguuuguuuugaauaguuugaagugaaacuaaguuuuuucuuccagucuaucacucaagccuucugggcgcgugccuucccucuugaaaauuuucuguuguuaaugcggucucuuuacuugugaugggucuaguuuugacugucuuauuucuuuugucaauuuugauagccugauaauguuuuaguaauuuguccauuuccucaaguuucauaguuugcuagcuugagccccuuucuuuaccuuucucuugucaacucuguuaccuuuuuucuuuguuuuuguuuuuuuuaaauguugaauuagguguuuguuugcuuauuuguuugguagaacugggauuugaacguggggauugaaucuuagucuuuacacguugggcaaacaccccuuuaugaagcuauaucuucagccuucucuuacuuuuuuuuaaauugaagcaagguuucauucgguugcucagagugaccaugaacucacugccuagucuagaaaggccuuuaguaugucugggccuccucagaacuggagucagagucguccucaaggaaacuucucuuuguaauagacagaaaccacuacagaaaggcacagcucgucaaaguggaaagcuguggaaucagucccaauggcuaccucaaagcacucccugaccuaaggcucagggaacauuuuagaagaugggacagaaagauugacuguaagagcuuuccuccagugggguugugucucccgguaagguugaagcuacaauacucaccaacaugacugccuccacaugagcugagaagggcagcaacaauagacaugcaaagucugccagacacagaacuacaagucaccaaggaaugccgagagagagagagagagagagagagagagagagagagagagagagagagugugugugugugugugugugugugugugugugagaguguuaguuuucuccaggaagagcgcacuaauuggcucccaauaccagauggucagccgugaaaacauacaugugaguaguguuauauagacugagcagguuguauuuaggaaauauauauguguauauauuuguacacauguaugcacauaguagcaauugaugaaagaagaagccaugaaguugaaagggcaaggaggggggaugugggaauguuggagggaugaaagggaagaggaaaguguuuguaauuauauuacgauuugacaaaauaggaaaauuaaggacucuucuauccaaaaagcaaccacuaggccugacuuaagaucuuuuugaaagauaauuauuugaugggguguugucauuauuucuaagccuuuauuuaauggguccccugaauuacuggccauauuuaugaggguuacuuggaagucucuguugagugacacugggcugcuuuuuaccuuguguauuacucucuauacuuguggucuguggagggccagguauugaguauauggcagcaucucugcacacacugcuccucuuuucugggcuucucacugcuuuaauggcuuugcugugcuauuucgaugaaauuguauauauuuugcauuggaaagaauuugaugucauacucuggaggauaaagccuuggagauauuggcguggcuaagaugacagugauuucuuuuaacagugaaaucugugugucuuucacuuguaggucuguagaauuucuugguaucacacccagguaucuaucuucacuaguugugcuaauuacgcuguuggcuuugaugguucucaagagguguguauugucugucugauugaaguuuggccccuguaaugggcuuuuucuuuuuaccgcugcccagucuuugguguuugaacccaagaaggcucuuacuagcuaucugucccccuaauuuucuuuauaguaaaccaacugaccuugaguucuaguccuuuaaguugccaccaugcucuguguuuuugaguguacuguaggcuugaauuucccccacacuucuuuccaguugaguuaauuucuuuugaggaguuucaaagcucucugcuuuucuagaaucugaaccaguauacaggccuaugccuauuuggcuccuguggugugaguggguggguugaaggcagguggaguguauguaaagacaugccucuucauguaugucaaggcuauucaaagaccguggagaggcaggaguaagaaagucuguucaccucuuuuuggggaaguauaaaauagaauugcacuuaucccugccuagcuucaaaugaaugagaaucaaacuaugauuuauuuauuaggcucugcaaaauuacuggggauuacccauaaucuaauucucuaauacuagucuggcuacuuccccaacucugcuccccaaaugcucgcuguuugaaucuugcuagguuauuucuguucgagcaaucugguguucuggggaggcaguucacucuggcacuugauguuggccagucaagacuuauggagaccucccagucuuucuucucucacucacuccguuuuccuucuccacccucacccaugucccuacccaggacccccagcggaguagcugaaaacccgccuacuucuauucuccccaguagucagcuguugccuuuuuuuuuuuuuuuuaccacugguuuuaaacuugggagcaagguuugcacaacaaaagcugguguuugcacaacaaaagcuugucuugcagccaccagaucuugggguacagauuuagcauuugaauacuuuagcagcaccugaccaaccuccuguagggaaguacuuuguacacaggggagugaaaagagaguuaguagauggucugcgguaauuauguggcuaguuucuuuugcuauauucauuacaaugacacaugagagaacuauuucuuuguuuaaaaaaauuuuuuuugaauaaugacuuuuuuccauuaauugaaauuuaaauauuaaaugagccucguuucucugaagaccuccuuggcauuuuguuuaguuuuaugugcagacauuuuguugaucuuuuuuguguaucugcuccauagguguauuuauuuguaucugaauuuuucaucaucauuuagugucuuugguuugguguaaacaugauaaaaaugagguauuagcuccuuauuugcuuuguggauacauuguaucuuuaaauaucuuauacacccuugagacuccuugagccuaggaggguagugguuguuuucuuagucaauuaaauaauauuagcagaugcaagacuguucagacucuuaccagugaaccuaaaggacaaagccaucucauuuaaauugucuauuuguaagaguucuuguauuucuuauccuucuuuuggugccugggggcucaggagucauguauuuucugcauuccuaauauugauauuucugacuuguuagucuaccuaaggugcauuuauuuuugucuauuuaaagcuaagcucuagaugcuguuuucuugcuaguuuaacuuguuuuagugugguggcccccgacccccaucuuuaucauucccucuauacuugcuuuggauguauuacgccaucuuaguuuuaggaggugugaacuuugaugguuggcuugaucugucuuuuaaauauaagcacuuaaaauuguacauuuccacaaaguaugaguuuaccugcauuucacauuuguuauguuuuuaauuauugaucuguuuauucugucuuucauuaugacuuauccucuguauacccuagguguauuucuuuguuuggucuuuuagagauugauuuaggaauuacuuugcuuuuggaaguuaguuaacuaaagcugugcauucaucagaagacauccuuuuuacauauucaguucuuuaaaauuuaucauuaaaaaauaauauacaacgccuuuaaucccagcacucacuugggaggcagaggcaggcgauuucugaguucgaggccagccuggucuacaaagugaguuccaggacagccagggcuauacagagaaacccugucucgaaaaaccaaaauaaaauaaaauaaaaauaaaaaaauaauauacauuagugugaucagaauuucugccccaccucccacuccccacacccagcuuccuagucauuguaauccccauggaaagaauugcagaugacacauaggugccuagaccaauggggaacaugcgcuuagcaggauugagaguggacacugaccuaaggguucaaguuguagccugcacacugcacaccgcaguacaaacagcuuuccccaggagcuuuauucaguccacgugguugacaguuugauuuggauuuguccuuuaucagaaggccuagggcuguaaguaaucuuaagguuuugauagauaucuagugaccuuaagggcaguucagaaugucacuucuccuggguuagagguaugauucaaauuucacucuucugugguacugggagucugcaggucaguccuugguuuuaccagcugaugcuuaugugguacggcccauccccaguagccuccacgcuugccagggucuaacucgauaccugaugugaacggggcuguuaguuuaguugagugguguagaacacuugcuaugcccacagucuuugauaaaguccucagcaaacgcgcaugcaugaacucagauacacacacuuuuuuuuuuuuuuuuuugguaauuuauaguauucuuuaaauaucuuguacaugguaguguauggcuuuucuauuucugauuucuguuuauguggccuauuauaacugagaagaauauugaauaaucaauuguaaaguuguauguguuaguuucuaguuucagagcuacuauuuuagauagcuugaagcucuuguuaguuacauagaagacuaugucuugggcucaguuggagaggugcuuaaggaccugaauuugaucccuaaaacccauaguguuuuguuuuguuuguuuuguuuugucuaaagccaggugcagugaugcaggcuuguaaucucaaugcuggagacaagugcuuuucuggggcugcuaguuggucagccagccuagccugccucuugaguuuuaggcuaguuagagacugcguuccuccuaaacagggaaguauucucuuucuugcucaaagaugauauagucuggauuuugagccagaaaucucuugauucuauuuuaccuggcugccacuaguuaguuauauauuauuuaauuuuuuagauuuuuuuuaaaguuuauuuuuuauuuauaugaguacacuguagcugucuucagaacacacacuagaagagggcaucagaucccauuacagaugguugugagccaccaugugguugcugggauugagcucaggaccucuggcagagcagucucuuaacagcugagccauugaaacaagauguuuguguucugagaguuauccccgaguugucuuauuguaaagauuuuaaaccuuuuguuucuugaaugggucuuguguaaaacaugcagacucuucauaugugcaagauaaauaugcuucugaaaguucuauuacauuagaauauugguuuaaaaauagugauuguauauucagagguguuuuaucacaaagucuaaugaaacauuguaauguuuaugcuaauacugguguuaagugauaguuugagauuugaagcagcugaacugauuggauauaucugaguuucaguggugaaaaaaaaugacaguugaagacagcuguuagcacugugggcuuuuuagcuguguuucaguuaaguaaauaccacauuuccguuagugccuuaggaaaauaaagguguaaguucuccuuugccccuuaguaagucaguuacugacaaggaagguaggauuacucuuggacuauauugguuauuauuucuucuuuucuucuucuucuucuucuuccuucuuccuucuuccuucuuccuucuuccuuccuucuucuucuucuccuccuccuccuccuccuccuccuccuucuccuccuucuccuccuucuccuccuccuccuucuccuccuucuccuccuucuccuccuucuccuccuccuccuucuccuccccuccuccuucuccuccuccuccuccuccccuccuccuucuccuccuccuccuccccuccuccuucuccuccuccuccuccccuccuccuucuccuccuccuccuccuccuccuuuuuguuuuuuguuuuuuguuuuuuguuuuuucgagacauguauugcccuggcugucuuggaacucacuuuguagaccaggcuggccucgaacucagaaauccaccugccucugccuccccaagugcugggauucaaggcgugugccaccacgcccggcuuugguuauuuauucuuaaaugauauggggaauagaagaaaggaacaacaguaguauucacaaggucaacgagauugaggagccaaccggaagaucuguauggccuggcagcuguuacgauaaggagggaaaaaaguggagucugguauuuaaaccuuuaagguauucauuuuuaagugaauuaaaauuggaaaacuugaaaggaaaaucuagucuucucagaaagccugguccuaugucagaauaucaagggcaguaaaaagacuuuuuaagauuuuuuuaaaaauuauuuucaguaaccaauuuuuaaaaguaacuuucugauugcuguucuuacucuugccauauaaaauguuaguauugcauuccuuuuaaggaaaauauuguuuggugcaguugcagucaguauucaguguaauuugugguucauuaauucagcaaaguauuuaugcaaugugugauguuuuugguuauugaaacaagaccggcaagcacaauagacagagccucuguacaggacuuagauagauauuaaggcugugcagacaaaacaacugcacacaacucagacauuggauggucggggcaggccuuugugaagacggacaacuaaggagaaaggucagugcuaggaaggugcuuggcauugaaaaacugagcugagaucauugggacagcaacaacugcagagacccugaguuaaauaaagacugccguggaggagagugcagcaaggaugaccuccucuucuuccuccccuuccccuucucucccuccuccuccuuccuuucuucucuuuucccgcuuuucuucuuccacaugucauuaucucugccuacacucuuuguucucucacuugucacuacacuuauuuugguuuaauagaccucugucuacacuguucuuugaucccugagcugcccauguuugagggauccagccucaacugccugacauuucugcuuauuuauugccuccucuaucuucacuaucaaaaccaguuugcaugucuucuccugcuucaaccucugaccucuccuuucauaucugugcuuucagcugauagcuuuguuuuguauuuuagcagaaaagguaguaagcagaguuuugcaguacauuuccaauaaugucuacuuacuuaaauuuacuccugcuuaacuuucuuguagcaauauacccugugucuaagucuagucucuaagacauuccacccacauuucaaaaaaaucauguggauucuauccugccaucaguucuuucuaugguuauuuuacuguugcugggauaaaacgccauggccaagggaugaguccauuaguugugucagggaggcauggcagaaagcagcaggugugggggcuagagcaggaugcucagagcucacauccuguauuauaagcacagagagugagcuggaaaugaaaugagucuuuaaacucacaaagccuggcugcagggacauauuucccccaacaaggccacaccuuugauauuuccacaaacagugccacuaagugggaaccaaugaugagauuuaugagccugugggggacauuuccauucaugguaccacauccacucuaucagacuuuugugucuuacaaacuccacuuuagcuauucuuucagccauuccuuaguucucuugcucuuaguuucucuguuccuacuccuugugacccugcucuguagcaccgcuucaguccauuguccgaccaaaaguauugcuaugaagugaccaucaaaugucuucugugcaguuaaauauguagguuaauacucaaguuacuuauucuuaaugaagaacuuuggaaaccguugcuuuucuucaagcugguuacccaguuuuaagaauaacuacacagcugucuuucuuuaguguugcuggaaccagagcacaugguuucuguccucaucuaccgugaggaagagaggcacacccagggugugcagguuguuuaaacuuaaagcagcuuuaaguaguagggacgcuacagaggggcuucucccuugccgcacauuccagugcauuaauuugcaagcaacgagguucagaaaggguuggcauuuucucauuuaaguuugguaggacaucuuuguuguguuucauuuuauuugaguacaguuugaguauuuugaaaugcugagccuguuaaauacauaaaucugaauauuaguugaccaaaauuucuuaaaauauuugugauagaacuauauaguuagauuaaaaggauaucaggaaagcuaccacugcagagauacaaacacuaaaguuaugaaacauuaaauuaugauaaccagacaauaauuugauuuaaagggaacauuguugguuaauucuggcuuuucuuugucaguaaaagcaaccuuucauuuuacauauuaauaauuggccuuugaaaucugaauuacuagauauuuagaaaacauuuucaguguugcaguuuugcuagacuugauaugcugcaacuaaaauucagcuuuucuuuugucugaugauguuuuuguauguacuacuuagucaucaauuuggauuuugaaaauauuuaucuguauaggcuauaaauuagucgugacaacaaggaaacuuaacuuuuugagaaagaguucuugaugaauaccccauguaacuguauaugguucauuucaacugucaacuugaugaaauguagacucaccuuggagguggaccucugaguuugugaaguaccauguggguagugggaaucggacuggaguccucugagagcugccgaagcucuuaaccacggagcuauuucuccagccuccucugagcacgcuuauguuuuaauuauguuaauugagaugaacccuuccccuggacagggaucucugcuguugacuuuuggauauaaugugaccagcucucucaagccuuagaggugacuuccuugcagagaugaacuauaaccuagaauugugagccaaauagcccuuucuccuuuaaauugcuuuuugucagguucuuaacauagcaaccaggugaugucuauuuuugauguuaagguguguuucuuaaugcagcagagggaugaaucacauuuuuuaucuguuuugguuugucugcgccguauuauuggagaauugagagcaucagugcugagagauaucugaucagugcuuugguggugcugguguguucauaaagugugagcuucccucuuuugucugggguuauuuauucuguucuuucuugggugugguuaaacuuucaguaguaaauuuucuuguagcaccuuuguaaggccagauauguagauagugcucaaauuugguuuuaucacggaaugucuuauuuucuucaucuauuguaauuaaaaguuuugcuggguagaguguucuggacuggcaucgguggucuauuagagucuguagaccaucuguccaggcccuacuggauuuuagagucuccauugagaugucagauguuaauuuuaauaggucugccuuuuuauauuuuacuuggucuuuuuucuugcagcuuuuacuauuucuuuguuuagguuuuuuguuguuguuguucuuuuguuuuccccaggaauuucuuuucugguccaauauacuuuuauguuccauauguuuauacuucgauauguagcuccuuuagguuaggggaauuuucuucuaugauuuuucugaaaguauuuucucuguuuuugaucuggguuucuucuuccuguauuccuacuguuuuugauuuggucuuuucgucaugucccauauauccuggauauuuugugucuucucaguucuuaagcugauuuaguuauuuccuucugcuguuugugcuuucauggguauuuuuuuaaagggacuuauucuuuuucucugucaggaccucugucauauucacagaggcucuucuaagguacucgucuugcacugcagcuguguuucaguacucggggccugcugugguaggguugcugggcucugguggagaccucccguccuggcugucacugauugugcuuuuagaauggcaucuaagcuguaguucuaagugcugauaucuggacuuuguuaguugggugcuuuguucuuugguuucuguuucucacacucucugguucuugggaaaauguguagaccguauguuuccagauauuuuuaugggauccugcuagguguggccacuaggggguuccaggucaaauguguuucuagguguagguagcugacacuuaggaaugggaaacaacuaggagguggagaggaagguugaggggggucacaggagggaggaaagcaggguguuccaucaugaucugcuuagucccuugggaaugagcacagagaauaaacagaggccacagcagaaggucugcuauagagcugggauuagaauggggauuggauguggagaauggagugagcagugaaucuuguuuucuaucuguuuugguuugucugugccauuuuauuggagaauugagagcauuaaugcugauaucugcaguuagccugucugcuuagagccugcagguucccaggcaguaacuauuggaguuccgggcugggauauagccauaguaggacgaaggaaguuuggagguuugugagccacaggaggugggcuugggauggggguuggagguguaggacucuacuagggaggaugcagaggugguuuucuauagagcuagagaugagauuggaggagauucuaccuguuugccagguuaguguggccuguggcuucucaaggaguuucagucugaauucauucucauagaacgaugcauugaagauuuguccauguugccuaaauuaguaguuccuuuuuauuguugaauagcauuucaucauugaaauaaucauuuuagcauuuacuaagaauacuacccuuauuaauaugagcauucacguacugguuuugaugugaacacaaaguucaaucugauaaaucccuaggagauaaaaugauggagcuauaagaagccaaugucuagccuuucauuacuaaaacugucuucuaaauugacuacuuucguuuuuaaaaggugucuuaguugaauuuuagagcucucugaugguaauucuuuucuuucuguucuuaaaaugcugcuagaagucagugggggccgucuuccaggugucugucuuacucuggcccugggcugcuccacuuuauaucaggagguuuugucauaguaucagacagaccuugcaucgacauguuuauuugaaaaccuagauuauauuuagugauaccugcuuuaacauccuugcguaguaauuccaccauuugucuaauugcuauauuuauuuucacguguucuauuucagcuucuuaugaguuagagguuuugguaagugcuguauacuugcuguugguucuauuaugcuagucugucaguuuggucaugcacuguuguacugcuugaggaugcagauauguuacuuagaaucgggccagucuucuuugaguuaggugucuccagaguguuuuucuaaagcuuacuugauuugaugguugaaacucuccuucuuuaccuucugaacuugaaaccucagaggccuugaggauugcuuccacuguugacguuuucagaagacuuuucucuagacugaggcuuuuucaucuguagauacaaaucaccacuuaaaucuauuaaauucccauuaaagauauucucuguucggauccuuggguucuuuauugcugaagccuuggucuauauuuacccugcagguucuaguugccugucuccccugucuaacuuggaacuuguguagccucuuaagaaccuugaacucugcuuggcguccgcucugcccuccuacaaugaucugggagcacugacagaggucacuucauugauucuguucucuucauguccggaaguaacuggugcuuacaugucaaaguggccguuucauauauuuuguuugguuuaaaguagaugaauagagccagucuuuuugguuuuguuuuuuuuuuucguggaagauaaucucugcuuaauagaaaauuucccuguaguuuggcaaacacauacuuuuaugacuuuaaacuauuuauagggcuuugugggcaaacagccugcacaccugcuuuaggagcaguggcauccugcuccugguuguccccuuucacagacagucuuagguacauauguguaaugugcauugcggauuaguucuuuccccaugucagcuaucaccacaguacauuaaucaguauaacacaggaugaagauaguggugacaaauguuccuuuuucauacuugcuaagaauuuauuaaaguauuacuuagcauauacauuuuuaucauaauuguccuuuuuuguauaaguaagaugugcuauuuaaguuaccuugcuuaauuuuagauuuuaaacacaucuuuugauuaaaauuugcacaguaugaaaguguacuacuauaugggauuuuaccuaaacaaaaucuuuuuguuguuuuuuuuuuuuuuguuuuguuuuguuuuuuuuuuuuuuguuuuguuuuuuuuuuuuuuuuuugcuuuuucgagacaggguuucuuuguguagcccuggcuguccuggaacucacucuguagaccaggcuggccucgaacucagaaaucugccugccucugcuucucaagugcugggauuaaaggcguggaccaccacugccccccggcuuaaaauauuuuuaaggagaaaagcauucuuauucuauaacuagugacucaacuuuuagauuauuguccacuggauucaguuagcauuaaaguaagauagaucuuaucuuaaaacuuuuuuuuuuuauauuuuuauuagguauuuuccucauuuacauuuccaaugcuaucccaaaagucccccauacccucccccccccacuccccuacccacccacucccacuuuuuggcccuggcauuccccuguacugggacauauaaaguuugcaaguccaaugggcaucucuuugcagugauggccgacuaggccaucuuuugauacauaugcagcuagagucaagagcuccgggguacugguuaguucauaauguuguuccaccuauaggauugcagaucccuuuagcuccuuggguacuuucucuagcuccuccauugggggcccugugauccauccaauaacugacugugagcauccacuucaguguuugcuaggcuccggcauagucucacaagagagagcuauaucuggguccuuucagcaaaaucuugcuagugugugcaauggugucagcguuuggaagcugacuaugggauggauccccggauauggcaguuucuagaugguccauccuuucgucacagcuccaaacuuugucucuguaacuccuuccauggguguuuuguucccaauucuaagaaggggcaaaguguccacacuuuggucuucguuauuuaauacuauuguacacuaacauuacaaacaagaguacugguuaggagcuauauaaugaaaaaaaauugugauagccaagccaaauauguguuacacuauuguuauggggcauccaguucacuucauaauuuugucuuuagaauacccuaauuucugacucaagaauguaggucuaugguagagugguugcccagcauuuacaaggcuuuguucacuguuaagcacagcauaaauuaaauaauaaacacaaauaauuuaaaugaugacuauacacacacacacacacacacacacacacacacacacacacuaaugguuauuauauggagucuuuuuaaauacuuugucaguaauguuagugaccaagccaucucagccagccaacagguucuccagggcaggaaugaggauaaaaagagacgacaauuagacaacacuguagccugaccccagccaguucugaggcugaggcagguugacuuuuuuccagucugccugaagccuacuucuuuguucuagccccaaaucagauuccugccugagcuuacuuccuguccuggcccaaugucagauuccuaccaaggggcccaaaagcucuccacauguuaguuuuucauuuaaaaauuauucucuuaguggauugugucaauguauauauauuuguaauccuucguauuuguccuuuuuaguaacacuugugugagauuucuguuguuguuuuuaaauugcuggccuuauugauuaccaguaacugcuuuugcagaggacuuggguuucguuacuggugccccucucacauggcucacaucaccuguaacuccagcccuaggggaccugguguucuguucccaugaucacaaaccuguucacguacauacgugcuuauacauaauuuuaaaaauacauaaaaauuuagagaguuuguauaugggguuaauguauguauuuaguguguggguguggaaagugucuuuaggagccacauggaguuuccgcaguuagaguugcugucauugaaccugcagguuauugauuggcuaugcugcuugccaggucagugagcggcagggaucugcuugucugccccucuuccacccaaggcuccuuccuacauggggucuagggauggaaacagguccuaagucuugcacaguaggcuccuuaucuacuaagcccucuccauagccuuuaccuaaccgaugcauuauaaaguagaugcuuuuagcaucucauccucauguacauuucauaugauaguaaauauguuuuuuaaaaauuugaauguagaauuauaacggauagcaacauuauuuaguagcuauauauacuacuauucaagguaaauguuuuauacuauuaaggcuauuuguacugaaaugugucuuauacauucuuuguagaacuaucuuuaaaucuuugaacuuuuugaauuuuaauuuuuauuuuugaaacagcaugauaauucuuaucucaguuucauuuuuuaaccugacauguacagugcauauuuauuuuguagguauuuacccagguuaagaaguaaacaucauuaaaaauccuuuccccccagugucaaaaagugaauccuauuguaaugugcaugaaauugguguugcaguuaggcugauagaacacugaauuggguuuuuaaucuaauaauuguuuuaaaaauaccauauauuuacauccuuuagcguggaaauaaucuuugugagcgacaugaaucaauacauauauagcuuacauuccuagcaucugaguauaggcaguggggugggccaucuaguuaaugauugaauuugaauuaacuggucauuuggagaauaaccagagaauauuuaagacacacaaaaaagcuuggggucagggggugggugguuguuguuguuguuuucuuguuuuuuuuuuguuuuuguucaucuauguuucuuccuguuguguguaaugucugguauugugacaaaguaguggaagcaggugugaacgaacaguuuucauaucugauaaucucuaccucagagcccagugcuaguugccugcucucaauaccuagggggagaaugggacagagucuaagacaguuagcugcuuuuuagguuuguucucauuguauuuugugugcuauguugaauauuuuuguuaauguuauguauauuuacauguuaguaauuuugauggcuuuuggauaauuccacucuagagggagaacuggugggcgguccuuccugugacacgacccuugagugacaguucuauuugauugccuccaguacugugaggaaaggacacgacucuauggugaggacugauggacauacauuaucugagaaaagaaacuaccagguaagauuuuuuucccucccuuuucuccauuugucauaaguguauugagcuguuuuaaaguaauauaaaauuguaacuaacaguaaauacaaucuccugaaaauuugugguauaaguuuaaauauuacauaauggaauugacagcuugaaauaauugugaauguuuuacaaaaugacauguuuauaauguauauuuuuaacaccagaacaauuuucugacauaugccaaaauuuuggauuaucugauauauaauauaugauuuuuggcuggauucaaaggcaguaguucauaaaguauuuuacacacauuccugaaagaaggaaauguaaauuuuggguuauaguuucuauaauagagugauagagaaauguacauagcauugaguaggcuauagaagaaauauaaauggaaucuaggaauaugugacccagauccuguuuugucacuaauaugcuguccuuacaacaucagauucuuguuucgcuccuuacuuaacacuucuuaacacuauccaaucuuaauuauguaggaaugcucaaaagguaauggaacuguaacauuccuauuucuuccugagcuuucaaaagaagguaaacuuuaaagguaguguuauuaaagugauuuuuuuuuuaaaaaacagaacagguaguguuugaaguuaaguucuaaauggaaacuuacuucauaucauuggauagugaauccaaugaaguaauauuaaauacugaguaaguucauacaggaauaagccguuagacuuccugggcagccgugguuccaccccguugcucccucucaccucaggcgguuguccuuugagacuaagacagcuacugugacacaccagcuacucacaggcucauuugguggagugcaauuaacccuuucuuuccaugcacugaggcuugagcaguggagagaacugaaagugaguuuaugcugugucagccaagagccuuugguuauaagacuuggguucugucuuguaguaccauccccaauagaagaugcuucuguaucuaaccuuccuagagcuuuugucuaacuugauugaugaaguuucuggccagaucuuuauuauuuuaauaagccagaguaagcugcgauuaugcuggaucaguucucccuauaacacuucucugauuuguacucauagacuggacuagccucugcuaaugacuaauugugcuugcuauauagcucuuccuaccucagaaccacuuccagcagcuuguacuuguaagacuuugauugguuacacuuuuugggguuuuacaucuuuguuagguuuugcucaaucacuacaagaauauuguaauuauggguuguguggcauuuuagugcucacaaacauacuugcagacugugaguauagagcuuuuguuugauuuacacauuagcuaauuugugucauggaacaauauucauauacacuucuagaauuuauacuuaugaaaggaauaaagcaguuauauuuugccaaaagaguuucuuauuucugcuuauacuacuagaaaagugcuuuauucuagucucaauaugcaaauaauaaaaguuuuugagcuugcaugaagauacuuucuugacuagacuuuugcuggaugaaauaauuuuccacuugccuuuuacuguuacauagugguguccaguguauauugaaacaucuuuggaaauaggucuggaucguaaaauuauuucauuuugaaaacuccucugaaaaggacauaugcauggaagacugguuucauaucuagcauuaacaugaauguauugagaguguaugggacagucacauaauguugaaucaccaaaguaaaaaacuguauguuuuaguagcucuuaggagcuuguauauucuaaagugaaaguaauuuggaguuuauaaguuuuuauuuuauaagaauuucguucuuuucauuguuaaaguagacuucuuugugucuauauaacuucauuuauuugagaccuuuugguuuuguuucuuuaagcaucuugauaacugacuaauauuugagauuaacaaaaaauauuucuccaaauuucauuuccauauagaccuuauagacuuucaguuacacaggaguugaaauacuuauuuuuguaguaguauuaacuucguauguuuugucugucaguaagccuaguuaggcauuugaauauagcagaugaaguuuguuugcauaaauaaauuaguuucggaaggcaguccuuuaugaaagggucgucaagcuuuuuauaagaaaguagacauuaugucaguuuuagauuuuuuucuauauucuuccuauaauuuacauuaauuuugccacagcuaugcacauacauaaauuuaaaucaucuuaauuaucacuguaauucaucaauggcuuucucuaauacucaagcucuaaacauggcaccugcuugacuucuugguugcguuuuuaugcccucaauaccucuucucuaacugccuuugcuggguuugacuauuuaguaauuaaaagcugcuuuaacgcuccaugugccuuguaccccaagcuuuuaauaauuuggaucucaugccucaguaauuugauuucuauuuuuucagaagcuuccuuaauggacucaggacuauuuuucuguugcuucaaguccucugcuugcaguuaguguuggccuuagcacagagcagccaucuguuuucuuuuauuucccguacacuguucguuccauagauaggagcuaccaauggcugcuuaaacucaguuauguuaaauaauauuaaauuuuuauuuugcugaccaugcaagccacauuuuaaauguuuaguguauacugcuaguggcuccuuuacugacaacugcaggacagugcaucuguguggacacagucagcuuguggaagacugcagccacguucgcuuauucuggcaccaccagugucuaaugugguaccugcucuauggggagauguucagugaauauuguuugaauaaaauuccagugaaaaccugagaggaagaaacagggaaaugugcuggcagucuacuggugagauucccaagguuuuuauaccgaaugcaaacuuccuuucauuuagcuuguagcuuuuagcaauaaauuaauuuuuuuccucauaaaaaauguugaaggaaaacacuaagucccauaugaacguugaccauccuaaccuuuuucuucagugcuuuugcuuuguaaucuuugguuguuuuuuuuuuuuuuuuuaacaaauauguauuuucagcuuguuauauuuauggagauauugccauaucucauuucuuguuuuauuuuucagaaguaaucauuaauuugaguuuggcauuucacucguucuuauguguaauuuuuacuauguguguagguuuugauauuacaggcacaucuuucuuucuaggaguguuuugauaaguuaucccuuacauuccacuguuuugaguaggaaaaauaagcuuuuagcccaguuaaccuucagacacuuugucaagguaaacacguaacacuugguagucuaaaguacaaguuaaucuacuuaguaaccauguaaggagucgggaaggaguguuucuaccugguaaguucuaagcauuacuguacacagacuagcauuuuauacugcagggaaauggaaguguaagcuguggaagcacccagcuucacuuuuauaagucaguaugaaaagucuguaugcaggccacagcaucuuaggguaguugauguuucagagucauaguuguacuaguuagcuugggaccuccuuuggguacuuguaauguguuuagaaacacaaacauuugugcaucuuugacuaugucagauauugauaaguagugaauaucagaaaccacuuagaaaaauuuguagggauuuuuuuuaagcgaguacuuagcagucgauccgugguagaguauuauuauucucugggauaauagaggcuuuaguaggcuuuaguccuuguugcuguuugguguagaaugaagguaaguaagaguaagcagaugaaaaauugaaucacacacacacacaagacuuaaucuagagaacuauuucauaauauucucuuagcucuugaacaucuuguuaacaaugggaccuaaguauuguccuuggucagagacacaaagcagugggauaaaacucaaaaugaugacuuuaugcuuggcuucuuugcauguguuagagcugcuaauggaggggugcagaacaauaagaaacgccagcaguguaaggcugcuugcuguuucugccacagccacuguuucccuaucagaagccacuuggaauuuauaaccuagauuguaaaguaaagcuugguagguuuuucuccaccugacccacuuucccauguuucccuggcuuacuaacaucagguucagugacuucccaaguuccucaagguuggcccgcugcuacauuaugcuagccuuccuuuguguucaugcaaaugcaguuuuccuucugaaaucauaaaaugacugcaagguuguuuucuuaaauuguuuuuauuauauuuguuuaauccugcaugcuuguugcaugcgugcacacacauaccauaaugcaugugugguggaggucaggggacagcuugccagaguugauucuuuccuuuuaaccugcuccagguuauugcacucaggcuguguggcaagugucucuacccacugagccaucucaacugccgcacaacauuuguuuucuagaaaacauguuuacuuguaauaaaaugcauguuguggcccacccuugguguguguauguguguagguguggguguuaaauagggaccaaaauauucugcuaaguaugucuguuugggcaaacaucuuacagugguaguuuaaauaguaucagauaccauuucguuucuuaagauuaaaaguaucagguggcauaccuuguauucguuuugugacuguggcuuccuuuugggaauuuagacccuaugcuuugcuaaauagccacaccaaaucccauuaaaauguuuauaauaaaauuggugugauagcaucuuuagaagccccaggaugaaugcagaggaaaacaaucaaaaccccucauuuauccauuuuuuuuuguaguuaaaaaaaaguugacguaaaagcagcucagugcugaucaguuguagaacggacacaguguuuagcagaugaucacuggguagugugaguagauugacaucagaauagauuuccccccucagaucugucacauagcuguaagagauccagggaagguuagaguaaauggugcagccuagcuuguuaccugccacgagaagacucuaagugccccucaccuuuaaagacuggcaucagaguagugcagaaugugcacaacagcuugggaagagaggcucucagaaacgugcagagagaacagagccagcagcgucucagaagacaagcugugcauuuuucaaacauugaaugaaaauaauaaaagagacuuuaugaagcuagggaaguuaucugauaaaucaauacuccaaauucuugaauagucaguuucuaagagaucuucuaggaguacguuugagaguauaccaguuuugaguucauccacacaauuaggauuuguuggacauuaacugucacaauccauuaagcuaguguuugagacacauuacccuauauugagaauagacauaguuucacauagucuucuaaagauuuuaaauucucccuuucaaguuuaacuuuaaaucugucugaaauugacuguaugaguuaggaauucaguaucuucuccccccagucagcuccgcuguaacuaaccacaaccugccuucugucugucagaagugauguuguuugugguuacucugauaacuuuguccaugccuguaaaugauguucuguuuucaaguugucauauuuauguuugguauuuaugcuauuaaccuuggucucagucuuaacuuugauaauucacucugugacacauuuugaauauuuuaaaagacuccuccaacuuaaaaaaaaauccaaguuaaugaguggaauuggucugacucuggguuggagagagugauccuuucacaauuuucuuccuaucugggaauucuuuauuuuucucaaauucuuacuuuuuaaacaaaacuuuaaauucacucauauuuacacuuaaauacuuugauuucugguuguaaaugguauagcaaaagagucuauuguauagauguuacuauuaaucagaauagccgauuuuuuaaaauuagguuuuauauccaucacgguugcaaaacuuuuauucuuaaaauuuaucaguaguuuuguguuuucauagaagugucauuuggaaaugaugguuucauuuugugacuagcauugugaauugcccgguucuucugauaacucacugagagcgguuguugggaaguagucuuucucuguuuguugcuuaccuuaaggggggcuuuagguggucaccauuuugaggaugcuggugugguguuuuauagagacauauauugauguggcagagaauuguugcaaggguauuucauugguuuccccugcuuccugcccaccuggacaguuauugaucauaaguugucucuguuguuugugagacagcuuaucacuaucuagcccuguuggccucggguaagcaucaggcuucccucguuaccuuccuuccaguuuuccugcagucccuuuguugcuaggacguacguauaguuaguaugaugccaguuacugguuuauaaguucaaaauguuuugggguucucuauuuuucuauuucccuuccauguucagcaguccauuaauuuuggaaauguuaauuuuuacuguuuugcucauguauuccgaucugagaaugcuacugacacgagguugaaacccuaaauaaguaguggaguguggccagguguuguuaagagcucagugccugcugggcugacgcacacacacacaugcuuguugucugggguugacuacaagcucacgguuaaguaacuaccuugcccuugcaucucuguuacauacuuucauuauuuauugcuugagggggagaauuuuggguuuuugcuuuuccauauccauaauuugauacuuuggcuucuuucuuuuuccucuauuuucuaccuuucuugucuauucuuuuuccuuuucucuuuauucucccccauuucuuucacuuuacccuucucauguuuuguuugggguauccuuuucuuacuuuuacuuagaugcauuucuggugaugaugaaauauguuaggguucauccugugugugaaaaucuauuuuacucucauuuaaaaaauauuuuugcucaguaagaaauugaaaauugguaguuucucuuuuagcaucuuagaaauaggaugccagccaggcaugguagcacagaccuguaauuccagugcuugggacugaaccagguagauggagaguguuagguguaccugugcuguacgaccugaucaauucgccaaccaaacaacauuuaaaaauggcacuccacuaucuucugacuuauuucuagugaaaaaaaagugguugguguauaucuuucucucuuuggauacuauuaaggauuaaggacauuguuuguuuuauuauauuuaauguaugguuuugguucugacauaauucaugacuccagugcuugggauuuuuguuuguuuguuucuuucuuuggguuuuguuauguuuguuuguuuguuuguuuguucauuuugguccucccucaaauguucuuuauacucuguucuauggaacucaauuacuuacaugcagaguugaccugaaagucucccuccauuucccaacuuaguacucuucucccuugccuuuucucgagacaggguuucucuguauaucccuggcuguccuggaacucacuuuguagaucagacuguccucgaacucagaaauccuccugccuccugccuccugccuccuccugccuccuccugcugccccccgcugcccccugcccccugccuccugagugauuaaaggcgugcgccaccacgccaacuuugccuguuuucuuaagugagucuuugagcccugcauuuucaugcucugacuuagcaugcugguuagucuucuguugucacuguccacuaauucugccaucugucucauuggagucaauagaacauuucuguugauuuuuggagauuucccugcauguucuccacucugacugacuucacugcugcuuggcaugguugugcgccccccccaccccuccauagcuuuguuuuguugucuuauauauuuuuuaguauuuguguuaaaauucuugagguuuacuggggaugggguuauauuauccuugugagaccuuucucuugucucugucucuaccuuuuuaaaaaccauucaagagaaacaauagauuuuagguagggcugguuuucuucaacuacaaagcuaguauuuuuccuugaguuaguguuuccugcucuggcuucugggaacauaagugacauuuacuccaguggcagguagccguaggaucgcuuucucuuucuuucacgugguucucucccuaccuuuuauggcuuguuuccaugcuugcugaucuugacugcauugaagacuuaugggaaccgucuccaguuuuccugagcuguuucucugugcaacucauccugucuagcucuuuagccugcuuucuuugauggcuuagacuacccugacugagcucuaaucuucugauuugggaacucuacccaccaggcucccuccucaugagagccugaaagcucauugagucagcuaggaagguugguuguugccccaugccugagaacuauugcuagaauauuuucucuacuuuuuuuuuuaaagcgagagacgggccuugaccuaccaauauucuugucucuguauuuuauccauuuuaaaacuguuugugagaagaaauuuuuccuuuuaguccauccuagcuggacuggaaguuugaauauuucauucuuugacaugacaaauucguugagaagcuaaaugaaucauucugaauaguaggaauaagauuuuguguuaaugcuuuugauucagaugcuuucuguuguaaaagacaacauauaauaugcaauucaaaauugucacaccagaucugaacacuuaaaaauaccuuuuggaaagaaacauacuacagauugacaaauaaaauccaaguugucauguccugaucuauuuaaccuaaagcaaaaaaccagaccauuuucuuugaauuuucccauucuauauacucuaguauauauaauaggcucauaaacaguugucauuugcucuccuggcugaaguuaacaguguuucuuaauuuuuaauugauuuagucuugcauauauuacauugggaccacaguuucuuuuccuuccugaaguucuacuuuuuaauaaaaaucagauuuuuuuuuucaaggaaaaacuguaaaggccauauuucagacaagaaguacuaagguguggaguuugaaaucuuuucuguccgaugacaguccugugguaaugcuuuaaagguaugcuagguagaguaagugugccaguccucucaucucugcuggugucuguggccugccuguguggggucaucuacaauguugagauuuaagagugagagccucuaaagauacuuggcuuacuuuacaaaagcacucacuuuaacaaauguagcgagaggggugguuaguagcagggacacagcaugcauggguggacgacauccuuaguggaaaguccucugaacaccauugcuugucaccaugaugauguuauccuguaugccuuaaaugcuuugaaauucuaauucaaagguaaaagcuauaagagaaaaccuaugugagauuaagugccucuuuucccguuugucucaaauaaaauugcaguuuacucuuuaauuacaccucaagguuuguuugcuuucaguacaaaacaguaucauauacaaaugauaugcagauauauauauauauauauauauuuuuuuuaaugcugaaguaguaguuaacaguagagaaagcugguugauggaccaauuuaaucaaggucaaggcuaacaccaccuggaauaaauguuagcaucauacauuagcauauuggaaacacaagaagggcauaacacuuuugugaugaugaagcauucaaaugcauauuuuagucaaaaucaggagacauuuuccaguauauaugacauggcauugguauuaugaaagacauaaggacuagguaacacaaaauaacagcaacaauaaccaaguaaaacuuaaugaaaguagacaagugguugaacaacugaaguaggugaagcuggcucuauuugugggguucuccucuaagugucacaucuuuacacugggauguuccugugugugagcagccaaaggagagcaguguagcaggggcauaggaggaggggaggagcagcaaagggcaggcaggccacaggccaggggcccgccugccugucagcgcugcucuacugccucguauuuguaggguccucuguuuuguagaaagaaugcugaagugugguaugcaucgucuagaacuugacauugcagaugcugaauaaucauuugcuaaaugaauuuaugugaccaaauauuuagauuaauuuuaaaccaucuuuccugauugaaugaaugcuacacauuuuuaacugcacuacaccuaauccaggauucugaugcagcuaucuaccuaucuaccuaucuaucuaucuaucuaucuaucuaucuaucuaucuaucuaucuaucuaucuaaauacaagaauuuuagaauaacaugaucuucagugauagccauauuaucauuuugaauuugaaguagcacacauauaauagaaugcauuuaucucuaaaucauuuagcuucuauauuauuaaacaaauauacacaugugagugacaauguaaauuuuuacuaggaugggguauaguucagugauaaagcacuugccuagcgugugcuggguucagucucuagcacucauucccccaagugaguagauuuauuauuuaaaaaucucaucuucugucaucagauugcuuuaaaaugcuggugucaauuuacagugacuucccuacagccucugcagugcuggggcuacaggugugcaccaccucacccaccuuaauacuuaacauuuuauuauuugauuaaagugacucucugguggacagguccuuauuuguuucuuuaucaacauagaagcacuugaggaauuaauuucuucccaaagaauauaauuaaaccaaaaggucucucauuuuuaagaguucacugguucugucuguguaauccaacuuucauucuguugacugauggugcuaacgugacgagagcagagaguuaauguugaguacucaagagaacaagaguauguaaggaguggcuaggcagcauacuugaacauacucuacuagcaugauuucaugaaggccagguaagcccuauccuugcauauuuugggaaaguguucagagcuuugcccuuuuuagguuguuuuaauaaguauuuugaagcagucugaaagaugauucugggguugggaauaugaagagauaaacggagucauaauguugauacuggacauucagaucuuuauagcaugauuuccuuauuuuucaaagagcagaagaaucccaucguuuaucauguucugguuggacuccuuucuuaucguuugcuggaguuugaacuucagagcuauggugucaacccugcuguaauaucucaggggagcuccuaguguggggcuggugccauggcucacccuccaaccuuuccuucuucacuucagccuccagcucugagcuuucccauccccagaguagcaaauguugaaagaaguugcacagguaaguagaugcgggaaagcugggcucaacagugcucucuuauucauugguguuuugaggguggguggggccaucuugccagugagucauuuuguuuagaaaugguuuuuuuuuuuuuuugucuuuucuucauaaagcuaugguguaaauuauuagauaaaagucuaauguugaaaaaggaagcuaagaaaacaggaaagacaaauucacagaccacuaguuuguccuacaagucugaugccucaagugugugcugucuuuccuggggcguuaaccagguagcugugguuugacuccccacaagagaaauuccaaacaugcuuucuuugcaaucgugacaggaggccugggacauucugccauucaggguuugaaauauuaacaaaaguaaguagggugcagugcaguuacagcauggcaucuacacacaggucagcaaaugcuuuucccuguauucauauuuguucccuguaaguccuagcuugugaugugcaccuccuugagcacacagacguuugaaauuaaacccaggaaaacaaauucuuccucagaccuaggggaguugaaguauuuucuagguguuacgaucuuuaaauugcuaacuuucucaaugguuucucucuguuaaguucuaaaguuuuacuuuuucugagagccauguagggacacauaucccucagcaaagcauuagauuaguuuccucauuccuuuuaagaaaugccuuaacauucuugaaacagaacagcuuuuguugaguagaggguuugucguguauucuaaacgcagaagcuuuucugcugugaacuuguucucucauuuauauuuuauaguuuuaacucuguguuuaagauggaaguacuggcuguccuaggagguuucaaauccgcuucuuacagugcugguuacgagaugauucuuuacuggguagauggaccacaccuuuucucccauagauuaacauuauuauaugacguagagcuuugguuauagaauguauauuuaguguuuuaugauuugaauuugaaccuguauaaggcuuauugauaaguaaaaauugaagaacauguaaaaaaagaaacacaagaugaauuuauucacuuugagucaugaccaaauuuucggaggacgcauuuugguuaaugcuuucuggagcacaugcaguucucuggcagagcugguuggaaaugcuguccagaaagcgcugcagacccuagacgccaagucucagaugcagaagacugucucuuuucaccuuugcguucagacauuggacacuuuccauucguauuauuuauucaaaaauauacagacucuuucucaaacccuugggaaggacuauuaaggcacggcauguucuccgaaacacugaaucgcgaguguuugcaggcccuggguuuaaaacccuuguccaucuccugucucuucccuuguccauccuguccccugucucuucccuugucuacccugucccccgucucuucccuuguccacccuguccccugucucuucccuuguccauccucucccccaucucuucccuuguccauucuguccccugucucuucccuuguccauccuguccccugucucuucccuugucuacccuguccccugucucuucccuuguccacccuguccccugucucuucccuuguccauccuguccccugucucuucccuuguccauccuguccccugucucuucccuuguccauccuguccccugucucuucccuuguccauccuguccccugucucuucccuuguccauccuguccccugucucuucccuugucuacccuguccccugucucuucccuuguccacccuguccccugucucuucccuuguucaucuccugucucgucccuuguccauccuguccccugucucuucccuuguccauccuguccccugucucuucccuuguccauccuguccccugucucuucccuuguccauccuguccccugucucuucccuuguccauccuguccccugucucuucucuuguccauccugucuccugucucuucccuuguccaucuuguccccugugucuucccugcccgcaucagcauuuacuugcccacugucacuuacugaacagucacauugucagcuuugauuucuaggcuauucaugugcauuagaaauuagaacugauuuuuggcugaaauuugggaggggguucucagaaauuaguagaacuauuuauaauaauugagaaucaacauagcugguugaaaaucucaguuauguugcuaaguaaaaaaaucucuuagauuacaauauuacaauauugcaaccguacaauauuucacaugguuuuaaugaccuggaauuuaggcaccccugcaguaagauuuaaccugacagacuccccauggauaguuuccaaugcuaauuaauacuuccugguaaaguuggauaaauuuguuguuguuuguauaccuuuucccuacuugguagacaggagacaaccuguguguuuguggagaguauugaacugacaaagaagguuaaauucuguauuaucaauuaaaguaacuugccaacauaccccauaaaugcuaagaaaggggcagguuugccguucucuccacacccugagcacucccagugcaaauuccauaguaggaggaacacaagggugccccggaaacuguggagcaugcuggugcagaugugggcucugccuggcucugcuguuugucggaguuucugguccuugcuggcuuuuugucuguuuugagacaaagccuuucuuuguuaguuaggcaugccaaaaacucaaagccuggugcugcagaaacauccacagagcaggcucagcugccucuuguacuguuauaggauggaugauuuuaugacagcaaaaggaagccauaggagauugccuccacuuucuagaucugucuuaccuauugaucaucaggguuuggauuauuagcuucauaaugaaauuuaguguuugcuuauagucaucuuaauuucuugaaagauuaaauucaauucacucuagaaaguaauauguuaguuuauuugaaacgaagaaaauugguauacguuaauuuuuuuguauuccuuucuacuugaaguucuccuuggguaauauuuuucucacauuuuuuuuccuucacauccucucccuauccccucccucacccuccuauagucccacagugcugagaaucaacccuacaaccuagcaacagccuuagcucagugguuguuugaggauuuuuggucaaauucaggccuccuuuuucugcuuccugaagucuaugcccagcaacaguuacuuuaaauuaaugcgcugcuguuuguucaauuauuuuuaugcuaaaauuaaugugaauuucuuuaaaauagaugugauugguguuguauagauuguugucucugguguauaaucagcccaugguuuugcacaguggucucuguaguaccgugugaucauagcugccuugcuuucuuuguugcucaucgcaaaggaaggaccuuuuuuuguuguugauaauuauguugacacccuuaauauuuuaugaagaaaacacacuauaaaggauaaguuguauuuauguuugauugugggucgacuaaaugcuuaauagauuaggaucaaagccugugugugucguuaucaaaugcauacauagucuagagcagguuacuuaacuuccaguccugaguuuuucuugauaaaaaauaugggaugcuaacuguuugcuagcuuugcauuguaaugaugguacaaauaagcuuugcuuguuugcaacaggucuucacugcguagccccagcuauacagcaacuugccguauaaaccaaccaggcugcucagacuuagagcuccaacugccucugccucuaaaaugcuagggguuagauaugagcaccaccuggcuuuuccugaaucagagcugagaaaagagucauuuuacaauuaggguuauaauagauaacgugcuuucuuuuuacugauuaagaagagcagaccuuguaauuuagcauuaaaauuucaaagaagagugagugagcagugggcaagaacacuugacagccagccacguguacagaggcugggguagaaaggaauuugagcaacugaagguuugcccauaguguaauggugggagggaagacuuuuuugaagagaggucagagagauugauuacagagcuuauuuauuuguugaagaaauuugaucagauucaugaacauaaauuuucauuuaaauugcuuagauggaggaaaguagauuuaaggagaaugaagaacaaauagauaaauaccuguuuggaugcuguuggaguaccuugugcuaguagacuacagcagagagaaaacuguugacguuguagaugcuuagaguaaguaaguguuuggaguuugaguaguguagacuaguugcugagaucacagaggcaggaggaauucgugcugucguuaccuguacucugcccuguugaccuggcacuggagggccugcuuuucucacccagcacuuuccucagaaccuguucugcuugccauagagaaaggguuuuguuuggcuuggaauuuguggguuuuuuuuuugagggggggggggugcuguuuuugaguuaagcuucauguauccaaagcuggccuagaucaaucccagaacuuccugcuucugucucccacggcuuggaauucugugugcugcaacaccugcaggaaucgaaagcuguguuucccaggucucucccugcugagcuuucuccuagggguuugucucugaagcugcucuucucccacuuuacuauaauugguuaaggguuuguucaggcauugcacucauucacguuuccuuagacaggcuuaugaccuuguauuugaauuuccuaguucauucacaaaugugucuaaccagauugucagcuuguucaagacuacagcuuuuauucaagcuuugucauucgucaaguaggguuuuucagaaugcauguaguuucuugaacauuaacuaagauacauguaggaaggaaaaaagcagucaguuagaaagcccugguaccauaaaagcaagacaugcuggaugugaagagaaaauggaagaucaugaguuggugcaucaguuuuaaauuugucuccauugaugaaguuauacuuugggaauacaaaugcuagaaccuuccguuaagauuugagaaagguuuuggaaucauucuguauuuguuaccaggaaagaaucccuuaguccugagaugaucuuuucucagggaucagucacacccaguccagcauuugcguccucuggaucucagggaagaguggucccagagcucuugauggaaggcaggcuguuugcucaguauuguuauucuuuggauauagcuacaccuaggccauccuacuuuuucuauuuccagcucuugcuucugguucuauaugaagccacaaguguauuuucaaguuaaauuuacaaaguaagccgagcaaugguagcgcagaggcaggcagaucucuugaguucgaggccagccuggucuacagagugaguuccaggacagccagggcuacacagagaaacccugucucgaaaaacaacaacaacaaacaagcaaacaaacaaaaaauuuacagaguauuauaguguuauuuuccccaccauuuaaaaaccuuagagccuugccaccaccccuuuucuccaucauagucuuccuuagauaauguugucucugaaauuguugguuagauuaucuaaacuugaagaguuuucaaaaaaauuuuauaauuaugcagacuuacugaggcuggcuuugaauuagugcauguaaaauacuaagaauaccacaggaagggauuugagagauggcucagagguuaagagcacugacugcucaugcagaagucccaaguucaauucccaucaaccacauggugacucucaaacauuuauaauaggaucugaugcccucuucugguaugucugaagacagcuacacucuacucuuauaaauaaaauaaaucuaaaaaaaaaaaaaaaaaaaagacuaucccaggaaugugaauuggguacugugcccuccuaaguaauagcauaguacaguuggacauccacgccagcuuagcgccuccauucugccccagcguaguucucuguacuuucugagacaaagaauucuuuuugaagaaugagcuugguagagaaaauuuaguauaagcuaaccuaucugugugcuuuuaaaaauauauaacuuauuaagucaaaggaaugaugaaaauguuuugauucaaugucucccauaugaggaauauuacauuuugguauauaacaucauuccuaggggaauguuugugcauuuuauaaucuggucugagauucaagaagucagucaguuuguaguguaaguccuugaucaaagaauguagcaauccuuguuucugauauaaagaggaaauguuacuuaauuuaaacuauuuuuuuuuaaaaauacuuacaaaauuuacuuuuuauuuauacaguauagugaggcguuucauuauaacauugacacacacacuuuuucauugacagagugugguuucuagauuccccuuauucucugcagaaaaaaauauuuuucuuuuuaauguuacacguauccacuuauccuuaucugcucuucuucagaguauucagucaucuuuuaucccaucaucucucaccacaucugccuccuuuguagccuuaaccaucguccugcaucaccacuuuccuaacuccuccuccccuuccauccucacacaguccauuuucacacacaacucaggaucaguuguaaacauaugguaaguuauaucacucuucugagccucuucagauaccagaacucuugauuuuuccaucucacauagauaaaauagaaagucugcaggcuuccagcguucuauuugcuauauaguggcuuacugguggauuacuuaaauuccacacaguauggaaugcagccuauaauacaucagucauaccccagagggauuugucucuguauugagggcucuuucuauaagcauugcccuguggcuuuuuauuuucccuccuuuuuuuuuucuuuccauuuuuacuaugcuuacucauuguaaaaaaacauuuugcuauccuggucccucauguguagaaugaaggcccaccuguucuuuaaaauaaaucuagcuuuaagaaaaauaauaccccguccccuuuguauucugccauggaugagaagcucgucaucccugagccuaacucucggcaggguucagcggugauuguuguuaguuugcuguuagugaagucccgucagcggucagucuucucggugacaugugcuuuucccuucucuucucccucugccccacuugucucccuuuauacccgaccccuguacucaguugagaaaaggcagaauugguaggaaauaugcauuccugcauuuuaugggagacauuuuauuuucaugguauuagggugauuuauucuauauaauuucaguuuuggaauuuuaggaauuccaggaauuuuaggaauuuagaacuggccuuaaugauauuauguaaaacauuucacaacaaaguugaccguguauuauuuuaauucauucaugaguauaaguuuaaccuggauguugagcuaugugugcuacaugcuguuacccauguuuacucuuucucagaaguagagcucauuagcaaagguccuguaaagacaguuuuaaguagauuuguaauguuugcaaagcaaauuaaaauaacauauuuacuggaucuaaauuuuuuguaacuguuuauuuuuugaaauuaaacccaggaaaggauguuuuugccuccguauaagaaaaagcaccuagaagucuuauuuaggguuuuacugcuguaaacagacaccaugaucaaggcaacucuuauaaggacagcauuuaauugggacugccuuacagggucagagagucaguccauuaucaaggugggaagcauggcagcauccaggcaggcauggugcagacggagcugagaguucuacaucuccaucugaagccugcuagcagaauacuggcuuccaggcagcuaggacaaggguauugaagcccaggcccacagugacacaccuacuccaaggccacaccuaauagugccacucccucaggcaagcauaggcaaagcaucacaagcauguauggcccuucucugaaaauauguaguuuuuguuugaagagaauaaccuuagcuauagugagugacuaagacauuaaauuugauuugaguguacuuagaaaauauacuuaggggcuggagagauggcucagugguuaagagugguuaagacugcucuuccgaagguccuaaguucaaaucccagcaaccacaugguggcucacaacccuucguaaugagaucugacgcccucuucuggugcaucugaagacagcuacaguguacuuagauauaauaauaaauaaaucuuaaaacaaaaaaaauauauaguuacguuauucaagucucugaacuugaguauaugguaggaguuagaagacauccugaccuaaauuuccucauguggcuagacuaagugacaccuucuuguaaucccagagcucugaggugaggagauugggaauuggagaccagucuggguuguauacugagagcuuagauagaaacaaaacauaaacagaaagccuauauagaaacaauacugaaacagaaagcucauguuggccggcugauaguuuuggaaacuuaaaaaaauugcauagauuuuauagauuuugguauaagcuuauaauuguuaaaguuuuaauaaagacauuagaagcaaaagaauaagcaguaaacaaaacauaaauuuauaccaauaugauaaguuuguuuuguuguaugucuagguaguugugacuugacauaaauuccagaaugccuucccauggugguuaaaaaaugcugcacccccuuaagcccucacacucuucaacguucuaaaguagacauaguauugacacacaguuucauaugugaagacuuggaaauuuuaaaagaaaaaaacccuguguuuggaaaaauuguauuuggagcuauaauuauucaucaauaaguaauuugguuguauguggggccgugaaaauauaccauauagucagauuuguaucuuuaucugagucccaucacccuuaguuaaucuguuucaggaucguagcaguacguacucauuuuguuucuguagggguaaaguaaagccagacuuccaaaauacuacucuugauaaaaguaauauuuuugucuaggugacaaacagcauguuuggugcuucaagaaagaaguuuguagaggggguggacagcgacuaccaugaugagaacauguacuacagccagucuucuauguucccacaucggucagagaaagauguaaguuacgcugucuuuccucagcagcgcugcuguguucccugaaggaggagcgugugagcuccaggggauugucugugcuaagcauagguguagguccuggggacaaacagauaaaccuugcuuugccauggggaccauuaguauccugggcuucuuaaacaguaguaaugcuguuauaggaaguacucacggacaugcgcuaaagacuguaacuuugggguaaucugggauuuuuguuucaugauaaguauuuuuuuuauaauaaagcaaguguacuuacaaaguuaagcgagcacauuuguacgucuuggcuguaauucuugcuugcaaguuaagaauauccuucuccacagcuacagagaccacagucaaaagucuuugguacuguguagauucuacagcauagguaugcuuuggaagaguaguggaucaauaauuccuuccacaugaaagguuauuaaguuuauaggcuauuuuaaaaugaaugaacuuaagucauuucacucuaguuuaucccuucauaaagccaguucuauccugagcuguguaucugcccgacugcucuuuuccuucccgugcuuuauacauuugcuauuuccuaauuucuuuagcaguguucucaguucuguuuuaaauguuuaaaauagugacaaauguccuuuuuaaauuaaagcuaauuauuacuaauucacucaccauuuuucagaaggucaaccuaacuuaacauuaggaaccuaucccauuuccucaggcccagccuuucuucauuauuguuauuugaaaaauuuguuguuuuagaaaugaauaaucaauacuguauuuuccuuccaaauuuugugugcauuggcauuguuuauccuuagugugccuuuuaauaccguauggaguagugccaccuaguuuuauaauguuucuugacuaucacgcuauuucuauuugcugugcauuauauugaaguauuauuuacaugugucugauuuaagaguugauucugaagauuaaaaaguuaggaguauaguugggugguagagcaaguucuuaguaugagcaaagccuuuggcucaauuucuaguguugcaaaaaugguuggguguaauauuugauaguuuuauugcagaaauuauaauuuugugcacuuuacuguggauauguaauaaaagcaacauuuucuagaaaaguguaauggauaugcugauggaaggauguaauuaagaacauaugaagauucaaacugaaauucagaauucagcuuauguagacaaugaauaacaaaaaaaugucucugagggcuagagagaugucucagcaaugaagaucacuggcugcucuuuugagagggcccagcuucuauuccugacacucacauggcaauucacaacaaucuauaauuccuguuucaggaaauccaaugccuuccuuugcucuccuuggcacuucauaccugugguacauagacacacacucaggcaaaauaccuauauucauaaaaauaaauacuuagaaaauaaaacgugucugccuuccaggacuacugugaucuuaaaaucagagucagcauauccacuuuacccagaggcucacauauauuaacacuauuccaacaguugauugucacagaaaugauaauauuuuccuucaggaaauaauagggcuaauuaagaaguaguauaguaggcagaugaagaaugaacucaaaagcuuguuuacuuuacaaagugcuuguauucugacuuugccuguaagcaagauuaucucaaaacuuuuguuucuuugcauggaaaauuguugcuauugcuauuaccuuuuucuuaucacaaacauacaggcugacuguaacuuuuaaaaguauaaauauauagaucaaaagaucucaaaucuaguuaggacuacuucacuguuagaauuauaauuuuauacuucagauauuuucaucagaauucuuacagugaaaauuccuggaacauggugacgucuuucaccagaauguguguaauaacuuuuacucucaucagcauuugcauccuccaugucuuuaagaguaccagcccauaaaucuuggcauauagaccaaaguaguuuauuguuuugauguguaaguuuccuuuuucauugcuguuacagaauaccaaagagaauuaaccuaaggaagagaggauuuauucugacucaacaauugugggagaugacucugucaugucagggaagguauagcaucaggagccaguggugugaggguagagguuggcagcugaucccagcacauucacaaucaggaagcagagcgugaacaacagaaaguggcuauaaaaccucaagauucacuuguagaaaggcuccacucugaggguucuccgaccuuuccaaacagugccauccguugaggaccaagugcucaaacacaugagcccauggcagacaguucacuuucagugugucaaaacaaugugcguguaucaaaguucucuaaauguaaaguacagauguaauacacauugagcaaacggucagugaccacacgcauuugcugccucgcuagugucugugccucccugugcuucucuggugucugugccucccugugcuucucuugugacugugccucccugugcuucucuugugacugugccucccugugcuucucuugugacugugccucccugugcuucucugugucugugccucccugugcuucucugugucugugccucccugugcuucucugugucugugccucccugugcuucucugugucugugccucccugugcuucucugugucugugccucccugugcuucucugugucugugccucccugugcuucucugugucugugccucccugugcuucucugugucugugccucccugugcuucucugugucugugccucccugugcuucucgugugacugugccuccuuguauuucucucauaucugugccuccuugugcuucucuugguaggaucuuggccucuucuuuuauugcaaguaguuuuugcaaauucuccucuuuaguuuauucuuuuuauauuacauaguuauuaaucauuuuauuaaaaugauccuuccucuuuaaaauaucauuaugguuaauaacaaaacauaaaaguuauagauauuaagggaguaccaugugauguuuuaauaugucuacauuuuguaaugguuaaaucagcuuaaaucauuucugcaguuuucauuauuuugaggcuuucuguuuguuuccaugugugcggacuauugaacacggggcccggagaguacuagacaaguccucugccacugagcagcaucucuagccaagggauuuuugaaaacuguuuucugguuuagagaauccuaggacuucccuguagccaggcuuuuacuaguuuauggguucuucuuccacuuccacccuuuuuccauccuuucaacccucuaacgcuagauaagagaaaaaacggauagaaagaaaacggggcuaugucaucuuuagaaauccuuccugcugaguagggccuccaaguuccuuggggcuuguuugaucucugccaucaagguaucugauuucuuccuauuuuucugaacaugacuacuuaaacugugaccaacagugacuaaccaagaacagucaacaacccccaccccuuuuguggcccuagcguuuauaugcccucugaaaaguccccagaauuccaaaugucacacagucgcauuaucaucccugcuagagcacgagacaugguagauaguuagcuguuguggacaauauuugaagcagccccauaucccacaccuagcauuaaaaugaagacauauucuuauaacauuucucuguuuuuuuaagauuuucagaauucuuacuauauuuuccuguuuuacuucauaaccugauucauaacuguuagaaauguacccugauuuaaggugugagcagugagguggcaggcagguccuugucuuuuguggugcuauccaguugucuuuauaccuuuuagauuucacauuguggaccagagaacuuuuuucuuuaaaagccagguaguaacucuuguaggcugagaggcagaaugaaggaugcuacagagcuauaauguuaaaaaacaaagcccaaaacaaacccacucuuaguuaugcaaccuacauaacaagcagugugcuagguuuugaucauagagaguaaguugcuuaucuuugacaguauuuacugaaugacggagugaaacgguccccuuuaguauaucaauguuccugaugcucuugggcauguuuuaaaaucaugcugagucuguaucuagacuacauuagauugaauuguuuuggcucuauagaccauuuuuaaaacguggauaaagucaccuauauuucuuuauaugaagauuuaugucauuagugcacaucaguacuaauuucaauaccaauacugacuuccuuucagaaggaucuuucuugaccaggaguguagcucaguagcagaauauguugcucuuuucauuccagucuuaaggagggcuugugugugugugugcagggucaggggagucuuccuggugggauugaauuuauguguuuacuugugggggucagaggucaaccccaguucuuccuggggagccaucuccuuguuuucugagaccugggcauacagugcaggguaggcagauuggccagcagucacuguguucuacuacccaucacacacucugacaacagugccccccccccccaugccuuucucuucaugugcuugcuagcaucuuugugcagcaagugcuuuaccaccggacugucucugacaucaagucaggcuuuaccacugauguuuucaugcaguguugaauugcucuuugcuguuauauauauugugaauuuuuguauagucaccugcuuuuugcaaaauguuuuuaauugcuuuggugacugaauaugggcuguagaaacccuaauauauuagaguuacauuucagcugcaugauuuacaagcagaguaagcaguuuguauguauauaccucaacuggaacauaggaaaaguagaauauaacuagcucgugguaguguaaagauugaauggauaauuauuaaacauuuaaagaaaaauaacaaguguucuucaggugcucuuaauaugacuauuaguauuaccccacuugguucucuggauuuucagauaauuauguauauccuugcaauuagugacuauuuuguguuauuuguggaaaauuuucagauauaaaaauuaaugagaacauaacaauaaaugaacauaauuuaauuuuuaauaacaauuuguaauagcaaaaaucuggcuggugcuugagugaacguuggcgucagugcagucucccuuaaugacgcuuuuggaggaaaugaugcaacuuugaauuaucucucuacgcagaauuccuuaagccucuaugaugucuacagaaacaauuacaguuauuuuaaauauuaaucuuagacugucgcuuuaaaaagauuaaaaguuuuuuuuuuaauuccaaauuuugguggcgcacaccuuuaaucccagcacuggggaggcagcuagacuacaccuugucugaaauaauuaauuaaacgaaaauuuuucugcuuauucuauucauagagcacaaauauaguaucuccaucugcauaauuuuaaaaguaucuuuauuaacccuuugcuggucaaauuacaagccgguucuuuugaauguccucuuucuaggccuuugauuuuuuuuuuuuuuuuaaagcaugaccuguaagauauaugugauuuccaauagaaugaugaauuugcuauuauaauaccacaucugugguauuguaauagcagugaguagaguuugcuguguacuuaaucccauaaaccauuaugaacucacaccuagcccucagagcacauuagccuacagccuuuacagauaguaauacuuguuuccaugccaguaagaauaguuugucacagucgaguauaaaguaaggauaucucuugugacugucacucucaugauuaguauuaacuacauacaggaguuagaauauuugaaucucugauuauuucuuccccucccucucuccucuugccccauucccuuccccucucuacccuccacucucacuuuuagaacuuucauugaguuuuauauuuaaauacauuaugugagaaggcuccccuuugaucacugucucauacguuaauuuacacugccggcauuguucccauugucuucugaauucucuggguuucuaaacuccauaguacuuggauuauggaaaugauuuagcugguaaaagugccugcugccagugggccugagcaccugaguuuggacccacagaauagagagagccgaucccccacaaauuguugccagacuuccauuugggugcugugggguauguauagccacacauguacacauauguacauaaaauaaauaauaaagaugaaauuguaaacaacuuuauuaaggauaaaugcauaacauguaucauugccugaaauaccugguuauuuuauuuuauuuuuuuaagaauaaugccccaugauuuuguucuauuuauuuauuuauuuauuuauuuauuuauuuuuaaagauuuauuauuuauuauguguaaguacacuguagcugucuucauaugcuccagaagagggcgucagaucucauuucggguggcugugggccacaaugugguugcugggaucugaacucaggaccucuggaagagcagucggugcucauaacugcugagccaucucuccagccccugguuauuauuuaauccacuagaauuuaagcuuauuagcggcaaggauuuuugucuauauaguuagacacaugcuuuuagaaucuauaguaguuaguaaauaauacauugcuuucauugaagaaaaugggaauagauacuguugaaaauuauuggaagauagaauguuaaaaaucuuuaaaaucaucuuauaaacuuuaauagagaauauggucuggguguuuaugucaggguuuuuuuguuuuuguuuuuuguuuuuuuuuugcuuguuugguuuaaaagacagggucauugugugccucagacuagcuugggacacacuauauaagaauaacaagauuaaagaacaaguaguuucuagaauuuauuagcaauccuaucuucaaacaguauuuuaaaguuaaaauguaaaauggagagaaaaugauaggucuaugaagcauccaguuucacuaucuagagaaaauuauaaaauauuuaaucaucaauuaguauuaaguauuucucaauccaaaacaauacaagaaguacuaaguccccaaaugcccaguucuaaaacuuauaacacaucaugacugugauaaaaaauuuuucaguuauucgaauuuuggguuguuucuguugagaaggacacuuggauuuggaguauugaauuaccgaaagaugguuaauccguaauagcaaaguuuuguguguguguaugugcauaugcaugugugugggggggguuggaaguaugauauaaauuggcaaacaguauuuugagagaaaauuugagugacuguguggaaguguccuugccacagacuugauaugagugcauaugaggaaccuuuugauuguagaacccaguccugugucuuccuauaaauguauacuuuagcacuagcggggaaggaacucgauagcaucauauauagaaacuuccacugacauccuuuuuucuuuuuaguaagaacaauuuaauaaucuuaguugucguugagaaauucauuauuuuaccguuuuuaaacauguaagcgcuuacuuuacugucucugauucaaaauugucagcuuuucuaacuuauuaaccauuuuauuucuguguuuucugucccccucccuuccucuugcuuauuuuaguguaauaccucuuccuuguucuuuggcuucuguuuauuagauuuauuugguuuuauuuuuuuaaaccauugcuuuuuaauuuaaauuuuuucuuuuagauuuuuaugcuuguguguuugugcacagauguaugaguaugcuuuuuuggucucauuuuuuuguguagauaagauagagucaaaagcugauaauuuuuuuuuucuugaaauaagaggaacucucaccaucccuuuaaguaaauuagaucagacuuaauuuuaauuuuuuuaauauuuguuagagaaguuuuaucuuaaaauuuuuaauuccaucaccaaacuguguucagugguuuguauguuaaguacuuuuaagcuagcguucugaagccuccaucauaggaaacggugaaagaaaaccaugaguuugaggucagccugcauugcaaggugguguccugacucauaaacaacagccaagguuguagucugaugugcuguugggaaaggggaaaaauaaccggggccacauucuuuucgcugcugcuuuaaguuuucauuguguuguuugacugcacaauauaguccuugagagauguagacacugcauaguauaauuuuaaacugggaacaugauagucugcgugauaguuucaucauucuguagguaauguaacacuaucuuuucccaccuuuuacuguuuuggagaugguaaagcgggggugucuucuuacacugcauucuccacuguaauggcuuucuuggucuuaaguaagauuuuauguucuucggagaaacugguuuuucugauuaacuuuuaccauuucaauacguaacuuucuugaggucuuuuaauaguugauauuuugccaggauucguuucuaauuuucauuaagcuguuguguucgugagaagcacuguuuaaugacuucuguaguaucggugcagaaggugggauuuacugucaugcagugugguugaguguucgccccacagcguccucugcuuuauacugugucucacagguccccagggcucacgcucagcauacacgccauuuacuuauuuauuucuagccuuugugagaaaguacacuaaggugucuguuccuuggcauuaaguauucaguaaguauacauuauaagauguccaugugaagauuuuuauucauaguaaguuauguguuuauauuggccaaugucuuacaugugaaaccucugaaagugccucuuuguuuuauagcuagucauggcaacauucacgauucuuaaccauuguacauagaccuucugucacuagcuacaggguuauuaaaaauguacgucauucauuaacauguggauaaaauauuuauaguuaauaugguaacaguagugccuauugccuaaacagaagaauuuggucauguuuuaaccuauuugacugauuaaagguuauguaguuuaagugcuaauauaauugucuaggauacacacccuggauguaagaaggaauuuuuguuugacauuaaagaagacccuuugggaucuucuccccaacauucuuuuauuucccguuuucauauccuccucucccuccgcgucaacuguuaucucgcagcacuguuucuuaccgugcgcuuugauuauggaauuaacaugacaauuagcuguguacuguuggccuucaucaaguguuaccccuacagaaauugacuaaucaaucaaucaaucccuucaucucugggcagaggggucauuuccagugaugcugcacuucugcuauagcacuugcaguguaauuacauaauguugccucuuuccccacuagauuauaaaccucuugauaucauggcccauguuuugcuuuaaaaaaaaaaaauguuuggaugguuguauaagauggaauaaugaggaacugcuuauauguccucauguauucagcuuaaauaucuguuuauaaauggcacgccugcaucucugucuauaaagaaauacaaaaagaaacagcuuuuuuuuuuuuuuuuuggugaauguaccacagcauugaagaauuuauauucuaccaggcgaguaaguucuuguagcuugaaggcaucguacagcaaguacugacugagaaacucugugcaucagaugacacaucuggggguuauuuguauuuuuacuucuuuauuuugcucugcugaugguuuuucucaacuuacauagcuguaugaauauaaaaaucaacaaguauuuuuacauuauuuuacaacagguugaacuuagaauuuguuuaaauguguagacuaacaucagugucacacauaaauuaagcuaacaaggaguuuagcuuuguaauuuuuuuuuuuuaguagcgucauuuuucuuuuauaagugaaguaauaguguuguuauacuuuaguguaacuuaaaaacccucauaguauuaaguauuucuauuugaacaauuugguuuccucugguugugguagucuuuguaagaaauguuuauguuugacaaacaaggacuuggguugggucuuacauuuaugguaugaaguauagacuuguaagauguucuauaauauucugucuuccuuuaugcucuaauaucauuaauuuguuucuagaugcuggcaucgccaucuacgucaggucagcugucucaauuuggggcaaguuuauacgggcaacaaaguaagaauuuuguacuuauucugggauacuuuauauuuaaggaaaagaggaggauuaauuucuaccuuuguggguuuacagaaggucuuaacagaagauaguuaauuuucaaaauuauauuuuacuuguauagaaaaccucauuauguaaggacuuacuaauucucaauuuguuauuucuugauuauagcauauguuacaauuuauuuugacauuauguauaccuguacauucuuucacaguuccucagaaauuugcuaaacaauuaaaaguagccauucuugugcuuuuaauaagaggaagucaaagauuuuuuuuccuuuuguugguuucauauauuguuuagaacuucaccuguuuauuacuguaagcccauaguuuggcagcaguuugugaaauagcuuuuaugugguagaaauauauuuauuuauuuugcuuugguuuguucugauuauaacaccuaaauuuuuacucauaguucaauuuuuuucuuuacguaagauuuuguuuuauaaaguauuauacuuuuaaagcgcuuagcacagugccuggcgcauaguaagcgcucaauaaauguuagcucuacgucaucacauaaaauuuuauaaaauuaaauuauaaacuuuuuuauuuuuuucaaauuaaguuaccaaaauguuacauauuaauaagauuuuaucaucuuuuuuaguguaaaacaaucugcuuaguucucauuacuguuguuaauggcggcugggauaaaguguucuaauuuaccaucaaauaguagaggauaguaucuaaucacuuuaucaguuucaaguaaaaaucaguuuaguuuggaacuugcccugugugaagagaaccagguuuuuguaagugccagacuaguguguccuaccacucuacccugugcacugaccucaggguuugggcaguggguggggaauccuuauuuuguauaggaaaguguuguuuuccucuuuauuuuccccuugucucuuuuaugguuuucaucuuugcuacaagauaguuuucuaaugcagaauugguaaauauuaauuucauauuuaaacaagaacaucuuuuaaaggguuuuuguuaaaaguugaguuccuuauuuaucuacaaauguuuuuuucuaccugcuuaggcaacauuaaagccuucuauuauuaaguucuucuuaucuucuguauggugugacuuuuaccccuuugggaagccuucuuauacaaauccuuagcuguuuaaagcucucuucuauuucaguacagcaucugcauuagccuguuuucuuuuuaaaguccacaguuuaucauaguagaacgaagaucuaaaauggauaaaacauacauuugaaaaagugggguuguuuuguaacagugauuguaaccgcugucuagaccuugaaguuuuuaagcugcagauaugauaugcuuugggggauggaucugucuggaggauagugacggccuuggcauggcggacguggacugacggcuaacuguaguuugcuuuguuugaugugggaaugcauacaaaaauugaugagugagcaaauuauuuuucuuagaaaaaauaucuuaaagauacuaacuaguuuuaaaagaagccauuuauaccaaacauuuuuguuguugagacuugggaguuucacguguauguuaaaaugugaggggcuaacuuuagugagugauagaaagacuuaacaaaggacuggauuggagauacuauucuuauggcaauugauuauaacucgacagaagauuaguagaacuuaaaaguacuuuuucaccucaguuuacugaugguaacucuguauuuauguuuuacaaauucguuagugauuuacgcuauucaaauguaugcucuaucuggauuuuuauuaucguuuuuuguuugucuuuguggguuuuuuuuuuuuuuuuuuuuuuuugcaacauagucuuauuacacacauucuagccaaucaauaguauaacaaguaaugaaguuccuguuuuucucagugcugacuuguaaugggcggagacaauaaacugugccuucagugugcuaggauuaguguggcuuguuuuuaaauuugggugcuguauauugagcccagccaggccuugcacaugcuaggcaaagcacuuuaacacuuaccuguauacccccaacuuuuugcuuauucuugauuuuuuuuuuuuuuuuaaguuaagaauaaaggaaguaaagaaagaaagauauccuucccagaacuacgacuuugugaaauuaaacagcacgggggcguccuggaauggauauaggaguacuugaaccuacauuuugccagauugggguagaagugauuaugcagucaguguacgagguauccagaaaauacugaauuagagaauuguaugauuucaggccccuagaguaauauaauuguaucacaauuguaaacaugagauccacagaaacccaaggguuuguguggauacugcucagcaguugauaacagccaggaggcauacuguauucaaguugcaugauguuuucuaagugugcuaguaagauuugagucagucuuacagccuuacauauuccugggcccuaaaauuacuggauugaaauagauaaauuuccaggaauccauuucuccuagaucuucauugcauugaaaugaaguagcuguauaguuggaauagucuuuucuuacucggcuaaguauuuacaaucuuggaagugggauaaggaaaaguuuaucuagugucuccuagugugugucuuauauguaggcaguuaguuaaccagcugucucgaugaaccauagacauuugugucuggauucucaaaggccccaggcuacuuggaaacagaaauaagucuuccuaggauuuagaguccugacucguguguggugguauaguaccuaguucuaacugauagacaucugagauugcaauugacuuuguagagcaagagagcauaacugacacgauuuaaaagugaagauccugacguugggaugcccaggcaaaguaacuucuaguugcuuuaggaauugagucuggcgugcuuguuguaugcacuggagagauguauguggauaggaccauucuccuugaugcugugagcuuacuaucuaguaaacacacugcuguuuuuuauugugugucuugauugucuuugugccauuaggacuuuguuuaugagaagcacuuaguagauauuugcuguuauauaaugaagaagauaaguuucucgaacauacuguugguauaugcccuuagauaguuuaaugaugaaacaauuuagggaaugaggaacuuucugguuaucaauuaguuucagcuauuaguaaaguauaaucuuuccuuucauguggauuagagaucaaagagaucauuaagcuuuccuguauaaacuuucuguggaaacucaguuaauuaaacugccucauuuuucuuugacauuaagaucauuuguuggguccuucaacugucaugugcacauuaaaaaugagggggaagcugguauuccaguauuuacuguguguuaaucuucacaacuccaugaaauguuaaggaacuuguaaggucuuguagauggcaagugauggagccaggauuaaguuccuuuguaagaguagugcucugaaucuaacacagugugugaaacccaagagcugaagucaugauccuagugauaguguugccucugcagaucccaagaagcuacugaagguguugugacauuuaugcacucaucauguauuauugaugagggcugcccugaauaacguucuguaccaagacccaaucaauaguauaacaaguaaugaaguuccuguuuuucucagugcugacuuguaaugggcggagacaauaaacacaaccgaggaaacccugcaguucuuguaacaaguaggacaaagccucccagucaggcucaugagaugugugaggaggucaggguuacgugaaucagcaaaaagccucucugucuuaggaauuaagaguuaguguggaacgugaguacugagaauagaaugauaguucccggaaugaguggucgugacugagccuuuugaguauaggaaagcuagggcgcucuaguaagucacuuccugacaaaggagcagucaacaaguccauguaaugaacgagaggacaucagugaauuauccaagggauaucucagaucauaggaagccuuguaaacaucugcuaaagaauucagacugggcuggagagauggcucagagauuaagaucacuuggcugcucuuucagagcccuccaggaucuguucccugcacccacauggcagauuacaaccaucagugacugaggggccagaggauauaacauugucucuggcuuccucaagaacuucuauuuacacgcgucauaaacagacaugaacaggcaaaacaucuuaacacaugaaaaaauaaaggaagaauccggcccauguucuggcccuauguaaggugccagccugaugacccaagcuccaccuuagagcucacgcacagagcaguccuaccguuguccugugaccucugcauacacacaaaggaaaugcauaaauguaaaagaaaagaguaauuugaauacguucugauugcuguuguacaugaauagcaaagguuuuugaugccacuuccucuuuaaccaucacuuugcuuuguagaaagcgggcugaauggggaaggagugagagucaagcaggagcagggaauugggcuagagaccgagaagcaguuggauuuggguaguuuggaaauacaguuuacacagcuuguuauauagcguuuggaaagaaaauugccauauuuacaagauuggagauuuaugugacuggguacuaauuaauaaucuauacuggacauuuagguugggggagcgaacaaaguuugcuuacggaaacguguggcacugcgugcaccaugaaaauugguccugcagagcuucuuuugucugcuauugucugguucacaauagcuuuuuguucuagguuugaguuuugaaagcaguuugcuuuauccauuuucccaucugauacauccuuaauuugcggaaggcauguucuccuguaggucuguaaucagucuucuuccauuucucuuccccuuguuuccuaggcucaucuacccugucaucugccugcauucucauacagcuuggcagacucgccugucaugccaucucuagccacuugacuuugaaacauuaccuccaccauuuauggcccgacuuagaucauggucauuauugcauugauauagucuccaggagacuguuucuagucccaagccugcgaaguauugugcaugcccccaacagggucuuccuuagcccuuagcucuaugauguacucuauaaucuugaucccuguuguuccagggaagggaaggcauucuuagucagagaaugcucaguagugaagguccagggacaaauuugagaagagaggggaauaaaggaggauuauuaaucauacauagaguaucugagcaaugaaauguuaguuaaggcuagaacuuucuucuuugggagccugacagaguuguaaagacuuaaguuguggcucuacuuaauaauauccccaaacccuggcuguaccuuaaaaaacacuuaauggaugguuuaggggcaguaguuccuaaauggguuggaugacccucucacaggagucacauaucagauaugcugcuuaucagguaucuauaucaugacucauaacagcagcaaaauuaugauuaugaaguagaaacaaaaauaauuuuaugguuggggaucugaagaacuguguuaaaggguugcagcuccaagaaggcugagaaucaguggcuuaggguaaagcuucuacuacuaugaguuccccaaacucagaguaaguuacagguuguaaagaagcaaaaguuagcaacuuacucuaaaaaaguggcaaguaaugucaauugugaaaguacuuugaagucggaacaaaaacuggauugauggcuuccugcuuuguuguguaugaucugguuuucaaaagacuuguuuaguuuuuuuauguguauguuuauguggcuguaaguggaugugcucucacauguguguaacuugcagagccagagggugucacaucuauuggaguuggaguuagagguuguuguaagcuccugauugugugugcaugcugagaaccaaaauuaggucguccucucugagagcuguacuaaccccaacaugucucuccaguucugccgcugucauguuaaagagguuaauggcuuauuugacuucuuaguuuauaauaugguggaucucagaaauuuuuuauuuuguucuaaauucuuuuggauuuugugauggaaauaccagaaugaaauaguuuuaccgggaaccuuacuucaugcagggaagguuguagguaaagugauggagcucaagcccugccucagccugugucuuugcuuaguucgggcaugccagggaguuucuacagaagucuaccuccuugguauaauggaaaggaaggccucacacaggugccagguuucaggacuuggugcuguaacugaacuuucucauuagguuauuaauacuguuuggcuguagaaaggacgucuucagaugguacaacuugcuauaaguauuaagacccuggggugaagcugaucucuuaacaaaaagucaugguguguuuauaguuuucaucaguuacgaaaacaguguaugugcauucuuguauuagggcacauuggaagacaguuugcaaacggcaguuuucuuuguaccacuuagauucuaaggauagaauuugggucagggggucaggccuggggacaccuuuaccuacugggccugucaccaacccuguggaaugcuuaaaucaauuuuuuuuuuuuaggauuucugaaaagaggauccaugaagaauuuaauucauuacucagcaucaugucaaaaagagauaggaaucuauuuagaauacguacauuagucuuccugaaagaaguugauucagaacuauaaccuuuuaaaucauauuuguaucuucauuccuuauguguaaaaauuuggguaaaagaauaaaugucuuccuuauaaaauuuguuuagggaaaaaagggcagagauaauuuuggauaggcaguccuugggugucauugugucccccagacacucacaaacacggacuuguccucuuaccuuuugucguucacuuaugccaccaacagucgcuaaggguuuucuguuuguaguguguaugcucuguucuuguccugagauuuuagagaugauuuucuguuauuauuuauaauuagaagauuaaauccccccaaccuguccaguuagucauaguuugacugaguguaauaacuuaguacauuuugucuucuaaaaauaacucuguguacuuucauucaauguuucucuguuuuaaagagcuucaauuuuuaaguaaaauuucagcuaacccuauuaaauauuuaagaauuggugguacaauuuguaacauguauuuucuuuucaucuuucaugaauauuucaauaaaaugaauaaaauuuauuaaauauauucuguuuaaccaagaugaacuuggaggcuaaaauucaaacauauuguccucuuccaccacauagcaauauaaauuaauuagaauuguccagucuucaauugaauaaaacacauuacccauuguuguuuucuuggccagaauauuuacuaguauucagauuauguacaauauuuaaaguaguucaaaaauuagacacuuuucuuacacagucagaaaaauacacauaggggaaguuuuuguuucuguuuuguuuguuuguuuguuuguuuguuugguuugguuuuucgagacaggguuucucuguauagcucugguuguccuggaacucacucuguagcccaggcuggccucgaacucagagauucgccugccucugccucccaagugcugggauuaaaggcgugugccaccacugucccgccauaugggaaguuacuguagacaaaacucagucuuuuuugagggccuacuaauuucuuuaaaagggcaaaaagagugaaauuugaaguuauaacuuagagcgagugaugaaaauaagaagaaugaaaaggaaggaaagggugaagcugaagggagacagacagacagacaggcaggcagacaggaaagagaggauggugggagaggagagagcgagacagccaacaguacagacaaaaggaggcuggaggcagguggaggaaaggucuuacuaggcacucacgauggugguuccuucuguguuguucugcccucu

SEQ ID NO: 5740 - RNA, 4404 nt, Mus musculus
ucccucaaguaggggaacacuucuggcagcuuguguaguuuuuccagucaguagcucuaaccaugucagcaauuauccucuucagcagccgucuguguagacaacacauugaaggaagguucuagaaaccuagcauauacaagacagccaaacaggagcaugcaaagccagguaaggacagcuagugcggcaugagagccucagggaggucacugugagcggcugcuacuacagaugcccggucccucagaggauacuggaccacagccgaccuuaaaggggugaguuucaacaggucugucugcagugggcgggcacagcaaacaacccuggcauccuaaugauuuuuuuaggaaagcauugaagcuggcuuaaaaguauuggauccuguagagagcgggaucauggaaaagcugggaccagaagguauagacaucucuagaaauucuggguuauagcuuucaaacaaauuaguguugagaaaaaacaauccuucucagacaaccucguuggugauuuucugcaaccuucuagcuuuuucuuaucaauagaccaguaguuuuaacuacuuauauauucauucuuaauuuauuaaaggauagcuuguguucugcagaaaucuugaggguaaaacaaaaaaaggcuagccaccuugaucuauguccauaccacucggaacucacagaucuauuuuucugaacucucccggacagcucuaaugaucagccagccuguuucugucugccccacgcugucaccagacaucugcacuuuguucaugucagcuugcccagaacuugcucacugcauuccaagaugguggggugagcucaaguuucugugugguuguauuuuaauaacuucauagugcugagcaugaaaugucuuccaugcuguugucuuacagagcacuuccccguauggugaccauuuuauucagacccaugagaugggcgggcucaagaaagggggaucuuuagucuaggguggcccaaugaagaugagcagccagcacaucugcucucucucuccucccucauccucucucugugugucucucucugucucucucugugucugucucucucuuugugucuuucuguguguguaugugugucucugucucucucuuucugugugugucucucucugugucucuuucugucucucucugucucucucucucucugucucucugucucucucucuucuugggagugcugcuuucuuguauguuugaacucuugucuccagguagcuuuucaauuauuuggaaaacguuuaguuuaauggcaacuguggaaaggccagacuccugcacaaaccauggaaaagaucucccaggucaggcaggugggucuuggguaucaaaucaagcagauagacuuucuuuuuccaccuucagauagagccagcacugucagaaucagucucggguaacugauagaacacugauuaacccaaguuaacacagccgcucagcccaggcauauuggcagcuagggugcuuucuggcccuuccagggcaauugcuccuuagcucuguacgcaggcugcuaggagccaacuggccuccaccccaucagucuaugccuccacucacgaggcagcauccagaucggacucugccucauacuguuggagcagccguggaacuuccagucugaaccaguguaauuccaaagagaggaaccacagaugacaggugugaguuggcaaagguguccugagcaagcucagaacccauuguuacuccaaaaauaagagacuuaugaaugaauuaauuaacuaacuaauuaauuaaauuuuagcaugcuucucuuucuugguagguucuugguuaaaaaaaaaaaguauccguguguauaaauguaugguacuccauacggaagaaguccugagaaguugugugaugaaauuucacuugcaugauaaagcuaaggaaacugcacaaggaaagguaagaaaauggauuuuuuaaagaaauccuuucauagggacggcaaugugacuaggaguuaagaguauuugccaccaagucugaugaccugaguccgauccccagaccaaaaagaugggaggaaaaaaccagaacggagucacagggauuguccucugacuucuacacgcaugccacggcaaucauguccaugugaguguauacacacacacacuccucacacaccucacaggaguuguccucugacuuccacaugcaugcuauggcaaucacauucaugugaguguacacacacauacauacauacacacacacagacacacacacgccucacaggaguuguucucugacaucaacaugcaugcuauggcauucacccuccugugaguguguacacacacacacacacacacagcacacaaauaaauuaauaaaauauaaaaaauuuaaucucauaaaacacucacaucuuuuauguaaggcuuuaaaauuuaaauguuggaacguuuucuuaaucuguggaaaugcauuggccaucguuauaaaccaucugaauuucguuuucaccucagccccguagagcagcggaguguggaaugcgcucagguggaagcugccugauuaucaggacgucuuacuccagggggaugcucaagauggacuccuugugccuugcaagacucugcucuuuuuaacauuguaaaauaacaccugcucacuauggaaacuuuuuaaacacagagaaacagugaaacaaauuuacccacagucaucagcucuccuuguucaauuggcuuuuuuuuuuccugugcuccucuuuuuugccguguuccuguuuuucgcuggguuugccagaaccucaaacaagcacccagccuucuuguguauuuuuucccaaaauauuacuauucaaaugaccuuuuuuugacuuaguuggggcgggguauucguuauguugcuguugagacaaggucucacuguguaacccuggcuggcuggcacuugcuguaucaggcuuaaaccgugcuccucuuucuugccaugcuccucuuucuugccgugcuccucuuucuugccgugcuccucuuucuugccguguuccucuuucuugccaugcuccucuuucuugccguguuccucuuucuugccaugcuccucuuucuugccaugcucuucuuucuugccgugcucuucuuucuugccgugcuccucuuucuugccgugcuccucuuucuugccgugcuucucuuucuugucguacuccucuuucuugccgugcuucucuuuuuuugccgugcuccucuuuuuugcuggguuuuucagaaccucaaacaagcacccagccuucuuguguauuuuuucccaaaauauuacuauucagaugaccuuuuuuugacuuaguuggggcaggauauucguuuuaguuuuauguugcuguugagacaagguuucauguguaacucuggcuggcuggaacuugcuguaucaggcuaaacucaaacucacagagcucugccugccucugccuccauggcccgggauugaaagcgugcaccacaaugcuuaugaucaugauguguaugaaauauauuccauuuccuacuuguuaggaaacaugcauuuccccaucccaugauaaaucauuccuagguagaauuuuaaauaacugugcauuaauaauuacaugggaguugucuuaguuacuuaacgguucccaguuuagugcauguaguguuuuuuagcuccaaagaacucacagcaagcaauggaaaguccuuacugcacaauuucaugcgaaaauuucuuuugaugguucauuuuuaucuccuacaccuagauucuccaaacuaaaauucucuuauaaucuuagaacauaaaguguuuguuacauauuaaacguuggcccuccaacagguucagcucauauauaauaacguuccuauccagacuggaugcuuucagauaagcagaguauauaucuguauacauauuucuugauuucuagagaaauugucuauuucccacauauuggcuaauguacuccacaaauugcuuuuuucacauaauuuguaagcaguaauaguuaccagaguauacauuauacuugugaaaaaaaauuggagggagggaggaaagucuaagagcaaaacaggaacaaggauauacuuugcaaguuccugggacaaaacaggaacccugccagaugccugagggcuccugaaugaguguuggccggagguucuaggagggaggagacaggauauccaauuggcccagguuggaccugaugggaaaugugguauccuugugguucugcccuuuuuaauuaagccucugcaaaaagugacuugugaccaguuccugaggaccugggaguaaacacggccagaguccaccauccuggccacuguuuaauuaaagcuugauucaaacuuggcucaaaa

SEQ ID NO: 5741 - RNA, 1358 nt, Mus musculus
ggggaggagccuguuuccugcuguacagcacagagccacaucugggagacaguaagcacuucugcauccauuuccaguagacagauuuuuaaauuaauaguuaccuuuauuugugugugugugugugugugugugugugugugugugugugugugugugugugcuugcucagggguggagcuucccgcucaaucguucugccacgcccacugguggaacgugccgcuuugcuguuuggagucacacacguggucacccugcuacugaacuccgagauuauuuggcgggaaucgggcccccucccccuuccuucauaacugagugucggaacaguaaaauugagcuuugaucagaaugccugucuuagcugcaucauuuucucucgccgccuagccccucuucucuuccagguuuccagaaugccuuuccaagcuagaacccaggcuaugaucugcuggccggacacaacaugcaagaucccacagaggccagaagacaauguuggaucaucaccccacaccucacauccaaagcugccguuaaagacaguuguaagcuaucagauacaagggcuggcuggcguggauauggcguggauaugagggcuggcguggaaccuggguccucucaaagggcagcacgcgcucuccaccuuugagccaucucuccagcccccagcagccagaccuuggaggcccucguucuuggaacggucuggcucaucguugcuuuucucaacuggacgcgauuauggacgagaaguacagagcuuuaauggccauuuaaaugggucuggaaaguguucccaccucuggaaagugccccccccccgggugcauuacauucuaaugaauuaauuaauaauuacauucuaauuaaucuaugcuuuugaaggcuagucagccuuccuucuuguccuuugucaaagagaggauuuguguguguguguguucguuuuggcagaaauggagacggaccccagggcuucaauucugccauacgagcacccuaccacugaacuccacuuccagcucaaauguacccuuuuacaguguggcaagacgcuagcuggacacaaagcaagacuguacaaaucagaagccauugcuucugauuacauauugguuaaggcuuguuggaacuggagaaaaucuguaaaggauguaggccuuuggcaacacuuugaaggaugcauccuggaaaacuuagcagcggguuguuguuguuuugugccccacucaggauugaagcagggccuuguucggguuaggugaguuguaacacaaaggagaugacuaugcauucaaauauuuacaguuuuaccuacauaguacaaauauagguguuuuucauuuuua

SEQ ID NO: 5742 - RNA, 1430 nt, Mus musculus
uccuucgaaucaagacugauuggguagaguugucccuuucaggaaccaaauuaguaacagcaguacauugguacuaugcagaaguucucgggaaggaaagaggcaugagagcuagagagagcuagagacaggccacugagcagcugguggcguuguuuucuuuauuuuaacaaauacagucuuugaagcacucaccagccuugugaccagcuacuccugcgugguggaagagugcuguggcuggucuuguucuuugguguuucaaaauagcucgugugaaggaacugcuucuggcacaggagugacagucacccuggauuccaggccagcaacagcacacaccuucccccuaggaagaggugcugggggcuggaaauguuuucuucgcccuauuccuuuacagcaucucaccuggcuuucucuccaucagcccugggaugagccaggaccaucccuuccgcucuaaugagaugccuucggagcagugggguaaccuuugaauuggccuucaaccucagcuguucaagagcuggaaggaagaaggggaggagguggcucuugauucucuuccuuggccagugcguaccgccuagcuuuucuggggucaggcucuggugucuccucugcccaucucccaacacggcgaaccccuuugcccaccuugggggcauuucugcaaggauuguggucauagaugaccagcuucagauuugucaagugggccaggcuggggaaguagcggauacuguuccgauccacgucgaucaccuccagaaagggcaugcgaagcaguaccgaggggaagucagcuagcugauugccggagagccagaugguccugagcucgcgcaggcgccggagcuggccggguagcagacguagggcguuggaaccggcaugcaggguuuuaaggagacucagcucacacaccacaucgggcagccgggugaggcaguuggauucgagccacaggguccguagguucuggagcaggcugagcucauccgggaggucacagaguuuguuauugcccagguagaggaugcagagcuguuucaagguacacaccacccgggggagagcuuugaaguuguugaaauccaaggccaggaucugcagguucugcagcugugccaggucgggaggcaggcugugaaggugguugucgcugagguagagcuucaccagcuccgugaaggagcacacgugcagugggaagcgacgcagcuggcucccgcucagauccaccauccuguccaggggcaucucccggaggucucccaccacauaacucuggcagcggucgguggggaugaaagccacgaaggcccggaugguguuucccaugugaaacgggcugcaaggcgagccccugcccaccaacucugucagggagugggcuggcugugcucacugcucgggaacccuuc

SEQ ID NO: 5743 - RNA, 2555 nt, Mus musculus
agauuuauuuuuaaauguggggugggcauuuguacuugagguacagcuguccugggaagccagaggaguugggucccccccccccaggagcuaaaguuacaggugguugguugacuugggucugggaaccacacuuaguccccuuaaccacugaguguuuccagcagcaguuucuacauaugugaccgguuuccuccauggcuguugaaguggauuugagcuguacuucccugugaacucgacccuaaggaucagaguuugcugcuauuguuacugucuccauuccugugcccuuuauccucuucagucauacucuguuuaaaacccgccagugcacucacaugugguaaauccagaugcguuaccuugcuagguuccugugggugcauuuuaaugucuucauaagugggaacuuucuguagaucacaauuguuagagaacuuuaaaacucccagcaugaacaauaagggagacaggauuuagaguccugccuuuaguuuaugaagcugaggauggaacccagacucacagguuaguaaguggcagagguggggacugaguccagauagcuaggaggggggcuucccuccgccaugguacugcagaguucucugaugccuguggccugugcuuuuaagguguuuucaacuuauuuugacuucaagacaaaagccaugccccucccuaaccccugaguuugagacugacuuagcugugccuuagccuccugagugcuggcguuacagguaugugcuagucuuggcaaaucccaccuauggaguacaaaauuacaauuuacagugguaugccacuuagggcaaaauagaaaagcuugguggucuauuuauuucccuaacaaaugcuaaagauaaguggguaggcacgguaggagucuaagcuuugaguucagcugagacaucauauugaggcugucucaaaagaaaacaaguuagcuguguccugggguuuuuauugcugcgauaaaacacauaacuccauccccaagggagggaagucagaggagaacccgaagcagaagccauggaggaguggugcuggccggcuuucuucucguggcuucauuuacuucccuauaguacccaggacccgggagugguaccuucccuagugaacugggcucccccacagcaacuacuaaucaagaggaugccacacaagcuugcccacaggcccaucugguggaggcguuuucucagcugagguuuccucuucccaagcgauuucuagcuugugucaaguaaaagcugguacgaguccauacuacucaucucugauaacugaggagaggucgguagguaagaccuggccucccuucauccccaccugggauggucugcaagggccaucuuuccuucagugcuuuggguuuccagacugaaaguccagaagaacaauaacuaacacuuggugcuucagccuuucuuccuuauuuugcugaugagaucuugguaucucuaagaccaccagaagauggcucucagcuuacaaaccccuuugguaaaccucugucccccccaaauauuuacauuauaauucauaacagcaaaauaacuguuguuaugaaguagcaacaaaaauaauuuuaugguuggagggcaccacaacaugaacuguacuaaagggucggagcguacgcaagguugagaaccacugaauugaaagaaauguaaaugccguccguauaaacgugauugaaagcuuaagaguggacacaauuauuuggcagcaaaaacaaaauaaauguugcaagcuuacugauuuagaaaaaaaaaaaaaacaauuuggcuauacuccaaaugcuagugaucuauaagagcagcugcauacccgaugggaacccuggucaguuagcuucaacucaaggcuguggacugcagcuuaugccggagaagacagaccuguucaucuugagauggaagacugggcaaaaaagcaacuuguaaacugcuauagcagaaguguccuuggaaggcaaauucuuguuugcaaauugcauuuagaaucaguugaguauggcuucaguuaccugaaaaagaauagacaaaaaaacaaaacacaaaaaaacaaaaaaaaaaaacaacaacaaaaaauaacaacaacaaaaaccauucuagcaaucuaguaggaauaugcacgcguagcuguaaggagaaaucugucccuauggguauaaacuacuccauuuaaugacuaaaggcguccuuggcggucugaucacugggcugccgauguucugcaccagagagguggugacaggguuuugugacacuccaggaccuccucugacuuagccagcaguauuucugaaaggauucugauauuccagaacugggcucgugaagguccguccucccaugguucuuuauaaaaccucaguaugguuugucuuaguuaagaugacaauuuuugcccugguguuuugaaacgguuauucauauacagacaauaauuuaggauuuaugcacuugugauacauucuucccuaaauaacggccaaaauaccuacguuuguagacagucaacagacccuauga

SEQ ID NO: 5744 - RNA, 564 nt, Mus musculus
gcgccuuucuggcucuuccuuucccuccaccauucguuucucuguuuuuaaggcuuuugcucuuucguucuucacgggagcacaugggucccacugagaaagaaacuauucugucuccuggucaccgcucccauaaauaaagguauguuuucagucuuacuccauguaaggaaaguugggagagggaccugaagaaaguaauuuagaauagcccaaaguaaacacucaucccacaaagcucccagagaugggucccgaagagaucggcacaacugaagcacagaaagaggcuuccaccgauggaguaaaagguaggcacgaggucugugcugacugcagagaggagcgguuggcagaggugaguaggggcucacccuuggaugcccacacccucugggcuaugucacccgggccaccgcccuugguaggugaagcacagcugguguaaucaugugugccaagccaaacuaaugacaagucgcaucagacaucugagaaauaauuaacugcucgcucuucuuuuuuuuuuuuuucagcccacaauuaaacaagugcagguguaau

SEQ ID NO: 5745 - RNA, 5702 nt, Mus musculus
uucaagagaggcaaagaagcagaaagaaugugacacagcugucagucaccagccaccaccaagcgccacacugcaggcccugaacugcaugcuuuucaaaaaucugcagguggaacacacuaugacugcgugaugaucucuuauucugggcagugcgggacacagcccgcuucugaugagccaaauggagcagagccuccaccucuuucucacauaucaugcauuggugacaguuagcgccucacucccugggcuugcccgacaaaucucacacucgcucccuugucccuugugggucccaguagcuagcaggucucaaacggucucauuguagaucucuauauaacucgccacaaaacuguauguccagcccuggccacucaucuuuuggaccacagagaacagaugccgcauggccugagggaucagcccuuccaauugggggucuccccuagguucaccuuccauagugaaggucuugccacugccugucuguccauaggcaaaaaugcacacaggguagccauccagugcugacuggacaagcauggcgauccccucaaacacuuccuccugcuugcuuccuggagggaacacccgaucaaaggagaaaucauggcggguagugggugccggggccccagucaggguggagcgccgacagugagaggcuaaggcgagucgggggaucagaggguccagcagggccaggaagaaacacgaggaagccaggagauggaguggauuccccugcgaggacagggcgcacguggcagaacacccagauauugcccuucaguuccugcagcugguuguggagucgucccguuccaucucuaacccauagagcuggucuccuugcuuagccaguaaggucaccugggcuucagucuucugccaaagacacaccaccucuucuuggcugcuugacagagcugcuucugcgaccugaaaccuccucuccugcuccuccaguuggaugcucaaugugcuccacuccuccuucaauugcagccgcucucucugaagcuccugaaccaaccuuuccgugguacccagauauuccuccagcuccaagacacaggcacucagcaucuccagucucugcugguccugcucagcucgggugcguacauuggccagcuccccuuccagggugcucugcucuguccccagggucguggccugcuccuggaccucucugagauguuuccgaagcccccgguucucccguuccagcguuugagucuucucccgauagcguuucaacucuucacugaggucaaacaacuggcccuucaggucccaggcaagggcguuugccaggucucuuccuuaccacuacaggagcaguggaugugccaggcuucugggcaggaacagugggagcuggcuucugguuccucagcacuguaccaacaguagagcacccacgagguccugccuucuuagggccuuucugagcugcaguguggcccugggucugugacacugugcugaagagugguccucugggacgggauaugucaacuuuggucacugcacccaugccucguguccguuucuuuacgggcuccaaggcauccuccaucuggucaggaccucucuugagccugcuugcugacggggcacucgggaggagaacuugaccaggcuugucuucagcucuacauuccucuucacuuccaacaaagguggccucugcgccugcacguccauggugguccgcacaggacgggaugcaaaggcagcaggcagggugccggugucccgagacucacauccucucaagggcucgcacugcaaaacgccggagccaggccguccaggagccaggcuaaucugccacacuaauccgccauacuugccacuuuugaauuucuguucuuucuuuucgacacaagaucuuacuauguagccccgccuggcuuuuuaguacaaaauaauuguuaagccaaaguggcaaauuuuggguguuacauucuuucuaccuuuaccagauuuuguuaauguacuuaacuacugaugaacacuacaguuccuagucauccucuuccuccuccuccuccucuuuguaaauacuuucaaagugguccaucaagacgcccuccugcccuacgcccccaagaaaaagaauaauggugucuccaaaaggaguccuucuggguacaauuugucuguuguuaacaacacaauauuauuaugccuugaaagcaaaauaaaucaucaacagaaaaaugauaauucaaugagaaagguaucacgauacuuacgaguucuaggggcucugccucuaaaggcagcugagcagugaucuugauuaguagcucauuuucagcaugcuaguguggaaccaggagcuuuggcaagaagauauuugauuuugaaaaaaauuuuuucuuucauuuuuuuauuagauuuauuuuuguuucugugcuaccgugugugugugugugugugugugugugugugugccccaugcaugcgcagauacaugcagaguacaaaagagggcuucagacccucuggaucuagacuuacaggccuuugugacuuacuggacaugggugcugggaauugaguauagguccucugcaagagagcuacacgcucuuaacugcuaagcugucucugcuucuccacccccagacuucuugucaauucauguuaauucuuguucauucuucuuggaauucauggagcuugaugaaguucagaagguguccuuaugucuaggugauaguagcaacaagauucaggaacaucucgugcuaugcaacuccuggcuucuccguccuuugcuucauuuuuuucuucaucucauccacuuugguuagaaaugugugugacuucaucauuacaugaagccucugaguaagggaaauauaagccugcacuauauagaacauuuccugucccgauuaagaagagaaggcaggacucauuugugguaaaaugacaaugggagagacucaguagagacugaaguggaacgcuuuauagauauaaagcgagugaacagacuuaccacguauugauggcuuauuggugaggaccuagcagagagagguacuggguugaaaggaagugucaggaacuggaagcagaguugaauggaguuaauuuggaugugaguuugugcucgugauugcaaagcaaugcagagaagccccuaacagauccaugggcuauggaaaguucgagcugggcuguuuugcugaguguguuguaauuuuuuuuuuccauagcagaaacuacaaauucuuucaaggcaagugugcuuaccuaggugacauccuggacuuuaaguagggaaacacucugacugaaaaccugguagacuuuuagaucaauuuggaccucuuuaaaagaaguguuuagaccugucugcuuagcccagaaaacagucuuguaaacgagguguguguggggcuggaagauggcucagcaguuaagagugcucauugcuuuuccagaggacccaacuucaauucccagaaccugaguuaccuguaauccagcuccaaggggacuggaaagcucuugucuccuugggcacacccacacauguguaccuacccacacacagacccauagacacacacauauacacaccccaauaauaaaaaaucuuaaaaaaaaaaaaaaggagacauuuagaccaggacucagaaaagucugagccuguacagagacaucucuuugaaaguuaaauagauggaaguccuucguguucccaagagaacuggaaaccuaaguugaugguagugauagcgugccccucagaaauucacaaauauuucccuaaacgcagauaauauaaaguuuuccaagugccaucggacauauaauuacugccauuaucaaagugccguggaaugacuugcaaaugugaguugucaggcacuuaagcaaaaguccuccucccccuacuacggaaacgggcgcagacuucuguaaagugcucagcagagcauuuacugucucgcugcaggcuccuuauuuggcaugcccuacaaacuacaucaaaaagaagacaaauauuuacgaaggcauuccuuaauggaugguaaagccaugcaaugggcuuccaugguuucauaggcugagcuaauguggcagggcguauauuaauaauuuaagaaagaaacacauguggaacucauuuccuguugggucagauacauuaauggggugguguggggaaaagguaguuuuuguuuuuguuuuuguuuucccuucagccuucuggggauuggggugagguuucugaguucuugaauucugaacucuaacuuuugcuccacuccuggagugucugaggcuacagaccccugaagacuagauauuucuuugcucauaauauaaagcagggucaaagagcugggcagcuggagggauggcacguuguccccaggggaugcagcaacuccaguucccagucugacccccacccuccaggcaaaagguuagaagacucuucccuuugaucagccgaaggggaaagagucuaaaauacuaagauggaguuguagacugagaagaggagagucagcagagcccacucugcuuugagagggaagauuaaaguuucugugccagguugggcauggugguacacaccuuaaauucuauaaaaccagcaggcagaucucugaguuugaggucagccuggucuacagagggaguuccaggccagccugggcuauacagagagcaagaucuugaacaaaaacaaacaaaucaaaacaagacguuucuaugccuguggugguuugaauaaggacggcccccacgggcucauauaguuacuagggaguggaacucccagauaggaauagaaggaucaggaggcgugguguuguuggaggacguguguggacucuaagauuucaaagacccaugccaggcacggucuuucugucugccugcaggucaggauguagucguuacauuucuagcaccccuccugccaugcuuccugccaugauagugaacuacgucucuagaacuucaagcaagccccugguuaaaugcuucauucauaagaauuuccucggucaugguguuucuucacagcaauagagcagugacuaugacuagugggucucaaccuucccaaugcugugauuccuucacacaguuccucguguuguggugacccccaaccguaaaaugauuuuuguugcuaguucauaacuguaauauugcuacuguugugaaucuugauguaaauguuugauaugcaggauauaauaugcaaccccagugaaagagucauuugaucccccaaagggucgagacccacagguugaagaucacugaacuaaggcaaugaugaacagugauguagacauggaagccagauaaucccuuuccucccugaguugucuuggucaugguguuuuaucacagcaacaacaacccuaacaacagcaaugccuaucuuugacuuagggagcacccauagggaaaauagaauuguuuuccucugugagcuuacaguucaacagaggucacaacauaaaauacaaaguauacagugugcugaggaauuacagaugcuuuggauaaaaacuggguggugguuaugaaaugccaucucgggagaguauugcauugauggauuaaggucagauggggugcaugauaacaaacaccaccuaccuccaugcaaccucugcacccggaagccucucauc

SEQ ID NO: 5746 - RNA, 21886 nt, Mus musculus
auguguaagacaaaucucuuucacaauucuucaauaaaccauuuauuugcaaauaaauaacaucaaugccauuucuaaauaaacauuuaagaacuaauaacacacaagguacuuuauuguaaaucgggacugaagcugcccaggcugccgcacccaccgccuccuauucaaaugcugucacgugggaggaguguucuuguucuugucucugaagcuuuaacgcaacauuaauacaaagcuauccuucgcuuccucuaccuuacaguuuuauguuuucuauacuuagacgugacccuucaaucaaagggaagaggccuauuaugaaccaggagauuaaucuacauggauagacgagucaucuuagaaugaguucacuuuauccauguucugauucagucuuucugaaugggcugguuucuaaaccuagccuaaguacaggccugaaacauaggcaaccaccaggaaccacggagcugaggcaaaaaggcgcuucuaccagccucaggcuuuucaaccugggacaaacugcaacacuugugccacaccccuaugacaaaaagcugaaaaugcuggaaaauaaggcguguguuuucacuuacauaccaccagaugcaauucaugccuuuaaaacugugugugugugugugugugugugugugugugugugugugugugugugugugcgcacgcgcgcgugugugugcgugcaugcgugcauccauuugaagaucagggaacaacuuuguggaacugguucacucuuccuggggguuccaaggaucaaaugugugucaguggguguacacagcaggugccuuuacuggcugagucuucucugcagcccacaacucacacauuuuagauuacuacaguuucagaauuucaauaacuuaaauauacaauccuucacauagucuuuaacucuuuacaugaaagacacuaaauaaauuaaauguucuuauuauuaacaaaaaaaacagaaaucaaguacuucuguagcccuugaugaggaagguccaccaucaucugcaggagauggaaaggacuucucacauacacuuccaaaguccuuccaagcggagauuauuuaaaauauaaggaaaauauaaacagccaaugcaaauuacuuaaaacacaaauauaaaauaaacaagugaaauuucccuaaaaaggaagaaaauauucaccauauuuacucuccaggauaaauuauaagugaauuuuauguggacuaagacaguuuucuggcuuuaauguauaaaaauaauacccauguugucuaauuugggggucauauaguuagaaauauaaaauucuauuuuugugagcaggucagcuaguugaaguaaguuagcacaaucauuuggauuggcugucugcacacugggcagggcuuguuucuuuuuuuuagcuucuuugcacacgugaaacaugacaugagguguccagucuugccgugaacaaugcagccauuuuuaggccgccccuggcagaucacacaugguucgauggcauucagggagaagcuagauuccacacucucgucuuuguccugcguuuccuccuucaacucuuucacgcuuucuuggcugcuauaaacaaugcugcuggaagucgaugguugggaauagucgucacucuccugggacaggggcgucuguucggccuucuccucgcuguccuccucagcacauggcucuuuagcaucauucucugucagcuuuuugccaucaggcacauccaagccuucuucugccugagcugaguuuuccaguuuggcuuuuucagagauuuccacuuuaucuuuccccuuaucgucuggaagccaguucucacgaaggguccagcaucuuuugcagugugauggaaggggaggauucauuucauugcaugagguacacuuccaauaguccuucaauaaaaaagacaguaacucuucagucaguguucauagcaaggcuaauaacuucaauguggcuaagguaaaaguauaccauguagcuuaauuuucagcauuucauauuuuacauaaauaggcaaagaacaugaggaauauaucuaauacuauauaccagaaauuagcuaauagaguagacucuagguacuuuccccuacacacacacacacacacaaaaggugaccuauaugaaauagugacaggcuagagauggcucagguucugagcacacacgugguggcucacaacuaccuauaguccuaauucugaucucaacauuguguuuuauuucuuugaagaaucuauauacuuacagcuaaggaaaucucaggaucuccuucaaaagagucuguaucgcuuucuccugucugauagacugugacccgauagaccuaguaagacaaauucauuagcaucaauucaacccuucaaccaagaagccagaauucucaguaagucuuaaaacaaacagcuugagccauuaacuguggacgaagaguucugaaagaaaguuaaaugcaguucaaggcaagcaggaaacgcaggauaggaaaaccuuuacucgcaauggcaagaguuguuagauacuuaaaaccaaacaaaacacucaagaagacauuuuauaaauuuagaguuauuagacagaaaacaacuagaaauguagaguugcucccgagaaagagauacucggguccuauuggacacuguucguugcaugcuuuacauuggugaaaaacaaaucaguacugagaagggaggggcagaaguaggggcucacaccuuucaucccagcaaucaggaggcagaggcaagaggauucccaugaguuugaggccaggcuggucuagauagccaguucagggucagccagggauacacggugguacccugucucaaaaacaaauacacacacacacauacauacauaaaugggaagaccaaauggagaacuuugugguccagccauuaugagaauguucauccaucauuagcagagcagugguggcgcacaccuuuaauuccaggacuugggaagcaaaggcaggcagaucugaggccagccuggucuacaaagcaaguuccaggacagcuagggccauacagaaaaaccaagucucgccgggcgugguggcgaaggccuuuaaucccagcacuugggaggcagaggcagguggauuucugaguucgaggccagccuggucuacaaagugaguuccaggacagccacggcuacacagagaaacccugucucgaaaaaccaaaaaaaaaaaacaaaaacaaaaacaaaaacaaaaaaaaaaaaaccaagucucaaaaagcaaaacaaacaaaacaaaaacaccccaucaacucaaaaaaaguuuaaaaacauuguucaaacucuccucuaaguuuuuuauuuaguaaugugagacuauaauaaaucaagcaaagggcuggagagaugacucagagguuaagagcacugucuguucuuccaaagguccugaguucaauucccagcaaccacaugguggcuaguaaccauaucuagugcccucuucuggccugcagacauacaugcaggcagaaugcuguauacauaacaaauaaaucuaaauaaauaaaucaagcaaagaaacuauaaaauuucaccucaaauccacaaagcaauauucuaucuugaacaaaugaaaaagcaagacuuuccagagacucugaauagauggccucuucaucuuacuaaaaggcugacagacacagaaacccaccucaucauccucaucugagagcucgugcccuucgucacucaggcuguaaucuuccgaguccagagacucaacuucaaauuccacgcuaaacugaucagaaacugaauccugauccaggcaaucaccagaaugcucacuuacgccaucgucaagauccuauggaggaagaaugcagcgaauguaaaugcauugccucugggccucauuuagagcucccggguucaucccgagccacuauuuccuucucagccccagaccacauagacuggguucaagguuacuaccuuacucaaaaguccuaccucaugaaggaaaagucagagccccuuagccccgagguuacacucagaaugacugcauuaacauuuucaaauguccagcuaaacacacccuccacccuauucaauacccaugcuccagccacaucuuguuuccuaaaucaauccacacacuaacuuuuucucaguaagauaaucugaguuucuaagccccacucaucuuucuuugguuaagguucccacaauaccauaaaaagaucuuccacaaugaccuuuccuacgugugugauuauaugcacaccuacuauuaucugaagcaccacugugaguuuauccuauuaaacacaggaagacgaaggccucccugacucacaggcuagugugacggagugcuagugacgacacacaaacaccaagcuggcaucuggguuuuccgaugcagccuuaguuggccuggggccucaugugacacuauauuggcuauuaccucaugugacacuauauuggcuauuaccucaugugacacuauauuggcuauuaccucaugugacacuauauuggcuauuaccucaugugacacuauauuggcuauuaccucaugugacacuauauuggcuauuaccucaugugacacuauauuggcuauuaccucaugugacacuauauuggcuauuaccucaugugacacuauauuggcuauuaccucaugugacacuauauuggcuauuaccucaugugacacuauauuggcuauuaccucaugugacacuauauuggcuauuaccucaugugacacuauauuggcuauuaccucaugugacacuauauuggcuauuaccucagagagcucugcugucccugcuuccugagugcugagauuaaaagauucaacuucaggccaggcaugugguguaugccuuuaauccuagcauucauucaggaggcagagacuggaagaucucuguagguucaaaaccagccuggucuauacagugaguuccaggacagccaagagucagaacuaaauaagagacccugucucacaaaaaugcaaacaagagauucaacuucaaaucauacacuaaguucauccgcaaaucaacuuacuuacaacugauaaaaauacacugcucuagaauucaggacacaggcauucucaauuugcuaccaagaugcugcuuaacugcagacacaucauuucucuuccagaaaauacagucagcuugacauaaaaguagucuuuuuuuuuuaagauuaauuuauuauuauaucuaaguauacuguugcugucuucagacacaccagaagagggcaccagaucccauuauagaugguugugagccaccaugugguugcugggaguugaacucaggaccucuggaagagcagucagggcucuuaaccgcugagcuuucaaguucuagccugucuuauuaaauguaauaauuaguuguaggauccuuuaacaaauuauuugaaacacuaucaggcauaguguucccuguaaauaaaggguaaaacuacugagacuaauguucucauaaguaaguuaaaacaaagcaaaacacaguuguauuaaaagcauuuucacuuaaguuuaaaaaguaacaaauuuuuaauauggaagauuuuuagaagagcauauauauauauauauauauauauauauauauauauauauauauauauauucuguuuugacagcaggucagguucuauucuaagaaacuagauaggcagagauccgcagagagguuggcucacugacuguuggguguuggggauguaauuaacugguagaacacuugcccagugcgcacagagcccuggauuuaaucugcagcacucaaaacuagggcagagaugugguagucaacccacuuuccuggcacccacacaguggcuccaaccaucccuaaccccaguuccaggggacuccacacccuccuguggccucaaagcacugcaugcaugugguguacauucuggcagacaagacacuuccauauuaaaaaguaagauaauuucuuaaacccaagcacuaccugaugcgagggcgucucuguggacucgcugcugcugcugcuacugcugcugcugccgccgcugcacaucucccucagcucacacagacccaggcucggaucaaaggacagggaccugcggcgcuuccggugccgcuccccagguagcucaucuguguucucuucuauagauuaaaggacaugggguuaaaacucccuguacugggacugauuugagauugaaauaucuucagcaccuauuugcaacaaaauuuaauuucaauuauauuaaacagagaagugaaccauuaauguuucaaaagucagcaguguuucauuggaucuguucagcuacacauaagcucuacuucuaagcuugcaaccuucuuuguggacguuaccuccacaaguuacucauuuaauccuccuagugcuuuuacugauucaacaguacacgauuuccccaucaacaguaagcuuuaagaauaaggcugggcuggugaaacagcucagugguuaagagcagcagagcacucauacauuaaauaaauaaaguuaaaaaaaaaaagaaaaaagaaaaagacuaugcaaaggucaaccugaucuauauagaagcccugucccaaaacaaagaacaacuucaucuccuuuuauuagaagucuaggguagcagcucuuaacuuuccuaacacugugacucuuuuuuuuugguuuuucgaaacaggguuucucuguauaccccuggcuguccuggaacucacucuguagaccaggcuggccucgaacucagaaauccgccugccucugccucccaagugcuggauuaaagaugagagccaccaucgcccggcacugugacucuuuaauacaguuccucauaguggugaucccaagcauaaaacuauucucauugcuacuucauagccauaguuuugcuaaugugaugaaucauaaugcaaccaugugguuuucaguggucuuaggucucagaccucugucaaagggucauuugacccaaaauggaaacaccaagcaacuguuuaguaugucacauaaugucccuauguaccugucucacuaauggaucuccuucuagaugagguagacagucuagaaauuaaaucagaagaugaagguuucucuucugguggcgcuugcaaaggauccuaaguacauaaaagaaaguaaaauauugcaaaauaaacauuaaacauuggcuguuccacacccuguuuuauguaacccucccaauuuucaagaacuaugugucaugaagcuagagcgguggcucagagaagaagaccaugugcuguucuugcugggguguguuugguuuccaucacucaugucuggggcagcucacauccaccuguaacucagcuccaggugagcaucaccucuuucuuuuggcuggaggacauacacacacccacacuuacagacaggauauuuuaaagagaaaaguguguuagaguaagaacuuuaugcaaguauuaccuucagaucacucccaccuucaggcugacgucugcucucacucagcgaugugccagagucugaagauuguaagagaaaguaaaaaguggaucaaaacaaagaaaucaagaauucaacauauaccagucuaacacaugcccaauacaaaaucuaaccuuuuaacaacuauuaaccauuuguaucaagagucauuugcaugcuggagauauaaauucaacaggaauuaugaagcaaaauaagcaaauuuuaagauauacuagcaggggaaacaaaaauguuuaguagacgugggggaggggcucugaagagcuaucaggacagauucuggaaucgccuacgcugaaguuagcauaggacagacacuccagacugaaggauuaguaugugagaaaucaugaacacgcaaacaguuccugugacugacaccaacauaauaaacuccucuguacucaaacaguaaagugcagggucgcugugcacagagccaugcguguucagcugagucacauacaagguuauucuucucaacaguuauucaagcaguucuauaaucuugccugaggccaucuugcaacuucucacuauuaaaggguuuuaguucaagaaauaaagcuaauuuccuagcucacagaacuauucuccccagagagcaaucauaaaacuccuaaauaagaagcaacaaaccuccagguggugguggcacacgccuuuaaccucagcacuuggaaggcaaaggcagaggcaggccaauuucugaguucgaggccagcauggucuacaaagugaguuccaggacagccagggcuacacagagaaacccugucucaaaaaaacaaaaaaagaacaacaacaacaaaaaaagcaacaaaccacucugacaaaauagaauuuaaaaaacaacaaacccaccaccacucccaacugggcacggugauuuacacuacagcaaucaucuccagcaggccagccugggcaacucagugagacugucaagccauagugauucaguggaggaggccucaguuagcauguaggagguccacacgggaaggcaaacagagcacagaaacaagcaaacaguauuugaaauacaaagacaacuguguguguauguguguguguguauacucuguguguauguguauauguguguguguauagacacacacacauauacacauacauacauauauacauguaguuaaaguauuuaaguggugguuugaauaugcuuggcccaggguguggccuggcuagaggaggugugaccugguuggaagaggugugucucugugggcgugggcucuaaggcucccuugcucaggccccgcccaauguggaagaaaccugccucuuacuugccuuccaccuuuggauaaggguauagaacucucagcuccuccagcaccacaucugccugcaugcugccaugcuuacugccuugaggauaauggacuaauccucugaaguauuaagucaagccccaacuaaauguuuuucuuaauaacaggaguugccuuggucauguugucucuucacagcaaugcaaacccuaacuaagacaaucaacuugagaaaaauuaagacauaaaaacugguuaagacuagaugucuguaaggaaaaggaagugaucccaagagucuaacuagaugaagaaugugugguaccacucaccaagagaggugagggaggugaacgauuuagcuuggaaaaaauaaugaauuuaaaagaguuauguagauagacagguguaguuuguacuuaguuucacagaccaagcucucaaaacauccaaguuccagaacuggaauggacaaaauuacucaaaaaucacaauccauacccuagacuaccgccuaaagcacauccaucaaccgugagaccacagcugggcacugccgagcuccucaaacacugggugaccgcagugaacuguccuguauuauggcauaauacaaacuuuaaagggaauacauagauaggcuaugcuaccugggaacucugucuugggcuguguauaguuauaaaacagauguaauaaaguaacgggagugacaggcucaccuaggauuuucaaaauuacuuuuaacuaaacugaaacacagcaucaagagaaaucgucaguaaucugucaaaguuuauuaagugagugacuacuagagaaaauguaaaauacuaucagauuccauaacuguauagcaugacauaaagagccuuagcaggucccaguaaccucagcaucaugaggcagaagccgaaaaccacaggucucaguuaccaaacuaauuacuuuguucuuuuuuuagggaggauccuggugccauuuacaacacacuguacacacaacacagugacuucugaauauagaagggaauagugggaucgcaagagaaugguugauucagucuagaaaccaagcaagcuucugaacacaguagcuauguucaaggguaacgguaaggauuacgggguuucagagcccacagcuacuaguauucaaauacaacuaauaggagacauggcgguauguaagucuagaaggcagaggcagguggauggaucucugggaguuaaaggucugccugaucuacauaaugaguucuagcccaaccauagcuaauagugagagccugucuuuaaaaagagaaacucuuucuuuaaaaaaaaaaaaaaaaauagccgggcaugguggcgcaugccuuuaaucccagcucuugggaggcagaggcaggcagacuucugaguucgaggcaagccuggucuaaacagugaguuccaggacagccagggcuauacagagaaacccugucucaaaaaaccauaauaauaauaauaaaacacuauccacauguacacacuuauagaaugaaaaucaagugccuuuacuagguucucaaaaagguugcaucccaaaaauaaccaauucucucaguaaguagcucaacaucagaguugaugcuugugaagcacacacaaggaccugugcucaagucacuaaaaaagaacugccaaggagagcuaaaaugaugcuuaccuaaaaaugcuaaguguccacucaagaaacaagagcaagaauacaaaggggggcaagagaagagaagagaugaaaccccacucuuucacgguccuaccuagguauuauauuacuuccugaaacaucucaacgcauucugagguuugaucacgcuucuacuaagcagcuuuuaacauuaccuguccuucagaagaaacccugauaacccagggucgugacagagauuaacaagacauccaauuugacuucccaaugcacaucauggcauaaggaugcucuuaaacacgaauaaauguacuuucuuuuacuuuuaaggagaaucauggggcuggauuacucuuaguuccuagauaccacagcucaaaacucccuaacuccagcucuagggaagcugacacuccuggccucuaagaucaguugcacucaugugcacauauucacauaaagggacgcacacauaauuaaaacuugcuuuuugccuuuuugagacagggucucuuuauguaaacuuggcuggacaaguccauccgcccauuugcugagauuaaaugucuguguaaccacaccaggcaguauaauuauuuuuuccaaagaggggcuggagagaugacucuggugcuuaagagcacuugaaggucuuccagagguggcaauagucuaauuccaguccuaggagauucaaugcuccuccucugaccuugcugggcacugcacacgcguggugcacauguauacaugcauacagcaggacagaaaaaacacccauacaaauaaagugaaaugaaagaagucacuuuaauuuuuuaagagagaaugagaugagucaaagccuggcuggggcagcuaacuaguacaguacuuucuaaacgcaagggugugugagccuaaguucaacucucagcagugcugaauaaaugaacaaacgucagcuacuuggggagcaggaagccuggguuccaaaugagccuggauaauuuauggggaucuggucucaaaacaacaaaaaaguagaggcugggaacacagcuucaugguuaagagcccuggcuacucuaccagaaguucuggcuucaauucccagcccacacagcagucguuaacugucuguaacaaguucuaggagaccugaugggcucuucuguccuccaaaggcacugcacacagaugguacacagacagacaugcaggcaaaacacuaauacacccaaaaauaauuauuaaaaaaaaauugguaggcaaugaaagaguuaaaaauaauaaagagagccagaagcaaacacaaaugaaagcagcacacagugauauuuugccuuuuuagagugcuaaggguuaaagccagaacugcacucuaugaagaaguauacauccaagucuuuaaaacaugaaguauacaucuguacuggcuaguuuugugucaacuugacacagcuggaguuaucacagagaaaggagcuucaguugaggaaaugccuccaugagauacaacuguaaggcauuuucucaauauagugaucaagagggaaaggccccuuguggguggugccaucccugggcugguagucuuaguucuuuaagagagcaggcugagcaagccaggggaagcaagucaguaaagaacaucccuccauggccucugcaucagcuccugcuuucugacuugcuugaguuccaguccugcauccuuugguggucaacagcaguauggaaguguaagccgaauaaacccuuuccuucccaauuugcuucuuggucaugauguuugugcaggaauagaaacccugacuaagacaacauccaagucuuuaaaacaugauuaggggacugguaagauguuucaggaggucaaagugccugccacacacgccuacagaucugagcuggauaccagaacccauguaaaaaguagaccaauuccgccaagcuguuuuuugacuuccagguauacaccauguaucuaucccacccuacacagacauacagauacauacacaacaaaaagcuacucaaagguuugugguuuuuuuuuuuuuuuuaaggcucaaggguccguagcuacauaguuuaagguuagacuaggauacauaagaucuuacaugaaaaagaacuguuauuaaguuauacuauguuuauaauauucaaaauuaccuaccuugcugacuuacagccacuaaauuucuguagaucauugcauauauuuuccuuguaagaaaagaaaaaaaaaaaaaaaacaacaugugaguagagagccuacagcugagagaugucagauccauuuacacacccacagacuaacgacucgaccugucucaaaagaggucaagccugguaaccugcauucaauccccaguacccacaugguggaaggacaagcugacuccugacugccacacacucacaguggcauaugcacauacacacacacacaaucaaaacuaagauuccagaguucagguucccacacaauaugcuacgacuacuguuaaucgcaguagggccucaaaaaaugacacccaauguuagcauuuuguauccauggucaguuccucucugacagaggugagaaacagugaccgcccagcugguacuucuuuaagauguuuuuuauguuuaccugcauguaugucugugugagggcaccagauccuauagaacuggcaguaccaacaguuguaagcugccaugggggcgcugggaauugaaccuggguccucuuaaccacugagcaucucuccagccccaugcacagccgcucgcuguucuuauaacccaccacgcacaaggcuuaccugugcuccuucacagagaaacucgggacuccaaacacaucuccuaggagaucauuugaacaauacacaaugugcugcugcuucucgucauauaaccucuuagucauaauauacuggccaauauaaaauauaaucugaaacacaaauaugguuucuaaguacuaaggaaaucacauagaauauauacauuauacauucagcaauaccacacuuaacugaacaaguuacacuuuacacuaacagccacacccauaaucauguacaagaccaaacaguuguauuguagaagcuucuuuuaaauacuuccacacugaugaaaauagaaguaacuguuucuccacauuacuuaaauguauuuucuguuuuucuuuuuuucuuauaaauuuuaauuuuucccagaaacuuagauacuaacauaugauacuaggaaagaaaaaagagguuuaaaaaaaaggggggggggggacacuggagagauggcccagugguuaagaacacugauugcucuuccaaagguugugaguucaaaucccagcaaccacaugguggcucuguaaugagaucugaugcccucuucuggggugucugaagauaacuacaguguacuuacauguaauaaauaaauaaaucuuaaaaaaaaauugaauaaaaaaaaagaguaagguaaaauacagcaauguauuagaauagugacaugucacaaacguauacuucuacagcucugaggucaucacagaggaagacaggacaucaugaguaacaucucccaauggaauauucucaguuauuaauauagucuucaccaaacaguccagggcccgaaccaucacuauuauuauauuccaugugcuccauuauggcagcuuaagcaacauacuuugucauuccaaaacgagcccaucaacaauguaacucuagacagcauuuuacagugcacagguuugucaguacagucucaccauccugacaccccagggaacuguuauuccuguaugaaaacaaggucacgagugucguucaguagguaaaaugugcucccuugaucugacacccaguaccacaggggggaaaauaaaaacauaaacagagaugagaaacuaacccaggacaugacaccuaucccagcguacugucuaccacacuagcucacuacauucucaaguguccuagaauaaagaucuuguaacugaaaacugguaucagacacuauaaacaaucuguaagucccacccccacagauccauuugacugugggucuaauaauauuccuggcauccauccugaauguagaaauguuuuuccuugucacuauuccuuaaagaauacaguauaacaacuacacacauuguguauuacagauacucuagggauaacuuaaugucuaagaggugauguccauacagagacaguuucacgguuuaaguaagagacuuggcaggcaguguccugaagccaacuccccgcagagagcaggaggacagcugaccuacugcacacagcuuagcauaagcacuaaaucuuuuugauggccuucaucgauuuucucauaucuaccuacuacuaaauccauacuuguuuaucauuugucuaaccuuuauaaaggucaauccaaaguuaaugaccuuaaaaacaucacuuaacacuuaaagagacuuuaacuagcuaaguaggagccaaucaaucugaaaggcaauuuuuacaugucuauagaucacaaaguauugacagucagugggacagaaaggacacuuggguuccuccaacaaaguguucuuugagacguuuccaaauguguagcugagaagaagccccuaaccugccacaagaacuugaguguuuuaaguaaacaagccuuaaccuaagugagccagagaaacacuuauaucucagccaugcaaaacuucugucuacaacugaccaaccucuagcugaaaacaauacuuuacuaauaaacguuaaggcagagaauacaacauugugucuaugaaucagcccacugagcaucccaacaguuguauaaguucuuuuuucuuuuucuuucuuuuuccuuucuuucuuuuuuucuuuuucuucuuuuuuuuuuuuuuuuuuuuuuuugagacaggguuucucuguguagcccuggcugcucuggaacucacucuguagaccaggcuggccuugaacucagaaaucggccugccucugccuccccagugcugggaucaaaggcgugcgccaccacugcccagcaguuguacaaguucuaagcugggauccagggaugcccaagaaguccuuggauaaaauugagggaauccgcugggcagugguggcacacgccuucaaucucagacuugggagguggagacaggcagauuucugaguucaaggccagccuggucugcagagugaguuccagggcagccagggccacacagagaaacccugucucagaaagagaaaaagagaaaagagaacucaggaggcagaggcagguggaucucucuugagucugaggccagcuggucuacauagugaguuccaggacagucaggacuacauaguaaaacuuugucucaggggcuagugauggcucugguuaagaguacugauugcucuucugaaggucuuggguucaaaucccagcaaccacaugguagcucgcaaccaucuguaaugagaucugaugcccucuucuggagugucugaagacagguacaguguacucacauauaauaaauaaauacaucuuuuuaaaaaaaagaccuugucucaaagaaaggaaaggaggaagaaauucauguaaauuagaauuuuuagcuucaaauuacaguucaaaugaucacaaaacuuaauguccuugcucauuacaaaaucuguauggccaaucucacucaaacuugaaaaaccaccacagaugccuguauguaaccaugaagccaucggcucuccaccccucaguucugcucaccucuuucauaguguaagugucguuuugcgcuccaacggacuuuaacaacuucaaaagcaaugguuuuggucuaaccuguaaaagaaaagaaaaagagcugauguuacaccaugaacauacucuacagcacaagcccuuuauguauggccagaaagaagcccaauacaggcagcaaacgccgugcuuauaacaauuuguuaccgagcugcacuucagaaaguuggguuuuacacuaaguacaagugcacaccacuaagcguuaggacagaaaaugcuuugggaaaagcuacuaugaaauuaucaugaagucaucaaauccuggugucaugucaaauaaucaaacucaauuuguucugaucaaaacgguaucaagaugcuggagagauggcugagagauuaaaagcacuugcugcuuugcaggggacccaauucuagauuccuagggccaccaaaaggcagcuaccaacauccuaggcaauccaacauccacuguagucucugcaggcaggagcuacaaauacacacacacacacacacacacacacaggggagugugugagugagcacugacuccuuccuacagcuccaucaucugcuugccaccacacaaccuagcugagauccagucucuuacuauacuguacaaauccgucagucuacugaaagggagcuuauagaauguaggagaauagacuauaucuuagggcaaaaccuaucaccaaucuaucauauaccacauuccugacugcuaaagaaaccaaagucacaagguaaugaacaauucaaagaguacaaucacagcccucagcuacaacucauuguuuucuuuauaugugguuuaugcaucauuuauuuaucacuuaaaauacaugcaaaggcuagauauucucucucucucucucucucucucucucucucucacacacacacacacacacacacacacacacacacacacacucacuaaugacaaaugaucuuuaaagagcaugccaguaauaucagaagagccagaaaguguuuuuucuaugucuagccaacuuaaaagcaaaaguacuacauaaacuauaagaguaaauauauaacauuaagcuuuauuuauaaaaacaaguagccagcuacaauuugacucuaauccagcuuucccaguagugagacaauaguugauggggcugaggcuuagagguuaagaccacuuguugcucuuauagagacccugaauuuaguucucagaaccuauaugauagaucaaaacuaucuaacucugguuccaagggauccgacacccucuucugguuucuauagccaccagacauccacaugguacacauauacacaugcaggcaaaacauuccuauauauaaaauaagaaaugaauccuuaaaaagauaaaaacuggacaacugucaccuaccuaacaaggugucacccacaaagcagcuagugagcccagccuggcagccugacaacggauaccaaggaacaccaugauaaaugucccugagcuugcucuagccacgucagucugauaucaaaguauguuaccaucggccacagauacucuaaagacacuccugcacgucagcuuugaugaucaaggcuccuguucacucguguucuauagcuaguggaugcccagcacggagagccugcuggcuuucugucuguuccaugcauaugcauguuuugccugcauguacuuccaugcaccacuugugucccugguccccagggauaccacaacagugcuggaccccuggaauuggaguuccagauggcuaggagccaccauguggguacugagaguggaagccagguccucugaagagcagucgugcucccuccuggcugcuuggccggcugucucugucaggacaguuauuuuguauggcucuauuguugcaauggcugcagaucucacugugccaggccucugucuacauggcuagaauguggccucauggcagaguacugaggacaaauaggacuaaccacuaccuuuaaaggcauuuaguuuauuuuuaaaauacuauuaagugcuucaaggacaguaaguacacugagcugacuaagcugagagaguguuuagaaacugggaaggaaggcauguaacaugacuaugcucucuguaucugcaaacucagcuguuuuaguuugagauaaccacacagaccaccacuucuguggauuuuuuugguaauuugaagacuuuuauuauuauuuuauguauacugguauuucaccugauguauuuaagugcaccgugugcaaacaguguccuuggaggccaaaagaggccaucagauccucugcaacuagaguuacaagagggcugagccaccuuauccauucuggggauccaaccuggguccucuguaacaacagcaaaugcacuuaacugcugagcccucucuccagcaccacucuuuucuuuuucuuuuuuuaaagacuacuuuuagcacaauuuuaaaaugcacuuuucaguuauuuauuccagaagagcacacaaacugguuauccaauaccaaaaggucagcccugaaaacauacauacacaaauggcauuauucagacugagcaggcuguaucugggaacguagcauguacugggcauguaacaauuaaugaaaaaagucaugaaagagagaagggguauacuggaggcuuuggaagaaggaaaaggaaaggagaaaugguauaauuucaaaaauaaagaaaaaaguuuuaaagacucuguuauuuauguauucuguguaugagugcucugucugcguguacaccugcacaccagaagagggagggcaucagacaguugugagccaccauguaguugcugggaguugaacucagaaccucuggaagagcagucagugcucuuaaccucugagccaucucuccagccuauagaaaucaguuuuuuaaaaaaggguauuaagaccuuauuuucagauuaaguaauucacucuuacaagauuugaaaaagacuuuuuguuucuuuguuuuuucuagacaggguuucucuguguagccuuggcuguccuggaacucacuuuguagaccaggcuggccucgaacucagagaucugccugccucugccucccaagugcugggauuaaaggcaugcgccaccacgcccagcugaaaaagacuuacuaaugcuuaauuuucuuauguaacucauauagaagucaugcuagccuucuccuuaguguaucaauuuuaacauacguacugccaaagcaagaaguucuacauuuuugcauauuaaauuaacucaaaucaaaacucuacaauggaaagccaguuucuuaucaaagcuuacaagauaaaguuaauuuuaaaaacuacuauaaaaacacaacacuguaaucucacacuuaacaaagagaguucugaauaaagaucuacccggaaaagguuuuuaaaaugcuauaugaaaauacuuuaaauaugugcauaaucuugaaauggaagaauuccuccaaagcauuacaagaaaauucaaaaauuaucaaaauaaacaaauuugauaccuucaauggggcagacaucagauuauaguccuuguaaaaaaaaauuucuuagguuaacuauacuugaaaauuaugcaagcuacuaaaauaugcaaaaaaaaaaaaugggggaggaaaggaagagcgagaguaaauagagagagacauuggcaaacccagaacaaacaggcuguuuaacuggagaucugggacaugcccacugaaacaauacauuuuacuccacagagcaguaaccguaggaacugacuuaacuugcauacauguauucuccacaaauauguaugaaauuacaucagaaagggaaaacgagggcuggcaauauucgugcuggcaggaucgaagacggccaugaccucugcugagcagagugagcagucugcaaucaaaugugguuaccaggacguaggauucuaguucccuaucuuccucacccuuacuuuacucaaacacaugggcaacuuuuacaucccccaguagucgugagccugagacugucgcucagcucaguaguacaguacuugcauacacacacauucuaaaggcugagguucaaucgcauuaucaaauccuaugcagcuauuaaaaguaauuuuguaacuuacugacaagcuguagaacaccuuuauaugcuaauauaaaguagaaaacuuaaagagauacagagcaaagacuggaacuuuauauauuuuaugcauuccucucauaacuaaaauccucacaaaaagcacggaugcuucuaugacuuucgguuuaccauuuagaacagugauagaacaucaugucacaaccagcagcacccacacacugugcacuucuaaagccugcgucaggggaagggcuguggaaauauaggucgcagugaccacucucuaaugcaauugcaaucgagaaaguuaagaguuuguagguaaauacuuaaaacgacugugcgauaauccagguuucaauuuuguuuccucgauuaccugguaaaacaagcuauauuuacacacucgaggcagaaauaccaaccagagucucuuguuccgaagcuggaaucugugaggugcuugcagcacccucgguagacacagacauguugguauugcacauuggccuacaaguagaaaaaaaacaacaacacacacgauaaaaacuugaaauuauaaaacaucuacgaaaagggacaaauagauacaugcauuuacgaaggagacagaaaacgucuuucggcaauagcucucaaaugcaaaacgacgucggcgagcugucccuuaccuggaggcccgcaggagaagcgcggugauccgagagggucccccagggguguccggucggucucccgcucgcccagcagacggcugcggaaacggggcagcguuuaaauaaccccagcuggagacaugucaggacuuagcuccuccgacagccgacgccggacgugucccaacuugaccagccccacaggaagagcugagucaacucggcccagcccagucccacccgucccggaagccgcaucccggcgaguccgggaccaggcaccugucaccuccuggaccccagcaacgagcccagcgcgaccccggagcgggccccccgcgcgcggggccugcugggagacccccgcucuucccuccucccccucccuccguccccucccgcgcaugcgccgugcuaaccgcgccaucucccaccccaccccccacucccacccacacgcacacccccggccgcagaaugacaucagggcccagcgcgggcaaacggucgcccagccucgugccccgcgaccccacgagccggcccggguuacgaguaggccccggagggcgcggaaaagagggaaugaucgggacucuccgccgcccacggagcggguaccugcuacuucccgcgcaucuuccgacccuucacggggagcgcggaggccccgcggccggggccugagcgaccauggucgcuccagagcucgagcgacgagaaggcggcggcuccucaccggccgcuccuaggcuacgcuggccccggaggccccguuaacaaagcagaguucugugacgagcgcccccuaccguccgcggagagaacg

SEQ ID NO: 5747 - RNA, 21886 nt, Mus musculus
cguucucuccgcggacgguagggggcgcucgucacagaacucugcuuuguuaacggggccuccggggccagcguagccuaggagcggccggugaggagccgccgccuucucgucgcucgagcucuggagcgaccauggucgcucaggccccggccgcggggccuccgcgcuccccgugaagggucggaagaugcgcgggaaguagcagguacccgcuccgugggcggcggagagucccgaucauucccucuuuuccgcgcccuccggggccuacucguaacccgggccggcucguggggucgcggggcacgaggcugggcgaccguuugcccgcgcugggcccugaugucauucugcggccgggggugugcgugugggugggagugggggguggggugggagauggcgcgguuagcacggcgcaugcgcgggaggggacggagggagggggaggagggaagagcgggggucucccagcaggccccgcgcgcggggggcccgcuccggggucgcgcugggcucguugcugggguccaggaggugacaggugccuggucccggacucgccgggaugcggcuuccgggacgggugggacugggcugggccgaguugacucagcucuuccuguggggcuggucaaguugggacacguccggcgucggcugucggaggagcuaaguccugacaugucuccagcugggguuauuuaaacgcugccccguuuccgcagccgucugcugggcgagcgggagaccgaccggacaccccugggggacccucucggaucaccgcgcuucuccugcgggccuccagguaagggacagcucgccgacgucguuuugcauuugagagcuauugccgaaagacguuuucugucuccuucguaaaugcauguaucuauuugucccuuuucguagauguuuuauaauuucaaguuuuuaucguguguguuguuguuuuuuuucuacuuguaggccaaugugcaauaccaacaugucugugucuaccgagggugcugcaagcaccucacagauuccagcuucggaacaagagacucugguugguauuucugccucgaguguguaaauauagcuuguuuuaccagguaaucgaggaaacaaaauugaaaccuggauuaucgcacagucguuuuaaguauuuaccuacaaacucuuaacuuucucgauugcaauugcauuagagaguggucacugcgaccuauauuuccacagcccuuccccugacgcaggcuuuagaagugcacagugugugggugcugcugguugugacaugauguucuaucacuguucuaaaugguaaaccgaaagucauagaagcauccgugcuuuuugugaggauuuuaguuaugagaggaaugcauaaaauauauaaaguuccagucuuugcucuguaucucuuuaaguuuucuacuuuauauuagcauauaaagguguucuacagcuugucaguaaguuacaaaauuacuuuuaauagcugcauaggauuugauaaugcgauugaaccucagccuuuagaauguguguguaugcaaguacuguacuacugagcugagcgacagucucaggcucacgacuacugggggauguaaaaguugcccauguguuugaguaaaguaagggugaggaagauagggaacuagaauccuacguccugguaaccacauuugauugcagacugcucacucugcucagcagaggucauggccgucuucgauccugccagcacgaauauugccagcccucguuuucccuuucugauguaauuucauacauauuuguggagaauacauguaugcaaguuaagucaguuccuacgguuacugcucuguggaguaaaauguauuguuucagugggcaugucccagaucuccaguuaaacagccuguuuguucuggguuugccaaugucucucucuauuuacucucgcucuuccuuuccucccccauuuuuuuuuuuugcauauuuuaguagcuugcauaauuuucaaguauaguuaaccuaagaaauuuuuuuuuacaaggacuauaaucugaugucugccccauugaagguaucaaauuuguuuauuuugauaauuuuugaauuuucuuguaaugcuuuggaggaauucuuccauuucaagauuaugcacauauuuaaaguauuuucauauagcauuuuaaaaaccuuuuccggguagaucuuuauucagaacucucuuuguuaagugugagauuacaguguuguguuuuuauaguaguuuuuaaaauuaacuuuaucuuguaagcuuugauaagaaacuggcuuuccauuguagaguuuugauuugaguuaauuuaauaugcaaaaauguagaacuucuugcuuuggcaguacguauguuaaaauugauacacuaaggagaaggcuagcaugacuucuauaugaguuacauaagaaaauuaagcauuaguaagucuuuuucagcugggcgugguggcgcaugccuuuaaucccagcacuugggaggcagaggcaggcagaucucugaguucgaggccagccuggucuacaaagugaguuccaggacagccaaggcuacacagagaaacccugucuagaaaaaacaaagaaacaaaaagucuuuuucaaaucuuguaagagugaauuacuuaaucugaaaauaaggucuuaauacccuuuuuuaaaaaacugauuucuauaggcuggagagauggcucagagguuaagagcacugacugcucuuccagagguucugaguucaacucccagcaacuacaugguggcucacaacugucugaugcccucccucuucuggugugcagguguacacgcagacagagcacucauacacagaauacauaaauaacagagucuuuaaaacuuuuuucuuuauuuuugaaauuauaccauuucuccuuuccuuuuccuucuuccaaagccuccaguauaccccuucucucuuucaugacuuuuuucauuaauuguuacaugcccaguacaugcuacguucccagauacagccugcucagucugaauaaugccauuuguguauguauguuuucagggcugaccuuuugguauuggauaaccaguuugugugcucuucuggaauaaauaacugaaaagugcauuuuaaaauugugcuaaaaguagucuuuaaaaaaagaaaaagaaaagaguggugcuggagagagggcucagcaguuaagugcauuugcuguuguuacagaggacccagguuggauccccagaauggauaagguggcucagcccucuuguaacucuaguugcagaggaucugauggccucuuuuggccuccaaggacacuguuugcacacggugcacuuaaauacaucaggugaaauaccaguauacauaaaauaauaauaaaagucuucaaauuaccaaaaaaauccacagaagugguggucugugugguuaucucaaacuaaaacagcugaguuugcagauacagagagcauagucauguuacaugccuuccuucccaguuucuaaacacucucucagcuuagucagcucaguguacuuacuguccuugaagcacuuaauaguauuuuaaaaauaaacuaaaugccuuuaaagguagugguuaguccuauuuguccucaguacucugccaugaggccacauucuagccauguagacagaggccuggcacagugagaucugcagccauugcaacaauagagccauacaaaauaacuguccugacagagacagccggccaagcagccaggagggagcacgacugcucuucagaggaccuggcuuccacucucaguacccacaugguggcuccuagccaucuggaacuccaauuccagggguccagcacuguugugguaucccuggggaccagggacacaaguggugcauggaaguacaugcaggcaaaacaugcauaugcauggaacagacagaaagccagcaggcucuccgugcugggcauccacuagcuauagaacacgagugaacaggagccuugaucaucaaagcugacgugcaggagugucuuuagaguaucuguggccgaugguaacauacuuugauaucagacugacguggcuagagcaagcucagggacauuuaucaugguguuccuugguauccguugucaggcugccaggcugggcucacuagcugcuuugugggugacaccuuguuagguaggugacaguuguccaguuuuuaucuuuuuaaggauucauuucuuauuuuauauauaggaauguuuugccugcauguguauauguguaccauguggaugucugguggcuauagaaaccagaagagggugucggaucccuuggaaccagaguuagauaguuuugaucuaucauauagguucugagaacuaaauucagggucucuauaagagcaacaaguggucuuaaccucuaagccucagccccaucaacuauugucucacuacugggaaagcuggauuagagucaaauuguagcuggcuacuuguuuuuauaaauaaagcuuaauguuauauauuuacucuuauaguuuauguaguacuuuugcuuuuaaguuggcuagacauagaaaaaacacuuucuggcucuucugauauuacuggcaugcucuuuaaagaucauuugucauuagugagugugugugugugugugugugugugugugugugugugugugagagagagagagagagagagagagagagagagaauaucuagccuuugcauguauuuuaagugauaaauaaaugaugcauaaaccacauauaaagaaaacaaugaguuguagcugagggcugugauuguacucuuugaauuguucauuaccuugugacuuugguuucuuuagcagucaggaaugugguauaugauagauuggugauagguuuugcccuaagauauagucuauucuccuacauucuauaagcucccuuucaguagacugacggauuuguacaguauaguaagagacuggaucucagcuagguugugugguggcaagcagaugauggagcuguaggaaggagucagugcucacucacacacuccccuguguguguguguguguguguguguguauuuguagcuccugccugcagagacuacaguggauguuggauugccuaggauguugguagcugccuuuugguggcccuaggaaucuagaauuggguccccugcaaagcagcaagugcuuuuaaucucucagccaucucuccagcaucuugauaccguuuugaucagaacaaauugaguuugauuauuugacaugacaccaggauuugaugacuucaugauaauuucauaguagcuuuucccaaagcauuuucuguccuaacgcuuaguggugugcacuuguacuuaguguaaaacccaacuuucugaagugcagcucgguaacaaauuguuauaagcacggcguuugcugccuguauugggcuucuuucuggccauacauaaagggcuugugcuguagaguauguucaugguguaacaucagcucuuuuucuuuucuuuuacagguuagaccaaaaccauugcuuuugaaguuguuaaaguccguuggagcgcaaaacgacacuuacacuaugaaagaggugagcagaacugagggguggagagccgauggcuucaugguuacauacaggcaucuguggugguuuuucaaguuugagugagauuggccauacagauuuuguaaugagcaaggacauuaaguuuugugaucauuugaacuguaauuugaagcuaaaaauucuaauuuacaugaauuucuuccuccuuuccuuucuuugagacaaggucuuuuuuuuaaaaagauguauuuauuuauuauaugugaguacacuguaccugucuucagacacuccagaagagggcaucagaucucauuacagaugguugcgagcuaccaugugguugcugggauuugaacccaagaccuucagaagagcaaucaguacucuuaaccagagccaucacuagccccugagacaaaguuuuacuauguaguccugacuguccuggaacucacuauguagaccagcuggccucagacucaagagagauccaccugccucugccuccugaguucucuuuucucuuuuucucuuucugagacaggguuucucuguguggcccuggcugcccuggaacucacucugcagaccaggcuggccuugaacucagaaaucugccugucuccaccucccaagucugagauugaaggcgugugccaccacugcccagcggauucccucaauuuuauccaaggacuucuugggcaucccuggaucccagcuuagaacuuguacaacugcugggcagugguggcgcacgccuuugaucccagcacuggggaggcagaggcaggccgauuucugaguucaaggccagccuggucuacagagugaguuccagagcagccagggcuacacagagaaacccugucucaaaaaaaaaaaaaaaaaaaaaaaagaagaaaaagaaaaaaagaaagaaaggaaaaagaaagaaaaagaaaaaagaacuuauacaacuguugggaugcucagugggcugauucauagacacaauguuguauucucugccuuaacguuuauuaguaaaguauuguuuucagcuagagguuggucaguuguagacagaaguuuugcauggcugagauauaaguguuucucuggcucacuuagguuaaggcuuguuuacuuaaaacacucaaguucuuguggcagguuaggggcuucuucucagcuacacauuuggaaacgucucaaagaacacuuuguuggaggaacccaaguguccuuucugucccacugacugucaauacuuugugaucuauagacauguaaaaauugccuuucagauugauuggcuccuacuuagcuaguuaaagucucuuuaaguguuaagugauguuuuuaaggucauuaacuuuggauugaccuuuauaaagguuagacaaaugauaaacaaguauggauuuaguaguagguagauaugagaaaaucgaugaaggccaucaaaaagauuuagugcuuaugcuaagcugugugcaguaggucagcuguccuccugcucucugcggggaguuggcuucaggacacugccugccaagucucuuacuuaaaccgugaaacugucucuguauggacaucaccucuuagacauuaaguuaucccuagaguaucuguaauacacaauguguguaguuguuauacuguauucuuuaaggaauagugacaaggaaaaacauuucuacauucaggauggaugccaggaauauuauuagacccacagucaaauggaucugugggggugggacuuacagauuguuuauagugucugauaccaguuuucaguuacaagaucuuuauucuaggacacuugagaauguagugagcuagugugguagacaguacgcugggauaggugucauguccuggguuaguuucucaucucuguuuauguuuuuauuuuccccccugugguacugggugucagaucaagggagcacauuuuaccuacugaacgacacucgugaccuuguuuucauacaggaauaacaguucccuggggugucaggauggugagacuguacugacaaaccugugcacuguaaaaugcugucuagaguuacauuguugaugggcucguuuuggaaugacaaaguauguugcuuaagcugccauaauggagcacauggaauauaauaauagugaugguucgggcccuggacuguuuggugaagacuauauuaauaacugagaauauuccauugggagauguuacucaugauguccugucuuccucugugaugaccucagagcuguagaaguauacguuugugacaugucacuauucuaauacauugcuguauuuuaccuuacucuuuuuuuuuauucaauuuuuuuuuaagauuuauuuauuuauuacauguaaguacacuguaguuaucuucagacaccccagaagagggcaucagaucucauuacagagccaccaugugguugcugggauuugaacucacaaccuuuggaagagcaaucaguguucuuaaccacugggccaucucuccaguguccccccccccccuuuuuuuuaaaccucuuuuuucuuuccuaguaucauauguuaguaucuaaguuucugggaaaaauuaaaauuuauaagaaaaaaagaaaaacagaaaauacauuuaaguaauguggagaaacaguuacuucuauuuucaucaguguggaaguauuuaaaagaagcuucuacaauacaacuguuuggucuuguacaugauuauggguguggcuguuaguguaaaguguaacuuguucaguuaagugugguauugcugaauguauaauguauauauucuaugugauuuccuuaguacuuagaaaccauauuuguguuucagauuauauuuuauauuggccaguauauuaugacuaagagguuauaugacgagaagcagcagcacauuguguauuguucaaaugaucuccuaggagauguguuuggagucccgaguuucucugugaaggagcacagguaagccuugugcgugguggguuauaagaacagcgagcggcugugcauggggcuggagagaugcucagugguuaagaggacccagguucaauucccagcgcccccauggcagcuuacaacuguugguacugccaguucuauaggaucuggugcccucacacagacauacaugcagguaaacauaaaaaacaucuuaaagaaguaccagcugggcggucacuguuucucaccucugucagagaggaacugaccauggauacaaaaugcuaacauugggugucauuuuuugaggcccuacugcgauuaacaguagucguagcauauugugugggaaccugaacucuggaaucuuaguuuugauuguguguguguguaugugcauaugccacugugaguguguggcagucaggagucagcuuguccuuccaccauguggguacuggggauugaaugcagguuaccaggcuugaccucuuuugagacaggucgagucguuagucuguggguguguaaauggaucugacaucucucagcuguaggcucucuacucacauguuguuuuuuuuuuuuuuuucuuuucuuacaaggaaaauauaugcaaugaucuacagaaauuuaguggcuguaagucagcaagguagguaauuuugaauauuauaaacauaguauaacuuaauaacaguucuuuuucauguaagaucuuauguauccuagucuaaccuuaaacuauguagcuacggacccuugagccuuaaaaaaaaaaaaaaaaccacaaaccuuugaguagcuuuuuguuguguauguaucuguaugucuguguagggugggauagauacaugguguauaccuggaagucaaaaaacagcuuggcggaauuggucuacuuuuuacauggguucugguauccagcucagaucuguaggcguguguggcaggcacuuugaccuccugaaacaucuuaccaguccccuaaucauguuuuaaagacuuggauguugucuuagucaggguuucuauuccugcacaaacaucaugaccaagaagcaaauugggaaggaaaggguuuauucggcuuacacuuccauacugcuguugaccaccaaaggaugcaggacuggaacucaagcaagucagaaagcaggagcugaugcagaggccauggagggauguucuuuacugacuugcuuccccuggcuugcucagccugcucucuuaaagaacuaagacuaccagcccagggauggcaccacccacaaggggccuuucccucuugaucacuauauugagaaaaugccuuacaguuguaucucauggaggcauuuccucaacugaagcuccuuucucugugauaacuccagcugugucaaguugacacaaaacuagccaguacagauguauacuucauguuuuaaagacuuggauguauacuucuucauagagugcaguucuggcuuuaacccuuagcacucuaaaaaggcaaaauaucacugugugcugcuuucauuuguguuugcuucuggcucucuuuauuauuuuuaacucuuucauugccuaccaauuuuuuuuuaauaauuauuuuuggguguauuaguguuuugccugcaugucugucuguguaccaucugugugcagugccuuuggaggacagaagagcccaucaggucuccuagaacuuguuacagacaguuaacgacugcugugugggcugggaauugaagccagaacuucugguagaguagccagggcucuuaaccaugaagcuguguucccagccucuacuuuuuuguuguuuugagaccagauccccauaaauuauccaggcucauuuggaacccaggcuuccugcuccccaaguagcugacguuuguucauuuauucagcacugcugagaguugaacuuaggcucacacacccuugcguuuagaaaguacuguacuaguuagcugccccagccaggcuuugacucaucucauucucucuuaaaaaauuaaagugacuucuuucauuucacuuuauuuguauggguguuuuuucuguccugcuguaugcauguauacaugugcaccacgcgugugcagugcccagcaaggucagaggaggagcauugaaucuccuaggacuggaauuagacuauugccaccucuggaagaccuucaagugcucuuaagcaccagagucaucucuccagccccucuuuggaaaaaauaauuauacugccuggugugguuacacagacauuuaaucucagcaaaugggcggauggacuuguccagccaaguuuacauaaagagacccugucucaaaaaggcaaaaagcaaguuuuaauuaugugugcgucccuuuaugugaauaugugcacaugagugcaacugaucuuagaggccaggagugucagcuucccuagagcuggaguuagggaguuuugagcugugguaucuaggaacuaagaguaauccagccccaugauucuccuuaaaaguaaaagaaaguacauuuauucguguuuaagagcauccuuaugccaugaugugcauugggaagucaaauuggaugucuuguuaaucucugucacgacccuggguuaucaggguuucuucugaaggacagguaauguuaaaagcugcuuaguagaagcgugaucaaaccucagaaugcguugagauguuucaggaaguaauauaauaccuagguaggaccgugaaagagugggguuucaucucuucucuucucuugccccccuuuguauucuugcucuuguuucuugaguggacacuuagcauuuuuagguaagcaucauuuuagcucuccuuggcaguucuuuuuuagugacuugagcacagguccuugugugugcuucacaagcaucaacucugauguugagcuacuuacugagagaauugguuauuuuugggaugcaaccuuuuugagaaccuaguaaaggcacuugauuuucauucuauaaguguguacauguggauaguguuuuauuauuauuauuaugguuuuuugagacaggguuucucuguauagcccuggcuguccuggaacucacuguuuagaccaggcuugccucgaacucagaagucugccugccucugccucccaagagcugggauuaaaggcaugcgccaccaugcccggcuauuuuuuuuuuuuuuuuuaaagaaagaguuucucuuuuuaaagacaggcucucacuauuagcuaugguugggcuagaacucauuauguagaucaggcagaccuuuaacucccagagauccauccaccugccucugccuucuagacuuacauaccgccaugucuccuauuaguuguauuugaauacuaguagcugugggcucugaaaccccguaauccuuaccguuacccuugaacauagcuacuguguucagaagcuugcuugguuucuagacugaaucaaccauucucuugcgaucccacuauucccuucuauauucagaagucacuguguuguguguacaguguguuguaaauggcaccaggauccucccuaaaaaaagaacaaaguaauuaguuugguaacugagaccugugguuuucggcuucugccucaugaugcugagguuacugggaccugcuaaggcucuuuaugucaugcuauacaguuauggaaucugauaguauuuuacauuuucucuaguagucacucacuuaauaaacuuugacagauuacugacgauuucucuugaugcuguguuucaguuuaguuaaaaguaauuuugaaaauccuaggugagccugucacucccguuacuuuauuacaucuguuuuauaacuauacacagcccaagacagaguucccagguagcauagccuaucuauguauucccuuuaaaguuuguauuaugccauaauacaggacaguucacugcggucacccaguguuugaggagcucggcagugcccagcuguggucucacgguugauggaugugcuuuaggcgguagucuaggguauggauugugauuuuugaguaauuuuguccauuccaguucuggaacuuggauguuuugagagcuuggucugugaaacuaaguacaaacuacaccugucuaucuacauaacucuuuuaaauucauuauuuuuuccaagcuaaaucguucaccucccucaccucucuuggugagugguaccacacauucuucaucuaguuagacucuugggaucacuuccuuuuccuuacagacaucuagucuuaaccaguuuuuaugucuuaauuuuucucaaguugauugucuuaguuaggguuugcauugcugugaagagacaacaugaccaaggcaacuccuguuauuaagaaaaacauuuaguuggggcuugacuuaauacuucagaggauuaguccauuauccucaaggcaguaagcauggcagcaugcaggcagauguggugcuggaggagcugagaguucuauacccuuauccaaagguggaaggcaaguaagaggcagguuucuuccacauugggcggggccugagcaagggagccuuagagcccacgcccacagagacacaccucuuccaaccaggucacaccuccucuagccaggccacacccugggccaagcauauucaaaccaccacuuaaauacuuuaacuacauguauauauguauguauguguauaugugugugugucuauacacacacacauauacacauacacacagaguauacacacacacacauacacacacaguugucuuuguauuucaaauacuguuugcuuguuucugugcucuguuugccuucccguguggaccuccuacaugcuaacugaggccuccuccacugaaucacuauggcuugacagucucacugaguugcccaggcuggccugcuggagaugauugcuguaguguaaaucaccgugcccaguugggaguggugguggguuuguuguuuuuuaaauucuauuuugucagagugguuuguugcuuuuuuuguuguuguuguucuuuuuuuguuuuuuugagacaggguuucucuguguagcccuggcuguccuggaacucacuuuguagaccaugcuggccucgaacucagaaauuggccugccucugccuuugccuuccaagugcugagguuaaaggcgugugccaccaccaccuggagguuuguugcuucuuauuuaggaguuuuaugauugcucucuggggagaauaguucugugagcuaggaaauuagcuuuauuucuugaacuaaaacccuuuaauagugagaaguugcaagauggccucaggcaagauuauagaacugcuugaauaacuguugagaagaauaaccuuguaugugacucagcugaacacgcauggcucugugcacagcgacccugcacuuuacuguuugaguacagaggaguuuauuauguuggugucagucacaggaacuguuugcguguucaugauuucucacauacuaauccuucagucuggagugucuguccuaugcuaacuucagcguaggcgauuccagaaucuguccugauagcucuucagagccccucccccacgucuacuaaacauuuuuguuuccccugcuaguauaucuuaaaauuugcuuauuuugcuucauaauuccuguugaauuuauaucuccagcaugcaaaugacucuugauacaaaugguuaauaguuguuaaaagguuagauuuuguauugggcauguguuagacugguauauguugaauucuugauuucuuuguuuugauccacuuuuuacuuucucuuacaaucuucagacucuggcacaucgcugagugagagcagacgucagccugaaggugggagugaucugaagguaauacuugcauaaaguucuuacucuaacacacuuuucucuuuaaaauauccugucuguaaguguggguguguguauguccuccagccaaaagaaagaggugaugcucaccuggagcugaguuacagguggaugugagcugccccagacaugagugauggaaaccaaacacaccccagcaagaacagcacauggucuucuucucugagccaccgcucuagcuucaugacacauaguucuugaaaauugggaggguuacauaaaacaggguguggaacagccaauguuuaauguuuauuuugcaauauuuuacuuucuuuuauguacuuaggauccuuugcaagcgccaccagaagagaaaccuucaucuucugauuuaauuucuagacugucuaccucaucuagaaggagauccauuagugagacagguacauagggacauuaugugacauacuaaacaguugcuugguguuuccauuuugggucaaaugacccuuugacagaggucugagaccuaagaccacugaaaaccacaugguugcauuaugauucaucacauuagcaaaacuauggcuaugaaguagcaaugagaauaguuuuaugcuugggaucaccacuaugaggaacuguauuaaagagucacagugccgggcgaugguggcucucaucuuuaauccagcacuugggaggcagaggcaggcggauuucugaguucgaggccagccuggucuacagagugaguuccaggacagccagggguauacagagaaacccuguuucgaaaaaccaaaaaaaaagagucacaguguuaggaaaguuaagagcugcuacccuagacuucuaauaaaaggagaugaaguuguucuuuguuuugggacagggcuucuauauagaucagguugaccuuugcauagucuuuuucuuuuuucuuuuuuuuuuuaacuuuauuuauuuaauguaugagugcucugcugcucuuaaccacugagcuguuucaccagcccagccuuauucuuaaagcuuacuguugauggggaaaucguguacuguugaaucaguaaaagcacuaggaggauuaaaugaguaacuuguggagguaacguccacaaagaagguugcaagcuuagaaguagagcuuauguguagcugaacagauccaaugaaacacugcugacuuuugaaacauuaaugguucacuucucuguuuaauauaauugaaauuaaauuuuguugcaaauaggugcugaagauauuucaaucucaaaucagucccaguacagggaguuuuaaccccauguccuuuaaucuauagaagagaacacagaugagcuaccuggggagcggcaccggaagcgccgcaggucccuguccuuugauccgagccugggucugugugagcugagggagaugugcagcggcggcagcagcagcaguagcagcagcagcagcgaguccacagagacgcccucgcaucagguagugcuuggguuuaagaaauuaucuuacuuuuuaauauggaagugucuugucugccagaauguacaccacaugcaugcagugcuuugaggccacaggaggguguggaguccccuggaacugggguuagggaugguuggagccacugugugggugccaggaaaguggguugacuaccacaucucugcccuaguuuugagugcugcagauuaaauccagggcucugugcgcacugggcaaguguucuaccaguuaauuacauccccaacacccaacagucagugagccaaccucucugcggaucucugccuaucuaguuucuuagaauagaaccugaccugcugucaaaacagaauauauauauauauauauauauauauauauauauauauauauauauauaugcucuucuaaaaaucuuccauauuaaaaauuuguuacuuuuuaaacuuaagugaaaaugcuuuuaauacaacuguguuuugcuuuguuuuaacuuacuuaugagaacauuagucucaguaguuuuacccuuuauuuacagggaacacuaugccugauaguguuucaaauaauuuguuaaaggauccuacaacuaauuauuacauuuaauaagacaggcuagaacuugaaagcucagcgguuaagagcccugacugcucuuccagagguccugaguucaacucccagcaaccacaugguggcucacaaccaucuauaaugggaucuggugcccucuucuggugugucugaagacagcaacaguauacuuagauauaauaauaaauuaaucuuaaaaaaaaaagacuacuuuuaugucaagcugacuguauuuucuggaagagaaaugaugugucugcaguuaagcagcaucuugguagcaaauugagaaugccuguguccugaauucuagagcaguguauuuuuaucaguuguaaguaaguugauuugcggaugaacuuaguguaugauuugaaguugaaucucuuguuugcauuuuugugagacagggucucuuauuuaguucugacucuuggcuguccuggaacucacuguauagaccaggcugguuuugaaccuacagagaucuuccagucucugccuccugaaugaaugcuaggauuaaaggcauacaccacaugccuggccugaaguugaaucuuuuaaucucagcacucaggaagcagggacagcagagcucucugagguaauagccaauauagugucacaugagguaauagccaauauagugucacaugagguaauagccaauauagugucacaugagguaauagccaauauagugucacaugagguaauagccaauauagugucacaugagguaauagccaauauagugucacaugagguaauagccaauauagugucacaugagguaauagccaauauagugucacaugagguaauagccaauauagugucacaugagguaauagccaauauagugucacaugagguaauagccaauauagugucacaugagguaauagccaauauagugucacaugagguaauagccaauauagugucacaugagguaauagccaauauagugucacaugaggccccaggccaacuaaggcugcaucggaaaacccagaugccagcuugguguuugugugucgucacuagcacuccgucacacuagccugugagucagggaggccuucgucuuccuguguuuaauaggauaaacucacaguggugcuucagauaauaguaggugugcauauaaucacacacguaggaaaggucauuguggaagaucuuuuuaugguauugugggaaccuuaaccaaagaaagaugaguggggcuuagaaacucagauuaucuuacugagaaaaaguuaguguguggauugauuuaggaaacaagauguggcuggagcauggguauugaauaggguggaggguguguuuagcuggacauuugaaaauguuaaugcagucauucugaguguaaccucggggcuaaggggcucugacuuuuccuucaugagguaggacuuuugaguaagguaguaaccuugaacccagucuauguggucuggggcugagaaggaaauaguggcucgggaugaacccgggagcucuaaaugaggcccagaggcaaugcauuuacauucgcugcauucuuccuccauaggaucuugacgauggcguaagugagcauucuggugauugccuggaucaggauucaguuucugaucaguuuagcguggaauuugaaguugagucucuggacucggaagauuacagccugagugacgaagggcacgagcucucagaugaggaugaugagguggguuucugugucugucagccuuuuaguaagaugaagaggccaucuauucagagucucuggaaagucuugcuuuuucauuuguucaagauagaauauugcuuuguggauuugaggugaaauuuuauaguuucuuugcuugauuuauuuauuuagauuuauuuguuauguauacagcauucugccugcauguaugucugcaggccagaagagggcacuagauaugguuacuagccaccaugugguugcugggaauugaacucaggaccuuuggaagaacagacagugcucuuaaccucugagucaucucuccagcccuuugcuugauuuauuauagucucacauuacuaaauaaaaaacuuagaggagaguuugaacaauguuuuuaaacuuuuuuugaguugaugggguguuuuuguuuuguuuguuuugcuuuuugagacuugguuuuuuuuuuuuuguuuuuguuuuuguuuuuguuuuuuuuuuuugguuuuucgagacaggguuucucuguguagccguggcuguccuggaacucacuuuguagaccaggcuggccucgaacucagaaauccaccugccucugccucccaagugcugggauuaaaggccuucgccaccacgcccggcgagacuugguuuuucuguauggcccuagcuguccuggaacuugcuuuguagaccaggcuggccucagaucugccugccuuugcuucccaaguccuggaauuaaaggugugcgccaccacugcucugcuaaugauggaugaacauucucauaauggcuggaccacaaaguucuccauuuggucuucccauuuauguauguauguguguguguguauuuguuuuugagacaggguaccaccguguaucccuggcugacccugaacuggcuaucuagaccagccuggccucaaacucaugggaauccucuugccucugccuccugauugcugggaugaaaggugugagccccuacuucugccccucccuucucaguacugauuuguuuuucaccaauguaaagcaugcaacgaacaguguccaauaggacccgaguaucucuuucucgggagcaacucuacauuucuaguuguuuucugucuaauaacucuaaauuuauaaaaugucuucuugaguguuuuguuugguuuuaaguaucuaacaacucuugccauugcgaguaaagguuuuccuauccugcguuuccugcuugccuugaacugcauuuaacuuucuuucagaacucuucguccacaguuaauggcucaagcuguuuguuuuaagacuuacugagaauucuggcuucuugguugaaggguugaauugaugcuaaugaauuugucuuacuaggucuaucgggucacagucuaucagacaggagaaagcgauacagacucuuuugaaggagauccugagauuuccuuagcuguaaguauauagauucuucaaagaaauaaaacacaauguugagaucagaauuaggacuauagguaguugugagccaccacgugugugcucagaaccugagccaucucuagccugucacuauuucauauaggucaccuuuuguguguguguguguguguaggggaaaguaccuagagucuacucuauuagcuaauuucugguauauaguauuagauauauuccucauguucuuugccuauuuauguaaaauaugaaaugcugaaaauuaagcuacaugguauacuuuuaccuuagccacauugaaguuauuagccuugcuaugaacacugacugaagaguuacugucuuuuuuauugaaggacuauuggaaguguaccucaugcaaugaaaugaauccuccccuuccaucacacugcaaaagaugcuggacccuucgugagaacuggcuuccagacgauaaggggaaagauaaaguggaaaucucugaaaaagccaaacuggaaaacucagcucaggcagaagaaggcuuggaugugccugauggcaaaaagcugacagagaaugaugcuaaagagccaugugcugaggaggacagcgaggagaaggccgaacagacgccccugucccaggagagugacgacuauucccaaccaucgacuuccagcagcauuguuuauagcagccaagaaagcgugaaagaguugaaggaggaaacgcaggacaaagacgagaguguggaaucuagcuucucccugaaugccaucgaaccaugugugaucugccaggggcggccuaaaaauggcugcauuguucacggcaagacuggacaccucaugucauguuucacgugugcaaagaagcuaaaaaaaagaaacaagcccugcccagugugcagacagccaauccaaaugauugugcuaacuuacuucaacuagcugaccugcucacaaaaauagaauuuuauauuucuaacuauaugacccccaaauuagacaacauggguauuauuuuuauacauuaaagccagaaaacugucuuaguccacauaaaauucacuuauaauuuauccuggagaguaaauauggugaauauuuucuuccuuuuuagggaaauuucacuuguuuauuuuauauuuguguuuuaaguaauuugcauuggcuguuuauauuuuccuuauauuuuaaauaaucuccgcuuggaaggacuuuggaaguguaugugagaaguccuuuccaucuccugcagaugaugguggaccuuccucaucaagggcuacagaaguacuugauuucuguuuuuuuuguuaauaauaagaacauuuaauuuauuuagugucuuucauguaaagaguuaaagacuaugugaaggauuguauauuuaaguuauugaaauucugaaacuguaguaaucuaaaaugugugaguugugggcugcagagaagacucagccaguaaaggcaccugcuguguacacccacugacacacauuugauccuuggaacccccaggaagagugaaccaguuccacaaaguuguucccugaucuucaaauggaugcacgcaugcacgcacacacacgcgcgcgugcgcacacacacacacacacacacacacacacacacacacacacacacacacacaguuuuaaaggcaugaauugcaucuggugguauguaagugaaaacacacgccuuauuuuccagcauuuucagcuuuuugucauagggguguggcacaaguguugcaguuugucccagguugaaaagccugaggcugguagaagcgccuuuuugccucagcuccgugguuccuggugguugccuauguuucaggccuguacuuaggcuagguuuagaaaccagcccauucagaaagacugaaucagaacauggauaaagugaacucauucuaagaugacucgucuauccauguagauuaaucuccugguucauaauaggccucuucccuuugauugaagggucacgucuaaguauagaaaacauaaaacuguaagguagaggaagcgaaggauagcuuuguauuaauguugcguuaaagcuucagagacaagaacaagaacacuccucccacgugacagcauuugaauaggaggcggugggugcggcagccugggcagcuucagucccgauuuacaauaaaguaccuuguguguuauuaguucuuaaauguuuauuuagaaauggcauugauguuauuuauuugcaaauaaaugguuuauugaagaauugugaaagagauuugucuuacacau

SEQ ID NO: 5748 - RNA, 12932 nt, Mus musculus
ggaggagccguggcggacccgcucggagggcggcggccuauuaccucgcggcgcagcgaccgggacccggcuggcgcaugccugucuccggccggaccguggagcgggcggcugcgggcgcgcggcggcggagagccgggacagcgggagagcguccgagcgccccgcggggaggcuggacagcccgggcucggccgaggacgcugcuccgcagccggcgggcaucauggcaucgcuggcggaccggguccggggcaacgggcgcaucgccgccgggcuccuguucaaccugcugguguccaucugcaucguguuccucaacaaauggaucuauguacaccacggcuuccccaacaugagccugacccuggugcacuucguggucaccuggcugggcuuguacaucugccagaaacugaacaucuuugcccccaaaagucugccgcucuccaagcuccuccuccuggcccucagcuucuguggcuuuguggucuucaccaaccuuucucugcagaacaacaccauaggcaccuaucagcuggccaaggccaugaccacgccggugaucauagccauccaaaccuucugguaccagaagagauucuccgucagaauacagcucacgcuggugaguagcugccgcugccgcugcgcgagccugucccugcccagcuaccuggcugccuuucuccccgggaaaacugaauacaccuugcuuauagccuggcacgacggaagcccauucccauaaucuuuacuccacacacgagccaggcccuuauaagaagcuuguuuggggagggguggaaaaggccaucucgacacuccgcugcuauuuaguaaauggguguguuccugauagaaaucuuuaacugcugggauugaugagggagagagcugccuuaauggaacaguucagugugucaggauaucugcgaaagcucaaccuggaaagaaaagaauauccccaggaaaucgaaccagaagugauaaacaugaaaugguuuagcauaaaauaccucggaauacaccuucaguggcacacugcuggggugccuuguguuuacauaaaaggagauucguuaaaauaacauuagcacuuagugguuuuuucguuuuuccagucauaaugcuuuccuccuuccuuguuuaugcuuauguguuaaguacugguuugggggauuauuuuauucccuguaaauguguguccuguuuccuuacaaagcacaacgcacggauucauauuuucuuccagauguagaguuguaugugaaucucuguagagaaggauuggcaguuuuccccaaagaaaacuuacagugcucccccaccccagccccacuguuauguuuccuuaguguuguaagacaucauucuugaauuuaaucucacagcauuugccucuuugucuuugcagauuccuauuacuguagguguaauccuaaauucuuauuacgaugugaaguuucauucgcuuggaaugguguuugccgcccuuggugugguagucacgucccuuuaucaagugguugguaacuuuuuuuuuucuuuuugugccuuuuuaguagacuuuguaaauuuugaagcuguaacccaagguuuagagacuacaaguauagagacaacagacaugagaagaaagcguaacugaggaggugacgagagcagaggagacagcagcucaggugugcgaugcccaccaaguguccaauuguaagcgcacgguaccccugcuuaagcgcagcuggggacaaacuucuuggaagucuucacaaaaugagcaguaagguuuugcuuccuaaguucaucggucgcaugugucauuuacucuuugauuauaaagucacuugggugaaacacacacacuuccaaacuuuugaacaugaaaaaaauucagaugugcauauuuuaaacucagaagaaguguugguguuacgacuugcucaugggccucugauaacuugucuguguccguagagaguuuucuaggcuuuuagcuuccugugcaagcaggaggccuugccuguagccaauaaucaguuaauuuuuuuuccauggagucauuucacugcuguaaguugccaacaagcuggcuuuuguguccuguguaguggggagaggucuagcaggguauggggcagugaaacagucuccucucuaugcuggaaaccuuggucuggaaaugcugggugugccugcggggaaaucagagccaaccuguaaccaguguuaccucugccacacaaacaucggcuggcaguaaagaaagacauucuaguuaagaauguuagcucagagcugcacccuaacacuuuacuguuugcugcugggguugucccagaaacauuguuacuauauuuuggggggagggguggagggcugaggauugggccuacagcccguuagccuucuaagcaagcacuguauacugagcuaaaacucgccuagccagcuaacaacuucaacaacacccacagcuucugagccuucuucuauggcuguugucguccugauguugaauucaugaccucgcacacacuagccaaguagccaccacucagcugcagccccagcucccucuaccguuuauguuuuacacuuucuuauuuuguuuguaugcacauguacaugugugugcaugcacauucgggucccugugugcacauagaagucagagggcaacuuucagggacagagucuguucuccuaacaccuggguuucugcgccccaccuuugguggugugagguuuggcagcagagaccuuuccccgcucagcugucauugauccccuuuguacuuguuguuguccuuguuuagauuuuguggauuuguuuuguugaugguuuuguuuuguuuuuguuuuucuugagacaagacuauguuguucugacuggccuggaacucacucuguagaccaggcuggccuggacuucacagaacaaucugccugccuuccaagugcugguguuaauggcaugugccaccaugccuggccucuccuuguacuuuuuaagaaaguguaggcacguguuaccauaccucguuuacuugucaaauauuagaauuuuuuuauauuccauauacauaauaucaguucacaacaaucccugguuuggggaggucuuuuuauguguguguguaugguuguggccuuuguuguuguuguuguuguuuuguuuguuugguuuugguuuuuugagacaggguuucucuuuguagcccugguuguccuggaacucacucuguagaccaggcuggccucgaacucagaaaucuaccugccucugccucccaagugcuaggauuaaaggcgugcgccaccacugccuggcugguuguggccauuuuugcucauggauguuucaaaauugcuguagcucagaaucaaaagauucucuaucccugagguuugcaaugagauuuaucaaggaaugacugaagaccaagggcaaaggugcuaugccacaauaggguagucacccaccaaaaagauacuuuuaaacaaaauuauauccgccucucgcagccuaacuggguuucuacgauuguuuuguuuuguuuuguuuuguuuuguuuuguuuuguuuuguuuuguuuucugcugcugggaacaauaagacaagguggaagaggaaucuuuagcucuuggcuggaaaaagauggagggaugguuuguuugacaagacuuccuguaugcucgccugugaagacacagugaggagaagcagcagugaccuacccuuuaagacauaugugcagccccaugucuguagcuagccuggguaguaucccuccaagcugaggagaaucccgaggagcacggagaaagaaauggcaguucugcacucagagugacaaggcuagacuagaggggagugacaaggcuagacaagaggagaaguuaauuuagcucgguggcgcagaaguuugcucagcagugaagucuugaggccuguccuuucacauguuugaaacuguggagcacuuggggagcacuugauguguuuggugaagcuagacuauagauguguuucgagaaagcgaaugccagguagcuaagccagaccgcaaagucuuacuguugcucggaggaaaugucuuuauucugcagacaccagcaaaggagaauauuuagacugggaagaggcuuuaucguaauuuguauuuaaggaaaaucuaggggugguggagggugcagaagagaggaagggugaagaaccaggcaggggugugagcccaggaccuugaggaggaauuaggacccgagugacugggagccggcagaguuaaggagagaggguggcaguacggacagaggcagcacaagggaagcucauuucuagacagaaggagcuuggucugaagccuggcccugcagacuaagcaggaagcugggucggcugagaaguuacagauacucggagugugagaccagacauggagaccagugcuagggugcuugcccagcaugcacgaggccccaaguucuaccccuaggaccagaaauauuuguaaaagaugcucaagggagcaaugucagagcugucugugacugguacuaugaguauggcuugggagggggcgggugugcuuacauagggugugggaaaaaaugguggccagaagcuagguugagacagccgacccuagcagucagggaggaucgcacagacaggaaggugagccgucacugucugcaacuuuccuguucuugcucacagccucuccucuaagcaggccggggaagaaucagcccuuuguccuucauagccuccgaagacgccuagugaaaggcggcaggaguguggcucacauuuccugguuuuacauucuggucuuggugaauuccuauagacuugccuauguguguuacagaauaccucgguuuaggaagcggaucuguagagguugcuccaaagccaggcuguuccugccagaccugauucaagcuguuggcugaaugcucugcagagccccucgucagucauauuugugaaguguuuuuaaggacgugggauauagaguuuugagguuuuuacugaaugagacaguauuuuagggauuucaguuacuccacugugcccaggguguauuuaugagaaauccaacccacagaaaaguucucuggagagaaaaaugucuucugccacugaaguggcuccgaaguccacauaccuuucaagccacacacuggggugcaccucucacggaaauuuccauccccucccugucccccuggugucucuggcgcaggguuccuauugcguuuacuuccugcuauuuaguacuggggagaauagaggggugccugcugcuccccucucugaggcauugagacgucacuagaugagcccguaccacauuccaagucccucaugucucccuuuagauuguguagaaccgugagguuuguccuuguccccuagccugaccccauccguguugcuuugacaaaggcugcuucucugugugccugacguguuuuucucccgguugccagugggucggagccaagcagcacgaacugcaggugaacuccaugcagcuacuuuacuaccaggcccccaugucuucugccaugcugcugguggcugugcccuucuucgagccaguguuugcagagggaggaauauuuggucccuggucaguuucugcuuugguaaguucuaauggucccggugccugagagggugcacugaucuccccuuucguacuguaguuuguggaugugggagcacaaccucacgucuguucucacgugugauccccaggagacauauuuguucaaugacaacgauucucuugguuuauuuguagcuuaugguacugcugucuggaauaaucgcuuucauggugaacuuaucgauuuacuggaucauugggaacacgucaccagucacguauccuuuccgauguguauagucuuccuuucucaucuggggcacuaucacuuggccuugguuacguaggcugguugguuguuauauuucauuagaacggguguacuucugcaugcgugucugugcacacgagcaugccugaugccuuuggaggccagagaagccaucagauucccuggaacugaggcuacaggggccuuugagcuaccguaugggugcugggaaucucacccugguccuuuggaagagcagcugguggucucaacugcucagagagacacugaucacuccagaacuguucugaacuuuuaagaaugucuuuccagugucuacagagucuauuaacugagaaaaugacuuugcuuucuguaaaggaauacuuucuuaggucguagugaccuuuuauacgacugacucagcaccuggacucacugauagugggcccaagggauauuuacugacugcauagaggaguggaagcuuagguuugagccacuuuucaguguagucagcuuauguaauggacgauaauuucacauccuccauguguuugaggccugggcuauagacugagaucucauuuauaaaaacuggagaagaaaaccccugcugauuuauauaaaugaguaagugcucauuuauauagagucaaaaguaccaauacccuauuugccaaauaucaaugaguagcaaugaucaucguuucuuucagaaaccccggacucgaaagguaucuugugcuggauacuguccaaaugugcagacuuugcucacgugagaaaacuggacuagaagagguggaaagaagggaagccaucagacaggcacugccgcuucuaauuuauaacgaugcuaguuugugggguuacacgguggcccagcagugaggagcuugcuguucauccagaggaccugaguucgguucucagugcccgcgauaggcugcucacaguuauuguaaguccagcucuagggaugugauggcuuucucuggccuacacacacacacacacacacacacacacacacacacacacagagggaggggugcuggggguaaacaugaguaucuuuaagugccagcuuauuacccagaggggaucgggacacauuuccaaauagcaccaagaaguuuacugaacaaugaauaugaagcaguaagcucaggucccauauguguugcagaggcuguccagggagauagcgcaguuuggaggaggccuggcaugccgguagaguugcgguugcacgguccggguacagcuagucccaagucacuguagcacugugaugugaggggugagugagguuaccacagacaagucaggggacaguccuagggcacugcaccuccagaguucauagagaguagaguggugaggaguccgcgugaggagggcugggaaccgcagugucaagugcugccggauagucagucagguuucuggaagcuuggcagucaguuagcucugacaagaccuagugaggcaaggccacugaugguguugaccagagcacuucaguuccuaagaagagccacugaagagugucgcugccugcuucucagcucuguccugucuccuuucuguccuccuucagugucugccugccugggcacugcaggucuuucugccccagcuccaagccaccagccuuuuauuaugcaaaaagccacgcuccuuacucaaccagcucucuuuggggcuaagcgaccuuccccacugcagccugccuuucauuuuugagcagcuaauugagauaaggaguaucucacugugguauugugauaagcaucccugggcguaaacucuauagaucgaagauaucagcuccacugugucaaaccauugaagggaaaaagccagcaagcaggugcccugggugcugucuagagggcugcuggugagugggucucuuuggugcuuuuguuuccuggaaagcccuguggcccaggcuggucucacuuacuguaugguugacaauggcauugaccuccaauccucccgcuucagccuccgaagagcugggaccacaagccugcagcgcugugcccaggaaccgagccugugcacagaggucauacacagccaugcccccgccccggguccuuccaauccugugagccugaguauguugugggagcucuuauggauccacugaggucgcuuaugaacccaggaaccuaagguugggcucagucaccucacugacaccaucacugcaaagagagugacagggaaguggcuaagaaguuagggacgguaacguguacagugcugggcaguccugccaugcacuggugcuuauuauucucuguagcuuacaguuagcaugauggggcuugcuguagucuagaacucaggaccuuuggaagacagucagugcucuuaaccgaugagccgucucuccaguccccccccccuuuuuuuuaaagauguauuuuauguauaugaaugaguacacuguagcugucuucagacacaccagaagagggcaucggaucccauuacagauggcugugagucaccaugugguugcugggaauugaacucgggaccucuggaagagcagccagugcucuuaaccacugagccaaucucuccagccaaaagucagguuacuccuuuucuuuucuuuguuuuuuuguuuuguuuuguuuuguuuuuuuguuuuuucgagacaggguuucucuguguaguccuggcuuuuccuggaacucacucuguagaccagguuggccucgaacucagaaauccgccugccucugccucccaagugcugagauuaaaggcgugugccaccacacccggcugcuugcuguauucuaaaucucugcagguauuccuucuugauccacaucaacugaacaagguagacauaagaucaucuuaccuucaauaggcagaggcagagaaucugagguauagagugguggcugcuuauacguuguugcuggggagaacucgcagguuuguaguaugcauccgaagaguaaaacaguauuguuuagauauaaagaaugauuguguauaacauggcaagagaaucauugcucaggucucugugugugguuugauuuuuuuauuuuuugauaugagcaaugacucaggaaaacacuuuagccccauaauaauuugcuggcaguacauuagauuacagccugaacuuuggagcucuguaaguucaccuuuguuuggacucucagcacuugaacuccgucauuugccuguugcaguugcucuggugagaugacucagcaggugucccuuccaccaagccugaccugaguucagucccuggggcccacacgguggggccauaaguugaccucugaccuccauacuugugccuuugcguguacaugugcaugugcacauauccaaugcacacacacacacacacaacacacacacacacacacacacacacacgaccacauaaaaucaguguguuuuaaacuuauuaaagggucugagcuuccacaguugagaaauggggagacuggguagcaguggagggaggaggguugcucauggaagaguaccuaacagagcagcggcaggugcugguggugcucccucuggcuccucucucccuugcccaccuaaucuuaggcauacuggaaguuuucaucacaucagcucccuggcaccuggcacaucucagcucguugccaaugacaguugauuaggaauaccaugccauaguauaaccauaaaguccuaugcaaagugucuccucuguaccuugcucugcaugccuuucucccccgugcuguccccuuuggagaggucaccaggaacgcuugaggcagucuccugucacuuuggaguguguauguguagcagguccaacaggaaagaauaaguaugguguugggcucagcagucaagagcacacccugcucuuacagaggaccugcguuugguuccaaacacccacuucggguggccacaaccuccuguaauuccaaccccaggaaauucaacacccucuucuggccuccauggcaucacacucccagguacacacacaguuuuaaugcagugucaccauuuucacaccagucaauugcuaagaccaugacugaagagagucugaucugccccgcaugcuccaaguguguguucuuuaagcacgugucagccguugagucuguguuguaugaaauucuuuccagccacagguagcugcugcuguguuuguacuguccuguggacccaugugacccuaacaucuagcucguugcuccuuugucuccuuaccugaauaccucagcuacaacauguucggacacuucaaguucugcaucacucucugcggaggauacauucuauuuaaggacccccugucgguaaaccagggacucggcauccuaugcacgcucuucgguauccucaccuacacccacuuuaaacucagcgagcaggaaggcaguaagaguaagcugguccaacggcccugagcuuuggcagagaagagaaaggcgaaucaugaggaugagaagcgacaaacgugugcgucgucuauggaaaagcuccccguggaauuuagucagugacguacaagaaguauuuucuuugcagauaaugacaauuuuuaguaccuuuuaucgauuuaauuuuuaaaaaccaaaaugguucauucaggcuucucaaagacuuaauggaccuggagcuggcacucgguaguagaguguuugccucacacgcgugagacccuggccucaaacuccagcaccgucaaagaaaugcuagcaacugccuagaagauggcuucauccugccagcugaagcacgggagaguucggcuccauaggaaugacagagcgcuccuucgcugcagcugugccguggcugucgguguccagugucccuguucucccaggaagggcaagccaaccugcuggcucacccaggccuuccugucgggaaguugaaguucuuucucguucggacagggugguggucagaguuguauugagacuggaucucacugugucgcucugacuggucuggaauucucuacauagcccaaacuggcuuuggacucuaccacuccauguagccuuuagcuuucugauuucacugcagaacugaaacguuuauagaaaggaagcugucaucgacaugcucaugaaaccaauuacaucucugaaaguaucaccuuuucaguagaaacuuaaucuaagacauucuucccuguuagacagggcaggagugcuugagcccaaagcccgcucagcagcacagcucugcccgugcuagagggagcgucugcagacugacagucucauuggucuucucgcggcuuugggcuuugagugaguucuagauacuauauauggaguuacaggaaaacccaucuuuaaacggcucaaagcaaagcuguagagggccagcagguagagccaguaaccgggucccugcccagcacucauagguggguucgcagucguccugguaacugcuuccccagcuugcuuaauccuuucaucccaguguuuucugauguggccucccuccuguacucccugccucccacauccugagcaguagauaaggagcguuguauguauuggaaaaacuggacugaaccaggccuugcaguuuauguggcaaaucagagcaaaggcugcccaaguucuaggcagaaacuuggugaaaaacaggaaagauaugaaagacagguagaaaacuagcuaauauuuagcuacuuguaugagguuccagaggaauugagaaauguuuuuaguugagauguagacagaauacauggggcuccagcaaauagagcccuggguauuuaacugcaaaagugugugucugccuucagguaucuugucguuuugccauucacagcagccgcugaugaccgcagaagagucgggucucuuggaauaauaacuuuuucuaagcauacacuuccugugagaaagcagcuuaagacaaagagacgugucuugugauaauacaucuuaucuggaauuuucuucuucacaggaagagguaacuuuuaauauauuaggauuuuuuguugguagugguaguuuuuagguuuuuuuuuuuuuuaaccaaauaaaaaagccuggguuguauccccagcacugccaaaacaaagccuuuucaagucaucaggccacaggagugcugagcucgaggagaagacacaccccuaggucucaagguugggcagugagucagggcuacgaguuccuuggccguguagaccgcacagacuuccagggcagcccaaaucacauacugaguucuguuaaggggaaaggaagggugccuggucuaggacuuuuuuuuuuuuuccuggccucacuaaauguguauuuuggagaauggcauugucugcuguguaucaguccaugugcuuccgugggucuuuguuuuaaauauuguccucaguuuacagaguuguguuauuaugccaagaacugcagaacaugccgucuucaccaucauggaccuuuggaaucaugcucaagaaacauuuucuguguauguuuaauguuuaacaguuucccagaagcuaacggaaagucuuccagcacagagagccucagguuucugugcauuaggaacaacggaguugauuuguacugcguacaaauccuagcuguagauaagcccuggggaccggaguugauuuguacugcguacaaauccuagcuguagauaagcccuggggaccggggugguuugaauagguaggugggugggguaugauaaguggcuggugucaguaggaaugagggacagagugggaguauggugaaucaaggcguguuuauauacgugaauaaacucucuacuauuagaaccauacaggcugauaagcaguuuuuuacacccugaagacuuucaucuaguugaaaauuccuaaggaaaacacacugaugcccuggagcaagcacagugaccacaaugacagacacuaggcagcacugucuuuuuguugccaauggaacugaauguaguuuuuaauccuaugucaaauggcuagacuuaaacucuuugcua

SEQ ID NO: 5749 - RNA, 27215 nt, Mus musculus
aggcggggcgggagggcggcgcggagugcgccggcgcgucgucggggacgccggguccaggaucuugcuagggaaccaguguugucgcgucgucccgcccccucggggcuuuugcucccguuaacugucggcggggcaggcuccgcagcgcagggcgacaugccggugcgcuucaaggugaggccgggggcugggcggcggguggcggggacgccgcggggugggugcgugacgcgccugugccguaccgagccuccuggccggagccugugcggggcggaggaugcuccggccgguggcccagcgcggaggggcggguggggagaguucgaugggggccugacggcgucagucuggggucgccaggagcggaggcggaaggagggcccuugacagugggacgaaaggcugcugucgguguaggacaccugugguuccucuugccgauagcauucagcuccuuuccugcaaaacuuuaaagcgcgcgggucuuuuaaacgcuugggaagcgggccccaguaaaaggagagcguggguaggugugcagccugcuaguugcacguuugcuuuagguuuugcucacaguuccagauagcugucugugucuaacgccuuuccacgcaacagguggccacaguguuucuguaaucccggacucuuuaauucuaaagugcuugccagacagagugggaggggaacacgucuuucucuaauugccuuuuauuaaaagccauaacauuaugcacucgaugaauuuaggauaaaccucuagugaggacuuagguuuguuaccacacuuuggaaucagagaaccaguuauagcgcagccucauugagggacuccggcuugucuggcucgggugguugugaggauuaaggggcuacuuagcccagggcuggguaaauauuagcuauuauuaaggagcuugacugggguuuaauucucauucuugggccuuucaagaacacucuucagagguugagguuuuuuuguuuuuguuuuucuuucugaugcuaaaacaccucuucacuacacugugcucaaauugcacuuuucauuauaggggcugagugaauaccagagaaacuuccuguggaaaaaguccuauuugucagagucuuauaaucccucagugggacaaaaguacucaugggcaggacuuagaucggaucaguuggguaaguugagcaaaccaauagcuaucauaacuugaauaaaccuuggguucuguuuacaaaacaauuaaaaucuaccuguguuggccucauguauaauuggcaaauauuuauugaugcuauacugcgaucccagagucccuuauguacaaacaaacaaaaacaaacaaacaaacaaaaaacacaaagaaacucaucaaaucgaguuguauauaaaauagcaugauaucaaaaaaaguugaauaguaaaacugaaggggaaacgccugagauugguuguucugaaagaggcuuuucuggaaauguuugagcggagaggagcaagccugagggugaggacuuucaaagacuugaagaauggaaggguagguaacagaggcauggcuggaacuugcugguuuuggucagugccaugaguucagaaaucauguucuuccucuuacauaggcuucgucuccugaccucagagaauuugagcccucgggccaagguuuccuacugcacauugaaagaguggacugacuguucuaucuacuguuucucucucaccagcuaggauauuggagaguaggccucugucuccuuguuugucaguggaggcgcaaggcuuugagacacccuacuuuaacuuauuuuuauuuuuuauuaaugcaaguauaccuguguauaucauguaugcaugcagaggccagagaaccauccuggguguugcuccucaggaaggccgcccacuucauuuuaauacaaggucucucacugcccuggagcucaccaguuagacuaggccuccuggccagagaacccccgggguccaccugucucugccucuccagugcucgauuauaagagcaugcggccacacuuagccuuuuugcauggguccuaugggguuaaauucaggguuuugugcuuacaaggcaacugaucauauuaucagcccucaaaccagauuuuaaauuaaugaauacaucugaauuuagauauacaauaauuauaauuuugagcaaaucaaacuugcaaagugggcuguaggaagcuccacuauccaggguugaaggaggccuugcuugguaaggauuuuguguacauaggucaguacuuaguguucuauggaugaugugugagaaugauguauaaaccccucaaauguuagguguuugaagccagggaaagacaagacuuaccaugagggcaugugucugggaagggaguaaaguaaagaguguguuuauaucagguuuggagaacagaguguggguagcucuuuagggcuccucugcugcguaaauagugcuggacuucagagacaagauguuuccugauucuccggcaguauccuggaaaaucucucugcuuguaaguucuguacuuuggagaguucguuagaucgagaauacaaaauaaacugucuucaggcauaaccacuucacugaaagcuuuggggcagggagugauaacugcacaccagacaacuggucaaccugauuaacugcccuucagcauuuuagcugagaccagcugcauucagguggccagugugagaagagccugggcacgugaagccacucuggagcagggcacauugugaaggaggucaugguguaagggaggacggcuacugggaguucucaguaagcacaagugauagugucagagucucaggcugaucagcccgggagggaggagguuaacgaggacagcuggcuuaccuagagcuggccggccauucuggcaaugcagugcaucccucacugccuggagcacuugcuggagcugggaggacagagggcccacuggcuggagagucuuccucucuucaugcuuccuguaagaacuuaagaggggcugggacaauggcucggugguugagagcagcaguacuccugcagaggacccaggguuaguuucugcccucacguagcagcucacaacucucuguaacuaugcccagggcucuaacucccucucccggacccugcaggcaccaggcacguauguaguauauacacacacaggcaggcaaaacccucaugcacauaagcuaaggauuaacagaauggagaggagagccgggagugcuccccacaacguuaggaaaaucuuguuaaccguccucccacuuuaaaguugaucuuuucuuuuuucuaagcuuuuacaaguaguuucaaaggauauagauuuugguagaguguauaugugucauauauagagaguguauaugugucauauauauaaucuguucaaacuuuugggcugccaccucggcucauucaguuauagaaaauguucauagaauaauuugcaaagccacucuaaucagcaaacaggcuugccaaauuagcucggcuuucugugagacaagucuaacuuuaugccuugauucaguguucaggugcaucguguacuuuccaugccggcucuccacccugaacuuugugggcggaggggcaaacgggaacuggccaccacuccucuauuacuucuagucugugucuuugcuuucccgugacagugucccuuaggacacuugugcuuucuuguccuguugucucccuagcccugaguucuuguacuaugucacagguagucugaggcugcuugagaugcgugccugucuguugugcaguggaagcaggaucauguaggccguagcagauagaaacacagaugacagguccagcaagagcgcacauggaauucagaauugccccuuucugcccacccugcccccaggaugucucugugugcccguccauugaagguuacuagucugggaagcccgugagcuugggacucuugcuucaguggcagaaagagcucggagagagguuugagagugauagcuuuaccucaugucagcuuuucugucgccuccucuucccuucgguggccuugcucuuacuguggcaggagcagcucuccuccuguuuaaagaauggccagaacuagggcauucguguugcaugcucuuguucgcucuuguuuggggucauucuuuuuaauccucaggaaaccaaggcagaggagaaccgaggucuagcauggggacaccucauccccuuucaucguggucugcucugcuuaagagaagcuuugggaaaagucccaguguggacugaccagggcuuauuguuaugcuaaguagcgcagguaaccagaaacggagggagcgcgcacuugcuggcgccaggucucuugccuugugaccccugugacuugugugagaacaacuuggacacuggccucagcauucaacuuuaaugcuucuuuaaagcaaaaauaauuugauauugaaagcuauaucuuguuagguuuuuacaaguacuacaauuuggaggagggugugugugugugugugugugugugugugugucugucugucugucugucugcaugcaugcaugcaugugugcaccacaggcauguguaaaagccacagaacaacuugugggaguugauuuuccuuucucccauggggguccugaggccugaacucagguugucaggcuugguggcaagugccaucuugcucucucaacugacuguuaaacuccaucucucucaggccuuuuaaaaagcucuucuugaccaugcgcguugguagcagcuacuuucauguucuauguuuuguagggaucacgaaagaaccagguuuuauuucaaaaagaagaguucccuaccaugacccucagauuucaaaauaccuggaguggaacggaaccgucagaaagaaggauacgcuugucccaccagaaccccaggccuuuggaacgccaaagccacaagaggcugagcaaggagaagaugccaaucaagaagcaguucucucacuagaggccuccaggguucccaagagaacucggucucauucugcggacucgagagcugaagggguuucagacacuguggaaaagcaccagggugucacgagaagccaugcgccaguuagcgcggauguggagcugagaccuuccagcaaacaaccucucucccagagcauagaucccaggguaggaagagccaccguguuucuuuuaaaggaauauuuagguuucuuauugguucuugucuugucuugugucucugguauggacgccagcaggcugcugaacguuacugagaagggcucuguucuuacugguugcuauuguguacugaguguacuaagacauaccgucccuacaugggcagucugccucuggauuuuauucaucagagacuagcagccgaguccccaggacgaggucgcgcugaggcagaagggcaguaggccguuucucuggccgggagcucaacugaccugugccuauccuuguuugacuuuccuauuguaccagcaagaaagcaaacaaucucagcugucaggaggcaaaaagaagagaguucuggcuagcucucaaagaucuugccguucuguccucuuaugucacagcuggcuugcagcagguccccaaaagcacauaagcagagguggcaggggcgugugugggacaucucacugccucccacaguucguucuccaggcacucacccucuuccuaaucuacuucagccacugacuggaagccuggagccacccaggagugcuggaggagaaucugugacuuguugagaaagccagggcauacagggguccauggaaggugaugugugagauuggugggcagagggaagggggccacagagguguguggacagggugaggugcuaugauuuauuuauuuauauuugauaguagauuuacuugugaaugauuggcagaaaggaacugagcauggcucuacucuauuuuuuugagaugcauuagcauaauagcaggcuuaaauauuuagacaguuuaaaagugaugauuuaaaaguuugccauacuacugucugaauguaguuagcaaaacuguaagguacacuuaaaacuuaaagggauaaaguuccuguugcaugcuuuacagcgcaauuuagacuuaaaaggaauuuguguagcaaauuuuaauagcuuuaaguggguuuuuucccccaacaguuggauaggcaucuucguaagaaagcuggauuggccguuguucccacgaauaaugccuugagaaauucugaauaccaaaggcaguuuguuuggaagacuucuaaagaaagcgcuccaguguuugcauccaaucagguagcucaagagaugcguuucugaguguucucaccugacucgugugugaguacaggcuacauggaaagagucgguucugaccugggccuggcucugaguucuggaagacagugagagguuugcuaggcucuugcucucccuucugaucuacaguggcgauacuacacaguccugugcuauuggugaucggcauugccaggcccucuaagugggaggcggggcagugacagcgagggggaguggcaaguucacaggccagaggaugguuuuaugucacuaucuucuuaaucauccaauugguuauguucuaaauuguuauuaacguuuuugcaugaugucuauuuuuuaaggaagacuaacugcuuuggacauuuauauauugaaagcagcacugcauauaauuguccccuugagucaguuaaaugauggcaggaauugaguuuuuauuugcaaaauuuuaaaaggcauaauggacuaauuugugagacaaauuucauuauauuuugugcaauuuuaguauuuuauuaucuugcuaauaaauauucuguuaauugcugcuguccucugggguguucuuagacugaauucuuucuuauguuuuugacuauacuuucagcuucggaagcccaugacagcuucaucuuuuuccugauuuuuuuuuuuuaaauaagucuacacauaccuccaugugcccuccauucauuuugccuguauugcauguuccuuguauacucuguaccuaagaucuaacaggaagauuuagaugcaguggggugauagcaucugcgagccucggcagacacuccacugaccaugucaauuguggaagcuuugcuuacuuguuaucaaaauacauuuuagggucacgugaggugcaaugcaaaaugauguguccucuuucugugaccugcuaaguacgagcagugccucuguugccugcucucaaguggucuucgguaccaagugcuccucaagauauucuugccuugcuugaaaauuguguuuuguuuuuguagagcauuugagcuauaagcuagagcugauuuuaaucaaagccugcuugacaaaauuuacaugccagcgagagcauuuggcagaaauguuucuuucauaggaugagaagcacaguguaaaauaaacuacuugcaaccuucucaguugugagcccauugcuccuguaagugaggcguucagagggcugcuuuggagcaagagcucuuugugaauucaaagcacaucugcuuugaggucauggaagcucgcugacaagcuuucagugccccucuaaggagccgugugcuuuuaaucaggggccuuuucugguaagguugucauauuaauauuuaaaggaguuggaucaguuuuggcuggaaagcccuggagguuguguugucccuagaagauguaccguuuggauugggucugugcuagucaguguuacgaggcaggggucauggaugucuuaccugccacccucccuuucuuugugacuucacugccagcagugacacgacaccagcacaugggaaccauauugaauauuguggaugaaagagaacuucuaaaagagaaauauaggaauucuuggguguucucucuugccucaaugagaaugcuaaauauaagcaggcacgaggcaagaagagcaaaucccagcuugaacaucucagcaucgucuuagguucucucagaaaaugggaaauucagacaaggaaaagauaauuuguggagcugacaacaauuacuuuaauaaaacuaaugucuguucauacuaugaacauacacuuaacuucauuuaucucauuacuaaacuggugggaggagguagaggaacucugggaaggagaaaucagauaaggaguuuaggguauuuuugcuuauguaauaguuugaucaugauuugaguguuuacucaaaacauaguaacaaguauagacauuugaccauuggcuacuaaugacacacaugaagucaaaaugcaggcauauacaauuugccuuuuuguguauuauaauucaacuuuuuauggguuuuuguuggacauuagugggaggaguggcccuugggccugaggguguuggaugccccaguguaggggaaugccagggugggaaggugcaaguaggugggugggugagcaaccucauagaggcagggggagggggaugggauaggggaguuucugaaagggagaccuagaaaggggaaaacgauugaaauguaaauaaggaaaauacccaauuuaaaaaaaaacacaaaagacauacuauauacuaaagacauacuauauacuaaagacauacuauauccuaaagacauacuauacuaaagacauacuauacuaaagacauacuauauacuaaagcugaaauuuaagaacacacugaggaccuaugaaauagcucaauaggaaaacacacuugcugccagucaugauagccuuugauccucagagcucacaugguggaagaacagacucguaugaguuauccucugaccuuccuuuauacacaagucauagcacacacacacacacacacauacacacacacgcacacauauacacauacacacacacauacacauacauuaaaaaaaagaucaauuaaacaccuaaguucuguaccacuuaguaaccaaccaaaaacguaacuguuuuuuguuuguuuuaagguuuuccguaauaaaagccaaauuauuccacaguuccaaggcaauacauucacccacgagacugaauacaagcgaaauuucaaggguuuaacuccagugaaggaaccaaagucaagagaguauuugaaaggaaacagcagucuggagaugcugacuccaguaaagaagguacccacccaccagcucugaccuccugcccgaggucucagccucugcaugccugccuucgucuccgccugaggcucucucucuucuagcauugauucauuuguucaguagaugccagguggucguugacuccuuccguggagucagguccuguguagacugagaggacaggaugcagacaugccaaggcucagcagcgcuuaggcugcugggagacagauacauagauaacuaaaauugaugcagcaugaccguaccuagcagugcagcagguaagucccccaaguccaacgucagacgacugagcuuacaguagugugagccgcagggcagcaggaggauggagacgugcauucuaaguaguagccauuaaacagagcacacacuuaucuuaagggaaaauuucuacuaugcuaaauuauaguuaguauaauucauaucauuuacuucagugaaaauaagccccugaguuugugugugaauuuacagguauucugaguuaugacauuaggcuagagucaucgcagaguguagaaaauguaugacuaaaagugaaauuauguaccuguguguguguguguguguaugcauguguaugcacacauaacacaugcauguacacacagcacacacauacaguuuuuuauugaccuaugacauucuugaaggggagucuuauuuuguauagcaaugugcuaauuagcuaagcuucaauaacugcaacccuugaauauaaauuuaagggcuaauucaaaaucucuguucaauaugugguagcauuguuuaauauuuugaugguauuuguuaauuuuuaaauucaucuuuaaaaaaaccccauaaaaucagggaucuaaacuccuuggcuucaaaacuuguugauuuggguuuguuuguuuguuuguuuguuugcuuuaguagcuaaacaucuagaagcaaaaauguaguagaguuucuaggccuaccuuuauaacauguauguuuuuacuugaaugucugacaucucuaagcauaaacacucaaauuauuuccauuucaauacaauaaggcagaugagccuuuagacuuagaaguagacauggcgucggaagacucagaccagucuguaaagaagccugcuucauggagacaccaaaggcuuggguacguagcucaccaggaaacggucaugucuggguggucagcuugcuaaaauacuuacuugcguucugucucucuuagaaaagugaauucugaauauagagcaaaguuccugagcccagcccaguauuucuauaaagcuggagcuuggacccgggugaaggagaaccugucaaaccaggugagucugaucgcacacgcucuuccggccgagccagccacugcaccaugaguuucacucacagugugaggauggaugguccaauaguagcaccgcaaaucccaccaucuuaaaaucguaguugucaccuuaccgguguguguacuguuuuuauagcagugaccccguggagauugacauugguuauuaaagucauuuuuuuaaagccaugaaguaucugauaguucuaaugaguucaguuugcaggaugauagccuucuugguuggguccucaugccauccagaccucagacuuugaacugaagguucucucuaucaauaaugaauguuccaggaagauugcuacagugugcaccccugcaucauguaggaaaggggugugugcagcuugagguucaaguucuacucuugggguguccugauguagcagagaagcuggggcucugaagauugggcagaggagaggacaguuauagccuccugcugagaagcggggcuucuagucaaaggauaaaugguagaaagucuauauuacuguauaauucgugucuuaaaacuguuaucuggacacuuuucagcccuucucaugugcacaagcuaaauuaaaccguuuuugggguuggauuguauaauaacagauauucuuuucugucuaucuuuccaaagaggguagauugggucuggucuuugugagcugcugguuccgugagacaaguagccuugcuacacccuccucagcgcucugccucaaggggcucucugacuuuucucacugcagccacacccuucucagcgcucuguuucagggggcuuccagacuuuuccacugcagcuacucucagaacugucuacccaagccucacccagacugugcgggacaggagcagcuagcccagcccaggcugcgcaggacaggagcagcuagcccagcccagacugcacaggacaggagcagcuagcccagcccaggcugcacagggcaggagcagcuagcccagcccaggcugcacaggacaggagcagcuagcccagcccaggcugcacaggacaggagcagcuagcccagcccagacugcacaggacaggagcagcuagcccagcccaggcugcacaggacaggagcagcuccuggucaucugggcauuuguccauucacucugguaaaaucaaguaaaaaguuugaguuucacaagcagccauaauggaaaaaggacugaauccccuaggcucuugcacaguugaguaauauucuaggccuuggcaaagagauuauuucugggggauugggcagggcaggagaaaacgggaacacugaagcauguggcugaagagggccaguggacaggucugagaaagcugcguugggaagagccuuggcuaguguacggucucuucagacugaggugaguugguauuuaggccucaccguuuagcccagggagggcuggagauguugaagucaggcggaaugcucuguugucccagggaggagggugcugugcuguaauguagaggcugcguucucaguuucacccgaugugauaucuccaugcuguaaccuucucauagauguauuaguugcuacuggaaguuuauaaauuagggugaaauuugcauuagccuuuuaucaaaaaaccaaaacuuaaguuggcaaaaggaggacauagcaauucucagagaagccagugaucaguuuuuuuuuuaaagauuuauuuauuauuauaucuaaguacacuguagcugucuucagacacuccagaagagggcgucagaucucauuacagaugguugugagccaccaugugguugcugggauuugaacucaggaccuucggaagaacagucagugcucuuuaccucugagccaucucuccagccccagugaucaguuauuaaccaaguuauaaacauuuaauaggggccauguuuuggcuaaauacuagauuuuuuccccuggacuacuguuugugguauauggcugauacugagugaccugaauaucaaguauucugccaucuucucccugcccccagcauuuuuuggcauguguuuuauguauguguggugugugcagugugcauacauggcugugcacguggaggccacagguggagcugcuugcuagcuuacuuuuugugacagcaugucucacagaacccagaucucacugauaggcugugugccuggcuacugagccauggccuccuuuaccuuccagugcuggaauuaugcagggggugagagggcaagcgcugucacccacugagccgucucuccagccacaauccuaucacugacacacucucugcucauaguucagauacuaacuucauuuccuuuuaaauugucuacaugcuacacuuugggaaucuguuuuuagcaaagcuacuggguguucugucuuaaguccuguguacuuacuaguggaauagacauccugugugagcugguuuugauuguggcuauguaucccacaccugcaucauuucaguuacacacugcugcuuuauaauggucauauaagacugccuuuaauaauggaaucuguucuaaguuaauuugguuuuugaaaagggucuaaccuuagccucauagcaguccuccugccucagccucucccaugcaggcuuaacaggugugugucaggauggcucgcuggcauguacgucuuuuuggcuugguuauugaugugacucuugaggccaguuaggacuuugauucuagauaaagugcugcauuugagauccacccuguaaccugacagaugcuguaaggaccagguguaagauuucgccucauucauucuugcuguuuucugaauucgauuuuuccgcacguaaauuuuaaaugauucaguucaaauugggaaaaagaauucaguaaugaaagcauucuacuuauaguguuuagauugugcgcguguguuugcauguguguucaugugccugugcccauggaggccagaagagggcauuguaucccuaggaacuggaguuauagccagcuguaagucacuuaaugugggcgcugagagcugaacugguucuguguaggagcagcaagugcuuuuagccucugagccaucucucucuccuuggcuuauaaaauaucccaucauugggugacguuguugggaauaaugcauucuuauccuuuauagcaguccuggucacuggcccuaggggucauuucugaaaucuacacucaaauucucccucuugccaguagaggaccuuacuuugagagacaguuuuuuaucuuuguuuaggauuauagacacuuaaauauaaaacugaguguuagcauuuuuaggaaggauggcuaaugaagacuuguaaaagcauuggaguucauaggucauuaauaaauagaacugaauaggcauacagaaagugccugcacucuguccuuucuaaauggcuaugggcucuucccccauucucagucuuuaagcacacggagcuccugugugaacaggacgcagccuccuugucugucuuuccacugcucagcauggaaggcuguguugauuggagcccuuugaaccggcccuucaguucauguccuuguuugucugcuaggacacagguuguggcagugcuggguggcaguuuacacacugcugcugaagaaugaggcccugauggaauacguaaaacaucucucccugugaaggccaaacuauuaacuaaaauaguugagggauaaaagauuauacacaaggguaggaacucuguuuuuuaaaauauaguuauuaauagcaacaaauguggcuaaauauaauaacauuuaaagcagaauuguaacaagucagcuuuuuuuuuuuuuuuuuuuuugcacuguauuggugcauuuagagaaaccagcagguggcaguguuauguauaaaauaaaaagguuuccaaugguaguuggguucuuuucauauaaaaguacaugauuugcaaauuagagaauucaaaguauuuuauaguuccucaugauuuaaaaaaaaucuuuuuuguugacuauaucacuauuauuuggaagguauuuauuuucauuuauauaguguauuuuuguuuguuuuguuuguucuuguuuuugucuuuuuuuuuuuuaacuugagguuuugcugacuucaagagauuuggagaaagaaucucacaguaguuaguggggucuuguguaauaggagaggcuggcagagagcugggggauuaagcuagacuaggagucacuggcauggagccacucuucuagagauggagagcaaggaauagcagucaguuaccuaucaguagcaccaucacagccagagauggggagagagggaugacaaucaauuaccuaucaccagcaccacagccucgcaagagcguggcugguccucgagcagugcuaagaugucuugguuacugaguucacgauuacuaaggauacaagaaauuuaauuguauugacaaguugguaucuauuuagaaggaagaauaauaagguucaguaucucauugauucccauuaauacucauguauggcauuaaccugucauuaagugugucucuguauuccuccccuaggguucucuaaaugccaugugguaugcagagguugguugcuuuugaguucuuaaaaacuauaauaaugcauagaauacuuguguaauuucaguuggaguaaaaaaguauuugucaaaauuguucuuagcuacuacaaaugucuccuugccuaguaguuuggaauaaauuagcugcauuaugcuuuugcuuaauuguuuuaauaucugcugaaacgcauagucugaugaguguauguggcuguuauuuugccugccuuucucauuggacuguggcuguauccugcuuuggcuuucuuauguacuugucgguguuuauaaaagauccuuggcaauaaaggaaggcaccugaacucucugcguagguuaaggagcuccgagaaaaggccgaaucuuacaggaagcgaguucaggggacacauuuuucucgggaccaucugaaccagauuaugucggacagcaacugcuguugggacgucuccucagucacaagcucggaaggcaccgucaguagcaacauccgagcacuggaucuugcugggugagauguucuuuguggaaagugagaaggcuguguuauagcuugugugcaucauaggaugauguaggaaaaugacccagcuaacucacaaucugcuguuuagccagaugggucucuuauuucauuauuuaaaacuuauucucugugguaaauguagcuauauuauacuugcuuuuuguguuucuguaugacuaauaaauaacucugggcagcuaacuuuuguaauauucuuuguaacaacagaacuagauaagauagauguaaaagaacuuuaagaaguaaugagcagccauaaaaacuuaugaaaauauaagugagugauauauauccauuaucauucauuaaugaauuuuguggcucuuguggaacugggccucuagauguagagaauucucugcuguuuuaaauuuuaaacugagcacuauuuaacuauuuguaagggaaauuauacauugauuuguagcuaauaaaguagagcauucucauauagucacauauaccucauucauuuauaaauucuacuaugugaucuugcuuuaaaaguucacaaaauacucuuuaauaauauuuuggaaagaugaaucuaaaacauaaaaauuugaaucugcguacuugugcaugaauaugaguuuaguuaugacaaauuugccucguuggaguuaguccuuaucauuuugaggguaacguuuuacccuuuugucaccagaagugcaaguguaagugugugaaguagguaacuauuacuuuuuggaauauuuaguggacacuuggguagagcuuucucuugcucuauugcacaauaacuucacuacccagagaaggccuucaguauggaaacgaagagacaggaagucucacacucgcuaacccaggauaaacugagacacucaaaugcagauuugcaauaaauuuuuuuuuuuuugaaaugcagagaccuuacaaaccacaggaccccccagaaacacccuccuaccaaacuagaagaaagaaaaguugccucgggagagcagccccugaaaaacuccaccaggagacuggagaugccagagccugccgccucggucaggaggaagcuggcuugggaugcugaggagagcacgaaggaagacacccaggaggagcccagggcggaggaggacgggagagaggagagaggacaggacaagcagaccugugcgguagagcuggagaaaccggacacacagacacccaaggcagacagacugacagaagggugagaccuaaguuccucagcguauaggacauucuaguacgugacggaugcguaugugcugucacuggguacacgguugcaccggcagcucugugacuagcaaggagcagugacauaggugcugccacauggagugugcugggaucacacagagugcgauggagcacuggagcacugugcucugcgaggggcagucaguucucacaugcguccugugcugaggauucgccagauuuguagcgugucagguaggaugacuucacaggggaagcugggauucaugaauaucaggugcuucugucaagaaagaaaggccacucccuuguaauauuuuuaaagugguuucugaaaauggccaacaagggcgguuucaugugcagaccgcuuuagaggaguggcucuuugccuuuguugacaguccacuuugucuguagccaagcccuuuguucguucauggaugcaggcgaugggaacucgugcugacuaacuggacgccgucuuccuuauggauggcugguguacagugaucuccccuccuuucuaggcuuggcuucgcuaacuccuuauggauugagaaguuuuaaaaggauuguuuuuuagucgagacuucccuauauagccagagcuggcuuggaacucaugacucuccugaggcugcguccuaaacacugggucauaggcucccuccaugagggagccugaauuuuuuuuuucuucagaaacaaaacuagacuucucuuagaugguuuauguuuucuuacugugcuacuuaacgguaacgagacaguuuugauuaaauuuucuggaagaaaggcuuccuaauaaauugucucacuuucuaggucggagacaucuucuguuuccucagggaagggaggcaggcuuccuacaccgaggcugagagaacucgguauccagcggacgcaccaugaucucacgacgccagcuguugguaauggacaaacccugcaaccugucauccgcccuuuuagaauguagcuuagugugaccgacacuuagugugaccgacaugugcuuuccauggggucuuccagguggcgcagucuuagugucuccaucuaaagugaagccaccaggccucgagcagaggaggagagcguccucccaagauggcuuagaaacucugaagaaagacauuacuaagguagcuauuuguauuucagaggaaaaccucgucuugcgucuccaucgucucgugauaaaugacauguaggcucagacuucagaagaccccaccgguugcauggaggaguaucccuauuagcucucaguaaggcaagaccaaggcacugggacuucuuugcuuauuuaguugcucuugccauuguguugcugcugauaagcauucacagguucuuagugugacucgucaggaaggaagaacaauacagucuguugucugcuaguuguguuccagccacauuccaggcacuguguagcacuggagauaaaagcuaagaccaggacucauccagccaucagccuagcagggggcaaagccacggucaugauauuggagguaaaacacaucagguaggugucagugccaugagaaaaacaggcagggggugagcaggaagugaucagggagguccuuaccagcaagggugugaauagaaucuggaaaagaugcaggacugaucugggcaugggagaugguguuuuggacaaagagaacagagaugcagagucucugaggugagaggaccagucauguguucuugugucaggaacagagacuugucugggugauggguuuugagacguagugcugugcuaaauuguguagggcuucguagagcaugggaacagcacacauguuuuucccagugagacgggaggcucggaagggcagagcagugacuugauuuggcucauauauacacacacauaugcacacacauaugcauauauauacauguuugcacacacacauacacacacacacacacacuauuaaacagguauucgaagacuugggcaauccagggaauaaauauuuauggagaauggguggagacacaucuggguccgaggauuuaguauuagggaagugagaaguaaccagaaggaggagaauaucagugacguagugagagucagcagugacgucagagagaaaggagcaucaagaggcugcacuauaacuuggugguggaauguguaugucuacugugcauggggcccuggguucaauccucaguacugccagcuaaaauagauaauagaugauagauagauagauagauagauagauagauagauagauagauagauagauagauagaaucuccauucuggagaaggcucaauuacuaagagugcuugcugcucuuucagaggaccagacuuuggcuccuagcacccaagugaaauggcuaacuccagccccuggggaucuagugcccucuucuggccucugguauuauuuccauaaauggcauucauaaguacacacacacacacacacacacacacacacacacacgaaaagugaguguuggugcuaagucaguagggaugagacuuugucagaaucuuguaaaagcuaagcaugcaagagauugaagagaaaagacaggcugagucagggacaccucuguggguuugcuuguuuguaauugguagugguaggaguugauccuaugguggugggugugguuggcaaaugcugcacaauuggcugcauucccagccuccagauacaagucauucaagaucucuguccaagaaaggaagcaaagagcagugggugucuggugagacugacgugcgccaucuguagugugugguguuugcuaccccaccuuaacuuaagcucugagaaugggcugcacugccagccccugcccaggcucccuuagaucugaggaugaaacacacacacaccccacauuguucaaagccaaccugucuuauuggcuuaauugcugggcacuuguaaucuacugcagcuagugugcccuucccaauauucuuagugcaauacccuaaauccacccucagcuucaguugcucaguuacuuuuagucccagcucaacacccuaaucucccaccuagaggagcagccuaaggucgcucccggaaagaucucacguggccgcucaccuuuuccucgcccaacacacuguaaaaguuccucaccuccccuguagggaccuggaagucccacuuccuuccuuccucccucccagcagucccugcacuucaguucucugaggggcucccaacaccauccgaaugacacccaucugagacauccuuacugauagaucaagacccaauucuguuuuaacaucagacccacccccuacaagugcucaucuguugaugaagguaaucguacagaaaaguuucacacacaugcuguguauuucuaucauacuuaguccucauugcccucuccugcucaccuccuacucgccuccuuccuccagcuaauguccuuuccagucugcccuuccuucucucuccuuuccuccuccuuaccccuguuguuuuggugaggccccacaguguucuauuaggguuugaguagaguuuguacaggagcccugcugccuaccagucaugcuuacugaacuaaaaugucucucccuucccagaguccaugacugcuuacacaucccccacagcuaccacaguguacuugugaguccccaagggagagugcugaguguguguguguguaagagagagagagagacagagagacagagagagacagagagagagagagagaggagaaagaagaggaggaggaggaaaaggagaaaguguguggguggaucuacagggaagagugggaggaaauaagacuggaaagguggguagggugaggaguuuguguguuguccugaugucguuggcagccccucggagaucugaagugcaaaagccaguguguuugacucagagaaaaucaagucacugcugcucaugaaacucuuucuucaaggagcguuggaagagugugccagcaaaggcuugagguucggagcuagaccagucaguuugcuuaagccugaggaucccuucaguuaaaauguuugucuuauucagcuccuuuuaacaggagugaaaccaagauggcagaguguccaagccauaugggaagaaaaacaaagcgcuuuucagugugacuuguaacuuauuaaguguaaaggagaaagaggaagcaaaugggagauuucuguucuuuuccuggaccuuacauucucuugggaggaagcccucagcucagcucuuuggucacagagccuucuuguguuuggaaacugucaaugucauauccaugggcucagaugaggacucuauaggaguccaagcaaugacuaagacuguugugccugugugugacuuugcuacguugccaccuaucaaaaaauaccauuggccaggcaguggugguucauggcuuuaaucccagcacuugggaggcagaggcagaggcaggugguucucugaguuucgaggccagccuggucuacggagcuuguuccagcauagccagggcuacacagagaaacccuguuucaacauccccagccccaccccuccauccaacaaaggagaaaggaguuuagucaugggggcucagggucaagcugcauuguugcuguggaaaguugaaaauauggacgagagagaaaggacuguucucccauagacgcuguggcgagggucgcugugggcuccugagggucuuguggcaguguggacauaagugguagucuacaggcaaggcuucacaaucgguuuuccccucuugcuucuuguaugcuagcucuguuugagcucguguacaucguucucuguuggcuugauucuuacugcgcucgcagugcacacacuuuugcauccuuaggcaucacucacucucauggcagaauggaugcuagcuaucguucagaaguuuuaaaccagacgcuauuguucaaauacaauuuucagauuugugucauuucauuuuuauuugaacaaucuaaagcuacauuuugguucauucaguguuaucaucucaucuaagcguucccaaguauuaacacaguucaaguagacacaguugcagaguugugaagcguaggcugugguuugcuggacuuugaaagaccggaaggacccugucuuucuucuucuuugucauaucugcauauuauauucaauuuaguuaauuucuacagucugguaagugaacauuacuacuucagugcuuuuauucugugguuuaaaaggcuagugagguagacugucacuccauuuauauccaucugaaucacuuccauaugccccuuucugcuucguaaugagaccuacugcuauugcucuaggggucucuguuaguguaaucauaacucuguugaugucuccgcauacauugucauucagugcacuguuaauguacauuuuacuguccuaaaauguacacagggcuguucucugucggugguuaagccgucucuccagggacacugucucuucccccacaccuucugugacgugugacugguuacaucugaauguugauccguucuuuacuuuuggacacacgugugcgucuuuuuugucauccagaaaggaaaaccccgucccaugucucuguugacuucuccggcugcuggcaugaagacaguugauccccugccucugcgagaagacugugaagccaaugugcucagauuugcugauacucuuccuguuucgaaaauuuuggaccgucagcccagcaccccugggcagcugccuccaugugccccgccuuacugucauccguccagcaggauccagggccgucugcgagacccugaguuucagcacaacaguaaguauuugguuuucauuucuuaucucuuaaaaagaaaaguauuauacugauagauccgugcuauaagaggaaccacuugcuggcaagcucuguuagguguuuuucuuuuucucuuuucuuuugucuuuuucauuuauaauagacuccccuuccuucccccucucccucccucucuccccucuuucuccuuuauuuuuaauuuccgugcuggguuucugugaguggagcagauuucacuggacugugcugcugcgcccagguucacaguucacuccaugcagugaaaggcacauccgggucuuaccaagggacgcaggaggcuggccggguguugugggaaacaguaaagaagaaccaccgagccccccugcgcucccuccagcuucucuugcccuccaacgcucugcaggaccagaguucccuucccugcccgccagccccacacagcaaccguccaucccgcagucagaugccacagcacccagcaacccgguuagaaacaaaacucuagacgcuuauaauuaacaagucagauuuauagaucaauaaauucucaguucacaagaugcccacacaguaauuucagaaccaagugauaaugguauaagcugcccaccuagauuagaagguuaucccaauugcucuauccuuuaugaugucauauccaccuguggcuguuuaaagccaugcuggcucaggaucuucuuccuguccaugcuccaucuugcuuuuccucucuuaagccgcugcucugucccugcaacucuuagcaccgccucccuuuucccuguccaaucacaggccuccugcugcacuaauauuuuaauguaauuggacagggaaaauccugucacagccaggugccaguggugcuucuuuuucaggcaggacaacaaaaacugccccuggacauugccugguguugcucggauguggaauucaagauuugcacauucgaggaaauucugguuuccuuagguuuuguuagacauugcucugcuguuuggugucucccucugucacagcugggaauucuccggcagcuuuugcccugucacuuuuguaugugguggcugcucucugauggcuuugggauugucuuuaugaucaugcaaacguuacugccacuuuacagugcugcuucuuggaagugggugucuccccacucauucugcuggugccccgugggccuuuccaccagaucagcuccucucugacucugacgcuuucuugagcaguaauuucagaagcuuguaguuguugcacuccugggcgaggcaguuacccagcugggcaaacucggagaagaugauguguucuagccagugcauagagagcuuuccagaguucccugcuucaucuuaccgucacuacagcuccagaggagacugagcgaucuccaacaccccuuagcccccaacccacacccccaucaccuggggccagacacagggugcugcuucucaguuucuccacucugcuggcauaagacuuaugccccucagguguuccguguuucucucccccucuugcuuuccauucuccagcuugguuacucuuuccuaggcuuuuguuuccuuuguucugugaacuucugcugccucucuaaauguguauauugaguuuucgcuucucaauagaagcuuacuuugucucuuugaaguuacaucaauguucucauuggacaaaauucuaggcaccuagccauaauauauguacuugcuaaacauaugacauuuacccaguggcccugugaugucauaguuuccauuaauauacaaacguaacugauacacuuucucaugacuuacuuucgugacuaguuuacugauuugcugugucacaucaccugagauugggcaguguaucacgaacagagaugagugucucauggcacuagaagcugggaagugcccgacagaggggcuggcaucuaguggagguguccuugcugcgucgucuccuggcaggaaguggagagaaggagggacagacccucccugauacagcuuuaggucacagccuguccacuucucaagguccagucuccucaugugaucacagcagcaauucaguuucccugugaauguuuggaggggucagaccugcaaaccauuccacuaacgugguguuuaguagcuaaagaauaaugccuucugccuuuuuucuucaagugggaaaacccaggacgaacaauuugcagcuacauccacacgaugccuuuaaugaugaagguauuuuaguaguuacuuaagaaacauaucggcacuucccagcucgcagagcgcuucugcagguggccccacauuagguccuugagaucccaagauaaggaugaaguccuuccugugugacacaggcguccccugugugcugggggcaucuuuccccuucagcaggugcucugucugcugucugucuagaaucuggccugauguaccuguagccuguauauucuuaucauuuuucaucucuaaaaauauguguaauugaugaaaauagacacuucuuccuguauauuccucauccugucagauuuuuugauugggcaggaggccuuuugaagucuugagguaaagcaucgcagugacuguugucccguccugagaagcacggcuguaaucugggaagugccagucauuccugaauuuauugacuuugaauucggaaauaaauuuaaauuuaaugcucuuuccauugcaugcuaaguacauuagaaaguuuuucucuuuuaguuaguaaguuuguggcucuuuauucagagaacuagaaagcgaguuauguuuugaaauacaaaccuggccacuuugaauccacuacugcuuggucuggaugacaaauaacaguuuuuauaccuaugugguggguuugcucacucagcauauggaauuucaguacugaaaaggguagcauagugccagauauuuucccccuacauuuagggagauuuuaaaaaaaugauauaacaaaccauguuaaaauauagcguuuugaaaagauuuauuuuuauuacuuuugauaaugugugugagagcaugugcacaugugugcaugugugugagagcaugugcacauguguacaugugugugagagcaugugcacauguaugcaggugcccugggccagaggcagggaaucccuggaguuggaggugcaagugguugugagccacccaacguggaugcgaggaguugaacucagguccucugggauagcagcaugugcccuuagccucugagccaucuccccagccccagcauuuugcuuuuuaaauugaaaaccuuuuuuuugcuccaaauaguuguacuuaugaaaguaggauggcuucccugauaauauggcaaucagaagcugugcuuaauuaaugacauuaugggauuccaaugauguaaaaaauuucccauuccauuggcauguugaccucugauaaacgugggaaacggccacgaaagaugaugagcucccagguucccuguuuccucauagacagcaucaguauuaagucucgauggcugcauucccuggcaguggcacuuuccgcauaguccuguucuuacgaugauuuacauggauguaauccugggauucucucauuacagaugcagauagacugucugagaucucugcucgcucugcaguuuccagccuccgggcuuuccagacucuagcccgagcucagaaaagaaaggagaauuucuggggcaagccauaaaccucucaucuuaucuagugacaagcuggcucaucuuuacucacucaguguguuaagguuuucagaggguuuggaguuucuucuaacacuucugacucagauaauuugaauuuucaguggcucaucuuagccagaaaauugccaugcagcugugucuaagucugacucuuugagagcaccuuugcacuugucugaguacaaaggugcgggguuguguauuucuucacacacucuugacuuuugugucaggucucggggguugcuaguagaagccugaaggucaucuacagaauauucuaaagggagaaaaugaagucaacauuaagaucuuccaacuuaauuuccccucagauuggucuuaggcauuuuaauagcuguaggugucaugaaaagaaucucacuguuuuauuagcgccuucuguauacacaggugcaguguuaagaugauuggacuuugaaaagcuggcuguacauauuuuucuuauuuauguaacaaaauuugcugagagaauauguauauuuuugaucuuuuuauguauuuuauuuguauaauaacuggcauacauuugaauaaugucuagauuuugaaaaaugauuugugaaauggagaauuaaaauuuuguagacauuuaaaaaugaaaauuaagugugcuuggcuucuucaggaaguuaucauguggaauaaauaucuucuagaagcauucuauuagaacugcuuaaucaaaaauuauacuacuauugcagcugcuaaaugcagugaaacugagucuacaguauuuuuuuuuucacaaauacgagguuuuaaaaacagauucauuaaaaaauuuaaacaccaac

SEQ ID NO: 5750 - RNA, 2624 nt, Mus musculus
aggacauuggaagaagggagucucuaaagcagaaggucacucuugggaggaaguggccucuugcgucccgugucccgugaccggagcaccguuacuacucucucgaagcuccucucggcccccuugccgagacacuccacuccgcugccaagaugccccggauuaugaucaaaggaggaguguggaggaacacggaggaugaaauucugaaagcagcgguaaugaaauaugggaaaaaccaguggucuaggauugccucguugcugcauaggaaaucggcaaagcagugcaaagccagaugguacgaauggcuggauccaaguauuaaaaaaacugaaugguccagagaagaggaagaaaaacucuugcaccuggccaagcugaugccaacgcaguggaggaccauugcuccaaucauaggaagaacagcagcccagugccuggaacacuaugaauuccucuuggacaaaacugcucaaagggacaaugaagaggaaacaacagaugacccccgaaagcuuaagccuggagagaucgauccaaacccagagaccaagccagcccggccggacccaauugacauggaugaggaugaacuugagaugcucucugaggcucgagcccgucuggccaauacucaaggaaagaaggcuaaaaggaaagcaagagaaaagcaguuggaagaagccaggcgccuugcugcccuccagaaaagacgagagcuucgagcagcuggcauagagauucagaagaaaaggaaaaggaagagagguguugauuauaaugcugaaaucccauuugaaaaaaagccagcucuugguuuuuaugauacuucugaggagaauuaccaggcccuugaugcagacuucaggaaaaugcgacagcaggaucuugauggggagcuaagaucugaaaaagaaggaagagauagaaaaacagacaaacagcguuuaaaaaggaaaaaggagucugauuuaccaucagcuauccuccaaaccaguggugucuccgaguucacuaaaaagagaagcaaacuuguguugccugcgccucagauuucagaugcugaacuccaggaaguugucaagguaggccaggccagugaagucgcacggcagacggcggaggagucaggaauaacaaacucugcuucuagcacucuccugucugaguacaaugucacaaacaacagcaucgcucugagaacaccacggacaccagccccucaagacaggauucuacaggaagcucagaaccucauggccuugaccaauguggacacuccguugauaggugggcuuaauaccccacugcaugagagugacuucucuggugugaccccacagcagcaaguugugcagacuccaaauacaguucugucuaccccucucaggacuccuucuaauggagcugaagggcugacuccccgaaguggaacaacuccuaaaccagucacuaaugccaccccagguagaacaccacuuagagacaaguuacacauuaauccagaggauggaauggcagaccacagugaccccucuuacgugaagcagauggaaagagaaucucgugaacaucuccgucucggguucuuaggccucccugcaccuaagaacgauuuugaaaucguucugccugaaaaugccgagaaggaacuggaagaacgugaaauagaugauaccuacauugaagaugcugcugauguggaugcucgaaagcaggccacccgagaugcugagcguguaaaggaaaugaaacgaaugcacaaagccguucagaaggaucugcccaggccgucugaaguaaaugaaacuauuuuaagaccuuucgauguagaaccaccucuaacagauuuacagaagagcgaagaacugaucaaaaaagaaaugauuacgaugcuucauuaugaucuucuacaucaucccuacgaaccaucuggaaacaaaaaaggaaaaaauguuggguuugcuaccaacgauucagagcacauuacuuaucuugagcauagcccuuaugagaaguucuccaaagaagaucugaaaaaggcccaggaugcucugguacaagagauggaaguggucaaacaaggaaugagccauggagaacucuccagugaagcuuacaaccaggugugggaggaaugcuacagucaaguccucuaucuuccugcucagagcugcuacacucgcgcuaaucuugcuagcaaaaaggacagaauugaaucacuugaaaagagacuugagauaaacaggggucacaugacaacagaagccaagagagcugcaaagauggaaaagaagaugaagauuuugcuugguggauaccagucucgugcuauggggcucaugaaacaguugaaugacuuaugggaccagauugagcaggcucacuuggagcuacgcacuuuugaagaacucaagaaacaugaagacucugcuauuccccguaggcuagagugucuagaagaagaugugcagcggcaacaggaacgagagaaagagcuucaacagagauacgcggauuugcugauggagaaagagacuuuacaggcaaaguucugaagcacaguggauggaugcucugccacaggagagcgaguuccugguuuccuacucagcaaggcu

SEQ ID NO: 5751 - RNA, 2624 nt, Mus musculus; identical to SEQ ID NO: 5750

SEQ ID NO: 5752 - RNA, 2715 nt, Mus musculus
uguguguguguguguguguguguguguguguguguguguuccuaaaacauguugacaaugcaucaauauaggauaagaguuaagagcuugucacaaggucacccacaggaagcacaagacccaggguuuccaaaaagaugaaaccaaggccuggggaguuacagguuucucccaacuguguguugugaacacaaauguauuuccuguguuucaggacauugucaagacuccaagagacuuagccagagcaggauggaaaggcagaagcaaagucagugagaaacgauuauuucauccaucucuaguccauggacuaagacgggcuaccaucucccugcuccugagcgagagcgggaggcuaguuagaggcagaggcagguagccugaaaggugagcaugaguaauuaggccacaaaauguaacaagacaccugucccuuucauuugacgucauucaucaucaaagcccaaggauguuuggaaugccuuuggccuucuauguaaaauuuagaagaaugagaauagucuuuaugcuuuuaaguuaccuuuuggauucucacggccauacuuuaaagguacuuuuaagguaguuucaugauauaaagcaugaauggcuggaauaccgccauaucugaaaguuaauugaccaagccuuucauaagauguauaaagcaauccuuuuaaaggaugucuaccauugcuucgccugaaaacaaacuggacugcauagcacuagaggcuaaccagagccgagggguaggacgcccagaagucuccucagagccugauuccuuuccuucccucauccucgucuucuacccuugacacuguggagguuucauuuuguuuuguuuuugacaaaagagauaaaacuuauguagcgaucccaguugcaccccagccagucgugugagucaucuguagucagcguuccuccuuguggccuaacuaggaggaggaggaggaggaggauacaagucuucucacucccuccuacccacugcucuuuccacuaacacacaaccucccagccuaagcaagaguuuccaucacacacccaggggggaccacaagagcucugcucaaugcuccccuauucugccuccuccucagugcauuuacccagcaugugggcaauaguuugauugucuguguuuuuccaaaauugacacacacacaaaaaaaaguccucccaaucugucugcaguggggaaacaugagauccugcuucaccuccuagcuuuaucagcugaugaguaguuaguuucuaccgcuugauaauuagagacaaugaaaaauaaaaagccaacaauacagcaacuugcaaugccgucucaccucaaacuuggcaauacucaugaaugcauccuuuuucgccuugcuguugcugaagaagguaguaaucaggugugauucaaugacgcuuauguuguugcugauggccugauugucuuucaagacuucaaagagucugagguagaaagagauaaucuggcucugcaggauuuucaugucaccauccuugggaaauaacacaaagggaggauuuuaagaaaugacccauuagaaacaacagggaaacugggagaggagaaauauucaacucaccuuuugccaguuccuccagauauccaagaagagacucuuuucuuccacaucuaugccacuugaguucugaggaaaagagaaaaaaaauugauuuguaauuauuucaccaauugcccugaaaauaucuaucaaguuuuguugaauucagugcugauaauggucacagguuuccuucugggcccuuccacuuacuucuaacaacaaguauccccuaaaagacugcauguagccaaacacuguuacuguuacauucuuuuagcugcaggauguacuggcccagucuugaaacugcaaggccacaaauaaacucaacaaagcugacgagguuucaaguacccucaaguaaccauagugagcuaaaaagaaacuuacucucaaauuaagaaagggagagagaaaaucauuagaaucaucccacugugcacacugcccccuuaugguccaggccucugaaacaucagucugugcuguaauagggcuucauugcuacuuuaaaaaauagcuccaaacacauacgggaggcagcuugauuuacacugugaggagaggauugaccguagaugcuugaacauuaugcuaauagcuauauguauacuaguauauacauuugggacaaauuauaaaauucuaaggauauaaaauuugcuucuguuaaccauuaauuuaaaaaaaaaaucacaaaagagaaaauccugaaaacucugagaaauauagagucucauuaaaccucaccaagcggcuggcuuugauucgauuguaguagaauuucaaaauuacuccucaggguaaaacaacuucgggggaggggggcauuucuuaaacagaaacauuaagaacuuugccucccauuacuuuaagugauaagcuguuucccugcguaguuuuggugguaauauccaucucucacuaucacuuucaagacgucugaaggaauaagaaccauugagguaaggauauuuuuuaucacaacuaaaugauaagaaaucacaaaaucaucagcaucuuuguaccuuggaccuauacuaugccuaucuuugggaagauugguaauugcccucuaacuccguaguaaguuggacagaggguuaaaucgauauugagaucauua

SEQ ID NO: 5753 - RNA, 1248 nt, Mus musculus
caagacaucaccugacauaccugagucuccaaagagacucacuucauggucauuuauaaaacaaacaaacaaaagagauggaauuuuuccacagugacuggaaaguacaagaccaggaaaccaacagguauaacuuccugauaauuguugucuuucugcuuucaaaaacagugcuucuucagcucucaaacaucaccuaaaacucucuuggaggauuggcauuacuguggggggggcaguggaaccucaaggugguagagcuagguagaaggauguugggccaccaggagugugcaguucugggguuauuggugucuagccucuuuuccucucuggcuguuaugauaugagcuguuuugaucugucaugggcucucugcuaugcugaucagccaccucaccacaggcccacgcaaggggaccaaacacaaggaccaaagugucuauagccauguuccaagauaaagguuaauuccuuuaggcugguuaucuuagguaucaugguacagccaugcaacgcugagcaggaagggcccuuguugcuugcucucuugaucgaggagcagggaguccccuugaguggaagguaccagaacugagguagcuuucuaagggucuccucuccacccacaggaagaaccucuguuacccaaacaucuugagaacucaccacuucucaagaccaucuuauuuucccacaaacacuuaaacuggaacuuuggagggccaugcucaaacagcaguagcccugaugcaaaugauuggcauuccucuguuaccauccucaggaucccggagaacaggcauugcuuaaagcagaaggcagggauaaguuugugagaaaaacaaagcaagaaaaauggaugaaaaaagauccucgggcuggccucacacaguguggcccgucaaucacguaauuaucuagacauaugcagccaccucuccuagcuuccugguggcuguuuccccugguccugccauuccaaauauagacuuguggagguuagugccaguagagccuuugcugucugaaagucaagcuuuguucuuauuuuuagaaaaccuugggaggcuucuucuaccuuugcuuucugugucuccugaacucucuugaaaugacacacuuuacagaaauuggucuuacagguguuccgugcagcuguggcggauucgagguggcgccgcggguuccucauggaugacagcagaagcuguuaggacggagacggggucuccgugacuuccccug

SEQ ID NO: 5754 - RNA, 14616 nt, Mus musculus
ggcuguccaaguggacaaaggugcacaagugugccacgcgcgacaaagcauaaggugugcgacgacagagaagaaaauuuuuguucuuucugggaaacagaggcuauagaccacaaaugaaaagggcggggaaauucuccacgugucugggaagggaaagggaaaaggaaucuuuuccuccgaggaugugaggaaucagaggugucgcaccagugcagcagagagcugaaaggaaggugugucugucucaguggccgcgccgcgccggggaaaggcuuggaguuguaaggaaaugggaggugucucugauguuuauuuuugccuagcaacccacagccaacugcuaccucagcugcgguccacaggcgccugucugccuccccuuguccuagcgacuggagggcagcggucacucggugucagugaaucagggagggcgugcguggcugaaaugaagguggaagggcagccccuuccuucguccaugcuugggucaccaggcucagccgcagucccuccucggagccugacuuuccgaggugacccucauacaacuaaguucucuccaugauaaacuggggagaggggcuggcugggccacugggacagggacagggacuagggucggggccagggguggggggccgcaguauugucugggagcagccauuaggagcgguguuuaggggcgugauggaagagggaguggucucugcagcaauuucgggaggaggccggccgcgguagguugcgcgguagugccgggaggggcgucgcaggggcgagggggacccggguagagggcagauggccguaggggaggcacagggcgagccggagucgcaguuuuccugggagcggagggcggcucugcggaagaucggagggggugggacucccgggguggcgggugggggugggguggccgccagccuguguggcuggggccgggggugggggguggggggaguccggggcggggccucggcgggggcggggcuggccuucucgggcgcgagccgcgggggcgagcgugugugcgagugugcgcggacgcgcgcgggcccgggaggaggcucccgagcgagugggucccggcggccgcaacccgcuccccgcggccccgaugugagggagucggggaggccagcggugcggcaggggagggcgaggcaugugcacgggccgggggguacagcagccgcccgaggacgagggggacggcggcggcgaggaggagagcggggggcucgcggcggcggguccgggccgaggggaugcagcggacugcgugugucuggcuguagcgggagcgaggcggcgacgaggcgcgggugacccgcgugaggggcgaccaggaggcggcggcggcggcggcgaggaguagcggcgggaccggcggcgagggcagcacugccaugcacguuccucucccgcggccauguuaaccaggaaaccuucggccgccgcucccgccgccuacccgaccgguaagggccccgggacccugucggcggcguggggcgcgggcugcgcgcguuggugccccgggauccccgaacccggcgggucgagcgagggccauccggagcgcgaccccgccgcugcgccuucucgguggcccgcccuccccucccccggcccggcgacgugggcuccggagcuccggcccagcacugcuccccgccgggucgcgaacuuaacuuugcagcuggcgggugcgcgcuggggagucgcgucccgaccccccuuguuucccgcacgccgccggcuuuucccgggccgggugucuccuuccaucuucucccuagaagaggggguucgcugcccaccggggcgggggcggggggucuggguggcucucuucccccacccugacccucuuuugucuccucccgcgcguggcucccaggccgaggaggggacaccgccguucgccagcuucaggcuuccccggggaucggcgcgggggcuccccgaagcggaguggggaccggcccgcccucccccaucgcccugccgccucuccgggccagcaacgcuaccacuacagcccacacggugagaccuggcuucgggugggcgccaggcagaccccuggcuuguuggguuccgacugugggaagagagggccgaaucuccacgccccuagcaggggccuguccucgacgccgcccucugcaacuugggcgagccccgagcugcugccacaaaggagauucguggcgugggccccuugcuucccucuggugcucgcccaccccaggcuccuuuuccugggaacuuccuccuugcgcccccucccccuuuuuucaucucugcuucucagagcucccuucccccccgacccgguaaacaucuacucccaaccccagggguaguggauauuuauagaaacguauguguuaggggacagcuagccuacccugcccggaaaaucgaucccccaaagagccuccgaggccuggcuccagccagcagggagcacccgccaauugucccccgcguguguaagcauguuuuaugagagcuacagguuugagcacagcagaaauuguaauuaacauuaacaaaaauaagagcuacagcaguagucaaaacaaaacaacccccccccccccgcaggauucucaacguggauauugcucaaaaggaaagacugggcuuugcuuuguagguggcaaaggaagggcaccugacaagggcugucccuugagucccuggggaggagagcggagccugggacugguagcuguagagacuggcaagcuggaugugacuucagaauguaccuuuccucggcucccagcgauggccuuuggauggugaccuggagccuagaggaggugugcgcuugcagaagguggugguuucaaaggucucuuucccaaaggcucucugggagcgugagcaaccuaggaugguuucuaugugagguugcuugcagggcauaggauuuuguuaccaagugaaaguugguugagagcacccacccaugguuuguggccugcagggagcaucucugggggagggggguggggaaucaugugugacugaaacuugcuuaucacaggagaugagaagaagguggacuuuaguuguuuguaauggagacauauaagagagguagauaaucucauagacauguuuuguuauucucucuguuuuucuugugggucuauccuaggggcuggacauacacagaauuaacucaucuggguuguacuguugcugggaaagagagccugcaguuaguagggaugugauugccacaagggcauccuacaaaggaacagccauugguuuuagagguuuggauuuuuugugguuuuggcugguuuugaaucaucugacaguuuggaaaauacagcguccaucccccuccccccagcucccccucccccauguguuggugugcucauguuacauggugugaacuggaaaagaaauaauucaguuugccucugguuucccaguuuuuguaaggauggccuuagccugaucagaacuucuuugcgguugaaauaugucauggaaccgggugaaggagaaguugucacuagcagaauagccuguguggcaucagagaggaaaggccaugaaggcgauuucgggauagacgccugugcuuugugaccugugugugacauggcuguuuguaguugaagggugaacuucggcuacucugcauccuuggaugcuccguuuugaaagugaagcuuuguauuucaaauguuacuuucgacuugguuuguguaacauugcagguuucccagaucaggcauuaaggagcacagaguugaucuggcuccucuguguguuuaccugaggaggcagacuccacagguuaacugagcugucaggaguccagaggcaacucugauguguauugccgagucacacacccucccgagucuucguuuaauguacuauuugggacuacuaguucugggaaccaguauuagcuuaauuauaaauacuagaaccuuuacagauccagagucccaauauuccacauuuucaaaaguguuuauguguuuguuucuggagcaguuaccccugggaggaacuguggaggaauggcagagggagaaagaaagggcaggaagaaaaaugagcagagcaggggggcccuuucucccuuaaacacaugacaggauuaugaacuuuggaauuucccaugguaguuugcuuucuuuuuuuuguaugacguuuauuguauacuagagcaauuuaguuugggucagcuuguccuaaaaguaaaaccaauaaauaucucaauucucauuggcuuuaaaaaauaauaauaauauaugggcgaugauaaaauuuuugaaaacuuuuaauuucuauagauuccaagauauugguauauauccuuauaacuuuuaaugcuuaaauuauucaucagugauuuuauuuuuuaaccuccacgguuuucuucccauaacagcacacaucauuucuaagaugauuuggggaggcuuuaaaacucccagaagucuuagcacgaggagcaucuguugcuugccauuuugguaucgcgagagggugaugaaguggcagacuucuuagccuuuguugucggauagaauuuucaauacuaaaacauugcauguucccaggagggcuuuaugggucucuccacguuaaugcaugcauuucuggggaguuggaccaucaccuuuaguuagugucagcuuguauucuugaaugugacccauuguaguauuuuagcaaauagggccaacccauggucgcugacuucaagaggcugaggugagagugaagaguuuucaguguucuuauguuuaugaucugguccuggcuugucuggccuuucugggugccccucccccuaguccuccaugugucaguuuugugcauuugauuuugguugggauuucaggcuucuucuucuuccuggaaacuucaaguaaauaucuuuaacuccuggaauguguaaggcucugggguguuguuaagaugucuaccucagguacuuuuuaaccagcuguccuuugccucggaggcacagcgagaucuugugacuugggccucuugggauauuucccaacucccucaguguugacuucauguuuucuuuugaagaugcaaacaccaucgcugaagaaugacucugagagacauuucuugaugugcgcgcuucuagccgggagguauucauuaaauucccacuguggaccugaguuuauguugucgagggcuuaaaaauuagaggugacccucuccuguaauuucucagcagcuggauauauaggugugauuuuuuuuuugucaaaccagagugaaaugaagcugugaaugguacuguaggugugggguggggggagggggaauugaauaaucagaggacaugagagcccuggguuuugaagaaugaauaggaguuuaucauaugaacauugguaagaaggcgauuccaagucugaaaagggcuguggucauagcuggcacugcucaggacuauacccaacacuuuccacguguaaccccucuaaucucccuaauaucccuaaugagguagcuugggaccuuuuuauacacaaggacacugcaguucugagagauuaaguaaacagcccagggucacacaguaacugugggcacugcacucacuugacgggugaaaaucucugggcucuuagaaaacuguuuccaucaacaagagagggugugaaaaugcacaggaucccugggucuugggaguucagccuuguuccucugagauggauagaucagacuuggaagagcucaggccagaugcguucuuacugcaggcauuggcucugguggugggauguagccgugggccacaagaaaagcaagggcagugucagacagacagcgugugcaugccaacucuagaaaagacuauggagaaggauuugaagaguuuaggcuaugaagcagggugcgucugggccugcauagccaccucaguugucccagugaaaacaagcaguguacggccagauguaacucuuagaaagggugugagggguuggacacaggaggcuucccgggagugggaagggugcagaggcagaggagggucgcagguguacacugucagggacucccagggauucagccagagugauuauuuggaaagagaagggauuuuguuuguuuguuuguuuuguuuuguuuuguuuuuuguuuucgucgucgucgucggugcuuauuuguuuguuuuaaaguugggauuacgauaacaagaaaacauuuggcucuauaaagaaaaguuaggaguuuguuugaguugcucgugggagcagaaacucauuaguagcugagcggaaagggcuggaguccaggaggcagggauggauaggcaugucugcaagaggagaccugguaggcuccagccaacgagaggcgcuccggacaugccagcugugcucagcacugccuaggaaauuauuggagugaaacggcaagagaacggaagcuugcacccaccugucagcaaagggacauagcagauccugcaaaaggaugcugagagcagacagcuggagagagacaugguggaccaauugaugggcaaccucuuucacuucuggccacuaaaauauuagaauguuuugguuuuuggauuauacaaaaagucauuauaauaacauaagccggaguaaaaucuugaugcucaaaaacuuuuauggugguagcauuuuaggaaccuuuacaaaucccaagguugauuuuuauccuucauguggcucucgagucguagaguaucgaucuggauggcggcgguggggguagaccugaaggagucccccucuggcccugaagagacagauuucaaauccugaguccuuuucauuccugguguuuuaaagacugcagaggaaagagggcucagagaugaauggagcuuuggaagaaaugcagugcguagacuggggcacaguggagcagggcagcacccagcacuucagaggcaggcagugccagcacugguuucccccacccuaaggcuagcacuuguuagcaaguucuuggcuaacucuggggucuuaagaacccggggaaaggaagggaaggacaaacaagccuguguugccuuuuuaucugugcaaagcuuuucuggugcauuuuguggucugccuugcuuuugaagucgaaaaagauagcaccucccuuaguagaacauacagucgccuuggaugcauggagcaucaucugcggguuccauaagagaaaucugcugaaagucucucugaggaauaaaauucuugauucuguaaagucauagucgcgagugcuggcuuccuucuguuuuagaaggaaguaagcaaguaagcagagucucacuccauagauggucauuaugcuugcuguuugucaguucaaaaacaaaacaaaacaaaacaaaacaaugaagaucgugugauuccauucuauaauccagcugcucccaaaccguuucuugaauucccgugccacccuacagagugcgucuguucuuucaggaguaugaauaacccaaaacagaggacuuagcgcugaggaacuaggacucauccuauuuacuguaaaucuccagugggcacaguucccagcacuuuguagccugucccuuacuaacacugaaagagugggguagauuauggugacaaguugauucuuugagguaucaagugagaauccaccagcaggcugcucgaaggaaaucccaagccgauucaggaugggaaacggagggcucuuccuuugcccugucaaguuuuguuuagaugagacuauucugggaugacaugugugccagaaauagaaacugcuacuuuguauucgucuuaguuacuguuuccuuugcuuugagcaaauaccuggcaagaaucaucuaaaggaggaaggguuuauuuuggcuggcaauuuaaggagggcuauacugucauggcaugaagacaugguggcaggaaccugaggcagcuggucacacugccccugcuggcuggaagccgaugggggagcaugauaggguuuggcucgcuuugcucauccagucuggaaccccagccaguggaaaagugcagccauguauagguuggauccucccaccucaguuaacccaaucuagaagcucuuuaagggacaugagcagagguuugucucuuaggugauuguagauccugccauggugggagucucaaugucacauuauucuguguuggaaagcugaguaucccagcagccuguacaaacccaugcauggguacugagcuguggaccagaggccccaaacugaauggcaaguugcucaguuuguuggacagaaugaccuuaacugauuauaaagccaccaacacccagaaacuguaaacaacagguuugaaguucgcgagauaaccagggcacacguaucuaugggagacucugucaauagaagcauauuuugcuuguugcuaugugugcucuccaaggucaauuauaacuuccagggaagaaggaaacaacguguuuggggaggagaucuagauacguaaaagagcacuggacaaaugugauucccuguccucguguaaauaaagaaugccuagaugaaaugugggaggcacuguggucugggcgugggcagcaggguagauggcacuucuuugugcuuugucuguuucauuuccagaucagauauggcuccaaacacccgccaugggccaggccuguuauuaaacacuaggugcaggaugguaacaugaacgcuugauccuugcuccaggaaaacuuacuccaaggaccugggcuauguaggacuggcauucuuggggcuguccuauguauccuaaccccgcccagucuacuuuuuauuuuuauuacugucuugccuauaaccagccuacucauucucucugcugguguauguucauggaacggcuuccauguuguaaaaccagaugugacuuuguucacaccaaauuggauauuguaaagaugggaauggguuaacagggacuuuucaaaagucauccuuggagagacgcggggugccccccccuuccuuucuguugaugcuuuuugucugcauuccagauuggcggcaguaagcacaccaugaaugaccaccuccaccucaacagccacggacagauccagguucagcagcuguucgaggauaauaguaacaaaaggacagugcucacaacacagcccaaugggcuuacgacggugggcaagacaggcuugccuggggugcccgagcggcagcuggagagcauucaccgacggcagggcagcuccaccucucugaaguccauggaaggcauggggaagguaaaagccucccccaugacgcccgaacaagcgaugaagcaauacaugcaaaaacucacagccuucgaacaccaugagauuuuuagcuacccugaaauauacuucuuggguccaaaugcaaagaaacgccaaggcaugaccgguggacccaacaauggugguuaugacgacgaccagggaucguacgugcaggugccccaugaucacguggcuuacagguacgagguccucaaggucaucgggaaggggagcuuugggcagguggucaaggccuaugaccacaaaguccaccagcacguggcccugaagauggugcggaacgagaagcgcuuccacaggcaggcggccgaggagauccggaucuuggaacaccuacggaagcaggacaaggacaacacuaugaacgucauccacaugcuggagaacuucaccuuccgcaaccacaucugcaugacguucgaguugcugagcaugaaccucuaugagcucaucaagaagaauaaguuccagggcuucagccugccucuggugcgcaaguuugcccacuccauucugcagugcuuggaugcuuugcacaagaacagaauaauccacugugaccuuaagcccgagaacauuuuguuaaagcagcagggucgaagcaguauuaaagugauugacuuuggcuccaguuguuacgagcaccaacgcgucuacacguacauccagucacgcuuuuaccgggcuccggaagugauccucggagccagguauggcaugcccauagacauguggagccuggguugcauccucgcggaacuccugacggguuacccccucuugccuggggaggaugaaggggaccagcuggcuuguaugaucgagcuuuugggcaugcccucucagaaacuccuggaugcuuccaaacgagccaaaaauuucgugagcuccaaggguuacccccgauacugcacaguuacgacucuuucagauggcucugugguccucaacgggggccgaucccggagagggaaacuaagggguccgccagagagcagagagugggggaacgcacugaagggaugcgaugacccucuuuuccuugacuucuuaaaacaguguuuggagugggaucccgcgguccgcaugaccccgggccaggcuuugcggcacccguggcuuaggaggcgcuugccaaagccuccgaccggagagaagacagcggugaagagggucacagagaguacuggugcuaucaccuccauuuccaaguuaccuccacccuccaguucagcuuccaagcugaggacuaacuuggcacagaugacagaugccaaugggaauauucagcagaggacaguguugccgaaacucguuagcugagcuccagucccccugaugcuggcaaucugaagagagagagagagagagagaaccgcguuauagcugagccuuacuggguugaaaaaguguagcucagaccuguuuuuauuugcucaauaacucgacucauuuguaucuuuucagcacuugauguaagacuguuuuguuuuuauaaaauacauggggacaaugcuuuaaguuuuuauacuuucugaaacuguuuuuguuuuugguuuuuguuuuuuuguuuguuuuccuuccuuguguuucuaaaaguacgaugagccuuacuguauuuaguguggcagagaaaucacauugguggcaggccauugauucuucaugacugucacacauuuacagauuggucaaacacauucacucuguuuucgugguuuucgucccacuccccagggaggugguccccugaggccccccuccucucuccuggcuccagguucacacggaagcagcccgccuugccuccauuuuucauaaauuaaucugggucagaguggaggagggagaaggggggccggggugaaaaaucucuaaggaaaacugcacuuucgagauuuucuuuuuuuccucacggucuguucaaaugauuacaaaauaggauugcccgcuuucaacugcccacuuaacauucugaugugcuuaagccaccgagccgcauuuaguggauaaguggaaacugagauguguccguuccucccgaggcacuaggaugauggcgggcugucauaaucaggaagccuucugguuacggaauugcuuuugcaccuaauuuuaaggacucccccucccccacaguguucccugcugccuuuucucuuguucgcuccucuuccaccacacacaucuguugccugcguuuagucugucuuuuuuguccaucccagaccaauaacacagagagacauuucagcugccauucugucuacaguuuuguaccccaaaagaacaucggccuagcuaccugagguggggauuugcguaguuccaaagaagaguuagccgccuagacuggagucaguucacacugcaggugccacagagguucccuuagccuggggaagcaucaacucuuucguuagaaagaauagggguugcaaagggaggagaaauuccaaugucaaguuaaauggccugacuuauucucugauucacuagaagagccccaggaaaaacacuauuccucuguugaguugacuuuuucuuuugaaucgcacugaguguuuuuguggggaaugacgcuuuaccugagagaguaacugagaguuagguaaaagaauauuuucuucucugaauaauaauuauuuucacagugaaaauuucaguauuuuaucacuaauguaugaacagugauauauaucaauuucaaggcacguggaaagaauuuuuuaguaugugcaauuuaauagagaaagauuucugccuguuuggacaauagguuuuggauaguaaaaauuaggauaaauaaucuuuuauaugcacagauauuauuguauugccuguaaaucgauuuacaaguacuuaaagcacgguccccagcgaggccaagaaaguuuccgguuaaguuuuuuuaauucuauguuuucucuuacuuaaaaaaaaaagaaaaaaaaagaaaaaaauagaaagugucauuuugaauaaaacauuuuucuuaucuugaggcuuugccaguugaugguggaaaaauaugcucaggaauuauuucaaauauuugccaaaaaucaguaauaagauuagcuuauuaauaaguuaguaauaucgauguuugcuuuacuauuuaaggaugucauugauaaauuaauuuguaccccuguacuuagcaauuauagcuuauuuccccuagucaaacucuuuagcauacuauacacaguucuguguaaucugugaagugcaauaauaugucaauaaguuacauaaagaugcccaugugacagcacccccaaucaguggcuuagagggcuuaaaaaugcuguauuuauuuuuaaaacuuuggcuuaaaggcauaagaaguauaaagagucggucuggggacuuuauaaagcuaugagccucuuaacgaugguuauugucuuuaggucauuaaaauaaauuuuuaaaaauggacacuauuuccccuccccgccaggcucccuucuucuguucucacuugguugcugccugagccugagucuaagguuacucacuccccuagaaccucacuguacuugcaacaguuuagaaguggacuaagaugguuugccuuucccccaccacacaaaacugguucuucguagaugccagcggaacuuuugugaggagcuuuacccauauauggaaccaucaugugcuacaaggcuuuuguuuccuucucuccccccacccuccucccgggacuacagugaaauuuccuuuauucacaaaaaccgugucagcauuuacugauaccgcugcuuugaggagaaucuuauuuaacuauugugucuaaaaugaaacuguugccucuucaugaucuucaccuaaguaaagggcucugauagcgacuaggaguuggcuuggaaacaggucucacagguuaccauugucuagggaugucucagcuguuuucagauuuaggaauagcacaguguagucuugucuuugguugcagucucacuuggcucuguuucuugcacuaccagaguguucuuagcacaaccguggaacacggagggacgcagggcagcauagauuaacaucguagaggagaaauugugcccuuaguguuaauaaugugccuuuuguucugaaugccauguuacagggcaugcauuuuuggccucuuuaacucuuugaaugagagguaguaaagagggaugccaccucugcggagauaacaucugucuuaaauaucuagauuuauaggccuuaauagaaaccauaaggcgugaauugucacuggaugcugagcaagauaacuauugguuaguuacgccaggaauucccacguuuaagagguuaaagauggucuuuguuguaucuuaacaucagacugauuuuuuaacgauaacuuuuuuguuguuaugcuaacacuagacaaaaaaaaaucaacuguauuuguaaaaauuuaccucaaaccauuuaauuuuauagugugauugguuaaucccagggcauuugguaugaaccaaagugcauuccuuuuuuuuaugugccuggcuccaguaaggauggccagggauuuuuacaauuugggugcaugacacuuaagccacuuuuaaacuuacugggcggugugggguccuguuagacgacuccaucagaaugucagaaaacacuuuaggcaucaguagcauugggccauauuggaaucuuaaaagcgcgaauuauuuuaaaagagaacauucauuuuuuguaauuuuuuucaucaagacuauuucugguaacagaagauuuuuuuuaaaauaaaaaauaauaauaaaaaaaaucaacggauucgguugguaaagguuuuaauauugcccaacauaaugcugugguagcauuaaaaaaaaaguauuuguggacucuguuuuuaggggcuuguacaucucucugcuauggacauauauacgauacauuguaauuauaucagcucaacugcugcaguuaugucuaggcgggggcuuggguuuuuuaucgagcaacaccuuagacacgugacuguauuaaugcugcaacuguguguacugaaaauaugugaaaugguugaauguggacuguguauauauguauguacagauuucugugagaugcugcuguugccacuugacaugggaaguguuguagugggucugaacccuagcgaccaguucuaugauacuguaugcauuguacagccagagcagaaguaagacuguuuagugaauuauuuguuaaauuuuauuguuguggccagagauaauuucagaauaaaauuuuaauguccuaccuuacaucuca

SEQ ID NO: 5755 - RNA, 17360 nt, Mus musculus
gaauucauuuuauuauuauagcucuuaucuuuauagcuugaaugaccccgauagacuuuuauaggaaacauuucacuuugggcucaagacagcaaauguucaccuccuccuccuccucaugauacugugucuuuuaucacuucaucuaaagaagaugccuaguaucagcuaugccggagacacucauauuuugcuaauaauaugcacauugcuuaacagugcugagcaaugcccuccugcuucauccagauguuugggacauauuuucaaguuaguuuccccuggaagaucuuuauagggaaaaaucagauguugugcugaaaugucauguagacuuaucuguuguuugaggaggugacaccugauucuaaaaauaaaaugagccuuagagaaagacacugaagaauggaaagacuuuuaaaaaaauauauggcuuaugucagcuuuagugauauuuccgaacucaguugcauaggaugcgcugagaaauggaggcccgugguuaggugaauuuauggcacauucucuucccaaugugagagauugacaguguauguuagagaacccaaagcucggaggagcuuuguaggaacucgguagguagagaaucaauuuccucagcaaaguguuuuggaggucuaagugagcaccucuuugagcuguggaguagaucagaagccaguugcagaagccaauuaggaagccaggagccgcgggauccgacuacauggugauugcuaguuuuucaacauguacaauggaggugaauccaguacugcuauguuuaguaugggcauuucuuccuucagagaaggccuuugaugauaaccaguuuguuaauccacuucagaggaacuuccuacagagacaauugagaagaaagaaaagaaagaguaguaggcaugucuuuccuuuugcuuucuuaaaacucugcucauaaauugguggcccaugaaaucauucuauuuugugucauuuugagggcauccccacuggagcacuuggacugaagggcauuugugacauuaucuuguauuuaauugacuaucucaggaauauccaaccucauuaggauuguuguucagauuucuacugcaagauuucuugaagacgugauacuguuaaaugccccacuguuuaaauuucuuugauuaauacuuugugaucaauucuguuuagaauuuagugcuaaaauguuuguuuguuuuucccuaaaagaacauauauuuuaucauaucagaugaauaaaauaaaaauaaguaaccuuccaccuuuuccuuuuuaucuuggcugccugugagaucaaaguaaaauuuuauagacauuguaguaauagcuauucaaaccuuuaaagaaacagcuuauguauuacuucaaaucucuuagaagcagguggcacuuaaauuuuauguuaaaacugaagcacauuccuuaugcaaagccuguguucagaaaauucauuuucaagcuuuuuaacugauacuguuuucuuugaaauaaaauuauaugcauguuaaauuuuauaauuuaacugggcuuuaaagcuuuucauuccauuuuauagcuggauucccaugcauagaaaccacaauuaggaauauucaaauuaaggaaugcagguaacaucaguuuucaacaaauagaucgauuuauuucuguacauuaaaguaccaagaaacacacaucaauucaguaagaacccaaggcacaguuaccuggugcuuggucuugccccucugcuugggcgagaccugguaucaggaagggcucacucccaucucuugcucagugcucugaaucugcgggucagucagggagagcacaucaugccaugucuugaauguagcaucaauaaaccauugucuggauggccgcgagugggucuuaaccugucccgcagacuucuaccccuuuucagaacuacugaugaagaaaaguaaguuuaaaucgucuggccaccuuuugcugugccucuuuucauuuggauauuuuucuugacuccugccuggagagcugucgggcuuuuguugcaauuauaauggauaacguuuuuaugagaagugccauuucuucaagacuccuuucuucuucaauucucuucugcuuugguaaaacuauggcaccaugagguaacuggcauagagggagguggugcuucugggaguagaauacuuaaagaugaugaugaugacugagugacugaaugaaaggcugaaauaagucagaauuagccuuuuguaggagaggcuagcagauccacuccuuguacuuccugugcuaaaaggagaggccauggacagaaagcacagugaccuggacucuucccccuaaaagaucauguuaaaaaccaaacucacauuuagucacaacacuuaggaggcagaggcagguggaucucugaguuugaggccagccugguccacauagccauguccaggccagcaaggggcuacaugaugagagccugccucaagaccuacaagcaaccacaaauaaccuuguaaggagcugaaacuugugaguuuuggaccugcaauuccuagugugauugcgaaggaaggagaaccacacuggggaaguaacagaaguuuacaaaacaucugggaugggggagggguggguaagcuuugcacacuaagauggugcugccuggaccagggauggaguugcaggaacccagauccucaaaguguuucucacauacagcccagggggguggcuagcaugggcagucagacugaaacuaucugugaggaggagcugccauugguagugugugcacagacugcucagucacucuaaaacuuccaguaccugggcagagaauggcuuugucuuccugaaucugauaggagggaaagacuuugcugguuucucauggguccgauuucucagcccuuagcaugcagagcccaugucaaacaauacauccagacaggaucucucuccuacauacgauacacguccaguguguggcccaugcgggguuuugcccuaggguguccacgaacacagcccaacacauuugccaauaagaucaugucacaaugugagaaggcuggacaucuuugcuggaugcuagaagaguuccuuacuguugggcacaagcaaaguugugauuuccagaugugaaaacaucuguaagacuuuccuccccguugcagccacugacaccaaggcuuguagcuuuuugucugucucccugucccagcaagaacucuagagucuugaaucuuucuccugucacacuguguguuacuuagugaauguuuugugagauggcgaauccauugguaccugcaguuuaaauaauggcuguaagccuuuacauuuucucggauguccagaaugaagaagagauaacaaaaaaacccacucugguuauauggggcuguaaggccaggaccaccuguucuucacacaugucugggaacuugaagggacagaugcagaauccuugggccccaaaguugaguuuugaagacuucuccaguuugccuuuuuuuuuuccuauuguguuuuuuguuuuguuuuguuuuuuuguuuguuuguuugcuuguugcuguuuuugugggcuuuguuguuguuguucuuuuugugugagauagagccuugcugugucauuccaagggucaagaaggggcuuuguaaucaaacucuccuugucuggacuuccuugguguuaggauucaaaggugcauaugcaugaucacauacaacucucacucugugcuuagucacugacuuauguccaguuuucuguuguucuccccacugaccccuuccccccccccaaaucuuuucugaggcucaacaccagaaggugcacaaccaacacuuacacuuccaugaaccucagacuggguuucgcaggaugguacagccuggaagcagcaugguugguccacucguuggccuugcugaaacaguuuggauauagugguaauaugaugcuuucagacuucggucauuuuucccucccuguggauaaacugagacccuugagggccugugacauaguuccccugguuccuaaguaugaaaguguguuuuuuagaacccaggagcagaagcaaagagaaagcccagccucgaagaucuaaaugugcaaauggugcucacgacugcucuuccccugguauuaggcagggagagcagggggggugggcugauucucucucagcaaacagcucagaaugauugaggaaauacaaguggggggaagggaaggaaggcagggaugggaaguucuuguuucauuccgcacccgggguugugugugcuacaccuguguauuccuagaaacguugaucucauucuccaacaucaucuguuaaaagacuuuaauuaaaugcauugaucagauaucagagaauaucgugaguguguuuuucccccgauggauaaggcauuaggcuugugggaugguagucuuuuggauacuguuaguuuaugaaagauuuuuaaguugggcuuccuggggaccccacauuauuguagaaguaacuuggcaguguuccauuguccucagacaguagcuaguaauggcauuugagauauguuagaagauaaggaguuugguuaaugaaaugguguuuuagagaauaaucuggugcgggaagaaggagcccaauguggaagaaaagggggcguuucuaucaucauacaccucguucccacacgcagucuauaccuucagagcaguauacaaguaaucacuuuggugacggaaggcguuacccaugcugagucuuaacuggauacagucagcagagaguuagaagagugugaaccaaaucugauccaagcaacagguuaggaaagaaaagcugcuucacacagccuuguaagcugauaaaacauccugguggaaacaggauuuaagucggaacaauuuugcauacggaaaaaauguucaggaucaaaaaaaaaaauucuuaucguucuggaacagguaaauaaacuaucugucugaagcguccuuaguuugguacccaguccaagguguuuagguguuucucagcacaugaucuuuguucguucuuuacagugaguccuggcagguagaguaacuggucauuguggucacaugaacaaggagggcagaaaccugagcucuuguccguaggaacuaacacauuaacuaacacauuaauguguuagcaaagcaagugaaagguggagaagagagaaaggagacaagggauaaaucaaaacacaaggucagcaagacaaaacuuaaauaaaucaauacaguggucagugcaaacaaaaugagagaagcgaaccgugaaugguugcuaaaaugaaggcaaacgugcagugcagucugcgcaugugcaugugcaugcacaugcgcaugggguccuguaaggucugcaucaaguccccuuggcacugugggaugucccugcguccugguaaaacucacaguugucucagguuugaaguugucagucuguaggccgaugucuugcaucuacuucucucugaccuacagugaagauauuuucacaguuaaaaaugaccucaguugucuccucacuggaggaugcgcucagaaaugcgcacuauucucagaggguuccaccuugcuccuccccuuggccugggagcauaguaaucucccuauaaauaggaaggugacagacugaucucaccccuuaaacucauggauaaccuuugagggaggcucuucagaaucaugguacucucucuucaggucccaucugcuugcuccucaguuugucuuaauaaauuucugcuuugaaauuacauuuaccacggccaccauggcagccacgguucacagagcuggaguccacgaaucucugacauaggucacuauuuccguucucagcaggauggagugccaccuugaaggucucuccuuaggguugccaugacccgccuuuccccccagagcuccuccuuguuucacacguuccagaucuuccuggauuucuuccuugcccugccuccgagcccugcaugugcaucucuuuggauucgcuccugguggcuugguucuguacucuuuuucucagucucgucuucuugaaaguaaggggcagggguuggggggagccaaaguaccaccaccaccaccaguauuuucaugccaagcaagaacccugugguagccuuaaauccuuaaaauguauuuaaaacaaaacagaacaaaacaaaacugguguuaaacacaaaaauaauucucaaacuagaugucuauggauauccuucuacucaggaggcugagacaagaagaccacgaguucccuggcuguauacaugacaagauucugccucaaaacacugagaagauguaguuccaugguagaaugcuugccuuaacaugcacaaaacucaagccucucacugaaaacaacccugauccauucaaucaaguuuacguugaccuaucuguugaaucuccaugaugcaggggcuuugagagaacaucaaucuauuucucagauuauguuuuucauucugucugcuguuuugcugauggcucagcuuccaucaccuuggagauaaccccacacaguugcucuugccgcccaucuccuguccuuuauggauccugauucagcucagccugccuucuuccuaguccacuaccucaccccacagucccugcgagcaugaaugggaccacauggcaugcagccaauagagaauuucuccauuccuggucucucuucuuucuuuauuccuaggugacguuucuacucuucgaugaaacuggugguuucuugcuuuccagcguccucuggacucucuucuucacaauacgcucucugccagguguucccaguauugucuuuguuacuuuguagugggaucuagcacacgcugcuggccaggaggccucuguggauacccggaacucuccuguuccucacucgccugcuuaccacugggcucucagccuacuccugugauuuuucucugggagacuucugagaauucugccaauagggggacugugucgagcaguugcuuccuguccucuccacccacucuuuaugguucccaauacacuugucauggcuuaucugauaucucauaaaacccauaggagcagagaccacuuuugcauuuauuuaagacugaauguccaauugcuugacauucuucaaacuaugaugaaaggauauugaauuagugaguuauaaauagaauccugcuccccacccgagucaaauucaauugccaucuuucuguuaaacacucagauccaccaaagauauacacauucuugaacauacuucuguguggcuugccuaauauuuggcuagcagaaaugccaaggucaugauugacaagggcagaugagaauaaguagaggugacugaacacagcguagaauccaagucaaugcagaccagaaggacauucguggaaaugauagaagacauaauuaugugaguuuaacggauagcauuuuacugagggaaacuuccugguuuugaugaucuacaugaagguugugugagguaccaacugacguuagggcaagcugaucgaaauggaaccauuuuguacaauuuuucugaaacucuucucaguguuggacaguauuucaaaauaauaaugauaauaauaauaauaauaauacaaaaacaaagugagaaaucuucuaggaguuuuuauguacagagaauauguuugaagguauagauuccuagcccugaauauuaucagccuaguagguguucaauaaacaccacauuguuuugugcuugcuugcuugcucugcugcggucuguguuguccccuuccuuccugcugccccuagcaacagcccggcuccucagggggaaaucugcucccagagaggcugugcuguggagggcagagccucacugaaggcagcagagacagggugcugagcgcauccugugugcugggaauuugcuuucaucugaaccgagaguagaguuuaaaaaguaaaaugugcuagaagaaaaucgucuaagacgcagaugacgucaucugccugccucgauuuuacaugguauauauuuucucucugaacuuuuauuaaugcguaacuccuaagauaaucuaguuauauuuccaguugugcuucuuuaucaauauuuuauggaugauuuuuaaccuucuuauauacugaggagugaccacauuuucauuaguagcauuacugaggaauucucacuaauuaauucuuacuaauagcaucuuaucucgaauuaauacagaauauuaaauauuuuuauacuuaaauauuuuaaacagauaaaaauauaucauugucuuagugcacugcaauaaaaacauaaaauacuaugacuuuuauuaaggaaaaaauguacaauaaaauaaaacugaagaaaccuuugcaaauguucaagagcuuucccaaggccauucucaacuuggccuauaauuuuuaaaugacuguguaguaaugcauaugauuaauaauuaauaauaaauaagaccuuccuagcaguugagcauuucaggaaggcuuucuaaaguugacccuuucagagaaauugaggguucuguuguuauuuuucuauugcucaugaaaccguugcugguaguuccuacugaaaauagacaauuuccgucucagagcugaacugcuauuuggucuaguucagugcuucucaaaugcccuaaugcugugacccuuuaauaccuuuccucguguugugaugacccuccucacaaccauaaaacuauuuuguugccacuucauaacuguaacuuuucuauuguuaugaaccauaauguaacuaucuccauacaaaaggggucgagccccacagguugagaaccacuggucuagaggcacagcagagauaaggcagucuuaguuuuuuuaaaaaaaaaaaucccucuugcugcuuugccugguccuccgggcgcuucucuagagcuuuugguucucacagcuuccuagcucugccuuccuggggcaucucuucacuuuguguccagacguuuacacuuccugcacaaaaucacgcacgaauggaaaguucagucauuguagcagagaucucagugacccguuuuuauaaugcaaagggagaaaggacauaucuuguuaugcuuuguccuuaugacaugaaauucagauggaggaauuuugaacagcaaucaaggcaggaaagaaaaccaggaggccccaguuuuuauauaggaaaggucuauugaguauccaaaaggaacacaaaaggccagcaagggucucaacucagaaacacugauugcguguaaacacauucuccccccccccccccguucugucugucugucugucugucugucuggugaagucuaccuauguagaucugguuauucuagaacuuauguagaccaggcuagucuugacucuuuagaguucugucucuugucuccugaguccugggauuaaaggcacacacgacgccuugggcucccuucuugagagcacuucaagacuggucuauuaguguaagcugccuuugcuuuauuuuucaacuaaugagcaaaaaaagcauuugaacauuauuuucaagcucuguaaguuugaagggagauggagacacgcacagagaacuauguccauguuccuaagaaacuaauccugaaacagucuuagaauguaaauccugaacuucauagaggucccuugcuauuauuauuuuaauuugcaacugaagaagccaucgcccaagggucagaccaaggacuuucuauccuccagccuugcuccuuaucaagacccauccauacuuauaugacuuccaucuugucacaaacuucugaaacagcaaccaaaacgagaugaacugagacagcuaagugucuuaguuaagugucuguacugugagcagauacauugacugagacaacucuuauaaggacaacauuuacuuggggcuggcuuacagguucagagguucaguccauuaucaucaaggcaggaacguggcagcauccaggcaugcauggugcaggaggagcugagaguucuacaucuucaucugaaggcugcuagaggaauacuggcuuccaggcagcuaggauggggggugggggaggugucuuaaagcccaaacccacagugacacacacagugacacccacagugacgucacaccuccuaaucgugcuacuuccugagcugagcauauagaaaccauuacaucaagcaaacgcugcuucuucaggacagugucucucucuaaagguaaauguuggucagcuguuggucagcgagcaagacaucuguaccagggaacuacgcauucagugacuaaugugcaaaaguccggguuauuaaagauacagauguuuauuacguuagcuugcccuccagugcucuccagugcccucuagugaccuccugcgcucucuagcccacacagcagaaacaaaccuuuccugucucugcugcucauuuuuagcuaucuagcauuuguuauauuacucauaugaagggccacugaauauuuccuccacacucucuucauaugacagacaugucccuucauaugacaggcaugucccuucauaugacagacaugucucuuaccgagacaguaguuuggcaggagaaaacacauccacacugcuucugugucaguagaugcagaaacauugcacugcuccaucuggagccugguguuggagcccuaggcuugaccgaucaagggcagacagcucaguuucccaucuuuugcccccauagugcaucuauaagcugaaguucauaaacccaucccauccuggccugugguaaagagggacuuguauuguuaggugacugucaccagucccugacuucuuacuguucuauugcccuuccagcacuauuguaaucaucauuaccaacaucgacaccaucaucucuucuuacccaugcccccagcucugugugugugugugcgcucauguguguuggcaaagcagcuugauuuaaaauucuucacaccguagaagcagguaaauccuggaguauaauuuuuccagucguguuacuaaauaaccucagacuuugucucaaauaugguuccucuugaauauugaaagcaucuaauggggaaaauaaagccucagagauaccgaagcacacagauuaaccuaaaagaaugcgccgcgacacauuuaugcucugucguaaagcgccauaaugaauaauuaaaaccgaaccagggcaucaaaguaaaugaugacucuggauugugguccuguacucugcauugcuugcaugguuuccugcuuguugauuugcauagaauaguaaucaacaaagaaucccuccaguuauuaaaugcaaauuaaaaguuaguauuuaaaagaauaucuugugcuuguuuuuggaagccgaccaauuauuauuuuuugugugugugugcuaagaaaguaaguguuugaagguacacagcuaagaacuccauggguugaaaaguaaaauuuagcucuucugucaugucccugguacuucaggagcuguggguuccugugcagacacggccgaauccaagaaccaccccacacaaaugcaauccccaaaaugucacugggauggcaauaggaaaucucagucauaaagauagggcguccccaaaggggggucaaccccagguuccugaggaccuuguacuuugccaggaagcacaggaaagucgugaagaagacacggaaaauaugaaggcagagagucugugugcagaggccauuaaggccuuugagaagucuuaggaugguuaagcccaaggcgccaaagggccccaaaugcaaauucagccaucuggcuuucauuguucaccccaagcaugggaggcagaucagaggccacgugaccaaccgccaugggcucugccagccaaaguccaauauucaagcugaggcagaggccagagcucuaccucagcucccaagggugcccaggccccugcgaaggccccauagaaaaggcuucugucugccacuguaaagccagacugcugugacacaccucccuccacaguauuugcacguggucagugcccugugcugucuuuacaaacaagcuugaguuaaaauucuaucagaaagaaaaauuaaauuuuccauuaauuuuucacgugggugcaaaccuuccuuugugcugagccuuugagagaaugaguauuugaaacagaaccuguguguuuauugcuaaauaagaguaguaacagaaauguacacucaagaagauccauauuuuauuucaaauagaacacuagcgugacuauuucuaugucuauaucugaacacgugauuuguaaauuagcuugccaggaggcucucugcaccaaugcagaagauucaugaucacaucuuuucucccuggaucuuuuuuacaguguuucaaaacagccuuaacccagugccuucaaucuccugugguauugguuugcauauguaugcacaugugugugaaugggugugcuugaacauguguuugaguguguguguguugauacaguccagagaaaucgacauugggugucuuacuuucuuacuuuuuaaaguuguuuguuuuuaagacagggucucuuacaggcccggaguuuaucaguuuggauagacuaccuggcugauugaguacacgacacaugauccaaaguuuccaacugcucccucccuccacacuggccuggcguuucccaugggccaggggaugaugagcaaccucuauaaaacauuggaagcucuauugaaaagcgugagcucuggagacaagggagagaggaagucauccuaacgguugcaccuaguaugucuugggaccucuacauguuacgucauggagucaggacaucaguauuaggaagcgcuuuccagguuuuauacagauaacucguugacuccuuucccccauggcacccuugcucagugaaucuuagaugcuagaaucccuacuacaguuuuugcucagacgcccauucuuuuuguauauacacacauacaggaucaucacagauagagaugcacauuuugguugcugucgauugcauugcagucgccgaagagucacacuaagcuugagcuuucacagaccauugguucuuuuuuauagugauaaauuggggagggacuaaggagaccagggcuuccucuuccugcuacucugucucuugccugauaccagguuuugcuuagaccaagaacaauacuuggaauugugauuagagcaucauuuguaggacaguuccaggguaaaaagccuaucuaagucuauguccugauacuauagcaagaguacccgaggguggguaauuaguaaagaaaggagccuugcuuaacuggcaguccuggaaggcuggccgugccaucuaguugguuccuagagaugacuguugugcuccauccacaacugaggggcaaguagauggacacaaaaagaucacgugacaggaucacgugacaagagaagaaaggguaggcagugaugacacagucuguuagcaaucgccaugcuaugagguagccagccuguugcaggaaauauuaaaaugaacggcaaguucccgaccuauacuggguacugguaggucacaugacuccagcgggguauucucagcucggcagucccucuggcuaggugcuuuuggucuuagccauguauguuauggcuauaacacgcaugucuuaggaugcuuagggaacauugcagaagaaagugucuaaagauucuaagagcuagagggucagggaauuugcuaugagacucugucucccaaucacaugagaaucuacauccauauaaucucaacaggacuguacaaacaugaacugaaugaggacacaacaguagacacauuaaaguggacaaaggaaaacccguaaggccucaacccuuacaaagaacuaccggcaacuaaggaguauugagagccagagucauuccccaaguaacagccaugaaaacacacauacaaguagcauuauacagacugaauaggauguuauuuauguauuuaagaauuauauauaugaauauauauguauacauauacauaaacauauacauauacacguauacguauauauacacaugcauauauacacauauacauauacacauacacauacauauauacacauauacauauauacacauacacauacauauacacauacacauauacacacauacacauauacauauaguguguaacaacaauuaaugagaagugagcccaugaauuuaaaagauagaaaggagggggauaugagagaguuugaagggagggaaagaaagggauaaaucauguuauuauauuaaaaccucagaaaaaaaaacuaacgaauuuuauuuuuaauuuaauuucauaucuucuaugccugcuaguguagcuuugcaaaacaaggauuugcacugauuuagauccuaccuccugcugucucagggucgcaggaagcauggcacaccuguauaaaguauuuaaagccucccuucugaccaaaugcgccacauguugugugaagccauccuuucggucagucagcgacaaauacagguuuggaaguuugcuuucucuuucccuuugucuguuuaauauaaccaagcgcuaugaccacgcccccuuagccaguagaaacugcagaugucugcuggucuccuccuuccuuuuguggaacagacuagcccucuaaugggugguuuuuguuuucaagucgaaggacuguauuucagcuugaaaagcuuccucugauaugagaaaguuauuucacuccuauaaucaagaauuccuuucauccuacauuuaaaaauauucuagaagauuugugcagcugaguuaaauauccuggcccauuuucauccuugucccugcugggagacaugcaggauuagggacucgugagggguaccacucuugcuuucaagggagccccauuucccagcuaaggucaagaauauuucaucuuagauuuaguauggagacuauaacuuaccuacccaaucuucauucuccucuacucaaagcaacuugagguuuggccagcuggcccagugccuggauaaacacuuguauuuccuggcuucccuuggguagucaaugagauuaagcugcaguccuugguugggaggcaggccggcuaugcaaagugagcugacucagcggucaggcaggcuuccuggcccuucccccucuccucucaguuuggcuggaaauaaaguggugcuucacagccaagcaacuauacccugagccuucaggauggaagccacguagggagauugugucugagaugcccgaugccuuugggcuugcuauugccacaugugauuuugucuucauuucaucaaggacagagaagcauaaguaacacauacacacgugugcaugugcaugugugugugugcauguacgugugcaugugcaugugugugugcaugugugugcaugugcgugugcgugugcgugugcgugugcaugugugugcgcgugugcgugugugugugcaugugugugcgugugcaugugugugugcaugugugugcaugugugugugcaugugugugugcaugugcgugugcguguauauauacacauacacacacaguucuagagguugggaaggcaacaaccaagaggccaucacguuugguuccguacgaugauuuucuuugaauccucacaugacagaagcagcccaugagccuuuggaggcucguuuagaaaggcauuaaccguguauauaaggccaccccaccauggccccauccccuucugaaaaccucaccgcuuaguaauauuuugaaauuugggaggacaugaacauuuaguagacaacaaugcuuacaucuaugcugccuuuaucuuuaugccuuauuaccuugugggacugucccuugcaugcuaacucauagugugcugucucccccaacuaccaggaggaucuuugguauugaaacuuugcauaaacuuuucugcccagccgccaaaucccucucaguacagccugucauccuuccaggcauccgggcagcacauaggccuauggggaguaauuucaaggggguguagaauuguugcuaauggacacacuacacugggcacaagcugggcuaggcaaggguaucauaaaaagagaaauaacaauaguguguuguaaguugauaaugaauauucaagcaagguaaagcuauuuaucagguuuuaaaaaacacugccuuucucuguccaguguguguguauauguguuugguuuuugagcaugugugugagugaauguguguguguguguauacaugaaccucgagaggguuguuucagcuuuacuugacaucguuuucccaucguaaaaggguugucugugauauucugagaguaacaucuggaauuuggaaguaguccagggaagagaaaaguagguaucaauaguucugaagcgcgggccuuccacaaaagguuaaugccguuagauagauuuagccaggaauaggagugacuuaauaacuguuaaagagccauaggaagaacaccuaucagcaucccguuucccacaccgugcacauagaggacuuguuuaagcuggaagacuagagggccauggaugcuguuucuugaaaaugaaucuuguuaaaggagaacggucccuagccucucccuguucucgggggaguguuggaaauucccaugucuuaagcuuuuagugcgcuguacauaacagucccugaacucacagcagacuguuccugcaucccgguccuugccucuaacaggagcgaaaggucuacagacauuccccugcacaggagucuuggaggcuugagaguguuuggauaaggaccgcagugagccagcucauaaauauucccuuucaccuuaacugcugaauggcuguuuguuggagguguuuucacggcacacgggcuagguaguguucuccuccugcuacugauuauuguuugcuuagcaagaauuuggcuuuugcaguaaaauggauccuauuauuuuguggcagguaauuacuauuccuuuguuucacagagcuaaaccgugugugcauucauucucacaaaguggcauaucaaagguauuuggaaagcaaggucaggaaaaaauauuuucaccugcaaaaaaggaaccaccuguccgaaugcuggaugccuggaguguagauuaagguuuuccuguuuagccguguaucuuaguuagggguuuuauugcugugcacagacacuacgaccaaggcaacucuuacaaggacaacauuuaauuggggcugacuuacagguucagagguucaggccauuaucaucaaggcaggaacauggcagcauccaggcaggcauggugcaggagaagcugagaguucuacaucuucaucugaaggccgcuaggagaagacug

SEQ ID NO: 5756 - RNA, 29382 nt, Mus musculus
ccgcccgccuccuggauguucccggaagcugaccggcuuacccgggucgaguugauugguugcaguuuuggacaccgcgcgccagguuuuguagaguuguuuugagccaaguucgccgaagagauaauggcuaggcaggaucgucugcgcgagcuccugggcccucugcacccguacaagagcgacgacgaggaggaggauugugcgcaggaggaggagggggagcaggaggaggaguuuguggaugccgaggaacucugcagcgggggcaucaaggcgggcagccucccugggcgcgcgcgaggugagccagcgccagccgggccggguuggcaggggucaaagaaguauuuucgauucucacugcccggcacccagcguccuugacuguugacagacagaccuguggugugacuggcugcuucaccguacuuagaugugguaguaauagucguaaugacucagagcacauacuguguuaagcuugguuuuuucauauaucgucucgcuuaaaguuaacaguuggggguaguuuuacagucgaggaaauagaugcacccucauucccacccagaaacagaauccuuuaauuauuguaccacgcuggcugaauaagagacggaguugcuguuaagcaacuuugagaaaaagagcaagcgcgcggaaacacacggccacacacacacacacacacacacucacauacacacagauuuacacauauacauacacacauacauaaacacacucauacacauuuacacacauacacuuacacauacauauacaugcccacacauucacacauacauguucauacacacacacacacacacacacauuguauuuucauggucuaguacaguaauagcugcugaccaggaccauguguggcaacugaccauuggcaauuuaaacacaacuuuggcuguguuugaaauuaaauagaaaggauuacauguugauggaaguguaacuggcuauccuggccaagcauuugcuacugggacaggccagggagagaaaauggcgaaguugcugucucaguggaaauacuacuugugaauuaagcagccauuuugguuuuuuuuuuuuuuugagauuuauuuauuuuguguacaugagugcucuaucugcaucuauaccugcauaccagaagagggcaucagaucccauuauagaugauugcgaaccaccaugugguugcugggaauugaauucaggaccucuggcagagcagccagugcucuuggcugagccaucaugucuauagcaccuaggcagacauucuuuaaucagagaaguaaccccaacuuaguacuuaguaccagacagcacuuggagaagugacauucaugagaugcagacacggcuuugcuaaagaaguccgcugagcugagcucugugguaacuguaggaacuggccaggagcagcauguaccucugaguaacuucaugcagagggaggcaccauggaaaauucuuuaagaccuacauaaaggcugauacuggcuaaggcggcgguaauagggagacuggauuuagaagaaucagauucauggcuugaauugugccuacuucagcaacacccagauggagcagcauucuguuguagacagagucagucagagugagguguuccagguagcggguagaugucuguaugggugcugccuguguguaugugugaggggaucagagugagguaaaugucgagggaaaucauaacaaauuuccuguuaucuccccuucucauuuagugucuaucccugaugaguauacuaaagagaaauguaccguguacggacguuucccacucaaagguccgugguggcgcgugaagguccagguccugaaaccccagcgauccaggagcuaucaaguucaaggcuuuccggcauacuuucuacagguugauaugucgccaccagaucaaaaacaaaucuguucgcuuuuucuuaaagaaugcaacuuagccucugagcgcauacaggaauuuuuaaaauggguagaaaaagugucaagcuuugaaaaucuacacuuugaaaaucuuugggaaacauuaaggcuuuucuacagagaaaccgaaaagaaagauaaaaagcugucuacaccaagggagcagcagggugaggagaugagaguggaaaaaucauguaaguacuauuucuauuggugaguuuuggugucagccagacauucagggacuggagugcuucaacuguuaauuuugcuguaccuuccacggauaaauugagcaucucuaaucagaaacucugaaaugcucuaugagguaaaacuuuuugaccauggacaugguagaccaggcuggccucgaacucagaaauccgucugccucugccucagaaguguugggauugaaggcgugcaccacccugccuggcuaaaacuguuauuuuuuuaacaguuuaaaguaaguuaguagcuuuuauacuacaggugacauuuucugauccaugggcaugaacucugucucauucacaaaauuauuauuuucuuuuuuugguuuuucgagacaggguuucucuguauagcccuggcuguccuggaacuuacucuguagaccaggcuggccucgaacucagaaauccaccugccucugccucccgagugcugggauuaaaggugugcgccaccacgccuggcucacaaauuauuaaaaucuuuuuacaguguuauuuucagccucuguguuuaaggugccuaugaaaaguaaauggguuguauauuuaggcuugggucucauccccacaccuucuucuuauauuauuauuaucuuagauuauggagaaaaaaaaggcccaacuauuucuuauaagcauuuaagagcgaggacacaaauuuucucauagccugcaggccacauguggucagggauagcuaugaacaugguucaagggaaaauaaccuuauuuaagauaggauauuuagccgggcaguggugacgcacaccuuuaaucccagcucuugcaagacagaggcaggguaaucucugaguucuagggcagccuggucuacagagugaguuccaggacagccagggcuauacagagaaacucuguuucgaaaaccagaagaaaaaaaaagacgucagauauauugauuuuuauuucuuugugacuuaguuguuugguuuuaagacauaaaccuuuucugugacaacauaaaaguuugggcacgccugggguccucuuggaagucgguuugaugaaaacguuguguugccuuuggugucccucccccgugacguggauucuguauggccaucuucaagauccagggcuuccaccuugaaacugcgauucucuuucuugacuuuuggguuuguggagagaacucugagucacuaaaacagaacccagugcccguuuuuaagaagacaaaagagaaaggaaagcuuuggaauuuuagaaauaucccaauuccaaaugauuuaaaauagcugcacgccguggauuucacugugaacauccacagacugagagaauuuccuucaugaaagcagaggacgcuugcaccacaccaaaugacuuccaggucaaaagggccguaguuccaauugggaaaauaauuguaaagguuaauguauaagugguuggcuuuguacuugguuuuaaguuuacccuuaugggaugcauucaagguuuauuuuuauaauuauguugcaaacaaaagacuaaagcauuaaguguauaacaagcauuaaguguauagaaaguuugcuguucauaacaaaggaagcagugaccuugcuagaaauuguuuuauuaacuuucuuagugcuucagguaaguugaauaauccugauuuaggggucuugagcggauugugcuaagagagaacacucccgcgguccgucugucugggcucacuugugugugcuuugauuugcucuuuccugaucucuugcagucgcauuuauaagugcaaugguagcucugcaauuccccaaagucauggaauuccuuccaucgcuuuucccucgacacuucaaaaggcucaucagcucgaguucugauugggugcugggaugcauagaagauguucuggguacacagccguggaagcugggcuucaggagggugagugagacccugggucugcgcauuuugucaucuuguauauaaggcagaguucuucaaaucuggcaauauuugaauuuccuuccauggagaauauauauggauguacugcguguuacagauagacagaaaugucuuaggucuguaauuuuuuuuuccccuaagauuuauuuaguauuauauguaaguucacuguagcugucuucagacacaccagaagaggaugucagcucucacuacaggugguugugagcaaccaugugguugcugggauuugaacucagcagucagugcucuugcccguugaaccaucucuccagcucccuuaggucuguaauucugacacgaggauagagucaaugaauaauaaagucagccggucuugguggcacacgcauuuaaucccagcacucgggaggcagaggcaggcggauuucugaguucgaggcuagccuggucuacaaagugaguuccaggacagacagggcuacacagagaaacccugucuugaaaagccaaaaaaaaaaaaaaaaaaaaaaaagaauaaugaagucaguugaaucaucaacagagaacaaaauagcgagguacauaccguucagauuauugcuguuaauuuggucauucagugucacgugguaguacaugcuuuucagccacucagcugucauuugccagucuuguugaggacagcaguucucaggacuccacugaguucguucuguucugcagcacgcucucccccuucccagucucaaccgcugcagacguguucucaggauacaucacgcugucguucacuccuuaauuggcccaguaaccccauuuacauguaaguccaaauuugucguuauuguuagagaucaagagucgagagcggcccuuguggaccaggacggugcuaggagucgaugucuuucuuaaaucuugguagcuaucaagugguuuuccaaauuaaaauguuguugauuaaguuugaucagcuuuuaguaugagaauuaagggguuucugccucccauccuagcaaggaaauagagguacccuuuguugaccuucuccagaggggcucuagacuuagggagcuaagccaggaaggauuccuggaaacgugauggaucauucaucaggggacaggucucuccuuaccuucgugcuaguaucaagaagcuuuguguucggucucuuuacugcaggaguugcucucccuggggaacuuaagcgagcuuacuccuucaucgaaggacaucagucuuaggagcuuccggcccacucagugcugugcccuucuugaacaugcaucaccucugaauuagucaggguucucuagagucacagaacuuaugaguagucucuauagaguaaggggauuuguugaugacuuacagucuauaguccaacuccccaacaauggucugcagcagcugugaaugggaguccaaggaucuggcaguugcucaguccuacaagacaagcaggcaaagaagagagagcgaaucuuccuucuuccaauguccucguggaggucuccaguagaagguguggcccagauuaaaggugugugccaccaccccuggaucugggacuugcuuuggcccagaugaccuugaacucagagaucucccugucuucugggauucauggccacuaugccucaagaucuccauaccaagauccaggucagaaauuuguaucucccagccuccagauuaggaucacaggugagccuuccaauucuggauuguaguucauuccagauauagucaaguugacaaccaggaauagccacuacaaccucuuugaaaggcacugucuccaaauggagugcaauucugagacaguagggacuuuaguguuugacuuuugagagaacacuagguagucuauaaaaggaacagaguuccccaggaagggcauccccaugaagauaauggaggugaaggauaauguggugagaugccuccuuuguaguguuugggaagaauuaucgauaaacacauggcaaaccaagcaagccaagagaauaagacaguuguucacuucccaauaugugcuaaggccccugcaaauucaaugucagugaaggaugccucuccacugggaaucuuacauauuacauguuaaacugauuucacuggacugauuaauuaagagugugugugugugugugugugugugugugugugugugugugugugcuaaagcucuuucccuaggcaaguaguaauuguuaucuuacaugguucuuaaagaguugaggaaagggauggguguuccaacgugggagucaguucuggaggaagaaaccauucgugauguugccuguaggagaccuggcaaagaauaaaucaggagaugccugcaugugugcugcguagcguuguuugacauugaaaacugauuuguaauuuauagaacugcccgauuacaaggcaguuaaaaaaaaauugcuaugacaaaaucaaaccaaaagaacccaaaaucaucaacgauguguuagcuagacaaccuuuucaccccaaauuuuguggaaauauaugucuuuuuacuuuugaaagauuuuauuuauuuuauguauaugagcacacuauagcuguuuucagacacaccagaagagggcaucggaucccauuacagaugguugugaccccccaggugguugcugggauuugaacucaggaccucugaagagcaguuggugcucuuaacuguugagccaucucgccaguggaaauauauaucuuuuagagcuugaaaauguuuaagauagcacaguuucaacuauagcuauaaaacccaucaauaugcguauccuuuguaugaggcauccugaacucucuuuuccuacagauaaccuacagagaaaugaaacuagugcgcugugaggccagcuggacagcguucagucagugccccucgcugcuccagcugaugacgccccugcagaagaaugcauuggucauauauucuaagcugaggcagacaugcagagaagacggacacacguacauugaaguaaaagacuugaccucgggcuugucggagcauaugucauucgaggaagcgugucagucucuggcguuucugaaggacauugacguggucauuuaugagaaggacuaugucuuucuuucugaacuguacgaggccgagcaagacaucgccuccuccaucugcgagcugaugagcagaccuccguggcacuuaaaaguggacgugaagaacguccuggcgucaauuagaggcgcaaagcccaacgauccaggaagugcugaggcaguggaagggagcaagccggaggagguggggucagagcagggugacaguguuuuagacgcccaagauggcgaugaccauguuagaagcaauggcgaacacgucgcaaaugcagaaauaaacgacgucccacuggaucaagaucagguggucgcccuggagacgaucugcgccaacgcggugacuguccucagugggaaaggcggcugugggaagaccaccauuguuagccgucuuuuuaagcacauggaacaucuggaagaaacggaagugcagcaagccugcgaggauuuugaacaagaccaggaagccucagaagaguggcuugacuguccuaagcagagcccagccgguguggacaaggcuguagaagucuugcucaccgcaccuacagggaaggcugcuggcuuauugaggcagaggaccgaucuuccggcuuacacgcugugccagguaagacaccucugacaguuuugccugcagagaaaacauuuuccuaaagacaucuuuugcuccuuguccagaaguaaucagcuugugcaguuuuucuuuuuauuuucacaggggagauaaaacucggggucguuuucauaccagacaaguacuuuaugacugacuuauaguuccagacucgaucgagaguuuguauguccuccccagggguuuuacacuguaguguccaucucugccucauucucugcccccucccauacacgccccccuaucaugucauaccuucccaggagcguuugcugccuggcuccucugggcuuuuacagcugcgcauaggaucccccuccacugcucugacugcuguucccagucccaacacugggauucauagcaccuaguuucagcugugauauaguccaguaucuuaccucagcuccugaucgauggagcgcaggacccaggcauuuaaacaccauguuggauccauccggcaaggccagucccucuacgcugccugcggcugcugccucccaagccucaguccuccugcccugguugcuggcauuccuaguugcucugcagcuucauuuggaucggaucggguaugguagaggaggaaauccugcuacggaggagaugccugguguccucaagccguggaaggcacuugaguuacccuuucuggcugcucugcccaugcuguuugcacucagagagaaaucaguuugucaaguuuaacggcccaguauccugagcccugugauaaagucuuaucugauaucaucuaguccugguggggacgggacuuaccuuccugcgaggugcccuugcugcauaagcuacuugcccauuuggcacuugauggccguuucuaucgucagaucucccuacucaucuaaggguucaccgcccuuucgggaguugaucucccacggcuaacggggcuuacuguucuuguuaaaagccuguguccuuauucuguaguagcucgucauuuagaucaguccugcucaggacagucugucuguaagcuuccccguuugcagcgagggagcggacacgggcuccacagcuugccucauugggacauuccugucaugagcaacugccaagggaaucaaaguaugugcuugauggugucauuuagcccccugcucgauacguuaucuugucuuguaaggaccaguuacaaagaaugucccuguugucuggcgcaccggagguggaagaagacauuucucugugguagaauacaaagguccacagacaggguuuaggguuuguucucugccgaucuucuucaucucuugcaucuggccaacagucacguaccgaaaguuugaaauguuucaauauggccgcgagaaugaggacuuggcaggugauagugguguaaggacuugaggggcagaauccugagccauccuguucugugaguucugaagaacuccccagcgcucgaggaggcuccagugaggaggcgggcauuucaguuaggagaaagcucuccagagaggcacuggggagagcgaucguucgcacagugcaacuuacugaucaggaagaagucuuuguguuguagaguauuggaaagaaacauagggcagcgaguuuuagcuuuaacaguaguauuuucucuuuaucccauugagucauccaaucuaaaaauaaucgugaacacuguuguuagcuggauugcuuuucuuagugccugugguuuuacagggugguggucagaaguuugggauacuugaaggacaacuuaguaaagaaagagaggauuggaaaagcucagaaagccaagagauuuauucagaccggaaagaaauagaucauuuuucugguuugcagcagugggagaagucuucagguuuuuuuuuuuuuuuuuuuuuuuugcagggggagcuuuaauugaagcuuauuauuaaguuaaacucaggacucacugggaaacacuuuuuuuuuuaacuguuugaagcuuucacaguuugaaaaauuuaaaauucaucucugcgugcgugcgugugugugugugugugugugugugugugugugugugugcauucuuuccuguaauuggaaaguuuuguaccguguuugcuuuuucuuuccauuuuuuaugccuucccaccaucagguaagcuuuauuuuuaaaaccacgugcuuguuauuucuaaccugauuccuucuuuuauacucacgcuuuccuuacaggucaauuacagcuucuauauguggaaaacgaaaaaugagguggacaagccguggaaauucuccacgguucgaguucugguuguggacgaagggaguuuggugucuguagggaucuucaagucaguguuacaguugcugugcaaacacuccaagcuguccaagcucaucauccuuggugaguuagacggccgggagucggcacauucgguuaacagagcugcgggugcugcuguggaugucagucuggccuuugcuuugcuggcugugggaagcuuuucucacagcccguagcaaagcgacugaguuaaggcugccugcuguccuuaccauccugggugggucgucuggccaguguaucggcaagcagggaugaacgagacgggccaugcuaaguuacugcuccuugcuggaguaauggcuauugaaauaguaacagugucggaguccggauaaaucaggauguagaucauuuggaaauaauaaaaagucugaauuauagaccacuuuacaguaauuuuaugauucuaagcuaauaauucaaauuaggccucgccggccgcuuaaucuggugagauuuaguuagauucuguggaguuuuagugagccauugguucugugauuuaauuguaaugggauuguauauaaauaccauuuauuuuaggcuugugaggauauuugauuagcagccuauucuguuaauaucuuaagcacucacgcaguugucacccagcagauacauauuuuuuuuuucucuagaguuugcuuuuugggucucacgaagauuuuucaguagccuaaagugcugccauuggguggcuggaauuugucuguuuucccaucgauucagcuuaauuccuuuucuguuuaguaggcuuguuuuaugcaggugaggucauggcucccccacauucugugaaacaaggacacagagucaauacaugcagagugaccauagacaagguagcugaggucugauuuuuaaaccuguucugaaguauauguuccaaguggcuuuccugggucacaguuacaaaaggagauaaguuaaaaauuugucaccuuauuaugccuucacacacauuuuuuugcaucauaugcaacuuaauuggauuuagaaaauaucuaguguuuuuuuaauauaacauuuguauugagaauucauuuuuauugagaauuucauacaucguuugaucacauuccuccuccccccauuccuucuccuaaauucuccuaggacaguaaacauucuuauauaauuuaaaaauaaagauuucaggguuuuuuuccuaaguuacaaaagcucuacaauuacacuguaugucaaccaguagaauacacguaauguacgcauuuuagaauccugguucaguaaaaucuuuuauuuuuuaugcccccaucccuucaggugauguuagacaguugcccaguauugaaccugguaacaugcugcaggaugucuuugagacucuuaagucaagacagugugccaucgaacuaaagacgaaccacaggacagagucucagcugauuguggacaaugcuacaagguaucacacaucgauguucuuguauuuuuaucucuguuggauuagagaugaaguguauuaggaaaaaaggaugauuuaguucgaugcauuuucuauauauuuuagcaauacccacuaaauccuugguacuaacuucuguuuuaguuaggguuuuacugcuguguuuuacagacaccaugaccaaggcaacucuuauaaaggaaaacauuuaauuggggcuggcuuacaguucagagguucuguucguuaucaaggcagcauccaggcaggcaugaugcaggagauccugagaguucaaugucuucauuugaaggcugcuagcagaauacuccucucuaggcagauagggcugggguauuaaagcccacacccacaguggcacaccuccuccaacaaagccacaccuacuuccagcaaggccacacccacuccaacaaggccacaccuccuaauaguggcacuccuuggccugagcauauacaaaccaucacaaacccuuuccuauccuuuuagugugugccuauugccacaguuagaaaaccaagguuuuaucuuuaauuacuggccuagcauaaacuaucauuaaaauguaagaaugaauauauuucucgccuuuaagaauguguacaucugguucucuugguugucuguauccgugcacacaacuaaccggaaauuaaaauauuuccugugcauugagcguguacagauucuguccuuuguuaucucccaaaugacauccuguacugaccguuuacacggcuuuuacauugcauuaggugucauggguaaucuagagaugauuuaaaauaaacaagaaggucucuguagguuauaugaagcuacugugccauuuuauauaagggcucgagcauccacuccuugggagauccggaaaccacuccugcaggaagugcacugcagagaaugcacagggauggcugcacgggaauuaaagugcgucaagcuuagugucuggacucugcccaaggcaacagagacuuagaaaugagucuuauucucaaaggagaauuggaaaagacugauaaauucugugggaggaaagccuagagguggggguugggaacaaauguaggauuugacucugagacgaaucuugguggccccccaggcaucugcuccucaguggaaagagcuagcucucucccccaguguuugccuaagccuuugggcuuccucuguacucggcgugcuggagaaacagaaccauugcuguucugugacuuaagaagcuaugaugcucugcaggugugauggggccaugcauacugauagaugguugugcccacuggcucacauuuugccuuuuuugucucuuuugugaacucgguuauuugcuauuuauacacaugcucaguugaaugucaccagaaccuugaacauaucaaacuagacuuuagcaugucccugucguccugggauaagaugguggaaacgguagggaugggugguuguuguggacucuugucagaaccucaagaauauuggaguugggagaauaauauuguuuuccugaaguuacuaccucaguuuuucuuucuuucuuuuuuuuuuuaaagauuuguuuauuuuauuuauaugaguacacuguagcugucagacacaccagaagagggcgugagaucccguuacagaugguugugagcuaccaugugguugcuggggauugaacucaggaccucuggaagagcagucagugcucgauuugauagguccuuuuuaagaagaaacgaacacuuauucaaucagaauuggacuuuaucuaaaacucagguacuuuccuaagccaccuguucaguacccuuucauuuaagcaaugucuccggucauuaauuacaucacuguccuacaaugugacugauggaaggaucuuugugacacaccagaagauguguguugugugucuugggugacaagccacaugggaaauccauguugauugcuuccaaauuaaaccugagacauugccugcaagaacagccaauucccuccauguuggaagguggaagaugguugaaggugccacggaaggccacuccuacgugacaccucugugaaguuuguucuuagacucagucacgagaggcucuguuaucacgaggcacuugaagcgugcuguguuuucucauaugagugucuggaaaagacuugacagaaggaaagauggagaggcagagcaagcagauaugagugcacaugcuaaacauauguaaaggaugcauucccugcaggauaacuuauguagaaagagaguuggagcuacugggcccagauuugcauccuaggcccuugcguucugaauuuguggccuugggaacgcaguaaacuugaucacgucucauauugcucaccuguagugaagaggagaccaguuuccuugcugauuaguagacugguucucugcaugguccacagcacaguguacaaucuuuuuuuuuuuuuuuuuuguuauuucaauugacuuaugguggugguggugggcguaauugcuaaauaugauacugaagucucauaauauuucuagucuauuauaaaaugaauuugauggcauauguaccuucaaagccauuuuccucuaucauccacuaauagguaugaauuauucuaagagugucaggcuacaugaaugguaauuuuaucuaucuaucuaucuaucuaucuaucuaucuaucuaucuaucuaucuaucuauccauccauccauccauccauccauccacccacccacccauccacccacccacccacccacccacccaucuaucuaucuaucuaucuaucuaucuaucuaucuaucuaucuaucuaucucaugggccagcuagccuagccuacuuggcaaguuccaguugaguaagagacccugcucaaaauauaaggcggauggcuccaaugaaacaacugaaguugacuucuagucuccacaaccaccugcguggacauccacacgcacacgcacauacacaaacaccccaaccauuuacacaugucacccacacaugucacccccccacccacacauauguuuuucuuuucuuuaagaaucuccagacgucaguuuccaaaauuugaugcugaacuaaauaucugugguaauccuacauuaccucucuccauucaagauaagacauuuaucuuugugagacucccugaagaagacagcagaucucagucgucuaaaggugaacaccgaucuaguaaguguuuauguuggcuuggguugaaguauuucaguuuuguaauauuguuaucaaacgacuagcuguguauuguucgaggcuaaagguaggucuugcuagugaaaacuggaggacuggaaauaaaaccacuuaagaauucucaagggcagauuacucuagcgcagugguucucaaccuccuuaacacugcgacccuuuaacacaguuccucaugcuguggugacucccaacaauaaaauuauuuucauugcuacuuuauaacuguaacuuugcuacuguuaugaauugcaauguaaacguugauguuuuccauggucugaggagaacaugaaauggcuguuugaucccccccaaagggauugugacccacagguugaguauugcuguucuagucguuucugaggaaguucuugacacagcguaaggacucucauuacauaguugaagagucgguaaguggccagaaaugauuuuguuuacagagcccuggcaaucccagucucuucaggagaaaguuaaguuuuauuuaaugaaaauuuccuguuauuuucuuugaguacauuguaaacaccacaugugauuuuggguauuagagugucagcuugucagggucgggaaggaguauaggauaggucguuuaagcacgugacucaaagucacuucaccacgugugaaauaagaguaaggauuuuggugucuguggagcuagagggcauccaugucacgagccacuauaucaguacuaauaaauaucauuacauugauuaugaaaaacaauuauauuugaauauaguugucuuaauuagaguuuuacugcugugaacagacaccaugaccaaggcaacucuuauaaagacaacacuuaauuagggcuggcuuacaaguucagagguucagccaggugggagcauggcagcauccaggcaggcauggugcaggcagagcucagaguucuacaucuucaucugaaggcugcuaguggaagacagacuuccaggcagcuaggaugaggggcuuaagcccaugcccacagugacacaucuacuccaacaaggccacaccuacuccaacagggccacauccucuaauagugccacucccuaggcugagcauauacaaaccaucccagcugucuugguuggcacagccuagaggcucuaagaagggaauuuuccauugagggauugcccagaucaauuggccggcgggcauguuugucuugaucacucacugacgugagagggcccagcccucugcagccacuguggguggcaaaucccucuguagguguucuugggcuguauaagaauacuagcuaagcaagugucaacugugccagcaggcaggauugcuucauggugccagcuucaagacccuuguuggauauuuccuucagugauggagcaguuacaucauaccuucuuccccuacguagcuucugguguuuuauuacagcaauggaaccagaagcagaacaaugguggggcucucuuggucuugauuuacauuuaaaacgcuggcuuagcaagcuuuaagacuagcuuaaggguuuaguaaugauuagccaugauuuaaaugauucuucugaggaucuauugucacaguuccucaccgugcauggggaaccaugcuggcgcuggugugaagcuucccuaccgcccaagucugucucccacugugcgcccgucugaucgcaccagucauuuccguuuuauauaaaucggguaugaagaugcauaucaugugagcugguuguaguuacacaccauagcuaaugucuauucuuagacagcuuaguuaacacaggugcuaacagaugagaagagcagauaccggcucuucauagcuugcuuccucugggacucugaagaguguaucgcaagcacuguuuaccuuggggcccgcucugucuauuaaagagaacccgcuuucuguuugagugagccagggucuuuucaagcugacuuugaaccccuaauucuucugucuccaccucccuaguugaugggauagccugugcuaucaugaccagcucaguaaaguguacuuucagaagcuaaagagguugucucuuucagaguguuagugacgcugaaucuguuuuaagauuuuuuuuuuuucugaaaaaucaguuucuuucuuaagaaaauuggguaaauaguccuuagagaggcaaauagcacuguuucauuaauaaguuaucgaggagguuguacccauuguuacaaagugcagagagaccuuuggaaguuucugcucugguugacuggcuucagagcucugaagucagcuauuuucuggagaguaucuuuauugaagaaaugaagugcccugugaggagcugacuuugucuuucuagaacagagcacuacagugcuccaugauucaccggcuacucgaugaucaacaaaauccugcaguauuccuaucccccuccccccuguuuuugcuugagacgggaccucauguugucuuggcugccauugaaucugcuauauagcugaggcuggccuugaacucccuuucccccagccucucucauacagaccaggcuagacccuaucuauaaaacaacaacuaugaaaaacaaccaccccugggguagugagcugggcauaaugaacggcacaugacuguaaugauagugucguguuagcgacugaacugugggaggucggggcacgggaggaaagagaaagcugaggugagggaggcaguguggguguuaggccagugggcacuuuugagcccauguggcacuaucucaguuauugcaagcuggugugcaccagugccucagggucugaaaccugucuccccggucuuaccagugucaaggaugacauaggcguugccauggugaccuugcguugcccgaggugagguguuuuaccugcaccgcuuaguaggaauugcuagguaauuuucucacagaaauugcauuacaauuuggcacuuugucuguguuaaccuuuuucucuuugccagauuuauauacugcaguuaaaacuuugcuucaaggaaaggacuucugcucuuuugaaaguucaaaaacaucgcaauuuauugcauuuagaagguaaaacguuuauaacguguuaauguacuuuauccaacuuuuuuuuuuuuuuuuuuugguuuuucgagacagaguuucucuguauagcccuggcuguccuggaacucacucuguagaccaggcuggucucgaacucagaaaucugccugccucugccucccaagugcugggauuaaaggcaugcgccaucacagcccagccuuuauccaacuuuuaaacuucauaaguuacuaaugugcauuguauuuagggggagauacauguaauucuuauuaucccuucucguucuuagagguaucuuuucauuagacacaucagaaggcauucugagcagggccguuugcgaucaagcaugcuuauauucucacuggaaguucgagaagaauaaaauugcaucugaagcuuaaagauuaaaaugcuuuuuucuucagcuggguguggcgcacaccuuuaauccuagcccuugggaggcagaggcaggcggauuucugaguucgaggccagccuggucuacaaagugaguuccaggacagccagggcuacacagaaaaaccccguguugauuaaaaaaaaaggaauaaacaccaacagaagauacuuuuucccagagaucauucuagaaacuucuuaugggaucuacuauaucagcaggggugugagugcuagcaugcuugcuagagcccucaguucaauucccaguaucacaacauuaaguaagaaaaacaaauccuguggcccaguguaugauugucugaacauaagccaguguguaacgugcgcugcugaagugacucugauuuuucccguguuucaggcaagacugugaccucaucaaugacugcugcugcaagcacuacacaggccaccucaucaagugagcaucuucccgacugacaccguaggggacggucguaccucaauuugcuguucuuucauuuauguggauauuugucacauagggccaugcauucaaaagucauacacuuucucccaguuugggaagugcguuaaucucuucgauuaaguggaucauauuccguuaggaauugaccuggcgcguaaguagagcaggaugaaaaguaagggaugguuauuuuuccgugguguccagguuggcaaccuccagccucuucaagaucaaugugggaauaaggagaauuucugccacucugugugugguguuuccuggaaccggaacagcaggccgugugcggagaccguuuuguaugccuuguauuugacagaaaugcucgucgcugggguuguguuaacuauaggagcuccugccucagaccacuguguugggcagccugacagaggacacaaaaagugcucgcaugcacgggcucaugucauaguggucccaguagcucugcucuugucagggaaucuuucuaauugugugaaugaagcugcagaaacagaagucucccaaaggguuaaggaagagcagaaugaaaaagaaacccagccgccauucaucgauuggcccaagccgccauucgucgauaccguuuucaugggacaguggcauaauuauuauaauggaaauacgagucaguacugaagacccgaaacuggagaauacggagagaggguggauuuguauggaaaaaugauaagguuuuugguuuagaaaguggauggaucagacuauccauuaucaacaucucuaacuugagcggguucagcggggcuuugucggaaggccuugaggugacaggguggaugcuguggcggugaauguuauuuggaggguuuguuauacucucucguugccuccaaauaucccaaauaaacgauacagagaccucugaauuauaauaagccauaaagcaccagagcugggcggauauaaaaagucucuguuaguuugucuacuuuuccugccaaaauccccaagauagggugugcuaugauuccucugggcucuuccugcugcaucgggcuuggcucucguggccaugaguuaaggauccaugcuaccccuuggcgaccuccuucuuucuggcuuuccucucgucccugccuuagaccccaagcuugggaaccuuagcuccaacccuuucuuuugcccaggccaucggcgucuuuauuaaccaaucaaggauaaccugggggcaagguuuacccagcaaaagcugauguacguggggaucuccucgucucuccuguugggugggguaaccaggucuugggagccaucugaauacauaaugacaccagcccaacccccuacacaauguaaucaagugacaguugugaccacuugauucuugaucuuuggagaaugaaaugauacaaagauguauaaacaagccgcuauucacaccagcuccaagaggggucgcuacuggguaaaaugaagcccagcuuccagguuugauggcguguucucacuuccuaaugcagagaccaugagaagaaacucaucuuugccgucggugauaagaucugcuguacccggaaugcauaccucucagauuuacuccccgacaaagaccaggaagccgaggggaaaggcuauggagacgccccugacgacgaugcuaaaaucaaacaggauuucgaaagcagcacccgccugugcaacggggaaauauuuuucauaacacgggugagucuuagggaguaacagguuugccaguuagagauuuuuuguuuguuuguuuguuuuccaaagcccuagaucucauuugggauuggcucaggggugcaccucuugaucaggaauguuuauauacccucauccaggaugaacguugguuuguagauuuuagccaugucuugucugguuuaaugucagaaugugacuggaucguugggaguagcucugcuggaaaguguugcuuucuagcauuuuuuuucuccucaaagacagagaaaggaaacuuuguugugagucggaagcuggaaugacaaaggagcaagcgaagcuguccuuaguuguagcaucaacguagagacuuuaguaacucucuuuccuggggucgcucucugcuguagacacccuugcaacugugaaagaugcggaaggggcugugagggaaagagggugugagguuucagggacuaaaaguuucuauuucugcucauugaaaugcuuaaacaugaagucauucaacaaaguauggauuuuaagcuucuccagguuuuaauuguuccauucuggggaugcgacccggagccucacaaguaccguucacaugcucugcaacuacagagcuucaagccccuggcgauucucaauuugauggauaauguuuguacuuaauacugcaccggagacaguguccuuaccacgugcauguuggaauagaugcaaaguuuucuuugucuugaucccaggauguaacugacguaacuuucaaaagaaaaagacuucugaccauuaauaacgaggccgguuuggaagugacuguggacuuuagcaaacuaauggcaaacugucagaucaagcaugccugggcaaggaccauucauacuuuucagguaaguugaagaggccgucguuugggcuuacgguuggaggguacaggcccucguggcggggaagaccuagaggcgggaguggccaguuugucacacugcauuccuaguuaggaagcagagagaagugaaugauggguaaucagcucucuuucuccuuuucauucagucucgggucccagcccguugaaugaaugcccccauauuuacagugggugcccccaucagugaacccccaucuagaaacucccuuccagccguguccagagcuguucccuaggugacucgugggcccaucagguuggcagaguuaccuacaacccuuuccacaacaggaaguacauggcgcugcuuuuaaugucuuuugcuguuauaaauuguaauucuucaguucuggcccagucucucgcucauccuucugcuuucuuucugagagccgccuuccagccuguggccuagcgcccgaccgugggccucugggcuucacacuugaagccuuugcuuccacacaaacgcucaggagcugcuccucgggcgcuagugagugccccuaucauucugagaaacuaagacaaccuuccacuucccugucucccagcuugacuccagcagggccugacgugaacugcacggauguccuugaacuuugacauuuuaucuaugguaugguuuugugugcauaacuuuugguuuuuaagaauauuucaauagaauauuauuugacugcugaagcucuugaacaugccuacccagcuuaaacuuugcucagaagggacuuuguccuguguuugauauauuccuauagauuauauauguguauauguauauauauauauguauuuuucuauauaguuucuugcuuucaagguuuaaacaaaggguguuaucuuacaucuuguuuauuuuuggcuuuauuaacuuugugaguggaccuugcuauucucuuguuauuuugacaaauguauucuuucccuccaauuuugugaacagcucccuuauaauuugccuaaucuuguuugagaacaacagguuuaaagaggaaauggaaauagcucagggugucccaguguguccagccaaugucugugugcauguguacaugugugugugugucuaucuguuuaaugauacuuugaugugugcauacauguugugucuauauauauuucuauagucuccuauuaugggcuguuuccuuugccaucauugguaaccuuagugaaacgcauuuacacguaggucuguacaguuacuucaaaaucuuugaaaguuaggaaaaauguagcgcuccuuuuggcuccuagaguuuguuuuggucaccacaagcuaguugugauccuguggaaccuaauguugguaacaaacuuagcaaaugugaguucugagauaguagauaaaauggauucugggagauagguggauacagacacaccagucagguggaaggacauuagcacacccuuaacacuuuucucuuuuaguuuugucucuguguguguuuguauguguuugugugugugugucugcauacaggugugcuauuccuacugugcauguggggaggucagagcagccgugaguccuugguuuccauuuguuggacacaaggucuccgugauuucucuuuugcgucugccagccuggcuugugaggcuucccccaguaagccucgugcuggagucgcuccucuccgcugagcucccagguugagccuucucacuguuuuugccucucagggguccgaggagaacacagucgucuacgucguggggaaggcaggccgccagcacuggcaacauguuuacacggcagugacccggggccgcuccagaguguacaucaucgcgcaggagucugaacucaggagugccacccggaagcgcgguuuccccaggcagacgcguuugaaacacuucuugcagaagaagcucucuggcagcugcgcacccucaacagguuucgcaucccagccuucgagcccucgagucggaggaagaccugacacccagccuccagcgucacaccucuguagaaccccagacaacaaagccacugcagacagcgccagaggcgacgaaagauggcugucagcuucuguuaacgaugacguggauacggaugaggagucagcacagcucagaggguccaaaagaaucggugacggcuucccguuugaugaagaaagccccaguaaauuccguaugguaggagccauguucccucguauucaugcuuucuguagccuuugccaacugcagugugccuggacaggagcgugcguacuucugcuagcgaauaggacagcugaugucuugcaucuaacaaagugcccccccccccccaccccccccccgugcccacuuggaacuagcucuucuccugaggcugcggcugccugucuagacagcguccacugauugaugaaugcuacucugugcccgccuuccccugucuuccuugucagugaccccggcacugcaggccacaguccuuccguaucuccacaucucccuugcacugguugguuccagucuucucccaggcuucgggagccuuuccuuaggucucccucucggcucccgcuuggccucuaguuuaacuguugcuacggguuugguccucuuucucucgguucacgugaccuuaccuaauucgaugguuaugcaccgucacagaacuccgucucuccccccuucucucacacauccccuaauugagacaucuccccaagugacaguuucacccauccccuccaccccaguguuucaguggcugccuugauacaggugcuggggacucuggguaagugacucuacaccguucuugugcugacuacuugccaguaugggaguacuuugaggacucacuggagagcguucaggaaacaguuccuucauguaucuuugaucuuugcuccuagaaaccagccauucuggaagcacagccucccaucuuucucuugguucccugucucaauccccucucucccagucugacaguuuaaagucucaccgucacaucauccugaccccgucuucgcacucuaggguuguagcguuacugagaugugauuuucuuugcccacucagccuuggcuguccuggcuaggguccuugucuugcuggaggaucaacugucugcccucgaaugcguuccugccacgcuccucguauacucugaugccuugggugcucaacucagucccucuguguaaaggcucccugugccuuaaguacacacucggggcuucucagucugcaccuggcucucccagaacccugugaugucucacacuuaccguuuaacauccuucagucugcuguuucgguuuguuaguucacuaaaggaaucaacgucuuguuccugucucuuccccuugggcuucuauaguuuggagauguuuaacuguccacugagugacuagaggggagaaggcaaaagggagcaaucccaaacgauucucugcucucugccugaaacagggaaacagcagagcuaggcacugagaugaaaaagacacaggaagaccuuguuugaggaaauacaaucuuccucccuuccuccagcaggcaguaaugggcgcuacacuuagagaugagguuuauaaauuacuuccaaacgugguuucagggaaaggguugacugauugacuaauggaccugucgcagauucgcuaggugggguucaguagagaccaguuccgagcagcaugugcuacugccccgguuccaaagugugacacucauguccacuacccaaagaaggugugggaccugcagcagguucucuaagagaguucaacugugcggccacugucuaucccuuuuuguuuuuuguuuuggauuggaguggagauccggaggaacauuuuaagugcuugugaauugaaauucaaggaaguuaccuugaccucagugugacggauggcgauuagggagaaacgaacuaauaaguuccuagcauaaagagacccaggauacagcgauugggcuggaaguagggugcuuccaacagggaaggagaagagaugcugaaaggcugaagggcagagcuggcgggucgucccacagauggauuaggucagcugggguuggguugcaggugauggauccagguaucagucaucagaaucaguaagaaggguuuaaguggcgaguuuuauggggaauggaagaaucucuggugauaguaagcccuaauccuccaccccagugcaggugagaaugacauuuaauaugacauuuucaucuucccccgcccccuccccagaaaagugagcuugcaaaggcccuggggcuaggcuuuugacuggagccgucaagggacaagcguaaagaacgaaccuccaaaacaaguuucuugaguuauauuucuucucaccgacauuggggggguggggggggggcuaugacuuuacaugguggcacaaagagaaaaaggcaguguuccucagccccaggcccgagucugcuggagccuucccgcuuggaccaaaggccugcguugcagaucugugaacguaagcgugagauugggcacugcgaugugccugcugccucucauccucacgcggugacaucagcccagaguuuguucaugggaggggaugaugcucuuucucagaggcuuugccaaaaguauacaguaucuccaggaaucccugcaaacgaggaaacagaagucaggccuccaggacugguaaaacagacggacuuccauuaacucuaggugaacauaucauuuuugaaggaggaacccagggacgagagcuguccacgugucuguccuuccuucaaaaugcacacugcugccugcagcccacaccagcauuuaaauucuacacaugaaggcaugcauggcugagcucugagaaacgccucccugggcagcugacccauacuugggcaaaugucgccauuguguguucacaccaaccuagaugguuaugguggcuccauggugcuauagacccagcgccacugagcgcugugaggcugcggcaugugcucuuucguggugaagacaauguuuauaagugggucacacuccaaaucaguagcucucaaccucccuaguuccucagcccuucaguacacuuccccaugcugucguuguggcaccccccccaccguaaaauuauuuuuuguggcugcuucauaacugcuauuuugcuacuccuacuaacuauaacauaaauauggguuuucugauggucuuggguaacccugggaaaggauucuuugucccccuccccccagggggucccaacccacagguugagaacaauugcuuuaaaugccugcuaaaaaucauaauaaaugcaccaauuagaagcguagcuacagacucuaguuacgaacuuucugcacuagcggcuuuaaaucaccgacuuucccagaucuguggacccugcacucauuacugguccaaaugccacuguggucugcaugacaauaaugaccaacugagcauuccuugccucauugcuuuaccucaguggcucuggguuuugaaaaacagauccuacagggaaauguugaccuuacauacugccugcucugaaaacagaacucuuugaugcaaauaacugcguggacacugccaaguguaucagaugaaacaauuauucaacccccccccccaaauaauuuuacaaaauucacauuguaacaugaaaagcaagcuagauaagacagucacaagggcugagggaaggcuagccccugaguuaguuuaaguccucugggagacagaggcaucugcacggucugucuguccauccaucugcgugucugucagggaagacuucauuggaaggaguccacucaagcgguuguggagagcugcaggugugauguguguaggaucaaauguagaugccggugcagggugagacugaaagcaggcaaccuggaggccuuccucggaagggagggucuuauucccguucaggcuuucaaaugccuggaugagauacgcccaccacacagcagauaauucucauuuaagaguucaccagcuuaaauauuccagguaagucaugccuucauggggacacuuagcaugacgggugacuaaguccagguuccagaaguccaggcauguugguacaagugauugcuuuaaccaaagucugauucuaaaaugcacugauagagaacccuguggaagauguaugguguuuccuaucuuuuuuccugugacaacugaggaucguacuggcccagugucugcugcucaggugucaccagaggcaugaagaguaugguccuggcgcugccauaccucaugccuggcucugugcuuagcgacuugcauccaucuugaaauucuuagugcuugcacagcgagccuuccuugaauucugugucuugcucccaauuaucuaguaagcccgauugcuacuuuuagaggguuguauuuaggcaacgcacagugacuucuccaugucaggcccuuagcuagguccaggggaugccacaguaggcagaggcagacauaauccuccagagagcagacaggauuguugaggagcgcaucauuucuuccucaggcucggucauggggaacgcacgcgcaugugagugguugaucggggauguuuuuguaaaaguaacuucauuuuuauuuucaaacagguugaagcgccaucuccacagguguccucuguguuucagaauaugagguugaauacucucacucccagacagcuuuuuaaacccaccgacaaucaagacacagguacggcagguguggcggacgacgccaacgaucccagcaaucaggagauggaaaugugaggaucugcguucauggccagccugggcaacaucguaagacccugcucagcccauaccaccaccaccaccaccaccacugaaaaccucaaagcagaaaaaaaaaaguuuacuucauauuaaucaagaaauuauuauuuuuuuccucccaagacaagaugaacauuuuagcuucaaaguuucaaacuucaaacucugagaagacagcauuaugguuuugggcauuuguaauuuugggcacaugacccaaaauaaaauuuuuauauuauuuuuaaaucuaaguuucaaaaggagguauucuaaaaucacccaauccaagaaaaccaugaugauuucagccucuguccucgugagaacaguugacaggggacacaguuaggggaaaaggugcuguaugcuuaaaacacucccguuuuaggggcugcuggauguuuugugauaaugccaugugaucauugcggaucuccuuugccagcacacugaaccagcaaagguggacugauuguaccuguugauuguaacacauucaaggaugcuguuuguggcgacauccuugcugugaugcuguggccaucacuccauuccugugccuggggcucugcguacguggggcuuggauaugccuuucugaguugggaguaaguuuagcauauaucccauuguagggaagacuuucucuuaaagcauauugguuuuuaaauauuuauuaccuagugguacuguggcuugaucgugucuucccaaaccugugugaguuuuuuuuuggggggguggggguggggggugguuucgagacaggguuucucuguacagcccuggggcugaccuggaacucacuuuguagaccaggcuggccucaaacucagaaauccgccugccucugccucccgagugcugggauuaaaggcgugcgccaccacugccuggcauggcagagugguagagagaguuuuuccaucuuucucccuucuuuuggugcuggaacugaagccaaggucucauuccuucuaagaaagcacuuuacugcuuaauuuuauuccugauccuaaacauaacuuuuauauguaccaggaaguaaacaaacaagaccagucaugugaugcagcugaugguaaugcuuuuguuauuucgggugcccugggacugaucugcagcauuucugagauagaccuuugugagaaauaaauccacuauucuuuuacuucauc

SEQ ID NO: 5757 - RNA, 60516 nt, Mus musculus
agaauauuucaacacaccagccaauguuuccuaaacuucauuuugcaaacucguugaagcacugcgaggaaagaaagggagacuguaguaaaaccaagcggcacgacggcagggguugccuucugcagcaaggaugagcaguuuguuugcccagguuuggccuguuuguugugguuuucuuuuuauguccauuucgcccggcguguacacguuuccuuccguuuaaaguuauuuggcaaaaacguguuucucggugagcacgcauuucuuuccugacgggacaaagagaaacuuuaaaagauguaacacaaaccucuuagauccaucguggccaggaggccgcccgucccagagcagcagagggguggcggcuuucccggauuccagccgcuguuccccgcccucauuuucuuggcuggucuccugggucaugucccaagacggggacggacagaacgguucauaacaaagaugaccuggggugcggcgcgcagggucgcgggacagcggcuaggagcaagggcagcccaggucucgcagggcgcaucccuggggagcggcucccuacgucacguggggcccgcccugcgacggcguguugcaagcuccgggcagccgucguggagcugaauuuccgcgguugugaaaggcggugacagcggcgaccucccugcuucucugcguggggucccgggacuccgcgauggccggccggugcggggcccguggcgcgcugucgccacaguugcugcucuucgaccugccgcccgcacugcugggagagcuuugcgggauccuggacagcugcgauggcccgcucggcuggcggggccugggugagugcgacucagaccugccgguccucccccgcgagggacucagcaaacccggggaccugccacucacucuccuucccucucugacagugggguacugcuguaucaaguuaggggauuggguaugucagaugucaagaaagcaucccgugcugggaagagauucucgcuucacucgguuugcagugugcgcagcaguaugcaaauauuaccguaugcagggcauggcuacuggcucuacaaccccuacaucagauuuuuuuaauauuauaacuucuuuuuugagaugccgcucaguugcuagagugcuuaccuauagauguaugaagcugcauguucgauucccuagcuuggaauaaaacagacagugguagugccagucauugagagguagaaguaggcaggacagaugcucaagagcauccucuccuuguagagaguuccuagcuggcuugggaaacaugagacgccaucucaaaaacaaaaagcaaacuuacuuucuuuucuuuccuuucuuucuuucuuucuuucuuucuuucuuucuuccuuccuuccuuccuuccuuccuuccuuccuuucuuucuuucuuucuuucuuucuuucuuucuuucuuucuuucuuucuuucuuucuuucuuucuuuucuccuuuccuucuuccuuccuuccuuccuuccuuccuuccuuccuuccuuucuuuuagaacuuuaagauaucuauucuuugguguuuuuuguguguguaucccacacuccucccgcaucuagaagacaaauuccaggaaccaguucucuccuuccaccacgggauccugggacagaacucagauggcaugcauaacccacuucgcuguuuccaauaagucuccaauaaucuauaagggaaaugcuguuugcgguggaugugauuuccacuuuucuuucuuucuuucuuccuuucucucucucucucucucucucucucucucucucucucucucucucucuuucuuucuuucuuuuuaagauuuauuuauuauauguaaguacacuguagcugccuucagacacuccagaagagggcaccagaucucguuacggaugguugugagccaccaugugguugcugggaauugaagucaggaccuuccgaagagcagucagugcucuuuaaccacugagccaucucuccagccccgauuuccacuuuucuuaauuaaauguuuuuugcuuauuugccaaaucuacugcaauaaaauuguaaagaaagccucuucauauuaaucucaaaaguuaucuucaaauauccauuuuaugcagauuugguaaacugagcaacuacauauuguaaaguggugauauaguaacaaaaaagcucagccgggcaugguggcgcacgccuuuaaucccagcacuugggaggcagaggcaggcggauuucugaguucaaggucagccuggucuacagagugaguuccaggacagccaugguuacacagagaaacccugucucgaaaaacaaacaaacaaacaaacaaacaaaaagcucaggcaaagucuaugcuuuguuaaauacaaguguucucuuuggaguuagaugauaacucaugcuguuguaguuaauguuacuugaaaauacacaugaguauuuuaaagcagcuuuaucuaaaauagugguuuuuuuccuuugugguuggcaaacaauaugcuuauaauuucugaaacuguaacaguuauguaaaaaugguuuggagaaugggcuuaggguaauuguucagucauagacugcuuucuucaaaugaggaaaguccuuggcuccauccuuggcuccuaaacaauuucuucagugaacaucucagaaaaggcuacuuggaaucaagucuucccgacuucaggaagacgaagcuguuuccauuuccagccuucauuugagagagaagauuccucuccuaucagauuguucccuauucaagcuagaucauggcauagugaguauuugcguauauagacuuacuaaaauuacugcauuuuuuaauacaucuuuuuuauuggauauuuucuuuauuuacauuucaaauguuauacucuuucccggucccugcccccccgaaccccuuuuccucuccucccucccccugcuucuaugaggguguuccuccacccacccacccacuucugccuccccauccucaauuccccuacacuggggcaucuauagaaccuucauagaaccaaggaccucuccucccauugaugccugacaaggccauccucugcuacauaugcagcuggagcuauguguacuccuugguuggugguuuaguuccuggaagcucuggggcuggggagggggagucugguugguugauauuguuguucuuccuaugggguugcaaaccccuucagcuccuucaguccuuucucuaacuccuccauuggggacccugugcucaguccaaugguuggcugugagcauccaccuguguauuuguaaggcuacugcguuuucaagaacaauauuuuugguacagugcucaagugcggauggggccaggucaugucauagaugaaugaagccagugggugugggucaugaauucggaagagcaugcguccuauuuaaagggagcuaucagcacaucaggaccuggucccugcugccugucaggaagcccagcuccaauaacuggcuucuuuucucucaccuccugucuuucucaauagcacuaaauuacaaauacuuaugccucauaaccugccuccuacacacacacacacacacacacacacacacacacacacacacacacuugugagucagauguugaaaucauugcaagugauucuacagauaaggacacugggcuacaaauuguuuaaguaauuugcaguucauacaguaggaaguggcagagccgggacuugaacuaagucuguauccaagcaucaugcuuugaacuacaagucacacugcauacuucccccaacugcuauauugcuuuccuggugcaucucacaggccccuaagacuguagcauuucuggcuugaaaaaaaccaauucagugugcuguuuauauacacaacucuauuuugcccuuguggaaauaaacgaagauacucuaugcaaguacaagccagggauaucuagguggucugugcagcuaggugggagauuuuaaauuugggagauaaaaauggaggcuuuacaacuaagugggagauuuuaggcguacauaguuggcugucucuaguuggaguaaaauucuaggcaccuauggguuccaauucaagucuuggcaguauaggacaaauggcugcaggcucccuggacucacugucacagguaauuuugggaugcuuacuggagauagcagguugauuucuuaggcucgaauugaugcaugcuguggaccaaaacucucucucuauggaguauggauauaaugcguuugcauagugauucuccuggggcaagcucuaccguguuuacucuugauguagcuguaacugccugggcaagugaguggcgcccugggcacaucccgugccuugcucggaugaggacagaaaaggaggaggugcagaaggggaaguuaggucugugagacaacagggaagaaagauggagcacugagccucgaagcugugcugagaucugaaggaguagcugagcaaacucuuauaugggaggcucugaguuugacgccccaguacacgugcauguaaaugugcauugagagaaagcacacagucauguacaugugcacuugcgcacgcgcacacacacccccacacacacacucaugggugggcaguccuuuuaugcacaaagcaagugagaaucugaagauacagagggccccaauuucaaauggaaaacaauuauuguaaugauggggacccuguccuaggcugaucaugauuucugagggcagugacgaugugauugggcuacauuagcaaagacaguucagacauggguggggcucauggcugccucugugauggguuaagugugugugggaucaaguagccuauuugcucaccugcuagaaucacccacgcaagacuuuuaauauacacacgcuuuggucucucuccuggagcagcugauucauauguguggguggaaagccuaacacacugcauagaccagauuccucaaagcacuuugguuaaguguuguucucaaaguuaguauaauuucgagaugauaucugguugauggcgaugacugcuuucuuugcagucauagugaugucauaauggacacacagagccucuuggaagcauucauuuauuucauuaccauagauugccaguuaaaguagaucaaggacaauucacacaggcaaaccucuccacaccuaagauauuccugggaaaacuuguauuguuauuguguuauagauucuaugcaagacuguauccauuuuuuuuucucuuuuaaaaugaaguaaggagcaggagaugugucucagugguggagaguguguagugcucuuccagaggaccugguaacuauuucaggugacucacaaccaccuguaacgaccugaaguccccugccucuguucuuccugaguaccugugguccuguguacauaacccccaacauguccacauaguuaauauuauuuuuuaaaaaaacuuuaaaaguaaauagauuaugcaaaauagucacuuaaaaaauaaacaaaucgcauuugaauaucuaauaaaggucuucaauaagaacaguaauacuaacagcuaccacucucaagcauuugauguugccuggcccuguauuaaguacuuuacauagacugucucauguaccuacuguaaaaguguagacgccauucccauuuuauugauagaaaaaagaauggauugcuggggagucuaagugacuugccuugagggaacuuagcaaccagcagggacucuggugagaugaucgcacuucugaacucaucuuuuucucccccuuuagcuucaaaaaucgaaugauuuuaccucuuaaaacagcuuuaugugggggcuggagagauggcucagugguuaacagcacuggcuacucuuccaaagguccugaguccaauucccagcaaccacgugguggcucacaaccauguaaagggauuggaugcccucuuugggugugucugaagacagcaacaguguacucacauacauuaaauaauuaauuaauuaauuaauuaauuuuuaaaaaccaaacagcuuuaugcuugugguaaggguacagaagaugauagagaguucccacguauccccugcauagaaguucuaccacgaaaucugggcccagaaucucccauuacuaguauuucacaugagcaugguauguguguuacaacccugacauguaaucauuugacugaaguccauauuccguucacacuccuuucauuuuucccagacucccauuccucuuuuggacuccaucccagcccucccucugaguuaccaugucacaauuccacacacacacucuuucuccuuuguacugucucaucucaggcugcuuuuggaugaccuugacaguucugaggcaugcuuagugcuuguuuuagucaaaguuucuauuccugcacaaaacaccaugaccaagaagcaaguuggggaggaaaggguuuauucagcuuacacuuccacauugcuauucaucaacaaaaggaaaucaggacuggaauucaagcaggucaggaagcaggagcugaugcagaggccauggaggaauguuacuuacuggcuugcuuucccuggcuugcucagcuugcuuucuuauagaacacaggaccaccagcccagggauggcaccacccauaaugggcccucccccaaccccaucacuaauugagaaaaugccuuacagcuggaucucauagaggcauuuccucaagggagggcuccuuucucugugauaacugcagcuugugucaaguugacacacaaaaccagccaguacagugcuccucgauugagauuuaucagugccuuucucauuauuacaguaagguuaugagucuggggggauaaaaaucacggagguaaacggccauuuucagcacagcuuaacaagggccuauacuucuuuuuauuauuuuuuaaaauuuuuauuagauauuuucuuuauuuacauuucaaauguuauccccuuuccuaguuuccccuccccccguuaaccaacccacccacuccugcuuccuggcacuggcauuccccuaugcuggggcauagaaccuucacagggccaagagccucucuucccauugaugaccgacaaggccauccucuacuacauaugcagcuagagccacaagucccaccauguguuuucuuugguuggugguuuagucccagggagcucuagagguacugguuaguucauauuguuguuccuccuauggggcugcaaaccccuucaacuccuuggguccuuucucuagcuccuccauuggggaccuugugcuccguccaauggauggcugugagcauccacuucuguauuugucaggcacuggcagagccucucaggagacagcuauaccaggcuccugucagcaagcucuuauuggcaucugcaauagugucugguuuuggugguuguuuaugggauggauccccagguggggcagucucuggauggucauuccuucggguccauacuucugaugcaucucugccuacauuuaccaugacgaaggcagugucuguuggguacccacaucauaaaaccucucuuucuccuccucuuuccacauugucucuuucagaaggaggcgcuguguguacucuuuccgucaggagcagccaagcauucccuccugaagacagaauaaagccuuugaccucagugucauuucucacaucuuaaaacuucuuuuuaaaagauuuauuuauuuauuuuauguauaugaguacacgguagcuguacagauagaugguugugagccuucauguggcugucgggaacugaauuuuagaaccucugcucucuccguucguucccauucgcuccggucaacucugcucgcucagugccugcuuauuuacuccagccccaagauuuauuuauuauuauacauaagcacacuguugcugaguucagacacaccagaagagggcgucagaucucauuaugggugguugugagccaccgugugguuguugggaauugaacucaggaccuuuggaagagcagucagugcucuuaaccacugagccgucucgccacaccuaaugaagcuuuuacuacaucauacuucaacucuaagcuaccagcccauuugucucuucucccucaaaagggcuauauaugcuuuacugccuuuauccucucuugaaccuucucugcuuuggcuuccaucucucccugguccuguugccacuccucccuagcguggaagaaggcagugcucauuucccaggcuccauauucuuugacacaacggacuguccuuucuccacagagugcucuguguuccuagagucuucuuuuccucccuuuguuacagaugguucucuauuauuuguggcgucucugggccgaauccauggcucacucucuaccaaagucuauuaagaugucgcuaacucccaacugucucaccugggucuuuauuaaaugucggcuccacccuucuauucaccuacuggauagaugucuucaacuuaacacucaaaaauugucucuccucccccuaaccccccaaagcauucccauuuuaaugaauagcaacccccaccuuucauuuauuuaggccaaaagauuaauauuuuguaacuucuccauuuccucaccacccccucucacccccaaaccacaucccgucucuaagcaacugauauguuguugguuugugccguuuugaucugucuaguaauauaaccacuuaccgcagccaccacagcuucugucacuuaccugggucagguggcugucuucugaguccucagauccuuuuucagaacagccguccgcgagccuuuuccacaugcaacuaaggccucuucaauccuaaccgugugguaggucucuaccucaccuugggugaaccugcagcuccuccaugaauccucuuccccgucucucuucaguguugacucuuuguuucuugaacauauagggcaguuguccugcggacagccuugagguaucucucuucaccugcucugugcuucggcuucccuggcugcuucuuggacucccaagccaggccguaguagcgcacaccuuugauuccagcacucgggaggcagaggcgggcagaucggugugaguuuaaggcuagccuggucgacagagugaguucuagaacagccagggcuccccagagaaaccccguaaacucgagccuaccuuaugcucuuuucuuccuuuuuacucucaucucuuccacgucucgcuucauuguccauccagaaauacgcuucauaguaaugguccuucuugauugucaaccugauuggauugggaagcgccuuggggacuaguagguccacacggacugucugugaguguguuuccagagaauguuaacuaugagagggaacucgcacugugcaaacaguaccacagcagggccugcacggaauaaagggcuggagucaggcauuucgucuccuuauacuccuaggcagcccugaacugaacugccgggcuccaccacacccuaccccaggguucucagccucccuaagacagcgacccuugaaugcaguuccucagguugcagugagccccaaccauaaauuauuuucuuggcuacuucauagcuguaaauuuacuacuguuaugaaccaaaaugcaaaccuuuguguuuuccuauggguucuggcagcagaacuccgagaggggucgugacccacagguugagaaucauugcccuacagugcuagccugaaaucucugagccugugagccaaacauguuuucucuccuuagguuauuuugcucagauucuuugucauaacaucacagagucugagcagcacaccccaggcaaggcaacuauuccgguuuuuuguuuguuuguuuguauuuuuaauuugucuuaucucccacugucucucuuagcauuuaacacaagagcuggaacagaacauuauguugugugucaaaaaccgagucaaugggaucauuuuuaaacaacuaaaauccuuacuagguaaaacguucaacaaagacggugcuagaaugguacuguuaccggcucgagaagauuuuccaaguuagucuagagcaaacuuacauaaacgccguaaggaagaccagcacaggaaagccgugugggaaagcaguauuggucauuaucagucaaugacauuacacagaguuggcuguucgggaccuugcucuguagaccaggcuggccucaaacucagagauccuccugcugcugccuuaggagugcugacauuaaaggugugcaccacguugccuggcugauguuacuuagacucuaaauuucagguugacaugcuaagauggcuucuucuccugugagcacccaagggccgcuaccaucaaguccuuaugugggucuagcaaaaccuacagauggagagacauuugugguggugacaauccuacucaggaacaaaauaaaaagugcacaugugcuuauguguagauaaguacuauuucuuacaaaauugauacacucacguugacacugucugguaugagaaauguauagguaacugacacauugggauuuuguuuuuauugcuuggggauuuaagaagauucuaaggcuggcuguucuugcuguugccgaaaccaaaccuauuucuuaguguguuuuguagaaaaccugaaaagaagccucuuuguuuucccauuagguugccuaaaaacaaacauugagaucacuaucuuaacuuccuagggcuuuggcaagcgguugcaugcaaauacagagauugcaaacugggguguguugcguuauucuaaaaaccccccuccagaaacauauuugcauauggagacacgauuucuguaacugaauuccccagugguuagcacaaucuagacaauucugccugcucaaaauggccugcugcgaccucugagcaucuagugauacguuuguaauaauugucuucuccagguaaacagaguuaucaacuucucaggcccauccuugugauuuauagaguauccaggucccuuucaauaagauuugucuucuguauuagucagaguucucuggaaucucagaacuuaaggaaugccucuauagaugaagggaaauuaccuggaugaguuacagucugcaguccagcuaacccaacaaugggcagcugugaagggaaaggccaagaaucuagucacuaacugcucagucccaggaggcuagguguuuccgcuggccuucuguauaagcuggaauccugaaggaguagguuccaagagguguguuagcaaauaaguaaagcaggcaaagauaaagaacgccuucuuuucccauuguucuuauguaggccuccagcagaagguauggcccagauuagagguaugcaccaccauuccuggacuuaaauuguucuuuacuuggaacuugcucugucccaggcuggccuugaacucauugaucugcuugucucugucuccugggauuaaagguuuguaccaccuugccugcugggccuaagcuuuucauggccacuauccuucaaaaucugcaucaaaagcccgugucuuucaaugccucaagcucuggaucacaagugagccuucuauuucuggauuguuguucccagcggauacuguuaaguugaccacugggaacagccaucacaccuuccaagacaaugguuuucaacaaguacggcccauuuuucuuacuuuguauuuuuaauuuagaacgcucuuuaacagcacauuuaagcaucgggaauuuuccucuuugauuuaugaagcaauaaaguccugcauucggaaaaagagaaggaaggaaguauugggggaaagcaagauugcagaauguagcuaaccuaccaagaauuugcauuccuguugcaacaaauccgaguuauuguuuuauagaauuggauuuaaaugaauuauacauuuuacgguuguggauaauuagucuuucuuuagugguguuucuauucaaaauucauuaucuuuagggaaaagcuauuaagguugcaccaugaaucaccgguaagagaaagagaaaacauauuuaauuucuaguccuggaagccauucaugcaugcaggcaggcaggcaguauugauucuaacagcguugcuagucucuuaccaagaacuucuacagaaaaacacuuccucccuaaucuagcucuccuuacacucugcccagcucgguguuauguagcugaaacauaucaguucacucacgccucagcugagucuuggaugcauacuuuaaggaaggaagggcugcuuggcaggagggaagagcccagggucacgcucugaugcccuuuuaaaacggaaaucuagcaguuuaaaaaaaaaagagagagagaaagaaagaaaggaagaaaaaagaggaagggaaaugaggaauggaacuuaggaaagccggugucucugggcuuuggaaaguuagccgguuuccuuaaucccuguaaguuguuucuuugcucuuugugagaacugugagcaauaaaauaaugcauagucucuguguguacagcuggaguuaccaacugcuacuuucuagacauuugaggucggucucguugcuggugggauaaauucucaaauucucgugccuguacucgggguuucuuacauugucauuuggcaaaagugaauugaacaucgucgguacuggcaugugacauacaaaggugaugaaaacuuuccugggccgcuucucucugaacccacguucuaaguguucccuucucuuuacucggugacacuuccuccuucgugaacuuuguggguuuccuucccacagaccuugucuucgucccucagucuagcuaaccuugcccuagcugcuccugcuuugagccuggcacucacuccccaucccuucccuaacugcaguggcucaagggagggucuuucuuucucugcccccagaaaauuaugcccucggccauaucccuaagauguaaaguacaagggaaccaaccuuauuuauuuaaagaaaaaaugcaaaaccugucaugaguuuuagagauaacauuauuaauuuguguggugcgcuaugcccaauacccugaaaaugguaauauuuagaaaauuaacuuucuaauggcugaagaagaaucccacacacugggagcacuuuccuuggaauguuacucuugagaguaggaaguuuucuaaagacuagaaguaguucuuucgcuuuagggguuuuguuguuguuguuuauucuuguucaguauuagguucuuaucccagggucuugagcauggugauugcucugccacugaccaccuucaaaaaacaaaggggauuuugaagucagugcucauuacaaucuuaaaagcagacagagaaagugcagccaaauuguguaaacauuuuaguuagguagcaguuugaaaucauucauaguccaugacucacugaaguagccgugugugcuaauggcaaagcugccacuaaacacucaucuuccugugggaacccaagguacauagucaugcuccauuuugaugggagauauugucccuggaagccggggacaguguguacagaguuugcaguugauuugucauguuuuccaauggaaauuccccugggcagcauccacuggcuaaugccucuuuaagaaugagcacuuauuuagaaauaauaauugcuuuaaacuaaaucaggguuccuggaacucccuguguaaagauccaucccuggugucuccaucuuuauuuagggaccuguuccccugcuccauuccuacuuggacccugcaguuacuauaauaaauggcacaaugaagagaagaacaaguguuucaaugacaguaauuugcucuuaagagcuugucgagauagcuaaauaaacuauugaggaaaaucaugcuuuaaccaaaaggacagauaaguuugauguaggauuaacagcaguggccaccucuauguaaacauaaggaccacacagugcagcggcaaaaacaucuccugcaggaugaccuaauugaggacuaccugagagaccaagaguugcugacauagacaaggccagccaauuggaaacugcuguugagaagagauacuuucuugggaccaauagggcagggauggaggguguuaaaggagcuugcagcagcacucagaugagcuugcugugggguuucucaccugcuuccagaucugugucuuugauuccgagccaucucaccuccaacccccaaggacagguagggucagguggugagcuguccagggcacaggcaacaguuugagaaagagacaaauuacccaucaguuucuuuucuuuuuuuaaaauauuuauuacuauaccccuccuuagaagugggaacaaaacacccuuggaaggaguuacagagacaaaguuuggagcugagaugaaaggauggaccauguagagacugccauauccagggauccaccccauaaucagcauccaaacgcugacaccauugcauacacuagcaagauuuuaucaaaaggacccagauguagcugucucuugugagacuaugccggggccuagcaaacacagaaguggaugcccacagucagcuaauggauggaucacagggcucccaauggaggagcuagagaaagaacccaaggagcuaaagggaucugcaacccuauagguggaucaacauuaugaacuaaccaguaccccggagcucuugacucuagcugcauauguaucaaaagauggccuagucggccaucacuggaaagagaugcccauuggacacacaaacuuuauaugccccagaacaggggaacgccagggccaaaaagggggagugggcggguaggggaguggggauggguggguaugggggacuuuugguauagcauuggaaauguaaaugagcuaaauaccuaauaaaaaauggaaagaaaaaaauauuuauuuauuuuaugucuaugaguacauaagagucgcucucuucagacgcaccagaggagggcaucagaucccauuacaggugguugugagccaccaugugguugcugggaauugaacucuggaagagcagucagugcucuuaaccgcugagccaucucuccagccccacccaucaguuucuuuaugugagacagcauugaauuugccuauaaaacacacagcccucuccuacgcuuuacaccuguuuuuuuagauuauuaauaauacacaagucaacauaaauaaguaaacagucgcacuguaugauuuagggacagaaguaagaacacagcugaacauguuuaaugcuggcuuugguuguagagucagggaucaaacucugggcuuuggcagagcaggcagacacuaccacuggcuuauauccccagcuccugguagaauuaaaauuuuuuuauaugagaauuucauaaugcauauaaugugucuucuuuuuaugaacucauuccaaauuuccucccuuccaauuucuccccuagccucccauccugaguccccccaaacuucgugagaucuuaucucuaaacuggaugagugccuucauugaggccaguguguagcugggugaagggccaucuacugguggcuucugggggcccugugcaugcuucccugcauucaucucucuuucauaccuccucagcuagauguggagcucugccagucccuccccccccccccaucccuguuggaaguuggucuggcuugaucuuguacaagucuugugcaugcagggaguuacagccacucuaaauuccgauguucagcucccuuguuguguuuggacgacacugguucgcuacaguuaucuacucagucuaguucuuaccgucucuccaccccuucuucugcgaagaucccugaaccuugggggcggggggaugugauauaagugucacucaauuucauaagucucuguucucugcauguuguccauuugagugucucuguguugcuacucagcaucuacuggagaaauaggccucucugauggggcugagagaugcacuaaucuauggguauaaaaauaagaaccuacaaggacauuuauuauguuuauuuagcagaacaauagcuucagggucuuuccuagggucuauugcuugcccaaccaugggguucuugguucugaaugguaccaggcaugaauacugucuuguggagugaaccuuaauccaaucagaaggugcuugcucacuccucuaacacucuccuuacucuugaaccagugcguguacuugucagcccacacucacuacuguagguccuagggcuccagguggguaagccuguugaguguuaaucuggcagcuacgcagcacuaugaaagcuaagccagaaggaaugaagccuccagauaaucaccagcuuggcuuuucacuguuuuaugacucaaguaugugauguaccagcaauagagagucuugccgugaauugcuugacacaacuuuuaaaaauacuuuuacauuuacuuaguugaauucucggguacagagcucacagauaagaagagccaacugcauauuaaaauaguauuacugccucuugccaaaguuuugccuagaagaccccuccccaucuuuuuuuuuucuucuuccuguaauggucauacaucuaaaacauauuugagaucuguaguucuggccucuuuguaagacaccaacccuuaaaaaucauacacacacacacacacacacacacauauauauacauauauauauauauauauaguuguauauauuguuccuuacagacuacucaugccuccaaguugaaugucucacuuacccaccacuuaauauguaaucacaaaagcugacacuaucuuucacucuauuucgaaacaagacaucacucaaaggacaagaagauucaaggcgcaaaguuguguguaucagucaggauagacuauguugugcuacaguaagaagcaacacucaaaccucagcggcuuagcacagcaugaccgugcuuucucagcuaccaagaggagccccgaggguccaguacaucuguacucccaugugcugacccagcaugccacguugugccaauccugaaucacccaaaguuggcauguccuuguacugugcuaugacuggaauaaaauccuggugaauuguacccugaaucuuccacagugguagaaaugacauuuggccauucauaacuguacuaggcagugaaauucagucuucagcaauggaguagagaaucgggaaugcuuuggugacuagugaugggcaaagucagucugggcucaaagaacagggaggagucgugguuuuguaucaucucccucagcuuuaugguuuuucugagaauauuaacaaggcuauaaaguacaaguaagcuguguaugccggcaaaggcucacuggaauggaaacgcggggggcagaggcuaccauauuaaaucagaaacaccuaucucuuuaauaugauuuucgaacacuauaaacgaaaaagagcaacucccuaaaaauuuaacagcccuaaaauugguuuuaaacagaagaagucuucauaaaguuuaccguuguuaucagaucugagucccuguuagccugguaaagaauaucaucuuuuuuuuucagugcuguuaaugcuggaggguuuauuccacauuugaauguggcagaaagcaaaugucgugaguuccaauaacuggucaugguaguguaucaggaugcccacgauuauucucaggugguaacugacuuucauucacagaccuauguauaggacccuagcuuuuauagucuuucuuggaggaaaaggcaugguggggugguaccaugaucaucugccgucuccaaacaaaccacuuaccuuagaacucagcgggauugcgcuaaccuggguuauucccacaagaacaaauaaguuuccccuucccucagcugccuucucucuuccuucuuucugcuuuucaaugcaguuaauauuuugcaguugugcagugagguggcacaaauuuucauuugguaaauccuguuaagcucaggcaccauaaaagcgguacuuugguacccagcucuuagcucucaguuacccaaauguucaacaccaagacaguauagagcgaauauuuaaacaaauauugcauaaguauaaauuuaauguauuacaagugaguaauaaccacaaagaagaggugagguaagaagggauuaaccuaagcuggugguaaacaacaucuuaacuggaugcuuuuuggcccagggcagcaagagcuauuguacuucacuuuaguucccauauuucucacaaaggugucucaacaauuuggaaaguacgugaugguuacaguaaggccaaauaaguagaaauagugucaguaacaggagcaaaguuucuugcuguucaagaacaaaguuccaaacaaggaagaacauguaaccugugguauuauauucaaaccagggguacuagaauagacacuuaguuuguuaugugcaugcacacaggcugagaauauagacauuggaucagugcacaugaaagcauuugccagcuauauuugcuucuagggucugucagagacaaaacuugaguccuaucuagcaaguagaccuuagcuuuggaacaccauuccugguagagaaaguacaguucuuugagcgagcgauuaacuucagccuugcagaaggggaaaacaaacaaaugaacugagaacacuguggagagccagaaaaugaggaagugauaaaaaaccuauagaccuugccagaagacaagaacccacuuagauggacacacaaaacagcuucagcagcaacauaauacuauuagauuuuacccuuuagaauaaaauguccauaaguccauacugauauacauuaagaguggaaugaauaaauaaauaagacugcauacuuuguugcaaaaaauauuguuaaugaauacagacagaaaagaucaucauuaagcaaacauauuguaguaguaauugugauaaacaagaucuauugagcagcguaaaaaaaaaaucugagcagugucuucuccuuaguugguaaaaggauaaccuguaacagagagacuuugcaggcaacacuguaacaaaguacugcaguaagcaggccuagaaauaagauacucuuaccacagcccuggaccuuguacacuggagauacacugccauccacuggccugaaagauaaggaaaagauacacugucauccacuggccugaaagacaaggagccagagagcagagcagacucagaggugaagaaaugcaaugcagaaacucaagaacuggagaggagacagcuccacuagugagacagcaggcagagacuagagagagacuaagguucaguuguuacuaauucucacaaguuuguccugguuagaccuguggauacagguggcacggcaagaguauauaauacauuagcuccaaauaaaagcuuacaauucaaauagaauaaaacauacacggugacaagacaaaucccaaguauaugaauaaagguagucuauuccugucuucuuucuguugcaauuuccacagcggagcgacuuucaaacagcuggcuggauguucgucauauugaaaaguacguaaaccaagguaaaaguggaacaagagaauugcucugguccugggcacagaaaaacaagacgaucggcgaccuuuuagagguucuccaggacauggggcaucaacgagcuauccacuuaaucaucaacuaugguaagcauguucucauauugaggcucucuauccaucugauggggacuuaucaucucuaaauauuaguaguguacuucccacagacacuggccugccuuucuauggagacccuucuggccuugaacucacagaugucugccuccuacuccuuccugaguacuaggauuaaagacaugccucacuucccagguugcuauaggacuuuaacguuucauucagcaacuaaaaccaucagcuuuuugucuaaagcucagaauaagaaccaaaauauuaaaauaaaauacauauaauguuauuuuuauuuaguauaauauuaaaagcuagcaacaacauuggaucucccaguuauagacaauacaauaauuggguuuucucugaauguaaaugauaccuccagaauaaaguugugauucuccuuuuuagaucauguccuuuaauuaugccuuacuuaccugccguucacucaaguuuauccuuucuggguuuuuuguuuguugguugguuuuugguuuuugguuuuugcagacaggguuucucuguguagcccuggcuguccuggaacucacuuuguagaccaggcugaccuugaacucagaaauccuccugccucugccuccugaguacugggauuaaaggcgugugccacuguuucuuuucguucauguugcguucacacugcagugcaggugugccagucaaggauaauuucuaggacuugguucuuuugauucugcugcacuccauauuccaggauagcuaguaugugaaccuauaggaugaugauucucaugucuuuaccucccuucuaccuucguauaaucuuggggagugggaggcuugugcaucugcucaguuucagggacuuccuaaaccaucugaguuguuuacuuccugaaucuuuguguuguuguuucauuuuguuuuguucuuucaagacguacaauuuguuuuucaagacagugucucucauugaucuggagcucagguaucaggcagggugagggccuaacaaacacgagagaucagccugucugcccccucuguguuggucuuuauugaugucuacauugccuggcuguuuguuuugauuuuauuuucaucguguggauucuggagauugaauuuagauccuuacacuugcagaggaagcaccucaccaguugugugaucucccaaaccaguguuuucuuguuuuaguuuuuaaacaucuucaauaacagaaaauauacaguuuuaugggcuucucagaggaaccauuuuaaagcuaucauuuucugacaaugaaauguuaccuuuguuuucuuuuaacaacauacagauaaugaaauuuaaugcuuuuauagcucccagacuugaaauguugcauguagcaauaccuguuucaggguauguuagcucuuuaucuagucuggcucugccggcuagaacuuucaacguaauaaugagcagucauagucagaccaagcagcccugcccuguuguugaccuuaagcaaaaaacauucugucuuuuaccauuaagcaugaccuauguuuuuuucccauagauaccuuauaucaaauugagaaaacucccuguuucuagaguucuggguuucaauuuauuuuucaaacucuugagcuaaaccugugguuuuguauccuugauucuauuggugugacugcuauauaacuugacuuucaguguuaagcaaaucguggcuuucuaggauagaucccacucaguugugacauguggugcuuugcaucuuuguggguuugguuuguugguguuuuguugaggauuuuugcaccuauacuuguacaggcuagugucugcacccuccuguguuugguacugguaucaaaauaacgauggcccauugaaugauccaggauuuguucuguccucuucugcauuugaagagucugugcaugguuugugcuaaacugucaauucguggcugguagaauuaaccaaugcagucaucuggacuggaccuucucucugugagacauuagaaaacacuauucacuuuuuuuacuuaucacauguccauucagauuauccuuugaauuaauuuuaguagauagaacccuagcaaucuguucuuaucaucugaguuaucuaauuucaugugcauuauauuuucuugaugucacuguauuccuuuauaacaccaaugauucaguaaaaccaugaaaucaguagagguuguucuucuuugguuuuaauuuuaauaaugugucucucuccuuucuuuucuccuucccuuccuuccuuuccucucuuccucccuccuuccuuccccuccccacuuccuucccucccuugcuucuuccuuuucccuccccacuuccugaccucucucucucuccuuccuuuccccucuuuacuuccuuccuucuucccuucuguuuucaucauauccaaacuauugccaguuuugauuaucuuuucaaagcacuucuuacuuuccuaugaaucccccuuuuugaaaauuccccuuuuccacucugaccugaauucuuuccauuugcuuuuguuuauuuugccauuaaaaaaaaagucuuuccuuaaagugaaagcauguuacugguuugagcuauuucuuccaccuuaagguagaacuccacaguuacaguuuccccucucagcccugcucugugcucccuaccuuaaguuuuuguccguuuuuuuuuaauuauugacuuauugcagauuauuuccuaauuuacucucaaccauugucuuuaccucauuagucaugauuuuuagacucauuaaucaugauuuuuuuacuguuccuauuuuugugaguuuuuccaauuuucucuucacagcugguuucuacuuuaauuucccaguggucaggaaauguacuuuguauaauucaagucuucuaaguauacugaggcucauuuuaucauccaacauguggccuguuuuggagaauguuugguguccucuggaggaggacaugugaguuauguguuugaaaagaaaguucuauagauaucaaauagguuccguugguugauuuuuggacaauauuugaggguuuugaaagauuaauugauggugucuuguugcuaguuuuguaaacaaauaauuugauaaaugcuagaaaauaagaguaacuagaucauaaaaacaaaaacauccuuaagguugaaucaaaauauuaccuagaacagcaaagacagaaguauuuuaaucuuucgugagacacaacacagagcaucucacuucugacagauuucuacaaaguaaaaauauagcuuauauuugggaaggguuugaguauugaugauugauaguguguguguguguguguuuguacacacauaguaaucucugauacuuuguugugaaaagaguaaaaaagcacaacauaauuaacuacccagggaguccggucucacaaccucgacacugaaaugccugcagagccuggugaaagcaugauguuuggcuuucugcuuuguguuucaggcuuuauuagucuucaugacaacuaagaaugcuucaauguagcucgucguauuauuaagcgaagacagguuugacuggguacuucagcaucaggaaacauuucacaggugugaauguaucgauuccaguugaaugaagaugaacucuagacaugagcauuacuaguguuauauuuauuuccauggccucaaggcaagcgaaccuuugggacguaaacacuuuuauacccagcucccuuugcuucucuuucaggaguaagcuggacuccuucagugcagacgcaucacgagcuuccauuccccagcuucccaccugaggugaagcaugcgugcagagaaaacgacccuggaccucuggugcgcacacuugcauaaagauugaaauucucuggcgggaaagagcuggacauacaggcagcgucugaaaacuagaaacgcuuuaccucucgcuuugucuguguuuaguugcagucuguaaaugcucaaggagugagggguuuuugcugccaggauccagcagagcugaggcauagaauuaagaugcgggaguguguggaggggggggggaauuacauacucuucucaccuuagcuuguuauuacccuuuccugugugauauuuuauggaauugcuagcuuuuaucacaacagaucaccaguggccacuguuuagaaagcguaacaauccacuuaaaacuggcagugauggcauugguacucugcuguucucagugggcauggaagccaugucuguaaggaagugaauacuauugaacaaagugagauaacuuagauuuccuccagcuuuuuucuaaacuccacucugcucugaugcaguguagagucucauggggagcuaucgauuucuguugagcucugcucuuuccaggcuuauaaaauggaauuacuuauuauauauuucuucucucaggaaccagccaaugucacaguggauaauguucuuguuccugaacauaaugaaaaagguaaggaaaaaaagggaaacaauuaaaaagcaauuacaucacaauuaauuaaaucacacauucauauaugugacuuugcagggggaaguaaugauuuaacugaacuguuucuauuccaaauuuauuauaacauuuucuuagguaugaaauaaucuuuuaaaauuugauggacacuuauaguugugguagaugacauauuguaauauaagaauccauuggcugaagucuuuauaaaacacaauacuaguguauuaauuaaaggaaaauaagaagugaguuugccucagggaaccucugaaacagaaaaaaaggaggaggaagaggaggaaguagaggaagaggaagaaguggaggaggaagagugggggaagaggagaagaacauaucaucaccaccaccaccaucgucauuauccauuggcacuaaugaauaccauggaggaauuucacauccagggacuuuguuacgaaaguuugcagguuuugugugccauaagaaaauacugaaaaaccuguauugaguuuuacauagccucagaaauuuucauagaugcacagaccuuuugagaugauuauaacguaaugcugaaggucacugugaaaagcuguuuguauuuuagauuagcuucuguacuuuauuaauagggaaaaugacuuaguuccaccuacgagucauucugauaaaauuuaaaaauuacuuaaggccaauugccuaagcauuugccccaagccccaagccugcagauucucugguuacgggagaguuaggacaucagcugagguuuucagucuuuagcccugaucuauaaaugaaaccauaaauguccuuaaaggauguuuauugagauauaguuaaaauuaagcucugcuuuaccuaugguuuuuaucuuuuauuucuauccugcguaguucuguguguagaaccucugagaugcucagccagcucucugcaacccaguccuggcucuaggcccucccaucuucuuaaaucugcaucugguuaucuuuaaaugucuucacccagccuccuuugggugaucuguucagaggugaagugucuucauuuacucugaggaaaucagcuaagugggggauggagagauggcucagcggucaggagcacugacugcucuuccgaagguccugaguucaaaucccagcaaccacaugguggcucacaaccauccguaaugagaucugaugcccucuucugguguauuugaagacagcuacaguguacuuacauauaauagauaaauaaaucuuucaaaaaaaucagcuaagugacagucagaggcuuuggcaccucaaaagcuucucaaucaguaaaguuuggagggggggggcacuguuuaacugccccaagaguuccagucggucaaaaguaaggcauugcuugaccuaaggacagacagguccccagaaucauggccucggcugagcuucuuugguuaaccucauuggagauaaaaaucaggcugcuguucaaauaucuaaaaagcccccugauguauugaaggaugagagccggaggcacugaaacacacagaggacacauggugggccucacugagggcuccugggccuugccucagaccuuccacucuaauguacuuucaccuucuuguaacagugacauugacucuuggaagagacggcucauugucuuucuuuuucucucucaaggaacacugcagaaaaccccuaucagcuuccagaguauccuagaaggaaccaaacauuuccacaaagacuuccugauuggagaaggggagauauucgaaguauacagaguggacauucgaaaccaagcauaugcuguuaaauuguuuaaacagguaaggaaagaaucacgauagccacccauuccucuugguuacuauuauuucauacuaaaaggugccacuuuuaaaaaucaacauugauaggagaaauauugggaaaucgaauuucacaaaugaaaaugagauacaagaccuugggauggggguggcugagaagugaccaagacacgacugccugucuuaaagggaugugguguguaagaucaaagucucucccauccuuagauguauugccugagaaagucuuuucuaaaagccguucauggccccaggaacguuaauggagaucagcuagagccaguaguggugguacauucccuuaaucuccacacuaggaaggcagagggagguagaucucugugaguucaaaaccagccuggucuacaaagaauugucuaggcaagcuaaggcuaugcagugugaccucaaacgaaucagaacaccaagaagaucagaaugugcauaguagcugcuuagugccaguugugucuucccucagcauagccucauaguccugcuacaggugaggccucucagccaugcuacagaugaagucucauagucguguuauagcugaggccuugcagccacgauaccggugagcauggagcccaggugaacagaugaucccucaucggugcucaggaaggugaggagcaaggagcuucuaguaggaccaaguuaggcuuccaucauggugacagauaccugagagagucaacuugaaguaggaaaggacuguuuuagcuacaguugaaggggcugaguccaucaucaauuggugacacugugcuauggcaggugaugagacagacaagacauuaugguagaacuugguagaguccagccacucagcccaugauggcuaagaaacagggaggguuggaccagggcauauucuuauagaguacugccccagcgcuuuaaccaacuuuuaaaaacauauacauauacacuuagaugugcacguacucauaauguacacauauauguauaccuaucuaucgggagaauaugguuauuuuugugcuuaugugugaugagugugugauguguguauauauagguaugugugugagugauauguaugugcauguaugagugugugugauauguguauauauacgugugugugugauguguacguauauauaugugaguaugugugucuauguguguguauaugauguaggugugaugcaugugucuguguguucuacagcuggaacaacagaaguugugagccucccuuuugcaggaaauauuaaaaaaugacccaccagcucccugugcuccuguuucucacguccagcuaacuccccgguggggccagaccgugcuucagugcucccacugcuggcaacucucucuagcuacccccugcagaaucuggcucucuugucccuggucugugguuccucucggccauuggcagucccacauuccaguaacuaaguaaaucaaaacucuuaaagcuuauaguuaaccaaucagauuuauguaucaauaaaaucacaauuugccagaugcuaauacaauaauuucagagccaauugaugauagaagcuuuaucccaauuauucuaaccuuaugauaucauagcuaccugugacugguuaagaucaugcugguucacguccaccucuauucuccuuucucuccucucugcuacacugucgucucuuaacucuuagcuccgccucccuuuucccugaccaaucacgggccucuuggugcucuaauguaauuggacagggaaaauccggcaacaccucccaauagauauagaaauuggaaacggaacucaggaccgugugcuccgaacgcuccuaacgcuccuaacggcugcucugccucugcagcucucucuuuccuucuuuuaacuccaagccuauaauguccccauuagugugccuccaugaagggauuagugcacacacgacgucugggcccucagguucuaaguccuucccaaauggcccauuuaugaaccuuggugcaucgugaaccaagacuccaacacacgagccuuccuaggggauacuugguaccuaaaucauccugaagccacgaguaguagcgagagcagaugaugagagccaguagagcuaaucacagucaugcaagagucagaugcauaaaagaagugcccuucauuuucacaccauuagucggcaaucaagaacugcuuauuaaacuccuguggaguggacccgcuucuguucucaggaguucauggucuuugagggcaaauacccagcucaguaaaagaugaaacgacugagccacaaguacuuuaacagaggcuuguacaaaaggccccaggaguauaugacacguagcaucucugcacacuaaagaggggacaaucuagcagccagaagaguacucagcauacagcacccuuucaauaaacauuccccaggagcaaauucaaaaguggauggaagaagcugaccuuuccucuggguugagacagugcguaggauuuuggugagcagugaaggaacggaagcccacgugcuagagaaacagacgcaggacuccacuuguggguagcgauucauuugguggcauaugggggggugggaaggaaacacagacaauaauacagaagagagaagccugaugaagcaggggagugaaagguuuggaucuguguuuaaaauacaacuuugguuagagcguagacgguggaggagacguuagcaggagacuuggcaaaagacuggaagaagaaagccuagcuagagguuuaucucuggugucaagaaaacaggacuuaagcugguacuccuggcuaugcuugugauagacucacccuggaaacuuucaggcggaggaggggcagcauagcaucugguuaacucagauuggugacuggggugccagguauaagcauuuguaaaaugucuuuagguggcagacaucaauauuaaaaacucuugagaauauaauacaguuacaucauuccccacuccccuuuccucucuucaaacccucucauggacccuaucuuucaaaugcaugacucuuuaauuguuguuacacacacacacacacacacauauuacacauauacguauauauguuauaaaauauauuaucuauaagauauccuaugucuguaauauauagauaugcauuauaaaauauauacauauacauauauauauauauauccuaaauucauaauuacacccaguuuagucuguauaauguuacucguaaguauguuuucagggcuaaccauuuauuauuggauaaccaacugaugcccacuuuccuagggaagagcaacucucagcauccuuugauugccugugguucuuuguuggguugaggccucuugggcucccacccaggaacgucuauuguucuuuuccuuggcagucauauuggugagaauuuauggguguagcuucuggcauuucuaggaggcacagucucacagcaaacucccugaugcucuggcuccuauaauauuuucaucuccucuuccaccauguucccugagcauuaauuguuuuguagguguaucuaguggaacugcauuuugauggcuuguguucuuugguaauggucuccaucuguuggaaaaagaaguguccuuggugaggggugaggauuucacuuaacugagacuacaaggacaaauauuuaggauguagucagggauuauacugguuugggaaaguugugguuguagguuuuccuuuaagagacacaacuuuacuagcccugggcacuuggcuggguuucuaguaucagccaugauuuccuguucaacagaucuuaaguucaacuagagaguuguugguuaccaccaagguaugugugccacuauuucacucuugggguuaucaugugaugcuagucauuguugaaacaaugacucaacaaugucauuuguaaaaaauuuuuaacauguaacuggucuuaagaacuguuacuuaaagcuaagacaaagucaccagggaaggugagaaggaaacaauggaauggaucugucuuaguuuggguuuuacugcugugaacaggcaccaugaccaaggcaacucuuauaagaacaacauuuaauuagggcuggcucacagguucagagguucaguccauuaucaucaagcagggcagcauccaggcaggcauggugcaggaggagcugaggguucuacaucuuguccuggaggcaaacaggagaaaacucuuccaggcagcuaggacaaggguauuaaagccuaugcccacagugacacaaccgcucccucuucucucuucuccuucccuccccucuccuccccucuccucucuccuucccuccccuuccugucuguccucuccccucccuuuccuuuucuccccuucuuuucuuuccuuuuucuccacuccauuuuacccccaacucaagaugaugcaaauuucggaaaaccccuuaaugaaguaaccgaauacuucucuaaaggaaugcaauuugaaacacugggacaaugccuuuauucccauuucucaaauagccgagguggggaaugccaaugugcuucacucaccuggacaucaucuuccagcugcugcucuggguggggcaggucugaacagcagcccagcaggaggcucagugcugcucugcaguucaagccacccagaggaaggcuuuccauucguaaaccacuuucaaguacaagguuugcagagacacaaacaggagccucuuucuuuaccagauuuaaaacaaaacacuggacaaacugugagugacaaaggauuagagacagccagugcaagggagggaggggccucuucuucccggagagagacuuugcaagacaaaggcggcgaagaaauaguucugggaaaugauuagugagcuaggcuuuuuauuuuuaauucaaccuggacagcggugcccagaauucuccuuggguuucaaugagcgcuaaacccuucauuuucuaacacauuguaaaugaggaccuuauaacuagguccucguagcaucuuaauuuaacaguuuaauggugaacaaggaacuugagauccaagaucaugcagugauacaacauugaacgcaccuaggauguguccucuacugcgaaguucucaguauaaccuuguugagguuauuaauuuauucaauaucugugugccuagaucuaggcuagauuauuauuauuauuauuauuauuaguaguaguaguaguaguaguaguagcaguaauuauuauuauacagggucuuacuguguguguagacccaggcaguccucaaacucacagaaacauaccugccuccugaacggugagauuaaagccccaugccauuugucuagauuugaaucuuuauaguaggaaguuacaacuuccuugcauaguaggcacacaucuuuucagaauuaaugcaaaaaccaauucgaauggaugugugugcaaaugagccgacucuugagugcuaagauggugguaguuuuugcagaacacggguagaauaacauuuuuuuccugugagaucagugaauaguuucuauggaugugguauuuucugugaaugcacaauauuuuugaauuuccgucaaugugaaacuggugaguuugaauauggcaaucacaauguggcaaauuucaggggaacguucuacugaagaguaaugguuguaagucuuguuuaggaguuuaaaacauuuuugaaaauccgaugaaugcuaaggauuccugggggcugggaugggguuacagggguggggcucaacucuacaucaaaaaagggaaacucguccuagacaaagauucccagaaguagagagccaucucuuacauuguuuccuuuuucuuucuucugugacauuuaggagaaaaaaaugcaacuaaagaagcacuggaagagauuuuuaucagaacuggaaguucuacuccugugaguguacuugguucaucuuggggucuuagagcacaggaauuggcauggcuagcauuuaauuagcguggguuggauguuagaacauuaaauacaguuuugacaucugcuuugguguucuccuuaaagugcauuuuaaaauguauuuugggauggaacagaauccgugauauacuuggacauauugaaacaagaaaaugucacaagaaguuaggugaaauccugugugacuaacauggccgaaugguaauucuuagcaucagaacacuuccccucccucagagaagucucaguugagacagcgguuucaucggagugguucucuucagaaaguuuuagacaaagaaauccaaggcuuuugaugugcauaugauuuuccugggaauucauucauggucugggaguccugggagacaaauuuagauggcuucaguuuuauauaaauucauaaguacagcugugcagccucccucacggagggacucuaacccugugaaguucaucgcccuucacaaaggaauucuuuuuccuagugcuuuugauaugugauguacggguggagagggaaguagggagagcagacauuauacaguauccagucccuuucauagccaguaccagagacuagaauauuagacacuaauauuaauagcuaaucaaacucucaauccagaaauuguaguaauagauuuuuuuuuugcauucaaguuuuacuuguuuaugaagguaagauucagacauuucaaaaucugagaugcccaaaaggguaaacuuagaggaguguuuucccucacuaccuagcugauuuuuuuccaaaggcaaccuuauugccagcuuuuaaaaacauauucuuggaggugugcuaugagugugcaagaacauuugggcgcagcuacucauacacccugaaccggugcaccggugcgccuuauauuccgggaucuuugacacagaguggugcagaggaagcuccguccccccucacccccccccccagccaguugagcucgauuagcccuggaaaucaaaggagagacagcugucccagcuagaucacccucacacccacgguuugguuucuuaguuuccuccuuucucaguuuucuccuuugcagcaacagguagcacacuguuugccuugcuguucugugugucgcugaccugccuucuauugagaggcuuaaauaaucuuucuugacucaagaaugcaguaacacccgugcuaucuuaaaagaaagaaaaaaaaaaucauugccaaggccagcguugaagacauuuuaggaccuuaaggcgucagaucuuuuguuuacguuugugaugugucaaucaaguuaauuuuuacauguggugagaaacaaauccucuuucccuucaucuuuccauacuaucagucacugaagagauguuucuuuccucuuguguauuucuuaccuccuagucacgguuuuaguugaggguguacuuagggcuugguuguuucugaacccucuguucugaggcacugaccuggaagggcugcuuucugccaaugcccaccgauuugauuacuacagccuuucgauguugcuuugagaaaggguucugcucgcucaccuucugcucguucuguaauugugucaacuguacauguguacauaagaagaguauauuuguguuugcaggaaguucacuauaaaagaagcaaauaauagaccuuuacaaguagaacauuccuuacagcuucaucgauuuuaauguucucaaacauguccaaaacacaguaggcauucagaauauuaaacugaauuugaaaaacacaacauaaaccccauuugucuccauuuaaggaccaggccuaauuuugaaaagaaagcccuaaggcaccagcuccaggaacagaccauaaauaagaucauaaaacucucucccaaagaacagccuggggauaaccacagaaauggagaaauagcuuaucucagaaugggcccucugugcucagcagccuuaucucauucuacaguugcacacucauaacacaggaaugcagacugcugaccaccugugacccucuagaacccaccaaugaaauuuuagauuacccaauccuucuagagaguucaccccauucucuacaagaaggccugugcaccucugucugggguccccauuucaaagaauaguuguuucugcagaauaaaugcucuuuguuuuugcauagugucugggucugggggucuucagcgauuuuuacaaacucacaguauugggaaauucacauuuuguggcugugacaagacacaugauuaaaaaacaacaaaacaaaacaaaacaaaacaaaacaaaaaacaacgacuuaagaggcugaagguuuguuuucgcuugugguuugagaggacagcgcaucauggcaagaagucacuguggugggauugcaagguaacuggucucauugaguccagucuggaagcacagagagauggacucuugggcucagcuugcccugugcuuucgauuccuuucgggaccaucaguccaucagacggugcugaccgaaagcugugcuuuucugaagcuacagugaagagugacgauuaggggauucuagccagcaaacagcuccggcaggccuugcccuguuccccuauucccuccgucuugcuaaaaaccauuauguucgguuccugaggcuagccaucauggccuaguuccuuauuugcccacuuucuccucuaaggcuaacuaccaagguccagcuaucaaaagcucccuugggcugcccuaauuagccuguccaaucaaaauuaaaugccucagccuaacaugagguuucuccuuuugcccuuauaaacugccauuuaccuuugggccacagucuauccucugucuauucaggggcaguccuucccacccccaccccccagacaaauaccccuguucccucucccuguuuccuuccccuucucccucguccucuaucuccugucuuugucucuuauucccugccuucugucccuuugggaaaaauaaauuuccuuuguucugagaacuuggucuuggggcuucuugucccuuccacuaucaugccuggacuauacugaccuucauauaacaaugacaucuaaggaguagaauuuauuugggcuagaugguuaauaacugauuaggacaggagccuaagauauauauagauauguguguguguauauauauauauauauauauauauauauauauauauauauauauauauauauaguacacuagaaaucugaaaucuaaaaucagugucauauuuuuauagaugaagacgcuauuauguggauuguagauaguaauccaagcuuuguaaaggcauaauugucccuugccuguauguaacugggccuuagcccagcacccuauguaguaaugauccagcaauggauggaugaagacagucuucucuaguccuguguuuucgugauuuuccuugcauugcacacuuaaucagauggguuuccauugcacaaccauuauuuguguaacaaauaaagaugugacacaguuucauaucaauaagugaauauugaauuguggcuuuuauaugaauguuugguaugacauuuucaguaucccaaggcucaagaaaccgaugcuuccuuaaauuuucugccuuguauuuuaauauauauauugauuuacaugcugacaguugauuagaaaggguggcacuagugcuugucugaacacccaaggaaauuacuugucucucagccaaacuuaguuacguuagaucuggucuaacguggagaaucugaugguuuaaaacuuuguuucaagguuccgucacccccacauacuagagcuggcugcauauuucacggagacugagaaacuuugucugguuuaucccuauaugagcaacgggacgcuuuucgacagauuacagugcacaguaagucguggguaccagucccuuggguccuuuggcuguugacacuggaggaagcugaagggcgagaucugagcaugcgcauugggagugggcgggguauauucagcaaugguucccagggaagcgaaggaccucccaggagauugauuucuuacccuuagaaggcggcuugaacacauggguuccuggguucuggguaauauuaacacauauguacagugaguuuauacccacuacccucagcuuccuuggcaugugguacucagaugggcauaggguuagugcguuacgcaugcuaagcaaggauucuaccgcuaagcuguaaccccagggcacuggccacaguuugacuaaacuaauguuaaaaauuguuggguauuucccuagagccgugguucucaaccuuccuucccaaugcuuugacccuuuaacacaguuccucauguugcgguguucccccaaccauaaaauuauuuucguuguuacuucauaacuguacuuucgcuacugcuaugaauuguaauguaaauaucugauauauguuauauuugauaugugaacccuaugggacuggcagccugcagguugagaaccacugcccuugagcuguagaggaaaacccauuuggaauuaaaaauaggugguagcaaacugaaauguugcuucgccucuccuuccgcagugccaucuacagcgguggcuguuguguuuuauaaaaagauagagaagagaagccagggauauguuugguggagacgugauaugaugugggggaagggggcgccucugcgggcccaugcugagacaucccuucccccugaaguaccagccacagauggcuuaguauggaauagagucuauuuagggcauggggggggggggggcugagggaguaguagagacagaagggggguggggaguagaagcuggccaugagcacguggagagagaaugagaaggggaaugggguggggagaggguaaggggcaagagcaagaggagaagagaacaagagugagagggggcaagcagccccuuuuauaguaaggcacauuuggcuguugccaggcaacuguggggcggagccuagacaaaaugcccacaguggcuacagaaccauaugccugcauagggaauauauagguaauuugcacuaaggaaauacaacuaagccgacuuguguuuuucuuuagaauggcacaaccccgcuuuccuggcacguucgaaucagcguauugauaggaauagccaaagccauccaauacuugcacaacacucagccgugcgccgucaucuguggcaacguuuccagguaaaugaccugagagcucuggguuccaccuaaaucccugucagcccugcaggugaguguucuuuucggccaggccucuuccuagaauacuuaggagugcaauaaacccucucaccuacguacugaaagucucacuuuuuuuuuuuuucucaacaaaaauguguuccccagauuucuagaaaucacauuuacaucucaaaggggagacugagaguaccuuuaugaacuacuaaugaauaauuauguguauuuuauuaauuguacuggauagccagaugugcaauggaaccuauacugaccuccucgcccuaucucuuaaguuugagguuuuuuuaaaaaaagauuuauuuauuuauuuuauguauaugaguacacugucgaucuccucagacacaccagggcaucagaucccauuauagauaguugugagccaccauguaguugcugggaauugaacucaggaccucuggaagagcauucagggcucuuaaccacugagccaucucuccagcccucuuaagcucaaguuuaacaaaaagagacacaauguauguauauggggauucccagaguacaauagcagugaaucaaaaucuuugguccuugacucaguagagucuuacuuguuacaaugaggcugccuccucuacccucugggccuuucuccuugucauucugugagaagccagcauggauccagcaaucccugauccaaugccacauacacacauuccgaguugacuccugcaguaaaauccccugaugauuuccuccuuguguccuuauguugagcucauccagaaggcccaggucucaccuuuccugugccaggggcagcuguguuugcaggccgcgccucucccagaccauuuccuaguaccgugaagguuuuuagcgcaccuuuaacaugagccgaaggaguggauggcucacuuuuucuggagaaauaaacaugaaagaagaggucuguagauuucuccuuaauccuggggcagcuaggaaaacggcccagagaugccuguuccugcuguaguguggaacuucugcaguugucagagguuucccagagucugagcagaaucaaagggcuccucacaggaccuggauagaguggacagugauggucccaggggucagggggcucaccagugggguccauuccauguggcugagaaugcaccccccacaccuaaaaucaugucucuuccccccagauuauaaucacuaaugaguacaguaacuauacaaauauuugcucuauuuacugaaggagagcaguguuggagucuugccugcgccuucuuccucuggcuuaaagugagcacugguuuauuuuaaaucucacauggugacgcauuaauauuugguucccuuuguguggcucaguucaucacuuaguucccuuucuugaaagcagcguuugcagaacagacagaagaguauuucucaauaggggagagaaacaagggcauccauaaacugaggcagaggaagcaucaggccagggagcgcaacagauggaggcgcacccacuuccuaaggcuucuuccagguaacacuagggaaggagacuaggaagcaucuauccagcgccucguccaucccgugagacagucgggacaauuuaaugaggcucggucaggaugaaguaaaaagaaggcuagagauacagcuuaggcaugaaguacuuuccuagcauauguggggcugugugcuccacuucuaguacagauaaaaauaauaggaaccaucgcccggcgugguggcacacgccuuugaucccagcacuugggaagcagaggcaggcagauuucugaguucgaggccagccuggucuauagagugaguuccaggacagccagugcuauacagagaaacccuguuuugaaaaaccaaauuaauuaauuaaauuaaaggaaccaaacacauggguaaaggagggaggaggggcuguugggguacuggcgcuaucgcggcucuaacugaugucauggaaaagccucugaagccgcgguggcuuuucaaagacaccaacaaauagggcagggcaugccaggacuugcgcugugucccguccuggagcagggcuguaaccugagggcagcaucucccuucuuccgugcucaguaccagauggggacucgguuauguucgugucuccagcuagguagggagcaagagcuagccugggaauggggcagcaaugaugggagcacagaagagucagucccagagaguucugaaagaggagaaccgaaaccauucaccuggguucuccuaccucccaacucaggguuccccgauguuuaaaucaggaagaccugagggaccagagcuuccuuuuaagcugcgacccugggggacagcacagccucugucuuugucucuuaaaaaaguccaaauagaccaauaacuucguuucuuaagguuaaauggcauauagugucucagugccaaggagagcacacacucagcaaaugcuaccuccuguacuugguccagagguguuggcaguggcagaggcugagaugggagggacagugaguguucaugcucaccacuccuccacacacuuccagggucagcagacaagcucugccuuugaaagaguugcuugugucuuagugagugcagguggaacacguugggagucaaguucuuacuugaucaaaaucuguugugugcaaaguuuaauggagaccacaguaggccaaacauagaaaauaugucacauuaacacauacccagugauguguuuauaaaaagauaaagagaggggggauauguucuauggagguguagucagguauggggggaaaggggugcggggggggggucaugcugaggcauccuuuccuccugagggaccaguuuauucagggcauggggaggggagugaacaggguaguagaggcagggggcggggaggggaaggggcugggagggagggaaggagcggaagggagggggaaggaggagaggggaggggaggggaggggaggagaggagaggggaggaacagaauaaaggccagccauuagcauguggagagaggggaugagagggcagagggagagcaagagcaagagagugaggaggggggcaagcagccccuuuuauagugggucaagccuaccuggcuguugccagguaacuguauggaggagcuuagagagagugcuaacacccagugugugccugggcugaguuggagcuaaagaagcccaagccaaguccuagaggaaguauggguuuuuuuguuuuuuuuuaaagauuuauuuauuaguuuauuuauuuauuaauuauauguaaguacacuguagcugucuucagacacuccagaagagggagucagaucucguuaaggaugguugugauccaccaugugguugcugggauuugaacuccagaccuuaggaagagcagucagguggucuuacccacugagccaucucgcuagcccuaugggguuuuguuguuguuuuguuuuaacacaaaguaauugaaaguagcagggagaauacuccugguggaggcaguaaauuuguucaagggggucaaagcaaagaacugccucacauacagcagaagccaaggaagggaggaaggaagggagggagggagggagggagggagggagggagggaaaaagguuggcuuguuggcuggagaacagauggaauuuggaaauaaaguaaauugaggugacaaagacagaacgugauggucaagggguugacggggcuuaagcggugacuagguuagagaacuagguuugauaaguaaacucaaaggagagacucaagcuugucuugaggacaaguaggaguagaaagauucguaguuuccaagacaauagcccagguacuuaccuugcuaugcuaaauuuaacacuguuuaauagcccagcuagacagaaucugggugauaaacacgcagaagcugacagauaagcaaccaguaagagagcagaguguguggaaauacagcgagucgcuuauuuacuuuauaguuaggggaugaacucaugauuguucccugucuggcuguuaccauuuggaucuuauguguaucugaaagaacaugcaugguggcucauccuagcacuugcgagccuaggcaggaagauugccaugaguuugaagccaguaugcauugccagacugucucgaccagccaccuucugaauaaagacaaagaggcuuuauuucuuuaugaauccuaggccuuacagcuuaggcauguucccagcuagcuccuguaacuuaauaacccauuuauucuaaucuacgucugccacauggccccuuaccucuccgucagucccugcgccuguuuccuccuccgugucuggcugcgaaucacccaugccugcuuguuucccagaguuccuagcucuacccggaaguccugcuuuuccucuacugcucugugauaggucuuuauuaaaccaaucagaaggugauggagaagaguguucacgaaacacugggacaggugaugcuuccuaaaaaugauagccuguucuccacucucugcugguacaggaaucgacauuuaaauaauacaaagaaaaccuguacacagcagacaagaaguuuaucccaacagguaugagauguacgaugagaucuuccacucccccaaggaaauaucucucaaaggauccuacauugaagauuugacggucucuacaguggucguauuaguggcguugggacauuuaggaaguggacucugguaugggaacucaggucauuaggagcaucuccuugaagggauauuaggacccuggaccuugcuacuggucuuugcuucucagccaacauggggaggauugaccucuucugcuuucacacaaugauguacguuccugccaugggcccaaaguaaugggacaaaccaaccauggacugaaaccacgaguuagaauaaaucguucgcucuuuuuaaauuguuucucucggguguuuugugaggggggggggggaagcuggcuaccaugacagauuuuccagggucugaggauucuaacgcagcccauccauaggcugcaccugcaggggucuccgccaccuccacagcccgcagaauaaugaucugcaggaggcaagaaggcaguucaguucuacaugacuuaaguagccaguguugguuccagcuucaggagucugacccggaguaguuuguuuuaggcaucacugagcgaggcacgauuugaugaaaauguuccuguggauaauuaacucgaucuugucuuugcgauaaaacauacauaaaucugcuggaggaacuugaggcacaguguaggcuaacuaaagaucggacaugacugcaucgaaagacuuugcaaaguccaugucauagccaugaagaugagaucuauagcuagacugagaagcaagcuucugauaaagaucuggagggagggucugguguggucucugggcacacagauaguacaaaggucaccaggcuguuaaccacgucagcucccagccuucuguguggaccacagggcauccccuccuuugaaggaaccaugcuguguguuuaauauuccaaguuguccuaguuuuaaucuaugagaauaaggagcucagugucuccuacauaugcaaacacacauacacacacacaaacacacauacacucauauacacacacauacaaacacauaaacacaaaugcuacauacaaauaaacacacacaaacacauauacacucauauacacaugugcacacacauguacacauagacacacauucacaaacacacacauacauacacacaaacacauaaacacacauauacucguauacacauguacacacacauaaacacagacacaaauagacacacacacauacacacauguacauacaaauagauacgcauacacagacacacacacacacacaaagaaacacauauacacuugugugaggagcggcacucacagucgccguuacaagauggcgcugacauccguugcuuguaguaaaaugugcucaggcgucaggguaucuuuccauuacccgagcccugccucucucuuggcguuaacugacugauagugggcagccaaucccgguggugcacgucuccaaccguacuucuaaccguuuugcgcagccuauaaaagggaaggguuuucugcucucugggucuccucuccugaagcugaucaucuaucucucgagauguauuaaagcuguacugcagaaagauccgaguggccugcaugcguuuugcuggcgagaugguagcgugggucacacuuguauacacacauacgcacacauaaacacagacacauacauaggaauacacacauacacagacacacacacauacacaaacgcauaugcacacauagacacacacacacacacacacacacgcaaguguguaagauguaaaucccagggcuguggaccuguacuuaggaaucaugcuuucgggugguuucaucaccaucccugccugcuccagcacaaaccaagccccuucagagccuuagccuuucugcugagcugccagcaaaaauauucguuggugccaacuucagccauaggcaucucccucuuacuuggugauaugcacaccuguugucuaggaauuggaacaagaccaauucaguucacuuaggccgccaaacaucugucagauggugacagcaucugucugugggaguccuggccaagugaguuggcugaccuaagucacuuuccugcaucucugaagagaccccuucccuucacgcaaaauuagaccccccugauucuuagcccauugcucuuaggagggucccaagucaccgacucuccuguguuugccaugcaguuugaaaagucauaauuaggaaagacaguuucuagcaaggaagccauauguguucuugacauuuggcucgaagaucuguguugaauggaaucauuuuccaugaguaacucugcuguuuuuuuuuuugucagaguagugaaaauggaaaaaaaucuccauauccuuuucuguacugaauugcagacuaaugggucagagaccagucgacauuaauucauauugguagcaugaagcaaccuggcacaaaagugagaugguuuaaaaucaaacagacaaacaaagccaaaccuaaguccuagauagaacacaauuguaaaauuguagagcuguaacauuuuuuuuaaauauuaaaagugaagcccaccaaaaugucuaucaggcuuuauugcugugguuuauuuuuguaauggcgauaauuugcuuccauuuuaucuuaaaaaaaaacaugcuuuaaguuaagacuaagaaaaauaaaauauguuauguuuucucucauauguuaaaucuauauuuuuaaaaaaacaugaaaaugaaggaagaggaaguaaacuuggaagauggagcggcgguaguagaucauguauauacaggaaacuuguaaugaaaucugaucuuuuguacaugcaauacauucuaauaaaaaacaaauagcccaacuucaaaaauauucuagauuauguuauacucuaaaagugaaaauaagauuuaugcugggugugauggugcaugccuuuagucuuaggaacuaggaagcaggaggauaucugugaguucaagcucaggcuggucuuaccuugugccaggccagccugggcuacauuguaagaacuugucucaaauauuaauuaauuaauuaauuaauuaauuaauuaauuaacaauuuaggacaaaacccccaacaaucugucaucauccuuucucucucaauccaacuaauaugaaaaaaauucccuugucucuaauuaguucuacuauuaaaaggcucaauaucuuucauccuuaugacuuuuaaagauaaagacagaacugagaagucuaggcaagucauaaaggucuggguaaauuauacaugcauguaaaagauaauauaauuauauaucaucaauaccauuauauaugaucauauauuuguauaugauuauaucauuucuauuauaauacauuuauuauacauuauaauacauuauuauaauguaucauauacauuauaauaaauaugauugcauauacccacuaucauuauaucauacauuauaauauaugugauuauauguauuuagugauuauacaccgaugauuuuaaauuucuaaggucaaguucaauagagugcuaccaaaccucuucucagaucuacagcauucucuuauuuaucugcccuugguaaaaguuaaaguacggacuuaaaagaacaaauauauacaucuagccagaauucauuuaagagcauuugguuuuuacccacucuuuauauaaauaugacacagaaauuauaccaaacugguauaauugaccuccuggguguuuaauaaccauucuuggaggccugucauucagauagagggguuaaaagagaaaauauuuuugccccuuaagaucaaugaagucccaggagacuguggaucaucuuucaaaauguccugucuccuacuucugaguccuuugcuauggucuuguuacauaggccauggagacaccccugaguagacucuaacugauguccaugguacagaggggagggucagcucagaagaaucuccuuaaugcucccaaacaagccaugaucaaacagcuuuugaccagcucccaccuggaugcaacaccugacaaaaggaauaguggaagagucagagguggcucccaagccugagcgacuucugaggaccaguccuuaacucaccuuuacagaagaagaaaaaauuaauucuggccaccugcaugguuuuaaacaccacgggucaugauuuaaugccagguccucauuuagccucuccagcauccccuccccacacacacccagugaagaucaugaagacaguacucagcagccuggugucuggcuccuuuuguuuaaacaaaauggaaugaugcucacacagucccuggagagaaaucaggcaugacaccauagccagugcccaggacauccaucgucaagguuggguucacacuaccuggccauuuccuguuuccaugucuaguccagccgagcugacuuuuugcuuuauauuucuuucacuuuguaaaacuaucuacauuuguucugugcucugcccacgaaccaggaguuggugacagaagagugguauauaguuucauauucuuuccaauccuggcuugguuuuuucucuguuuuugcauugugugggauucauacagagagaggguggcaccucuguccuucugccuacagaggagccacacucaagagugauucugaaaugcccucuuucuacaaacucuccccuauacuuuucuaugcccuccuuuuugcagccacuugucacuggguaagagugcggcccucagaucaugccucuguucccaccccuuuccagcauuagacuuugggauaagccccuaguccccagugcuuucucuccuucccaucuggaacuagauaccaaggugcugccuuccagggcucugaggaugaagugaguuacuaaacgguaagagcagccuagggccuggcagaagcuaucaucauauucuacccaugugagucucaugucuucaaacuccaaauacuuccaucugacucacuuccacucuggcuuucuggggagacccugaacucuaugagaggagauccaauuaucaaaacuuuuguacacugacuuaaaaucuugucgcuaagccuuuagggccacacacauacacaugcacaugcauacacacacacacacacaugcacacaugagcgcgcacaugugugugugugugugagagagagagggggggggagagguucauuuuuugucuccuuguaaucaauagauuuuaauuuucuguucagauagcugaaugaacacuuuucucaguugauuguuguaaaucaaaacgguacccaacauggaaaugggagguuaauuuucaguccuggcucuacuauuuaacuauuuuuuuuccaaagaauaaguccaagaaucgguguguuagagcagccauaacaagucacggcugcagauagcuaacggaauguuuuaacucacacucugucuuugguugauuaguaaugacuucccaaggacagaggggagagagagaaucuuguccgagugcuuuuggaauucaauuaacgauguccguagguaauacaggaggaugcucaacaacgucugggucauauaguuaucauucccgugcuugguagucuaaacuacucgagggcuucacauccccuugaggaaaugguuacacgaauagauguuugguaucuguuguaggcucaucauuacgcuugugcaaacaauacaaggugggcuccauuaaguaccaaauggcauacaguagguguccaauaguaacuuaaaagcaggaggcaugggcuagagagauggcucagugguuaagagcacuggcuguucuaacagaggaccugaguucaacucccagcaaccacauggugguucacaaccaucuguaauggaauccaaugcccucuucuggugugucugaagacagugacagugaacucacaugcauuaaauagauaaauuaaaaaaaaaaaaggcaggaggcacagugggcuucagagagguucagcggagaauuuauggcaacagugauucugguggcacauagagguguuggguaagaauaacacgggaagaggccuucugcauggagcagcacaaaggucaccagagacagccgcaugcgauucguccuauggcacugguaaauacuuauccgcgaaggauuggagcuagacugcagguggacugcgggguucagucuaagccaaggacuucagcucccauacagaaucccacagaaacccuugucagucuuucacuaaccccgaguguaggucugaacauuaucauuuguaguugaaaugaauuucuaggaggaaagcuaaggcuuagaaaaaccaggcauuugccugucaugugaccugucugucacaugacuugccugucacauggcuacagaugagaaagggaaggugccuuucuaugucucuguauucccaacaaccaugcucuuauuagggaauuuaaaggccugggcuuacaagggguguguuggccucaucaacagacacaggaauugagaaagagaagcaccaugggcacucucugagaugaugaugucagacucuuguggggagagagauuaguucugaagauccaugccauuagucugguuuguuccagcagagagagauuucucuuucuaagaaggaaaaugucaccaggcgugguggcgcacgccuuuaaucucagcacuugggaggcagaggcaggcagauuucugaguuugaggccagccuggucuacaaagugaguucuaggacagccagggcuauacagagaaaccuugucucgaaagacaaaaacaauaaaaaccaaaacaaacaagcaaacaaaaugucuggcuugcgguugaggaacacccacaggaggaagcgaagcccacauuccagagguguuuucagcaacucuggcaguucauuuagcccaaaaaauaucuuaguaaucugaacucuuuaagaggauguuauaaaaacaaaacccacuaccagaugguggggaguugagaaggagaggauccaaagagagaauccagaaugcagccuguagcuuuggcagaagacucacauuuaucuuuaggaagugaagauauuuuccaauuacaggaucucuuaaagcaucugauagcgcuagaccuugcguguucacauuuauagauaaguuuacauugagagacauuuuacccacagcaguucccaucccagacguucauuccugcuaauggcuccaaaucaggaacuuaaccucagugaguguuuccaacagguccuauaaacucagguccuaggaugguguugccauuggugaaacaggcuucugcauuagaggagggagacaggaagcuucaacggggaugucugaacaauggaaacugaccagagacacaagauuagagugcgggagagagcacacacagcguuucuuauaugccggucuauaaguaugggaggaggccgguaggguggauagacagccgcagguuggucuaucggccacaggacacucuuguuuggugacucugccucuuucagucuuuaucccaguccuccugggcaagucagcugagagcugcagacuugugaaggcugagagucaguuuacuguuuaauagaacaccucguggaugcaagaccagcuggauggauugauccuuuaauccucucauacccgccccuauaggcacugaguuguugaaguugaaaagaaaccugguuccagaaugugacaauugaccgagccucaaaaaagucccucuaaauauauguaaugucuuuaaagaucaguucuuauccucugggucaaacgcaaccuuguuagacacaacuuaucauucaaaucuuacauuuuaaucuauauacaucauccuaauuuuuaaggccuguuucuacuaaaccaggaaaguuagugaugagcagagaaagauguucuuaguaugaguauguuuggggagucauguuccuuaaagaaaaaauaguguuaagucacuacaccugaguaacguacaaugucaccaccuggucaggauugccccaaggucucggucggggauccuucuaucuaaagaauuacaaaucccauuggccucucuguuacagcaaauacuuuuagaguaagggguagggaaugggaaguagaaacaugaggugcaggugugggccaaagcugcacugccugccucuguaacggccagaagcaucagcacgcugcgcuuuggcuuuguguuggugcgacuucaacugucucuucuuuuugucagucccuucucacgcugcagaacaaacauacugagugguagcuagaggcacuugauaacugaagauucuauuuuagguugaaguaggggacaggggaaagcauucguguagagccugacaagguuuuacaaguuuuuacaagucccacuuuccuaaaccugagccuuccucuuucucgccuccuuguaaccauucuuuugaaccaaauaaaucacugguuucaaaaugugcgcucagcccuaaggccugcuggcaagaacucaccucuucaccagaugucaguauucaauguguaagggaaguguccucaggucauccugucugacccaugcccccucgcugaccccaugaccuccauggguguuuuggguggcaugguuuguggucacccagaucaccucugcucucagagucaugugacucacccguugcugucagcuucuguuacgcucuccgguugagucagcuggacaagccgaaaggcuuaaaagucacuuaugaggcaaaagaguuuuaaggaagcucuccuccuggagucuaguguucucuacccauacauuaauuuuucauucccgcguuccauuaccgaguuagccuaguguauggauccacgugcucucuuucaguauuuuucuauuauaagugcuuuuuaaaauugaauuuugacauggcuaaagccuucugccaguguuccaacaguucuagaagguccuugaccaagaucaagggcuuggaauuuaguaagauuguaaaagcuaagucacucccuuacacaggaauuuaccaucacuaaggaagaaggaaguuucagaccaaaggaaaaaccagaaacuauagcaguuacacccauacacacguauuuacaauguguaaauuuaaggggaagguggacuauacaagagacuaaaauaggaacuauggaaagggcgcaaagcccuugacccuggcuucuaagauuagugaaucuuaggcagagcccuuguugaucccagcuguuaucaauguauucuaucccaggugguucccguuagaccuuuuguguuugcauugcucuguuuuauguaagauucugguuaccucaauuguaccuugcgaauuugucacccaacuuccuuauguuggaccccaaauauggggaccuccacucuaguccagggacaggaagcacccacgaacacaagaauccucucuuguugcaagaggcuuuauuggcagagcuccggcccgacacguaccucgcgcaggaggcaggggagucgaccccggggcucggaagcuagggguuuuuaaagaagcaaagggcuagaagcaaaggaauuuugacaaaggcaugggauugguucuuuaacagaaagauuacaggucagcaaaaaggggcaucagggcuuugauccugugggcuggggcuuaucuuuguucacauaacaaccaauaaucaauugauguauggcuuuaccggacaccaagggguaauagacagaggggagguuccggccagguggugcugacucagacaagauagcccugcuaguccucggauugaggggagguuccggccagauggugucaacccagauaauguagcccuauuuguccuugaauaccuuuucaucuuuacagccaagauguucuuaggaaugccuuaacaacagcccugcccuggcaugccugagggcuguucugcuuuguucucagucccaggccggggcugugggcuccuaaacaaguuacaauauuccaucuuccuucacuuauuguccucugcauaaaaagucugaugcucgauucaaaaauuacacucagauuccacaugaccucuccugugugugucuguuugucacucauccuacgcuuuguccaccugagacuagagacccguuccacacagacaaaggggcccagagggucugcggcaagcuuccaacuuguuuugcucuaggucaaguucauggcuaggauuauggauuuuguuguuauugcugucccucucccucuccccacacaucuuucccauauuuaaaaaaaaaaaaaacccuccagggaauccuaugugguguuuagauucagguuugucauuuucaacugccuaacauauuaaucagaauaccaugacugcuggagaacuggggugaaggaggaagacauugaaaauguggcagucagcuagauggugaugguacacaccuuuaacgccagcucuugggaggcagggcagaugaauuucuuucuuucuuuuuuuuuuuuuuuuuuuuuuuuugguuuuucgagacaggguuucucuguguagcccuggcuguccuggaacucacuuuguagaccaggcuggccucgaacucagaaaucugccugccucugccucccaagugccgggacuaaaggugugcgccaccaccgcccggcugcaaaugaauuucuaaaucugaggcuaaccucauccagggcuauacagauaucccccccccccaaaaaaaaaagugguguuuagaguuuugacaucuuccucugugcagagaugacacagggguacucagaagugccucccagaguaguaaaaacuggagugggggugggguggggaugggggagaguaacucaugaugucauaggauaggagaguuggcuggucacuucugagaguuuccuacuauuuuguguuuuggaauuaggcaauggacagagacauagaaaguaguauaaacuggguaaaagaagaaguuauguuucuacgggaggaagcuggucauggcaggcaaaggggcaaaaguuccaacaaccucccauguacuucuacuacaaacaacuucaugugucccuucagcaucuuaaaucuccacccagggaggugccuuuuaguauuauaaugagccguagguccccuucagacacacgggagcaugugugccugugucacagauuuacuaggcacaggguaggggauucuacugccccccuuugccucuggcuucuuucguagaaauuugcagauuuuccccaaggcauuccggacuucacccucagcuccaucuugucguaugaguccugccauaaggguuggagauaucucugucugucucaucuccuaacucaacugacaaacccacacguucauauucucccaaauuaugaaagcauaaggguagguccagaagccccagauuugagcaaccgaagugugcaguuacaggagauuuaagcgugucuuccuccuccuccuccuccuccuccuccuccuccuccuccuccuccuccuucuucuucuucuucuucuucuucuccuccuccuccuucuccuccucccccuucuccuccuucuucugguuuuuugagacaggguuucucuguauagcccuuggcuguccuggaacucacuuuguagaccaggguagccucgaacucagaaauccuccugccucugccucccaggugcugggauuaaaggcgugcgccaccacugcacggcuuuaagcaugccuucuuacuuaguguuggagagaagguaggaucugaugcucgccugucaggcaucuucagaggaauggcaggaugcccaaugcuguucuccaacugagacaaugaaagaauggguggggaauggcacagaggugggucaugggggagauacaaguugccucuggcaguugcugggcacucaagaaaaggcagggaaggaaaaaguuaaggacugugaucacugguacaaaccuuggggacacagccccuggcuuauucccguacagcugagacuaucacacggagcaaacagggcauaauaaagucagcccuuggcacuuaacuguuuuucuuuauuccacucuguggagggaagagccagaguuuaaaauacauuuuaauucuuuuuuaaaauuaaccaaucaaauuuauguaccaauaauaucacaauuuacaagaugccaauacaauaauuucagagccaauugauaaugauaaaagcuuuaucccaauaaucuaaccuuacgauacuacagcuacuuguggcugguaacacugguugacgucagcagccaucuuccuuccucuucacguuuuuauucuuaaaagaaccuaggacaucacuucauuucaucuguugucaacuugguccuagcaaagucuggaaugaaaccuuaguuacaaacacagaacuaaugugcucaaauccacuaugaaucccaccauagucucucaguccugucuuccucuggaggguaacaguucagaauuugcccugccuagucauguucuuguacugggacagcagaggccuuugggacauuuguaggauuugguguuuguucaggcuuacgaaccuuuuacccacuggccgcuacuacauuugauaauagcgcauaguacugcaaaaucugugccuugacauuuggaugagcaagcuaaguagaaaaugucucaacaucaggauacaaacaaggucugaagagcccuaagcaaaacugaaacagaaggucacuuacuuacucaaggccuccaaccacuguggcagccucugccugcucccuuauggcugauugacagucuucaugguugccacaauguauccaaccaucccugcuacaauguauccagccauuccugcuacaguguaucuagccaucccagacagccaucccagacagccaauggacuuuauauuccaugagcagugucauggauucugcuguucuggccucaaaugcaagaacugaaggucucagaacuuggggaaggacuucugcuguguggaauguaugucccucugggcuucuccucuccuguuguccuaugacaggcuuuugaggcauaauguaaaccaauacuuaaucccaucuaaaaugugacaugauuauuuuuaaugugacagucccccuaaaugaauucuaugcucucugccuuugcuuccucgauauuccacauuucgagugagucucaaagcuaaaaugaaacucauagagauggaauucugaggugggaugaguaguaaaaucagguagugguucucaaccugugggucgugaccucuuuuggggucacauaucugguauccugcccaucagacauuuacauuacaauuuauaacgguaacaaaaugacaguuaugaaguagcaaugaaaagaauucuauggccggcugucagcacaacacgaggagcuguauuaaaggggugcagugccaggaagguugggaaccauugaaauaggggcugucaaagacuccucaagucuuucuaggguaaugguucuaggaagccuagcguuccauaacacaccucucugcauauaacagauuccacuacuagcugcuuaaaacugagcucaugguccccauaagaguacaagcaaccugaugugguuaaucuuaguuuguccuguuggcacagcaucuacacauguuucaaaaucugaaauacccacuguucaugggucagauuuuuuucucuuuagguuucacuuaaauuuauguuuaugcuugaagaaaaagguuugaauuuguacucgcucaaggggaucuauguuugacuucaucuuacaguguucugaaucacucagccaugucguagcucagccucugugauguuuuguccugucugucuuuguccacacuuucagugcaaacauacucuuggaugaccagcuccaacccaaacuaacggauuuugcugcagcgcacuuccgacccaaucuagagcagcagaguucuaccauaaauaugaccggcgguggcaggaaacaucugugguacaugccagaagaauacaucagacagggaagacuuuccguuaaaacugaugucuacagcuucggaaucgugagugucgccugcuggcuagcuacggaagaguauucacugccaugagggcucuaaaucccgacagcagugccucucaaacuuucacagggauccccuaaggucaucugcauauuagauauuuacauuaagauucaucagaguagcaacauuacuguuaugaaguagcaauaaaaauaacuuuauggcugguggucaccacaacacaaggaacuguauuagaaggucacagcauuaggcagguugaggaccacuggcuuagaggaaaaauuuuaagaguuuuaacuuuuacaccuauugauuuucuguuacucauuacccgacacauuaauuuucgcauaauccuugaaguaacaaaauacaugcacauuaauuagaaccaaauccauugucaugucaaauaguugaaacuaauucuguauucauucucaacuucuguggcugacuugguggauggauguuccucguaggugaucauggagguucuaacgggcugcaaaguggugcuggaugacccgaaacacguucagcugguaagaacugcgcucaugcgggcaccguuugccaauuaguugucugauagagucccaggaaucaacucuguccuuuccucuuccuagcgggaccuccucauggaacugauggagaaaagaggccuagacuccugccuguccuucuuagacaggaagauaccacccuguccucggaacuucucugcaaagcucuucucucuggcgggccgguguguggcaacgaaggccaaguuaagacccacgauggacgaaguaagauaugugagguuuuauugaaagacgagccauggggaaucugaguccgauaaacugugcauccaagugaauucuucauuagugugacaaauucagcuucccacagagaauucuagacuaauagauaaccuuucuagcuuaaaacaaacaaacaccucacacuccugcugugguuguagaagccauuacuagguaaaaccagaguguuauaaaauaucaaauauggggccaguaaaguggcuuaguaaguaaaggcauguuuaccaggcaagccugcugacuugaguuugaccccccagaaugcuugcaaacaauaaguuauccugucaccucccggugagcuccccagaacacucccaccuccauugauaauuuuuuuuuaaucuaaugaaaaguaguuugaaaggggcauuuuauuuaacagucugaccccuuaaaggguacauauuuguuuucauuguuuuaaaauguauuugucauagaugugaucuguucauuuauaagcaaauauuauauuugggguaccagggauacauagcuguugugggaaauauuaaaacaacuaucaauagcucaugcuacaccagggacuggugggacacauggcuccaguggggugcucugaacucggugaucucuuugaccuggagcuccugaaauguccugaaauguaccagacucacuaaguucccuuggcaggucguggccaugccagucccgcgcaacaacugcccacacugaggucagccaccacaacaccuagcaaccugguagaaacaaaacucuagaagcuuauaauuaaucagucagauuuauaucucaguaaauuuucaauucacaggaugcgugcacaaucaauucaggaccaauugauaaugguacaagcugcccaccuagauuagacaaguugccccaauuguuuuaacccuauaugauaacacaucuaccuggggcuauuaaaauuacuuggauucuguaucacccuguucaucucccucuaucuugcuuccuugucccuaccugucuucucuguccccaucucugcagcucuucgagcugccucccuuuuucucuguccaaucacagacuucuuguuguauaaauaauuaaauuaauuggacaggggaaauccugcuacacauggcggucaagauauggugaccauucucaagcuugcaauacaacgaaaucagaucaauagacaugauauuucaguccaguaggcaggcaugauggcagucagaauuccaggaugaccaggaaggguagagucagaauagaguuggguugccagucuguggcaaccagaagauccuuacugaaggugauggcuuagcuaugaucugggaacaggucagauauggguaacaguaaggagagaggacauccuccgaagaggugaucagcacuccugagggaugacucagaggucacaagccuuagcuguaagaccugggcagucagcaucauggaggugagccuuaguuguaagacccugggcagccagaaucauggaggugagccuuagcuguaagacccuagguagccagcaucauggaggucagccuuagcugugagacccugggcagccagcaucauggaggucagccuuagcuuugagacccugggcagccagaaucauggaggugagucuuaguuguaagaccuggacagccagcaucauggaggugagccuuaacuguaagaccugggcaggcagcaucauggaggagagccuuagcuguaagacaccgggcagccagcaucauggaggugagccuuagcuguaagaccuggacagccagcaucauugaggugagccuuaacugugagacccuggacagccagcaucauggaggugagccuuagcuguaagacucugggaagccagcaucauggaggagagccuuaguuauaaauccagcaucauguaggcaagaugagguaaaggaagcaggaggaaauaaaacuuuaggagcuuccaggugagagagggacauucauucucugcuuggaguuggguuuuaucccaaguguacuggagagucauggcauuuggcaccuggaggccaggucacccuuggugugccccaugagaauccucuacuuucuguguuugaaaauccacccauucccaucugacagccuagagagaggcaguggcuaguucacgggugaagucaggugccuugauagucuauaguuucuuuuauuccuuccuucaaauuccuugauguggcucucggaauaaaggggcuucuccaauaucuaauaucuuuucuaauucguaauucuauguuugcacuuacuuuauuguuuuuuaucuuacuuacuuaauuuacuuauuaggaaaaugagagaacauucucuaugauguagagagagaaaaguaaacgggacugucacugaaguuucccuccguguuugugugcuugcuuccuugccguucagguccuguccucucuggagagcacccagccuagcuuguauuuugcagaagacccucccacguccuugaaguccuucagguguccuucuccacuguucuuggauaaugucccaaguauuccaguagaagaugaugaaaaccagaauaaccauucaguaccucccaaggaaguuuuggggacagauagagugacucagaaaacccccuuugaaugcagccagucugaggucaccuuucuaggcuuggaccgaaacagagggaacaggggaagugaagcggauugcaacgugcccaguucuucucaugaggaaugcugguccccagagcuuguggcgccaucccaggacuuaaguccuacugugaucaguuugggcucgucuugggaaguaccaggccauucuuaugggagcaagccaauggagaagagguguuccucugggcucuuuugcagugagcaugaacaguccaaaaagcagugaauccaccagaagaucaagcaaaaaauaaaagcaaacgucacugaaggcacugagcaaauagcauccccgugaaaagacacgagcucugagcuccgugaguacagccaagggaccaacugauggagaauuugaauggugcagauuagcagcaaggaagucuauuccuuccuccaaacagaauaauuucaagagaugcuuuauucaagugaccgccucucagucaaaccugagaagcuaaacuggagccaaucagaauuauccaagauuccggguucugacaaccaaaaccuagcaaagaguagcaggacaagucucucucuuaagucucucacucucucucaucauccgagugagaucuugguauaggugaacagagaaccacccaccuuccagaaccagaaccaccuuuuccccaagccagcagucagucacucaccaucagcagccaguagucaccagcagccaaucaugauacagugucacucucccucugcgcaugcccuacguccuuuauaaaacccaggucuucagggcccaccccuuucuuuuuccauccuugcucagaggcagccuuuuguauacauucccugaccccaccccaauuauaucucucauaugauaucuguugcguagugugacuuuguggcaugacuugguugucagaucauuugcacaagaacaaacgaauaaacaacaacaaagcccaccaucauuaccaccggcacuuaaugcuagucuuucugcuagggauacugacagucuauuugcuucccauggucauagggaaguugcucaaaugcaaagguuguagggaaugucuaauuuguaaauggcgucgggugccuuuggaaggaauuguguuuuuacagccaguugcuacucuuguuuaucgcugguuaaccggucuguccggaagugagccaagucauccuugcuagggcuuuuucuguguagagagggaauuccaguccaaagucugcuucucuguauuuaaauucuuagaagaguugccuguggcauuccaauuguuauauaaaaaaauuauauuaaagaauuacagcacuguug

SEQ ID NO: 5758 - RNA, 9618 nt, Mus musculus
uuuuuaucagaacuggaaguucuacuccugugaguguacuugguucaucuuggggucuuagagcacaggaauuggcauggcuagcauuuaauuagcguggguuggauguuagaacauuaaauacaguuuugacaucugcuuugguguucuccuuaaagugcauuuuaaaauguauuuugggauggaacagaauccgugauauacuuggacauauugaaacaagaaaaugucacaagaaguuaggugaaauccugugugacuaacauggccgaaugguaauucuuagcaucagaacacuuccccucccucagagaagucucaguugagacagcgguuucaucggagugguucucuucagaaaguuuuagacaaagaaauccaaggcuuuugaugugcauaugauuuuccugggaauucauucauggucugggaguccugggagacaaauuuagauggcuucaguuuuauauaaauucauaaguacagcugugcagccucccucacggagggacucuaacccugugaaguucaucgcccuucacaaaggaauucuuuuuccuagugcuuuugauaugugauguacggguggagagggaaguagggagagcagacauuauacaguauccagucccuuucauagccaguaccagagacuagaauauuagacacuaauauuaauagcuaaucaaacucucaauccagaaauuguaguaauagauuuuuuuuuugcauucaaguuuuacuuguuuaugaagguaagauucagacauuucaaaaucugagaugcccaaaaggguaaacuuagaggaguguuuucccucacuaccuagcugauuuuuuuccaaaggcaaccuuauugccagcuuuuaaaaacauauucuuggaggugugcuaugagugugcaagaacauuugggcgcagcuacucauacacccugaaccggugcaccggugcgccuuauauuccgggaucuuugacacagaguggugcagaggaagcuccguccccccucacccccccccccagccaguugagcucgauuagcccuggaaaucaaaggagagacagcugucccagcuagaucacccucacacccacgguuugguuucuuaguuuccuccuuucucaguuuucuccuuugcagcaacagguagcacacuguuugccuugcuguucugugugucgcugaccugccuucuauugagaggcuuaaauaaucuuucuugacucaagaaugcaguaacacccgugcuaucuuaaaagaaagaaaaaaaaaaucauugccaaggccagcguugaagacauuuuaggaccuuaaggcgucagaucuuuuguuuacguuugugaugugucaaucaaguuaauuuuuacauguggugagaaacaaauccucuuucccuucaucuuuccauacuaucagucacugaagagauguuucuuuccucuuguguauuucuuaccuccuagucacgguuuuaguugaggguguacuuagggcuugguuguuucugaacccucuguucugaggcacugaccuggaagggcugcuuucugccaaugcccaccgauuugauuacuacagccuuucgauguugcuuugagaaaggguucugcucgcucaccuucugcucguucuguaauugugucaacuguacauguguacauaagaagaguauauuuguguuugcaggaaguucacuauaaaagaagcaaauaauagaccuuuacaaguagaacauuccuuacagcuucaucgauuuuaauguucucaaacauguccaaaacacaguaggcauucagaauauuaaacugaauuugaaaaacacaacauaaaccccauuugucuccauuuaaggaccaggccuaauuuugaaaagaaagcccuaaggcaccagcuccaggaacagaccauaaauaagaucauaaaacucucucccaaagaacagccuggggauaaccacagaaauggagaaauagcuuaucucagaaugggcccucugugcucagcagccuuaucucauucuacaguugcacacucauaacacaggaaugcagacugcugaccaccugugacccucuagaacccaccaaugaaauuuuagauuacccaauccuucuagagaguucaccccauucucuacaagaaggccugugcaccucugucugggguccccauuucaaagaauaguuguuucugcagaauaaaugcucuuuguuuuugcauagugucugggucugggggucuucagcgauuuuuacaaacucacaguauugggaaauucacauuuuguggcugugacaagacacaugauuaaaaaacaacaaaacaaaacaaaacaaaacaaaacaaaaaacaacgacuuaagaggcugaagguuuguuuucgcuugugguuugagaggacagcgcaucauggcaagaagucacuguggugggauugcaagguaacuggucucauugaguccagucuggaagcacagagagauggacucuugggcucagcuugcccugugcuuucgauuccuuucgggaccaucaguccaucagacggugcugaccgaaagcugugcuuuucugaagcuacagugaagagugacgauuaggggauucuagccagcaaacagcuccggcaggccuugcccuguuccccuauucccuccgucuugcuaaaaaccauuauguucgguuccugaggcuagccaucauggccuaguuccuuauuugcccacuuucuccucuaaggcuaacuaccaagguccagcuaucaaaagcucccuugggcugcccuaauuagccuguccaaucaaaauuaaaugccucagccuaacaugagguuucuccuuuugcccuuauaaacugccauuuaccuuugggccacagucuauccucugucuauucaggggcaguccuucccacccccaccccccagacaaauaccccuguucccucucccuguuuccuuccccuucucccucguccucuaucuccugucuuugucucuuauucccugccuucugucccuuugggaaaaauaaauuuccuuuguucugagaacuuggucuuggggcuucuugucccuuccacuaucaugccuggacuauacugaccuucauauaacaaugacaucuaaggaguagaauuuauuugggcuagaugguuaauaacugauuaggacaggagccuaagauauauauagauauguguguguguauauauauauauauauauauauauauauauauauauauauauauauauauauaguacacuagaaaucugaaaucuaaaaucagugucauauuuuuauagaugaagacgcuauuauguggauuguagauaguaauccaagcuuuguaaaggcauaauugucccuugccuguauguaacugggccuuagcccagcacccuauguaguaaugauccagcaauggauggaugaagacagucuucucuaguccuguguuuucgugauuuuccuugcauugcacacuuaaucagauggguuuccauugcacaaccauuauuuguguaacaaauaaagaugugacacaguuucauaucaauaagugaauauugaauuguggcuuuuauaugaauguuugguaugacauuuucaguaucccaaggcucaagaaaccgaugcuuccuuaaauuuucugccuuguauuuuaauauauauauugauuuacaugcugacaguugauuagaaaggguggcacuagugcuugucugaacacccaaggaaauuacuugucucucagccaaacuuaguuacguuagaucuggucuaacguggagaaucugaugguuuaaaacuuuguuucaagguuccgucacccccacauacuagagcuggcugcauauuucacggagacugagaaacuuugucugguuuaucccuauaugagcaacgggacgcuuuucgacagauuacagugcacaguaagucguggguaccagucccuuggguccuuuggcuguugacacuggaggaagcugaagggcgagaucugagcaugcgcauugggagugggcgggguauauucagcaaugguucccagggaagcgaaggaccucccaggagauugauuucuuacccuuagaaggcggcuugaacacauggguuccuggguucuggguaauauuaacacauauguacagugaguuuauacccacuacccucagcuuccuuggcaugugguacucagaugggcauaggguuagugcguuacgcaugcuaagcaaggauucuaccgcuaagcuguaaccccagggcacuggccacaguuugacuaaacuaauguuaaaaauuguuggguauuucccuagagccgugguucucaaccuuccuucccaaugcuuugacccuuuaacacaguuccucauguugcgguguucccccaaccauaaaauuauuuucguuguuacuucauaacuguacuuucgcuacugcuaugaauuguaauguaaauaucugauauauguuauauuugauaugugaacccuaugggacuggcagccugcagguugagaaccacugcccuugagcuguagaggaaaacccauuuggaauuaaaaauaggugguagcaaacugaaauguugcuucgccucuccuuccgcagugccaucuacagcgguggcuguuguguuuuauaaaaagauagagaagagaagccagggauauguuugguggagacgugauaugaugugggggaagggggcgccucugcgggcccaugcugagacaucccuucccccugaaguaccagccacagauggcuuaguauggaauagagucuauuuagggcauggggggggggggggcugagggaguaguagagacagaagggggguggggaguagaagcuggccaugagcacguggagagagaaugagaaggggaaugggguggggagaggguaaggggcaagagcaagaggagaagagaacaagagugagagggggcaagcagccccuuuuauaguaaggcacauuuggcuguugccaggcaacuguggggcggagccuagacaaaaugcccacaguggcuacagaaccauaugccugcauagggaauauauagguaauuugcacuaaggaaauacaacuaagccgacuuguguuuuucuuuagaauggcacaaccccgcuuuccuggcacguucgaaucagcguauugauaggaauagccaaagccauccaauacuugcacaacacucagccgugcgccgucaucuguggcaacguuuccagguaaaugaccugagagcucuggguuccaccuaaaucccugucagcccugcaggugaguguucuuuucggccaggccucuuccuagaauacuuaggagugcaauaaacccucucaccuacguacugaaagucucacuuuuuuuuuuuuucucaacaaaaauguguuccccagauuucuagaaaucacauuuacaucucaaaggggagacugagaguaccuuuaugaacuacuaaugaauaauuauguguauuuuauuaauuguacuggauagccagaugugcaauggaaccuauacugaccuccucgcccuaucucuuaaguuugagguuuuuuuaaaaaaagauuuauuuauuuauuuuauguauaugaguacacugucgaucuccucagacacaccagggcaucagaucccauuauagauaguugugagccaccauguaguugcugggaauugaacucaggaccucuggaagagcauucagggcucuuaaccacugagccaucucuccagcccucuuaagcucaaguuuaacaaaaagagacacaauguauguauauggggauucccagaguacaauagcagugaaucaaaaucuuugguccuugacucaguagagucuuacuuguuacaaugaggcugccuccucuacccucugggccuuucuccuugucauucugugagaagccagcauggauccagcaaucccugauccaaugccacauacacacauuccgaguugacuccugcaguaaaauccccugaugauuuccuccuuguguccuuauguugagcucauccagaaggcccaggucucaccuuuccugugccaggggcagcuguguuugcaggccgcgccucucccagaccauuuccuaguaccgugaagguuuuuagcgcaccuuuaacaugagccgaaggaguggauggcucacuuuuucuggagaaauaaacaugaaagaagaggucuguagauuucuccuuaauccuggggcagcuaggaaaacggcccagagaugccuguuccugcuguaguguggaacuucugcaguugucagagguuucccagagucugagcagaaucaaagggcuccucacaggaccuggauagaguggacagugauggucccaggggucagggggcucaccagugggguccauuccauguggcugagaaugcaccccccacaccuaaaaucaugucucuuccccccagauuauaaucacuaaugaguacaguaacuauacaaauauuugcucuauuuacugaaggagagcaguguuggagucuugccugcgccuucuuccucuggcuuaaagugagcacugguuuauuuuaaaucucacauggugacgcauuaauauuugguucccuuuguguggcucaguucaucacuuaguucccuuucuugaaagcagcguuugcagaacagacagaagaguauuucucaauaggggagagaaacaagggcauccauaaacugaggcagaggaagcaucaggccagggagcgcaacagauggaggcgcacccacuuccuaaggcuucuuccagguaacacuagggaaggagacuaggaagcaucuauccagcgccucguccaucccgugagacagucgggacaauuuaaugaggcucggucaggaugaaguaaaaagaaggcuagagauacagcuuaggcaugaaguacuuuccuagcauauguggggcugugugcuccacuucuaguacagauaaaaauaauaggaaccaucgcccggcgugguggcacacgccuuugaucccagcacuugggaagcagaggcaggcagauuucugaguucgaggccagccuggucuauagagugaguuccaggacagccagugcuauacagagaaacccuguuuugaaaaaccaaauuaauuaauuaaauuaaaggaaccaaacacauggguaaaggagggaggaggggcuguugggguacuggcgcuaucgcggcucuaacugaugucauggaaaagccucugaagccgcgguggcuuuucaaagacaccaacaaauagggcagggcaugccaggacuugcgcugugucccguccuggagcagggcuguaaccugagggcagcaucucccuucuuccgugcucaguaccagauggggacucgguuauguucgugucuccagcuagguagggagcaagagcuagccugggaauggggcagcaaugaugggagcacagaagagucagucccagagaguucugaaagaggagaaccgaaaccauucaccuggguucuccuaccucccaacucaggguuccccgauguuuaaaucaggaagaccugagggaccagagcuuccuuuuaagcugcgacccugggggacagcacagccucugucuuugucucuuaaaaaaguccaaauagaccaauaacuucguuucuuaagguuaaauggcauauagugucucagugccaaggagagcacacacucagcaaaugcuaccuccuguacuugguccagagguguuggcaguggcagaggcugagaugggagggacagugaguguucaugcucaccacuccuccacacacuuccagggucagcagacaagcucugccuuugaaagaguugcuugugucuuagugagugcagguggaacacguugggagucaaguucuuacuugaucaaaaucuguugugugcaaaguuuaauggagaccacaguaggccaaacauagaaaauaugucacauuaacacauacccagugauguguuuauaaaaagauaaagagaggggggauauguucuauggagguguagucagguauggggggaaaggggugcggggggggggucaugcugaggcauccuuuccuccugagggaccaguuuauucagggcauggggaggggagugaacaggguaguagaggcagggggcggggaggggaaggggcugggagggagggaaggagcggaagggagggggaaggaggagaggggaggggaggggaggggaggagaggagaggggaggaacagaauaaaggccagccauuagcauguggagagaggggaugagagggcagagggagagcaagagcaagagagugaggaggggggcaagcagccccuuuuauagugggucaagccuaccuggcuguugccagguaacuguauggaggagcuuagagagagugcuaacacccagugugugccugggcugaguuggagcuaaagaagcccaagccaaguccuagaggaaguauggguuuuuuuguuuuuuuuuaaagauuuauuuauuaguuuauuuauuuauuaauuauauguaaguacacuguagcugucuucagacacuccagaagagggagucagaucucguuaaggaugguugugauccaccaugugguugcugggauuugaacuccagaccuuaggaagagcagucagguggucuuacccacugagccaucucgcuagcccuaugggguuuuguuguuguuuuguuuuaacacaaaguaauugaaaguagcagggagaauacuccugguggaggcaguaaauuuguucaagggggucaaagcaaagaacugccucacauacagcagaagccaaggaagggaggaaggaagggagggagggagggagggagggagggagggagggaaaaagguuggcuuguuggcuggagaacagauggaauuuggaaauaaaguaaauugaggugacaaagacagaacgugauggucaagggguugacggggcuuaagcggugacuagguuagagaacuagguuugauaaguaaacucaaaggagagacucaagcuugucuugaggacaaguaggaguagaaagauucguaguuuccaagacaauagcccagguacuuaccuugcuaugcuaaauuuaacacuguuuaauagcccagcuagacagaaucugggugauaaacacgcagaagcugacagauaagcaaccaguaagagagcagaguguguggaaauacagcgagucgcuuauuuacuuuauaguuaggggaugaacucaugauuguucccugucuggcuguuaccauuuggaucuuauguguaucugaaagaacaugcaugguggcucauccuagcacuugcgagccuaggcaggaagauugccaugaguuugaagccaguaugcauugccagacugucucgaccagccaccuucugaauaaagacaaagaggcuuuauuucuuuaugaauccuaggccuuacagcuuaggcauguucccagcuagcuccuguaacuuaauaacccauuuauucuaaucuacgucugccacauggccccuuaccucuccgucagucccugcgccuguuuccuccuccgugucuggcugcgaauca

SEQ ID NO: 5759 - RNA, 5568 nt, Mus musculus
cucugggaaaugcuacacuuuauuauuuuguuuuaaagauuuauuuauuuuauguauaugaguacacuguaucuguacagaugguugugagcuaucaugugguuguugugaauuguuacuuaggaccucuguuugcucuggucaaucccacuugcuccggucagcccgaucgcucuggcccaaagauuuauuauaaauaacuacaguugcuguccucagacacaccagaagagggugucagaucucauuacagguaguugugagccaccaugugguugcugggauuugaacucaggacuuucagaagagcagucagugcucuuacccgcugagccaucucaccagcccuagacuuuaucauuauuuuaagcuacacaauauugaaauugaggaucacuuguuuuacacaauaaucuauacauguaauaguccaccugagcuaaaggcugguggucuucucagugucugaaaacccuaaugauauauaaaagaaaaugucaaacuccaagaucuccacgcaaaauaucauuuauuaugaauuauaaaaaaauaaacacuucaaguaaguacuacugguaagauccacugauggccuuuuuaagacuauuuuaguuauuagugcgugggaaggugugcauagaaugucggugccagugacggccacaagagggcgcauccuugggaguugguuuugagccacccaacaagaaacagaaguugacucuuccucaggcucuugauacccuauuuuugaauaugauaauguaauagcuuucugccuauacuauuuugauauaagcauguuuaaucugaggaacugaguacaauggccauucuguaagaucaaauaguuauaaccacaucaaugcuuacaauacucagugccaggcaguauccaaucacaacuucagcauaacauucuuucaucaccaaagagauuuuauucaaguuucuaacacaaaugaguuauuuugguuugaauuacagaacuaaguacaaacugaaaacaaaguuucuggguuuuuuguuuguuuguuugcuuguauuuucaagacacgguuucucuguguaauggagcccugggugcuuuggaauugcucuguagaccaggcuggccuugaacucacagagauccaccugccuccaccucuugagugcugggaugaaaggggugcaccaccacgccugucucccuugccagucuuuaaggucuaccaggccaggcccuucgcggccuuugcucugcuuuucccucguuucuuuucucucuuggccuucagucuuuuucuuugccucugguucauccacacuggguacuggccaugcuggucuagaagagucuuucuguuucucuuaauuucaguuuccauuuucaugucaucuaaauuagaaacaaggauaaaaugaggaguuauuacauucacacgugacaaccccguggagucgcaugagcgucagaaccacauggaggcugaaaucaaaacaaagagaccacucucuauggaagcccuuacagcaaagucagacauaagccacacgugccgcugcaugcuccuaaauccaugugugcacacgugugugugcgggugcccacggaggaagaagagcgugcagucaggucccuggagcugauguuccaguuggcugugggccaccugacacaggagcugggaaaugaacucugugaaagcgccaagugcugagccaccucuccagcccugaaaguuaacaucguaagcagugagugagugagugagugagugagcgagcgagcgagcgagugagugagugagugagugagugagucuggucuacauuuaaaggaagcacagagaggaaaguagaaaggcugggaucaagggaugggcgacaacuucuggccgugggguuuaguguaacaaguaaugcuuuggugcagacagaggggacaaagacaggggagacagcugcauuuuuuggcugaggaaacuaugcagguugcacaguccccagcugcaacggggacaugaagaggaacauacuugagggcagaaggagcaagcuuuacuaauaugacuaaaccgaaggacuccccucgucuccacuucuauucccauuuagcuccugaaagauuacaagugagggcaccaaggcagucuccaggcagaaauugagagaauucuucucucaggaugcugaggaaaaaaaagaagaggcacagacuguaaaaggagauuauccuuuaaaaaaaaaaaaaaagccagaagccccccuuuuacccuacaagccuccacgcugauggacggcuccuccucacacccugaugcuuccuccacccccaguuuccaccccagcgccucgcugcagcgacaaugcaccagguauuugggaaaagggcuagacaagcguggagggaacaagggugaaagcaaggcagcagaacucaagagaauguaacaaacaacgcagaaauaucugaucaaauuacagaagcaaacaacaccccgacaagauacgauagcuauccacuaagagcaggaaguuauucaagggaauagucaaaguuaaaaauaaaaguuucggaauagaaaaacagaacaguauacuaagauccuacaugauaaaauuaagaaaauuagggggcuuuaugccaagagacucaaagaugcccagaauuuauaaagaauguuuacaauccacacagacagaaacaaccaaaccuuaaaaacaggcaguuccauugcagugagauauuugaggcacugcuagguggcuauaaaugucuggcaggugcagagaagagcaaagcauuacuguaugagccacguuccaucucuaagcccauacuccaaagcacugaaauuggguauuaaaaacaagcacacaagcaagcacgcaaacguggacacuaagguuuaucagaccacagaagcacggaaaugccccagaugccaacuacaaacaaauaaaacguggcacauacgacaaaccaguauugccuuuaaagggaaaaauugauaucugcuaaaacaugaaguuuagagugagacaguaagcuacaaagcaagccauagaagaccaacggcaucagcagcuguccgucucgggguuggaaggacagggagagaaacuccuaggggggcgcagccaagaaaagaguugcagaggugcugugugugcugaaagggacacagccaguucaagucucaaaccucucaggggcagcggaagcagagcagaccaacagaaaccagacaggaggguuucucuuuggaagaaugggacgcuaacacuucggauuaagcacuaagaacuuugggguccuuggccuucaagacaugaacacacuucuaccuuaagagugccuuuuaaaaaaagaccuacacugaagcuuugccugcaugucugucuguguggaugucagauccuggagcuacugacaguugugagcugccgugugggugcugggaacugaaccuggguccucuggaaguguagucaaugccccucauaugagugcuuccuuuagcugccaagcaggggcauuaaaaacaaacaccccuuucuuugcugaauccagcauuauacagagccuccaaugaguaacaauacacaggggucucuaaaaagaugcaaacaaaagugagauucugugacuuuccaggguaauuaaacaucugccuagaugcuaagcuccaucccgcaguaccaucagugccuggggcauucaagcugcuguguaauugcugaagauccauucuaaacagcucagcgaugcuauucacaaacacugacugugaaacagcuuagcacagucucuaaaagaaacguaagcuuccaaaggauaaagacgugaacacaccagguaugugaggugcauacagugagcacaggacagcuccaagugugauugaagaggaaguguuuacugucgaaaugagggaagguacagucagaagaguccagagcaggagagaaagaagacaaaacaucgccaguggacugaaccaggccaugagaggagagaaagugggguggggguuggggaggcaagagaggaagagaagugggguaaaggcgacugagaggaacgagaggauccaggagccgagagaagcacggccgagacggcaguguuauaugggagugagagggaggcuugugaaguggagacacuuggggguuggggggaggagcugagaggaaccagggugccagcauguacuuuauuaucuaauaagcuccacagcuagccauuuguccccaguuucuuuuggacuugacacuagggacaaguagaauggguagaagacggcuuuaaaaagacagagagagaccgaccccuaagagaaaaguggaucauuuuuuagaaaaaccauguaaaugaagaccgaggcucacccuuuuccucaucugcgccgucacaccgcccuuccucacacugcauuuucuccuggcgagguuuggcuaccaccacgguugcuaucuccucaacgucuuucauuagagcauccccguccacucugaggauacucuucagucuguugagcucccuuggcgcauucuucuuucucuucucggcccgcaucuuccucuuccacuuacuccgcaggcuuuuagccaugcuucaccuggcggugaacagaaacacaaacaaaagguuuacugcucacacccuugacuggcaaggacguggccaagcagccuucucuucagaacugggacagauggaagagaaguugugcugugcccucaugcuuagcuuauguaauaaucagcgcagagcaugaaaggacuaaguccggacacgucaggccccuuuaaguaggaacaagucguuaauucaagccguucucaaagagcagcuaugcauaguagacacagaaagcgaacagcuccgccuuaaaaucaccuauugcgcuguucuuauccaauauccgucaccacaucuuuagugugaacuuuuaacagcuuaaaccauagcucccugccuuuuaaagacuccuccccucguguaucaaagcucaucccgcuccucucgggccuccgacuuacucucuagccccacacgcacgcaagcuccaguccgcacaacgcccacuucaggaccgucacaucuccgaucuaggucuggaaauggcucucccuaaggcucgcucugauccuccgacuccugucagcuccuuucuaccaaguucggcuucaacccggagcuaccguccccgucugcggacugcggggcugagccggaucccccggggccaccgcucugcugcacaccguacaggucacgagaaccgugggguggcugggugagguccccugagcgucagcaaucaccagugguccgugugcgggaccccgagccucgcccucccgagccccgcaccgagcgaggaugcggucaggucucgccgcggaggcaggguccgagccaguccuucacgccgcggaguugaguccaaagcccacgcaacucaccugagagacaacaccgcgcaccacgcgugggacgccaaccggaaguacaggcgcuuccggcuuccguucaggggccagcgcacagcaugccgggauccuugagaggcg

SEQ ID NO: 5760 - RNA, 19675 nt, Mus musculus
ucuucaguccgugaccaagugaaugcacucagcaguuuccagggauagcucagacgagccaggagagccaucucaccguaagguaaagcagguaaugccuguacauuguagaaagagggacugugcugcugccucaucggacagagcaaggcaacauccaagggaaagucugugcgaguugauuucagagccaggaagggguucccaucagccaccacgggcaggccagcacaguggaagccaaauuaacugaagccaaacuccauuggcacucugucucccuuccuuauugucauuugguuuggugacacaaagugaucuuuuuccaagaaucggggauggguuaacuugcuggaacugguccaguuaccugacagggaaauuugcucagcaugaaggaagaguguguuaguguugcuugcuugcuuguuuguuuucguccucuggcuuagugggucuugacuccuuugugguggugguggugguggugguggugguggugguggugguggggcugucaaaugacucauucacagagggcuucaugucagauacccugcacaucaaaccuuuauauuaggauucauaacaguagcaauaugacaguuaugaaauaacaaaaauaauuuuaugguugggggcaucaccacaacaugaggaacguauuaaagggccgcagcauuaggaagguugggaaccacuguuuggcugaacauuucauuacuaaaucaacaccucucacucuugugguucugagagggagggacggagggggagaagggagggggacguaagauaacaggguagaaagacggacucugagcaacuuuugacucccagaauuuaccacuguggaagguguaucaucacggcgcuggcuauauucaaaaacuuauauccuugcuagucaguuggaguuggggucuccuuguauuccuaaaagccuacagucauuuucuuugauuuacuugagacucaucagaacucauuaucuagguucuuauaucuugguuuaauucuuguuagcuuucaucacaugaacugacuuauaagaaaaaagauaaagagauauauaaaagauaaaaucauaucuaaaaaguguguuagcuuucuauuacaauaacagaauaccugagggaaucaaguuaaaaagaagaaaauguuauuuuaucucaacguuuggacauuucaggccacagagguuuggcuuuuuugcuuuggagaagaaaaauuuucuuccaggcaaugagaggauuuagacauuacauagaaaccuuucugaaaauguguuccauacagaagacaaaaaugugucaggcugggucagguggcuggaccgagucucugcggccaaucucauucugcacuaggggcguggauuguuuugagcugugaacguagcgcucucuccagcugggcaagaaaugcucagcauugagaucucugacuaguaaucaugccuugauguaaauaugcauaaacauuguauguauaagcaggcucgaaaugagcuguucuaaauaacuucuuccguguagcgaagcaauguaccaugggugaaaauugaguaucguggguggucacagucccaacggcaucaggcggugagcacagagaccacucaggacaagggauuaaaggcaagaaauguaugaauuuccuuaguagggagccaugggagugaggggagaacagugggaagauagagauggaugggcuguacgggaaccuguacagcauccguagagaaggccagcaucuucauccugccaauaaaacauaacauaagauuauaaacuccaucgcuguugaggcuacgucuuacauuccugugucguaugcaccauaauaauguauagcucucauuuguucuauagucaaauaugagagcgagugacaagaaaaaaauaagacaagggaaugaguaacuagcguuuaucccagguaccuuugcaucugcagccuuaucugaauacuuuagcguuugaaaggaauaaaagaggaauaaaaauuaacauuaugauagacgaggauuaagagggguaucgguagagccuauuugaugucuacuuuccucgaagucuaaggagaaacaagaugcuauuugauuugugaaacacuugagccuucccauguagccuaggcuagccucaaacucgggaucuuggcugccucagccucccuaguucugagauugcaagcauguacccguguaccuggcuugacauauugaacuuaaaacaacaaaaaacacuuuucugagccaaacaguuaccauaaaagauugguuuuucuagugcugauuugcccuuaaaauauauuggagacguucuuccuaauccugaucuuuaaaaaauuguuacuuuaaaauacaguuuucucauuuggucaucuuuugcccucaugaagcgauugucccagaaauauuuuaguuauauauucuuuaaaugaugccuuuucaagcaagcuggcaaaacacugacuuucauuuaaaauaaauaaauaaauaaauaaauaaauaaauaaauaaauaaauaaauaaaugcauggggguaagcggaaugauuacccaaaaggccucccucuggggccaugugguacagagaucuaguggggacgcagacuagguacucugggccagagcugggacuuccuaacaagugaccuuguagcuuccugaaggucaccucaccuacucgugugaaacucaauguuccuacuucagacagccauugugagacuuaugccgggccccuguguauuaaaucacuucauugaauacguacuguacugcucccaucugggcuguagaaacacaaaauuaagucaccucagacauuaccucaccugaguuauaauuaaagaugcucuuguuuggugacgugcagaagcaggguucagaccuaugucccuagaaaaggcuaaacaguccuaagcuaaaacuucgucguaguuguugugugaccgagagcccgcuggagaagcugagguagauaauucugggguugacauaaaguuccacuuggguuuggaauugaguaaguugggaagccagccagccacaugucccuauucuaaaauagggacagagaccucguaauucacggauucaggaaaaaaaaaaaaaaaagucacgaaugcacagaacaguagggaaggaccaacaagaaggcauccaggaugcgugagaauguggaaaaggaaggauucacuuccaccaguguugaaaaugcuucacgacguaagcuaacucgaucgggaauagcuuggauugaauauuaagcuuccuccaaggaaaauggcucugcagcugaagucagccgcacgccggugccgagaagagaguacuggaucuuggggucuaggagagagaggggucuggugagugccaccggguuccuaccucauaaaccacccaucccuuuguagaucuugagaacgugggagguuaucccuaaaacuaugauucauucagcuuuuaaaauucaguuuuugugaccaccuguucuaggaaauacuuagguagcccaaugacucucucaagccauuucagagcugggugugaugucacccagcacgcccauuaucaugguagaauucaaaaccugccucagcuacacagugaauuugaggccauccuggacuacauaagacccugucaucaccccacccacccaccccccaaaaaacccuagaaaaauagguaaauaauauaaaauguuacaugauucaguguaagaccggaaacaauguuuuuggucaaugaagcaagaauugacucuguaucuuuuauggaaaguaaaauauaaugaaaauaaccacacuauuuccucucauaaauaccguacauaugccaggugugguggugucugcuuuuaaucccaacacuugagagguaggggcaggcagaucucuugaguuuaagaccagccugguguucguagcaaguuccaggccaaccaaagguauauagugagacccugugucacgggguguggguguggguggggguguggguguaauuacuuugcccuauugcuucauggcucucagaauccccaaaauaugcuauuuccuuuuucauaucugcucuacagugucaugggcuucagaccccaagcuguucauauggacguuaagacagugauuugcuuugaguucagguugaccuagccuuggauaagcuaaccugugcagcaguacacugaagguuagagagguuccuccuugucuugauaggaucaugucccauuaauacaaagcauuucuucuaaguuucucgaugcugcucuugguggcgauggugaagguuauuuucuucaugagcugaauuuuagaaguuuggaguggaguccagggagauggguuggugaauaaggcaacugaagcacaagcuuagguaggucccagcuucagggccaguagcaucacauagaagccagguauguuggcucacgacccuaacuccucgcugggcaggcagagauggauggauuccuggaaugggccgaucagccagcccagccaaauaagugagcuccaagcugacugaaagucccugucucagaaagagggcuggcaaugcauguagcuggugaauaaaggcuacuugcugucaagauggacaguccgagucccauggaacccacaugguaaaagagaaccaauccccacagguuguccucuggacuccuaucuaugugauggcagccauacaugagccucugugaaugaaugcagacauaaaauauguaaguguaaaaaacucuauuuagacagagaacuacugaggaagaagacacccgacgcuggcaucuagacuccacgugcacacacacaugugcaugugcacacacacacacacacaggugaacacagauacaacugugucucgacacauacacaugcaucuagacuccaugugcgcacacacacauggaugugcacacacagaugaacauagacuccacguguaugugcacacacacaugcauccagacucuaugugcacauaccagugaacauauauaugccacacauacccaugcaucuagacuucacaugcaagaaguuuaaaugaagggaacccaaauaaguucuuucagucucuuguggugaauucuccaugcagggagaggcugaagaccagccagcugcccgcacugagcaagccugcugugugcacacacucaguagaaacagaaccauuggaguugaaacagguugcugccucuucaggaaaacaaucauuaugagaucucccacuguuagaaggagaagauucugagggaacuggucuaccugggccucgacagcuccuacugacuauuggcaucauugacuauuggcaucggccccuaagaaagagcugaccuagcagggcuuggcccccacagugaaccccacccccaaguaggccagaaagcacagcuguuccguuggggcuggcccuggacuagacugcuuugucuagucuguggacgugaagggguuuccucaggagagagaaugaauggguucaguuuguuuccguuucagaaauaaacucagggagauuaaaguuucuaugccuuaguuuccuggugagaaaauaaaaacaacgaggaguauaccuuccuugacaagggauaaaggauuuuuaccucucuguaggauguguguguguguguguguguguguguguguacagcauauuauauauuuaucaagauuuaugaaaacauaaagcuauccacucuagagauuaauaagcagaguuaucacucaguccugaggaagauggaguggccagugugugucugcuucccugucucaacacuuagcucugagcuaagugaugcuccaaggcagauaagaaagaagugggcgcgauuuguugcccagaaagcauccagcuggcaguuuacuuccuuucuguuuuuaugaauggcggucauauuaugauuuggucuguuuuuccugaccagagccauucauaaaacuaaaaacaaaacaaaauaacaagaagaagaacagcagcagcagcaacaacaaaacuuucugggcacagucuggagcaaaugggugccaacggcugggaaaacaucccagcggccuuaaccgcaacccgcguugaaggcauucaagggucuguuuguuugguggccugagaaguaagaagugcugugucuaaguguagccgggagaaggucugugacaugaacuaggcugggagccaaggcuggcaaaaguucagagauugucuuucuccucacugaagugucaggaccuaauucauggaaaauugggcgagcuggcagcccucucggaguuucauugagacgcgcuguucaggacucgcaugaauggagcuccuuagccaaaaaaggagggggcugacgagcggucggagccagacagccuucgagaaugugugugcauucgaaacggucugggaggagaaguacagguguaaguggcaggggaaaagaggaagaaaggccgucucgacuuaaaagcgacccuuugaaaaugagcacucucucggcacacacuucugacuccuaagaggcgugaagcgcacugugcuuccuggguucaagucagccuagggaaaaaaggaaacaucucaaaaccugggcuuugaugcuguuaucucugcugugaauuaaagucaugaggcagacuuuuuuuuuuuuaacagugaaaauaucucuuuuuaaaaucucauccaucuuuuaaaaaaaauacucugcuaauuuuauauaaugauuucaagauccaagaaaaacaucacucccuuacagacauucuguauuccgaacacagugaguuuaacccaccucccgugucucugaaggacuggagcaauuucaucucuuuggcuugaaucucuaagucaaagguggcucgguuauacuugcaaacuucaggaauguguaaauggaauuaacagggcuuauaaucagacacaacccugcugucaggaagugaguuagcaaaggucugggacuucagaucugucuuuugucucacugaagaauaacaguaauuucuggagcuugauuggaaaauuaauucaggcugcagagagaucucagaaguuucacucaaaaggggaaauagauauuauggauauagauaugaaaauaaacuauagaucugagaaaggacuauauccaaagcagcagaaggaccccuaggucuuuuagucaggguuucuauugcugugaugaaacaccaugaucaaaaacaagcuuggugggggggcgggggcggggagggauuuuuauucagcuuacacuuccacagcacuguucaucccugaaagaaaucaggacaggaacucauacaaggcaggaaccuggaggcaggagcugacgcagagggcauagagggcucugcuuacuggcuugcuccccaugguuugcucagccugcuuucuuauagaccccagguccaccagcccaggauggcaccacccacaauggucuaggcucucccccaacaaucacuaauuaagaaaaagcuuaacagacuugcauacagccugaucuuacggaggcauuuuuuucagaugagguuucugccucucaaaugacccuaaccugcgucaaauugacaaaaauguagccagcagaggccucaauguuggaaaaaaaaauuuuuuuuuuguuucaucuuguuuuuuaaugagcaaaucauuugaauggaugacuacuuaguaagcacuugaaagauguuucguguaauuagugaggaggggaauucaaauuggcauuuaacuuuccacccgguuggaagucaagacuuaaaaaacgacagacgauuaacaagcgcuggcacauccguggggaaaagauuagaacacucucucccgcaccaguggugggucuauaaaauagugugccugcuuuggaaagccauccggccacugcucaagucggguggggguggagcauugccauuaccacucagcaacaccgcuccuaggugacccacaaugaaugaaagccuaccgugguggaauauguccaugaaagcucacaggagaugcucucaguagccaagagguggaaacagcccaaguagacaccaaccaaugagcauccagauaaguaacaugggggaguacugcuugccauacaaaccaguuaacuguugacgucauaggaguuguuacaaaaggguugacagauuaaggcagaaaggauguaggugggcguacgguucaaggacacacaguuccguaguggcuggggaaacgagggcggcaggagcccgaggcagcuggccgcuuuacucucucuguuuggaggcgcagagaggugagcgugguugcucagcuuccguacuucagucuggaacacagacagugggaugcugcugugacaacuucgagggcgggucuucucucuggcuaaaacuuuuccggaaacauuuucacagacacacacacacacccagggguguguuuccauggugauuguaaauccaaauaucucaaauauuaccauaugacuuucccuccucaccuggaaacagagagagagagagagagagagagagagagagacagacagacagacagacacaaaagcaccuguugcaugauucuuccacuaugaaaugucugaaacaaggcaauuuagguaacagaaggcagacugaugcuaaauuaagcucaggagguugacuaggaaaguggagagccauggggaguggcuacaaauagauacaaaguuucuuuuauggaaauuuaaaaauguucucaaauuagguugcggcgcuaauuaugcaccaguugcguaauaaagauuccucucaauucacugacuucaaaugagugaauuucgugguuuguaagcuuuaucuugguaaagagucuuccaacucuuccaguucuaugauagcagacuuaaaaccaaguuauuccuauagcaagccuauuccgauaugaguacuaacccuauucugucauuccuccacauguggaggcucucuaacuuagaugaacuuccgggguguucaguuuucuccuugcuuugcagguccccagccacacugaaugaacucacugaacacucagguucuucccucccugggucucccugcaaacuaacaccacuucuuuuguuuguuucucccucagccacaacaagucguucagaagaagccugcucagguaagacacgcccccuugugauuauucucaaaaaaaaaaaaaaacucaagcaaaauacauauggagaaagguuuccaagccuuuaauuggcauuuucuuauucugauuaugacaaugucgaaaaagcauugaacauuuguuguauccuucagaaccaggaauuauauauauguauguaugugugcguguguguguguguauguauagauagauagauagauagauagauagauagauagauagauagauagagauagucugagauuauauuauuacaaacuccagacaaggccagugaacuaauucagccgguaaaggcacuugcuaugccgacuucuagugccagaguccacuugcagggcggccauguuugugugcagauaaacaaauccgugaacaacaggaaaccaucagggucuuuggugucaaagaagcaucaguaauguacaaaauaaaacugugucagggcuguaaauaaauauuuuaauuuuauuguauguuuuaccaauacuuuccuuuuggguuuguuuggugucugucuguuuugagagaaggucuuucuacaaaguucugguuuuguuuguauguuuguuuguuuuaagauaagguucuucuacauagcccuggcuguccuggaacucacucuguagaccaggcuggccuugaacuaagagauccgccugccucugccucccgagugccgggauuaaaggugugcgucaccaugaugggguugcuuuaccaauucuuuuuuuuagguuuuuugagacaggguuucucuguguagcucuggcuguccuggaacucacuuuguagaccaggcuggccucgaacucagaaauccgccugccucugccucccaagugcugggauuaaaggcgugcgccaccacgccuggcugcuuuaccaauucuuaacugcuaaguuuugucuuucccuccugaccaccuguagccccuuugacuugauacauaacuuacuaguuguaaaugacucuuaauaauaugacugaaaauagcugaucgcugacuuguucugugaaauccuaaaacaccuccagugagggugaucaacugggaauuaugucaauguuucccauuccugaacucucagaucuugcuuuuaaaaaaaaaagaaaaaagaaaagaccuaacucuauugagguaaaaguacccuuacuucuuuugguccaugaaccugaagauccuugucuaagcuacaguguauauauaaaagcauaggauuuguguuuguugaagacagagaucuuuaagaagauauaacuaauguauaaauuaaucacaauuuccaagaauguaaacuaaggagguaugagaaucccucuccugggcuaggcuacaacucaguggcagaggcuugcagagcaccugggagcuccuguucuuuucuucccguuuggauuugaacagacaugcagaacacgaagguagaaccuauuaaaguaagucacuaaauaaucccaugggucaugagguuuucucuuaagucaucauguagaccccccuuuacauaauuaaaaauagccauagagauguugguuucccuagaaaguugucucucaaaagaauggugcuuugcuuagacaaaacccacgcaggcagccccaacgugcgcuccucuaacacuacugcuugggauaaaaguacaguuuucaaagacauauaaggauacagggggagugacuaaaauauguacaugcauuguuauugauaaaugcaaauuugugauaagacagcagcaucaaaaaaucacuuuguugucccaaaccuaaaaacccagcacaauuugaccaguacuaaaaauauccagugucguauaacuaaauaaaaugcgaaaaaugcuggauaaggacuggugcuguauauuugagucagaggauaucacaggccucagcauguaccacagucuagagauuaauaaccuugugcgguuugcaagcauugauuccgagucuacucuucggauuguagggaaggcgcacugaacaaaaaaaacaauguuuuaagagaagggugaaaugcagaggugagguuccuaccguagccacagugagagaagaaacauaugcuuacacaaaacaccuaaacuccgggacagcugugagcaucucuuuugaauucuguuucuuuacgggagagccuuaauaccauggaaacuggcauacacuugcaauccagaccuagagaacguguuucaaaacgccuacgagcacuggccacgcacaccauccauucuguugacuugguuuggagaccuucgcauggguauuuauuuucuaugagccgucuacgugaucccgaugggcguccaagaacaaacgugcucagugaugaaaggaaaaaaaguggcaagauguucggacauuuguuggaugagcaaaugaccacagaaugucaaugcagauguaaagucaggaguaagggaaaguagagacauguuauagugaaggggaagucaugugcaauaguggaguauuacaguguaggcuauauacauagaaacauguauguauauauauguauauauauauauagagagagagagagaaaauaauaguauauauuauauacacuauauauagaauaguauauaguaaacaguauauauaguauagaauauaguauacaguauauaguauagaauaagauauacuauacaucccauauauuuuguguauauagcaauauauacaugucuauacauuuauucauauauacacacacacacacauauauauauguguguauauauauauauauauauauauauauauauauaugcaauugccucauagguagaaaucacuaaugugugucuguaaaggaaaguaccaaggauaauauaagugaaaucucucucucucucucucucucucucucucucucucacacacacacacacacaaacgcacgcacacgcacacccaccagggaaucagaaucuaaaagaagucacgggggaggcaauaggcgucacugaucuaucuggcugucuuuacagacguucuucagauuuucccuuuaaaggaaagcagcucagacagaauuagccgcgaggagaacacagcucaucggaguaucuaauuuauaucgucuugaggcacagugaugaguuauguaaacauggguacuacagggaaguucguggaggauaauguaaauuuuacagagcuaaaugcucucuucccuuuccaucuguuuccuuccacacauacacacagacagagagagagaugacguuucccugggacagugugcacugacucgggcucacgccuugagcugguggcaguuagcacaguuaagugugucacauguaaaacgagauagucaugcauacgaccugaguguuuccuucuggccaucccugggcuuuguccuguguauccaucuaggaaacaaaaauggccuaauaauuauuguucccuaauucacaagaaaaagcaugagaaaugcauaauuaugugaauacccaaggaggauauuauauuagaacucguuuuauuuggcugcuaaguuucucauaucucaugauuuacauuuuuaaaauguuuaaaaguuuuaauucaaaaacaucccccccacgcacacacaccucguguuuuaauugcauuuuuuaauguuuuaaaauuuaaaaaaaaauaagauuuaaaaaaaaaucagaggaauuguauagcaauugcuaaauccuguaauugagaugaaagccaucagaacacccuuccuuauaugaaugucacaugaauauuggauuacagaugcucucugguaaagagugcuugcaguccccuggauagggacuagcaagcacuguaaggucacugugaggggcaaguucagccugaugcuaacucucaacaucuguguuuguguuuguaagcacauguguuuauaaaaguuuacagcaagcucuguuaugcaggggggugaguuuggagaacgcaccaggugccaugaaucacaaaccucaagucugccccacaauccuuaugggcaggagcucaucgcuuccacucucauggguaagccugcgggguucacagugaccccccccuuuaaaugcccaaaccacagaaaacaaagcuuacuagaagcucuacucuguauuuuaaaguccuaaaguaagcaaugcuuagaaacuagcugauuacaaaucggcaaagucuucagcaauuugaaauaaguccucaccacguauauugaaaacuuguuuuagaaggaaagagugauaggguuuuuuuuuuuucuucuucauguuauuauuauugacagaagauacgguuuuuccuccuguuguuuuuagcucugcuuucuuaaaaagccccgcuagcuuuucuguguccuacuguuucccagauacacugaaucaugcuuacaaguggccccuuauauauaauccagacuuugcuuaucaaagggaaaacggggauuuuuuuuuuuuuuuuuggcucuguuuuguuuaauuucucccagcauuccuucuuucaguauuugaaagcacccccugaguuacugaaacaggaauaaaccuucucuuuucaacuucccaucaagagaacuaaaaacgguucagcuucugaacggcuuaaaacaaagcauuccacuucgaaacagacuucuuaccuguggggaucuuccacgugugguguggcgcaggggcgagggaauccugggaaaccccguuguccuguggcgcucaccccuuccaagauguugaauguuuucacagaaacuucaagggugguuuucgaggcuguuuacaugacagacaaccuaaacaguguuuggagcagaaugagagguuucguuuggggacaggcaagcugauacauuguagccagcauauccuucucaaagaaggcauguuuacugggugcuuuuagucuagacagaccaaggaggagggaggacgaaggcauucucccuccagugcucaccuucuaucuacaugguacguuggccaaaaugccguaaacgguucguaauaaaucagacuuacggucaccggccggcucccuugggagccuguaauuuauuugccuaagucauaaagagcauugauugacuuauuccccugcucacauuccuccgagcugguaaaacauuuugugggccaauaaauguuuggaccgaguggcaaacacgaaggaucccaucgaaggcuucgauguuuugcuguauaggaaauaacuucuuuugacuucaccucugaccccuggcauugcagaggucaagggaaaaggagagagcgaggcugaaaccagugcguaccccagcuggagggccuagcagcggaggggaggcgaagggcagggggagcacagaaaaaugguccugauuguuaacccuaaacagaugcagugauuagcuuagcccacaguccucgcuccggacggagcauuggcagguaaggcccgcugcuuccaggcugggguuggcuacagagaauaaaguagcuccugaauggaggggacaauuuccaaaccucaauggaaggcaaauucagcauuucuggacuugacagauuugcugucgucaucguuauuguuguuuaguucaguuucccagcuguaugaguuagcuugcccaagaaagagcagugcuggcugguccuccugcucacaucacagauggucaucccucucuccucaccuugauguaagcuggaucaaauucaaauuuaucacguaucuaaauaauugucugcgcuugucaacccacguuaaguauagagaagagcaaggagcugucaagccuggccguugugaaccaguccucaguggauccaacagaaugggcugccuggcaggaaagggucaccgaacccucccguagcuguggaaucaucacuuaauacuacuacuuaauaauaauuaaguagcaugauacuuauuauacuaauuacuuaauaauuacugaauaauacuaucuacaacgauuguugacuuuuuuuuaguauuuucauucaaagagucggcacucagggcagagcuggggagaggacacagcggcuaaagcgcuuagcacacaaaccucaggcccuuagaacuccgguaaagguccagugggcacuguagccugcugaugacagccucagagggcauaagucauuggagauucuuauagcaagcagguuagcaaauacccauugaccucugccugcccaugcacaugcagauuugugcaugcauguaugugcacagacauacgcacacauacacaacacagagaggaggugggggagagacauauacagccaggugguagugguaaugcgugccuuuaguuccaucccugagcuugagggcagccaaagucuuguaccaaccaaccaaccaaccaacuagccaacaaaaccugcucaaaaacaaaaaacagaaagaaaagaaaaauauacaaagguuuauuacaaccaguaugaacuucugugauuuuucacccuccuuaccauacacaacacaaagauucauauugucaccugccaccaaguuugcaaggaagucucuuccacuacagaccuccuaucuacucuuccacccccaccccccccccccaacuuaagccccaagcuccauucuuaucuaauauggcucacagccuugcuuguaccaauagacaccaagaguucacucugagcaccaagcgauccccuuaagucacuuaaggcaugcccaaaggugugagcauggugccgaaccaacacgaaagagggacauauugggguuuuaucagcaagcuuccaaagcgauggcagacuuccauguguacaaaagaaaaccagggcagaaugagugcaauuaacugauaguuauaacaaaaauauaguucccugacuuccucccaccuguuuuaugcugguuguucuaauuagcagugaauggcagggacauguuuagugucucgugcauucacugagugacguccccaugcaaaucugcuccgaaaaguccgaaaaguuuuagcguaacauuccagaagcugcguucugaacagguaaaccuugaccagagcgcugguauuuggcuuccccaguccauuaaccagccccuaaugaggugugugcaacucucaggcacacuaugucaaucuccuuagcauuucaaggcugucaugggaacuuaacagcagucaaugcuccuugggaaauggguggcaaaugggaagccaucuuuagaaacaucuggagaggugcaagcuaugguccagaacccaccgccacaucugcuaaguaacuaaagaggauugagccuagauguugaucucugugguggccauaucaucccuuuggggacagcagagacagucacuuaucccagauaccccuuguuucugucugucccuugcacagcacaggagccauggguuguagguuuaguggaaaggaggacuagagucaguuuuacaaccauaucuuuguacccaacucgauuuuucuuuucuucuauuaguugcuuacacccuggggugggggugguggggagagccacacacggagcaaaaacccaggucacuuagaaaggugagaguuggaaagagcuacccacccuaccaguaucacucucuuggccaaccuuggcauuguuuuggggggaggccagcagaggcuaggccaagcaauacgcucuccacuaacuaaaccucugagaaacccaccgugccaaacuuaugagagccacauugccacccaacguuuaguggagugagauuucccacccugagcuccuuguuaaguucccaauccuaauugauaguuagaagcagaagaauuucaaggucagcggaaagagacauaaauacagccacucuccguguuguguuaagagcugcuaagcaaaagaaucaagggacugucccguuggagcugaguuguaacuaagaggauuggcuauugggauuuccagccgcucagguccagcaaggcuccugggaaccuuccgcaaggcugaugacauuccaucuggcgcaaagucuccucccguaagcucauagccugagaacgugcuaugaucuucaaguacuuagguuucuagaaagaagacuaucaagcugauagaaacggaauaaucauagcuccauccaggggugguuuccgcuugacuucaucccauuaaaucugcucccugugagagggugaggugggacacagcuaccuacuccucugcuguggucucuuccagaggagcaaccuaaagugaguccauaucuccugucauaaggggaagugaguccauaucuccugucauaaggggaagugaguccauaucuccugucauaaggggaagugaguccauaucuccugucauaaggggaagugaguccauaucuccugucauaaggggaagugaguccauaucuccugucauaaggggaagugaguccuuugggaggggacaaaggagggaucugccaaacaguuuagugacuuucaggaauuuaaauauuaagugaaaagacagggucagagggcgccccauccucggcuugucucucauucgccugcccauggcuuugaucaugcuacauccuccuuucuaaccaggacuccguugagaaucucggggucauggccuguugccucgucaagaugugaagcccacaguuuggcggggccugggaggcgaagggagguagcuucaugcguuccacauuucccacagaaccaaaagcagacuaaacaaagucggugugagcucccgugacuggaugccgcugcgauucugcuuccgaagcugcaauccauucauuuguauguguguuuauuccugggauuuacagcucccucggucuuuaagggaagagaaugaaugcuuaaaaccucuugugaaggacuaaggaagucgugggcuguguagcaagccaggauagaggcuccacgacucugugugugugugugugugugugugugugugugcacgugcucgaauucaugggagggcaugagccuccugccaugaaggcuucucuccuccccuccccuccccuccccugauuugcuaugauuucgaagaagcgucacacaugguaacauuuaggaaccccuucacagcugaaguguuucagacacuaaugaaugggagcucgguuguguagcacagacgggcucugaggcauacuuuacugagugguauacuguagugaccugggaaaggaagcgggguauaaauugugucaguuagccacccagacgaaaugaagccauguggaaaaucaaaucuauuaaaguaugaaggcuguuguaagcuggccauucuuaaaggggcuucauuggcugcuggaguaaauguuuaccccucucccagaucuguuucacaugccgucuuuggagccagccggcagcguuugauaaaaaucauccucccacuaacgacacucuuuaucggaaauguuuauuagcuccgcuuuaccgcccauguccugaaagguauugcagguuuguuaaauaagcagaaguuaaaaagaacuuuguagcucacaccagcuugcaggaaccccaacaaauuccagagccauaaggaaugaggggaaaggggggcugggguggaguuagauuuauaugggcgagaggcccugagaaaacauauauauuagguuuucucugcuuggcuggcccaccguuaaauguuugccugauguugacggauuuaguauugagauugaacaguuaugucaaacuuagcccauugccucaaaauguguuuuaauaaauguaaaaauaaggaaacugcucucaggagcaauguacuugcaggaugggucugcugucgcucucccacagccuuggcugaggaguuguauaccagcccuguuugacccaaaccugccccuacuugccuuauauauaagggguauauuguuugucuguacacuaaggaacccaucuaaaaaaacacacacacaucuagcaaacgcccaaacagcaucaacuagcaaaaguucaaauagcaucagcuaccauuaccaacauuugguggguggguugacuuucaagagcagcuuuuuaaacccgaugacuguggcacaccauggggagaaaccaacucuuucuuggugagugaagucuccagagaccccacaggcuacuucugacgguaaacaauugaauuugcugaccagcagccauggugccuuaagucaacagugacaaaaaacagcccaggaaaaaagacaaccccuugauuccucaaugacacggguugagugccugggaauagaggucaggcagugucccccaccauguuccgcuuaagcaagcucagcguggugcaggcgacuccugguuacaggagugguacucugggcaagcauuguuccccaaacaaggccuaacccaccugccuuccguguguugcaggagacugaagagacauccucgcaagaguccgcagaggaggauuagggggcgccgacauucaauuucuaccucagcaucaguuggaucuuuugaagggagaagacacugcagugaccaguuauucuuaacugccacggucuu

SEQ ID NO: 5761 - RNA, 2734 nt, Mus musculus
cugcgggaacagggcuuccgcgcgugggcaacccguagcagagcccccuggcagcauccaccugagaccuuuacuguagggucagggcgccugagagcuaaggaccaaaaguccuggccuguaccaaagaggcugugaagugccaguuaaggugugacauggucgcucuugugccuacugaauacccauaauacagaggaccaccgacugcgucccaggggucgcaccuggaggggaccucaccacacccacuauguccaggugagaauguccuuauaaucccccacuaugugugagugagugugugugagugaguguguguguguguguguguguguguguguguguguguguguuguaguaagauucagcaaaagggcagucccugaaauuuuacuugaacaccauauauggagucaaagcaggccggaaaaguuuucgcuccagcuagagcuguuuuacaggacauuccuccucaccuugacucaauauucacugauacaaucucucccccaaaccccaacucacucucucucucucucucucucucucucucucucucucucucacacacacacacacacacacacacacacuuacuuuugcacacuguccaaagaggaacuuugauaauguauuuuaagggcgcuaccucugaugaccaaaaugucagucccagauguuugauuacaggccaagcgcgugcgaaccugacuuuuuuuuuuuuuuuuuuuuuuuuuuuuggcacuaaacuccacaauuaaucagauccaaaugacccucucucaagacaaugaauguaauuaugccuuaauuacuauaauauauauccacacacacccaaacaaauguuugacaggaucuggagaugugggauguuauacaauuacuucucagcauauuaagaugcugcaaaagugauuaauugaugucaaacacggacgggggaaaugucaagcagauuuagaggguggauuauucuaacaugaacuagagggggguaauuuguccaucacgccgcgcuugaagaugcuuuauuugaaaguuaguaaaccucauuucuaaacaaacucgauucuggcaacacaggaaggcccccaagccaaaacauaguguauuugcaaucggccgcuucuaaaacaucccgugaauuacacccaacagaugggcagauuucgcuucacgaauuagcaguguugguggagcuacaggcagauggccuaaggaaacucaggcuggaugaguucugauagagcaaagagcuuuaaaggcccauuaauauuacuauccagcuauguaccugaaacgcacagugggcaggaacgggaaacucgaguauccccguucccauccuccgucccuccucccucgcuguuggagcuuguauuacguaagcagccauuuuucucccuccuuucccugcaacgcgcagcacaguccuuccccauaaucuaaauguuuaaaacaaaaauaaaaugagugcagccauuuauaaacuuuagauaagaacucuccaugaagcggggagggaggagcacauuuugaaggacugcagcaaugguggcuaggccuacaauaugucuguacaguggccgugagaggcggagcugucccuuugauugccuggauuaaguacaucaaggcuagaagaaggaagaauagacuuaaugggugcaaaguaaauggcagaccugaagcuauauauuucacaccugaugucucugauuccugacaaauuccugcagacuuaguaugccugccugucuugcaguuaugaagaccuaggcacagagccuaaaccaggaggauagaggugguguuggaauucaagccccaauccacaguguguguguacauguuuucaccauguuaacauggucuguuuucuacacacacacacacacacacacacacacacacacacgcacgcacgcacggagccaccuucaaagaggaugucccuuggggucccucugguuuuaaguaucugucaggcacucagguuaccucagguacaggagguaaagacucacauagaaauuugagcggaggcuuaacugccuugccagauuauccucucugggccuugcagguguggaccauaccuuugauggcucugcaaagaggaaagacgcuauccucagacuaccaccccggggaggucuguaacuuaggugcugacguuuaagucauauauccccacgguggguguuccucagugccuuuccaccaugggcuuaggaacagccaucuuacuaguucuuuuaaguauugcuugauuuuaaaaggccugguggaaauaaucacaacccccccacccccaccccgcaucccaggucaauucucccaugggacagaggcacacuggcaaacauggacaucggaucucccaugggacagaggcacacuggcaaacauggacaucggaucucccaugggacaguggcacacuggcaaacauggacaucggaucucccaugggacaguaguacacuggcaaacauggacaucggagcaggcguguagggguccuggccaguugcaucagcuuacuggacugcuguaacuacuaaauuaauguguuugagaucagaguuuggaaaauauaaacaaacauaagcaacucuugggcagcagagccagacacggcuggcuacagcucugaagccucgugguuuuagaacacaagauuaauuuaauuugcacgacugcagcuccucaucucucugccuuc

SEQ ID NO: 5762 - RNA, 55924 nt, Mus musculus
agagaaaauggcggcggcgacggcggcggcggcgccucagcagcucucggaugaggagcuuuucucucagcuccgccguuacggcuuaucuccgggucccgugacggagagcacccggcccgucuaccucaagaagcugaagaagcuucgcgaggaagagcagcagcaacagcagcaacagcagcagcagcagcaccgggcggggggccgcggcaacaagacgcggaacaguaauaacaauaacacggcgacggcgauggggggccggccgggcuccggggaccucgcguacuuacggagccccgcgggccucggccgccugucggccucggcugccgagagccccguggcaggaggcuccgggggcgcggcggccguccccgcggcgggcagcaaagugcugcugggcuucagcucggacgagucggacguggaggccagcccgcgggagcaggcgggcggcggcggcgcgcggagggaccgggcugcgcuccaguaccgcgggcucagagccccaccggcgcccccggccgcgggcgaggugacgggcggccacccgggcgagcggaggaagccgcacucgugguggggggcgcggaggccggcgggccccgagccgcagcccccggcggcggggagcgacggggccgcggaggacgcggacgaggagcuggcggacggugaggaccgcgaccccgaggccgaggagccgcugugggccagccgaacggugaacggcagccggcuucuccccuacagcagcugccgggagcacuacucggacucggaggaggaggaggaggagggggaggaggacggcgacguggccccggccagacagguauuaaaggacgacucccucgcccggcaucgacccagacggagccauaguaagccguucucggcgcugacugcuaaaucuggcggcagccggcaggagacuucgguucagggagggggagcacucgcgaugaaugacagggcggcggccgcggggagucuagacaggagccgaaaccucgaggaggcggcggccgagccgggaggaggaggaggaggagggugcgggugcgauccaguggacuccauuccucgauaccgugccggcgcgaagaagcuggccccgcugcugucgccuccgagucccgauggggacuccaccuuggagucgcccacggggccccuccucaaaaccaauaaucacauaggcggcggggccuucggcguggauucccccggucuguaugccaacagccucccucccggggccaccgccgcggccgccccuggcacacucaggaucaaccacgccaaccauacuggcuccaaucacaccuaccugaaaaccgccuacggcaagccgaagcucugcgagcccgaagaggaacuucuccagcaguuuaaacgggaggagguguccccgacggggaguuucagcgcucacuacuugucgauguuccuccuaaccgcugccugcuuguuuuuccuaauacugggacugacuuaccuaggaaugagagggacgggaguacccgaggacggaggacucaguaaguauuaagucaaccgccccccucagccacccacacacacccgagggccagauuaccaaaugcagccuagcuagcggugaccuugaccugcaagacauuuacuuaacagugaaagauauggcagaauucaugccucguuuuucuuuugagaaggaacacuuauugugccaauaucagaaugauguccuagggcugguuuucaaguuuuucugcaugguucaaauuuaaaacaacuuaagaagacgacauuguaagccuguuaguaaaaggagcuugaaugucuuaauuucuuuuaguuuuaaauaacagcagaugucuuuugcucgggaguuuugaaguguugccauuuuaaggcagcgccauacaugcaguguucucuuuuuaaaugcguuaggauucuagaagauagcgugcuguuucuugaaauucuggcacagacaguguagguaguucucuaaguucuuaaaagagaaugaauguuaagaaggcagcaggcacaccuccuaguucacuucucaggccacucccacuccugaagaaagucaugguagcuuagcaggggaccuuggagucaacugugguagaugacuguaggcaggcauguacguucauuaagccagcaucuuccuccauccugaggacugaguaaucaagacaacagauaaccauugugugcccugugaggacgugaggaugaaguaauuggugugagcuguuuuagauuguguggucacgggggcuaccuuucgagcauuguagagagacgacagaacacugccuggcaagggucacaggaaggggaaaggacuugaguggagcaggagacuugcuuuggaggaaaccauguugcaguugacuaugaugagguuuaauaaaauagguuuaauggacugcuaaguuuauuugugucccuucccauucccccuggagaguuuucuccuaguaggaauuuggaguaucaugauuuguauuuauaaaggugucuuccuuccugucuaauuuacuccacagugaugggauaguaaugugguacuguuagcaagcugaguaguaaugagguacuguuagcaagcugaguaguaaugagguacuguuagcaagcugaguaguaaugagguacuguuagcaagcugaguaguaaagcgguacuguuagcaagcugaguaguaaugcgguacuguuagcaagcugaguaguaaagcgguacuguuagcaagcugaguaguaaugcgguacuguuagcaagcugaguaguaaagcgguacuguuagcaagcugaguaguaaagcgguacuguuagcaagcugaguaguaggagcuuugaucucaguauagcuaagaccgauagacucuaaacaagugacuacaguguugcuuaaugacaggggucacaagagcagccaucacuucaguuggcucucugggaacaggagugaucuguauccugccuuaaauguuugagagcacacacacacacacacacacacacacucauucucucucucucucacacacacacacacacacacacacacacacacucauucucucucucucucucucucacacacacacacacacacacacacucauucucucucucucucucucacacacacacacacacacacacacucucucucucucucucucucucucacacacacacacacacacacacucucucucucucucucucacacacacacacacacacacacacacacacacacucauucucucucucucucacacacacacacacacacacacacucauucucucucucucucacacacacacacacacacacacucauucucucucucucacacacacacacacacacacacacacucauucucucucucucucucucucacacacacacacacacacacacacacucauucucucucucucucucacacacacacacacacacacacucauucucucucucucucucucucucacacacacacacacacacacacacacacucacucauucucucucucucucucucacacacacacacacacacacacucauucucucucucucucucucacacacacacacacacacucacucauucucucuuucucucucacacacacacacacacacacacucauucucucucucucucucucucucacacacacacacacacacacacacacacacacucauucucucucucucucucucacacacacacacacucacucauucucucucucucucucucucucucacacacacacacacacacucauucucucucucucucucucacacacacacacacacacucauucucucucucucucacacacacacacacacacacucauucucucucucucacacacacacacacacacacucauucucucucucucucucucacacacacacacacacacacacucauucucucucucucucacacacacacacacacacacucauucucucucucucucucacacacacacacacacacacacacucauucucucucucucucucucacacacacacacacacacacacucacucauucucucucucucucucucucacacacacacacacacacacacacacacucauucucucucucucucucucacacacacacacacacacacacacacacacacacacucauucucucucucucaaacucaguaaaugacagaaccuguuuuugccuuuguuuuucugaccacagugucaucugucuggcaguuaccuucaaccuauguaaagagugucuuacuuacucuucaacaacucucaggaaaaggugguaacuucaguuuaugaacaggauaaugaaauucaaguaagaagugucuaauugaaaguuuagugcgucaggggacuaugauuuauaugaguuacuaugguuucagauucuuuucuauauggcaaagcccauuuucuuaauauuuuguguguuuuuuguaaagaguuauagauaggaggguaccucuauugugccuaagaguagaacauuugauaggauuucaaauggaauuuguagugacccaaauuauuaaagaucacuuucauaucuguuucaucacuguacgguggaugauuaacguuuuguuauggacuuaaauuucaaguagaauuggauaggaugcuagauaggagaguuuccuuuaaaagacaagaacaagaaaacccuccuuagcuucauucauaaagagcaugguacuuggacauccugaauggaaacaagagauaggaugaccaagggcuuggcugagagaaucaaacucucacuucuuuuuuuuuuuuuuuuuuuuuuuuuuuugguuuuucgagacaggguuucucuguguagccuuggcuguccuggcacucacucuguagaccaggcuggccuugaacucagaaauccgccugccucugccucccgagugcugggauuaaaggcgugcgccaccacgcccggcucaaacucucacuucugagcuaagucauucuaagagguaacuauuaagcaugggaugacauuuauuuagaaguucaaauaaaauuugcuguauuucugguaaaguauaguauauauaacaugaaauaaucauuaauguaaauuacauuuacgucuuaauuguuuuuaaaucuauuuagcauuuaauuaucaucaguuccguuagauacacugugaagcagcuggcucagaaguuugagucagaguauccugaaccaugaugcacuugacaugguguaagccauaguagagagaaguuccugcucguucaguuagucagcucacuaacaccguuaggguugucagggugagcacuuacacucccuguauucugaauugcuuguuauaaugucucgcuguaguguucauuggucaauuguauauguuuuaaguuuuacuucaaguaauucaccggaagauuguagguugcauguggcagugagcuuuauugguuacuauugaaguuauacaauguauaaugucuuauauuuuugguugugagccuagccuuuaacggcugagccaucucuucagccuguauaauggucuuuuaaauguuuguuugguaguuuuucuuaaguaaaauguucuuauuuauuuuggucugcguuuucucauuaggaucuuuuuuuuuuaauuaaaccacuuuuacucauuaaauucuuaguuuucucuuauaucugcagaauuaggugauaaauuagaugaucuaagcuuuuuccaauuccaaggaugaacauucuaacuuucaaaacuacuaucagaacaccucacagauuaaccugcaauaauugucccauaggugauucaaucaugacagcucacugaaagaacagaaaggaagcagaguagauugccugcugcagauucauggucauuauuuaaacaucccucuucaacaagagaugggauucuuguagacaauuugaagagagaugaaacaaaaaacugaguguaauuauauauuccccucuuucuaauuuuguacacauuuuuauuaauuuauaacagggauauuagcuccuuuaauagccuugcuccuauuuuuaacauaaacauagguguguuguuuucauucaaaugauauguauaaguuuuacuuugaagugccuaccaugcuaagaacuuuucaacagcaugguguguguugagcaauuucaugugugguacaugaaauccucaggaccuacauccuaguaagaaaggcagugacuuuagagagcuggaggagggggucuggcaaauacugcaugcagguaggcaggccuuucugaaccaaggucagaauugccuagaggguuagccauugacaagaagaacacucuuggcagauagaacuaguuuguguguugaagggucaggaagacuacacgugggggaagucacaauggaggagucugaauuuuaguggcaacauuauguauuaagcaacuuguauuuucaguuaacauuauaucauagguauccuuuccauguacugaguuuaaguguaaagguauauuuuaagacuuucucucaccacaggucuuuuucucauccuguaaaaguguuaaaucugcuauccuaaaaauguacacuuccauauucuacuuuaccacugcucgcuucacagucaagagucuuucuccacugaucauuugguucugucugcuucacagucaggaguauucuccucugcugaucacuugguuuuugucugcuccccccccccccaccaacccccagcaguucuucuuaaucauucuucagucaccaguuagccagcuuccaugucucugccauuggguugacucugcacugcaguccccuuggauaugcacuccugcaaacucgcacagcaccacugucucccagcuuucauuuuugcguaggcuuuaaagguuuaguccuugcaacuuugucuucagugccauccuuccuguuucccugggguggguguuucauccauucuugaggucuugccucucaauuuguauucucucauaaaugucccuucugaauacacaucuuucagauaucccaaggcacagccccgccugccgucuucugugcagucauccuguuuuggccccucucuucuuugguuugauagcaaugcuuccauacauagccagaacucaagagagagaggugggaguuuaccuagauuucuuccuucccucgccuuacauguucuguccuguugguauuuugauguucaguaccucuucuuuguuuucuuugaaucagucuuuuuuguuguuuuguuuuucgagaguaacaggguuucucuguguagcccugacugucuuggaacuugcucuguagaccaagcuguucucuagcucagagaucccccugccucugccuccauagucccgggaugaaaggugugcuccacugcugccugguucagucuucguuuccugucacuucuguuuuuagguuagcuuuugcccaggcucucucuagcuagcagaaaggucuaugcuucugggcaguagccuuuucaguccaucucugcuagagaagaauccuaaaguauauucucucuugcuucagaguccccagugacucucucacuagucagauugaaauuugauucuauuuccugucuaccuucauuuccuacuagacaaugaguauguaauggcauuuugugucuuuaaacauauugcccauuccuugguaauaguuucuuuuucucucuacuauuuaucuuaaaaguuugccuugugaacucagacacuucauccuguuuaucuaaguuuggacugucaucacucagaagaacuucuuccccccacccgcaauaagaacaacuuccuucauagcguccauuaccccaugcgauuguaugggcccaccaugccagacagcuuagacucccuugguuagucuuuguaggucggauacaggcuuuauuauucagcuguagguuugaauuucaguucucugucaguucugugacuuuacuagaaauguaauuguuggguuaaacaacgaaggggcuugaugccuccgugggugggggggggggcuuuacgaguuaaaugagauaauuuauuaaauguuuaguguucuugaagauggaaaucacuuuaguauucuuggcucuuaaugaauaagugauuacauauaaaguacccaacacagggccucuguauguguaguuacacaucuguagauuuaaccagcuaccaaucgagaauauuugacagaaauuugcaucuaaauguguacuguguuauugucuaaauagugugguacaguggcuuuaucuagcgauugacauacauuuauauuugguuguuuacauaguauucugcauuaaaaguacagaagagggugaauggggggauauacagaugcuaugccauuuaccugacggacaccaacaguuccagauuuucaguccaggagccccauucuucaugcagacuugagaaccacuuuaaguauacacugaugggcuccgaaugucucagauuuuacuccaauaagaguauaugaaaauaacucauucucauagacauuuagacuacaucaagaucagugguaggaaguaguuacgaaucagccugaauuccaaguuuggacuuaguuuaguagguuaagcaauggaaaucacaggggauuuagauggagaacugacacaaacuuucaaggaggaugaugaggugggcuggggagugcagcaacagacuuagagaggagagcuaugagaagcauggcguuggucgauaauugggaauggaguaguagggcuuaagauaauugcuuugaagaaagaaguaugcuuguugauuguucuuuauuuucuguguucagaaucaaaggauuauuuuguggucaugagcccaaaugacuuaggaauauugauaccguggagaagaauuagagaugcagaagaggguuccuguuuggaaaauaauguauagaaaaacuuuuguuuaggaguguuuuucaaguucaaguggaacuauccuuugggucacgauagaaacgugguuguuguaaagaugagagacuggugcugcgugugggugaauucgggacuguccaauggugaaggaguagcuagcuuuucaaguauaagugucccacuuugugagugguggcuaaagacuuucagucuuuagaggaauauugacuagcggacucuagaaguugaugccugguacugacaugggguuaaaacuugaaaaugccgggcaugguggcgcaugccuuuaaucccaguacucgggaggcagaggcaggcagauuucugaguuugaggccagccuggucuacaaagugagugccaggacagccagcccuguuucaaaaaaccaaaaaaaaaaaaaaaacaaaaacaaaaacaaacuuuugaaaaaaugcuuguaguuauuugugaagaaugaucagaaaacaauguuuuuagaccuaagaauauuccuguaaauccaagauguuuguuauaacuaguuugaugauuuuagaaacuaaaaaauauuucucugagaaauaaaauuuaaauuuaaaauuaugaaacaucaaugacagcuuguuuaucgccauggcaguacguaguuugagggaauaaugguguagagagccugugugugagaauuggcauugucacuuaccagcuuguaacaguaagccugaguccucgucuguuaaauaaaagugaagaauaacaaaagaacacaugcaaagcuugcucuguggcugcaguaauaacagcacuuaaaaccuucugugugcuguguuccaggcagaggaucaagcacucguuaauccucauauggguauuucccuaauguaggcuggacagacagggagaagucaaggaacuugcucaggauccuguaggcagcccugcguggggaagguuggaacuuguaguagcuuuuagucaccaugcuagauugcuuuacguguguaaguacacaguacucgguucuggcuugugaccauuguccaugacgugcugaagagcaugggugaguuaugcagauuagugugugagagccaagaacugcuaagaauaauccagggaaguacaaaaugauacucagcuauuagggacugugugcaaccauucucacuuaaaaaguuuagauuaggccgggcguugguggcgcacgccuuuaaucccagcacuugggaggcagaggcaggcagauuucugaguucgaggccagccuggucuacaaagugaguuccaggacagccagggaacagagaaacccugucucgaaaaacaaaaaaaaaaaacaacaacaacaaaaaaaaaaguuuagauuaauucguagguauauggggaaggggugucugcuguaauacaaacuguaguacauaauauaugaagccauaauauaauacuuucuaacuuuuaaaauaguuguaagucauaaacguggugggaaaaguagucuuaugauguggauucccaguauaaaauuccuaauuguuuucuaggguuuaaauugaggaagagguuuagauaaauaguauaugugguuuuucuuuuugacuaaaauuuguguugcccauuuauuuuuauguuuguccuaguggaaaggaaauguucuaaaguguugguguguauacuuuaaaaauuagcuguugaggguugugaagacuuaggcuuuuguuucuauggaacaguguuugaauuuguauauuguaacuuucaaaacauagcuugaaaaaaaaaaaaguucagccaacuugagugucuuauuguaaagcucaccagaacguauacucgcuauacuggaggggcugagcuaccccagugcuggguguuaggggcugagcuaucccagugcugggugauagacuguuucuuuuuuaaauuaccauuucaagugccccuccuuucggaauuuaaagacuuaacugauaaaaggaaacauuaagaacuuucuaugugugaacaccauuuuuuuuaaaguuuauuuuuuauuuauaugaguacacugcagcuguguucagacacaccagaagagggcaucugaucccauuacagaugguugugagccacuaugugguugcuggggauugaacuuaggaccucuggcagagcaggcagugcucuuaaccacugagccaucacuccagccccucauuuucuuucuuucuuccuuccuuccuuccuuucuuucuuucucucucucucucucucucucucucuuucucucuuucucucucucuuucucucucucuuucuuuuucucucuuucucucucucucuuucucucucucucucucucucucuuucucuuucucucucucuuucucucucucucucucuuucucucucucucucucucucuuucucucuuucucucucucucucuuucucucucucucuuucucucucucucucucucucucacucucucucucuuucuuucuuucgguuuuucgagacaggguuucucuguguagcccuggcuguccuggaacucacuuuguagaccaggcuggccucaaacucagaaauccuccugccucugccuccugccucugccucccgagugcugggauuaaaggcgugagccaccacgcccggcucucauuuucuuucuuaaggcuuugguuucuccacaguuuaaaagacaaaagggguuaaccacugggcuaucucuucggcccuugaacaccaauuuuuaugagaguaguuacuacuaucccugugagaaacugaaguguggaagaaaaaguaucuuggucaagguccucagcugagugcuagcuaugugauccagcuccagugugcuguaagacacugcugccugccugccugccugccugcugccugccugccugcugccugccugccugccugccugccugccagguggcaguccuucugaugcuuagcugcugcuguguuuggguggggauguacuuagaacccuugagccuuaguuucuauagcuguucaaguaaaagcaucguaaguacuccuuauguccagccauugaguuuuauagggaauuuuacauaaaugauuugaagaaauugaaaugaucuaaacuauacuucucauucugugaucuagaaucccucaacuauaauaguauacucuaagagccacuuguccagcucaguggcaggccuuccuaauguuagcgaguaguagaacuaugugagauucacaguccguagcaguacuugaagcuugucuccuaccuugucugaguagaaaggggcagcugucauuguuccauaucauucauuagcaucuuccugauuuccugcacugaagaagaaucuuuuauuuuuguugcuauauuauuauguuauauccuaaaacacaaccagaagcuagaauuuaauggugcugaugucaagaagguagauugguaacucagaguuagaauacauaaugcaaauguaguacuggauuugaggcagaaaauacaguuaagcaugaagguggguuuuacuuaagagguuuguuuuuagaggaacagaaauaagagaaugauguauaaugaaaaggaauuauuaggcucacaugauagugacugguagccagcaauagcuguuugcauucuagaaaggcugagcauccugcagccgcaguccacgaagcucucagcucucagcagucucagucuggcucugaaggccuggaccauaccugaccgugguggguaguguggguuggaacgccugaguugcugaguucccgcagcagcagcugcagcugcagcagcaagacugaugcagucaucagcaaugagcaaggcagggagacaaggcagcacuguaucugggagaggauccuccuccaguuuauuccuucuuggaaagacccucauagacaugccgcaguugggucuuguagaccaggcuggccucaaacucagaaauccuccugccucugccuccugccucugccucccgagugcugggauuaaaggcgugagccaccacgcccggcucucauuuucuuucuuaaggcuuugguuucuccacaguuuaaaagacaaaagggguuaaccacugggcuaucucuucggcccgugaacaccaauuuuuaugagaguaguuacuacucucccugugcuguugauacuagcugaggagcaauaccugcuuggcuugguaaaagcucuucagagaacuuagaaaguagguugaguauuccucuaccauagugggaagaugaaguauuuuauuccagucaauuaaaugggugcagucaagaaacuagaagguauaaaauggauuuaauaagcaggauauuaaaaucagucugucauauuagaaggaauuuaaagugcaauaagaccuccagucucuuggauaauuuuugugaaacauauaaugacaguuuuauuccauuuugaauuugaaacaucaaugcugugauuuuucuuuacuagaaucauucagcagaaauauaguacauauauuuagcuaaaauuuucaaguagccacauuaaagcauauaaagacauggguagacugaauacuaacaauuaacuuaguuuaggcagaauaugaguuugaauaacuaguguagaaauuccuaaugaauuauuuuaugugcuuuguguguguguguacuaaguauucaaaacucaggaugucuuauacauagaauaaaucaacagacuagcgaucuuuccaagcucaguagacacauguggcuaguccuuacugggacagcuuagcccuaggcugcucugcaguauugguuuaauuagaucugacggcucauccugggauuacacugugcugugcauuauguccuauauaauucaguuaauauuucuaauaauaugauaaaaguuuugcuaucaauuuacagauacaaauaguaagauaagcagguauucucuacaagaauggauuuacaacucuuuugauugaaacccuucuguuugcuacaugacaguguuuugaauauagccacgcagagauaggacaggccgguggguccuugacucuugcuucuuauuuuaaggcaccacacaccucuuagcuuguaaugacaguaguccuggcagcugcucucauagucuugcuuucccacuuccaauuuaaacugcuuucuauugcucuugaaugagagguguucugucuggcaguuggcuguagugagagggggaagggaaggucagcuccuguugggaagagaaacagggaggaguaaagcuugugucuaucaggcaaaguuuuguuuuguuuuguuuuguuuuaacuuugucagcguuugagauuucuggggagcccuuacucaacauguuugaguuauacacauuuuauaucaguuuauuguauguuauauaguagauuuauacuuaacagcaucuccaauuuaaguugaauaauuccucgaauuagauuccuguuuguaaagacuuuacucaccacagcaaccuucuuuguucaaagagggagaacaggcagcucuccguuuugaacugaucagagucacgggugauguggauacgcaucuuuaaacuugcagugccccuuuaccauggcuggaacuacaguuuaccaucagggcgcuuguuuggucagucuccagcaggccagacaaaacggggguggggugggauaggguggggggucggcaacuguauucuuguagccuauaagaccacagcuugcuugcuuugcuuugcuucguuuucauucuuccuccuuuuccuucuuguuugugcaugaguguuugccugcguguguauauguguaccacaugcaugccuggugcccaggaaggccagagagucaucagaucccuuacacauguuuaggagccacugugugagugcugagaacuaaaccuagguugucugcaagaccaacuagugcucucaacugcugagccaucucucucucucucucucucucucucucucucucucucucucucucuccccccccucucucucccucccucccucccucccucccucucucucucucucccccucucucucucucucucucccccucucucucucucucucucucugcauauccccacaucuuucuuaaagguguuuaaucuuuuguuaguuucuagagauuuaaauaagggacaccggcuuucaucacugccuagucaugaauacuagaagaaaauaaauaaaaauaugugagcaugccacuugaauucagauuuuuuuuuaaagauuuauuuauuauauguaagaacauuguagcuguccucagacacuccagaagagggcaucagauuucguuacggaugguugugagccaccagcccagaauuuuucuauuuuaaguaauauguuccguuuuaguuccaucaaacuauauauauccuacuauaaucuauuuuuaaaacaucugaauuugggcuggcaagauggcucagugguuaagagcacucauugacugcucuuccaaaggucccgaguucaaaucccagcaaccacauaguggcucacaaccaucuguaaugagaucugacacccucuucuggugcugucugaagacagcuacagggacugagggaagcaggguggaccagagcgagcagagguccuaaauucaauucccaacaaccagaugaaggcucagaacaaucuguacaacuacaauauguacucauauacauaaauaaaucuuuaaaaaaagagaaauucuaauaagucuucuagccagaacagauauuggaagaauauaaguaaauaguuuguuuuauauuuguucuuacacaguuaacccuaccaaugugucaugaggcuucuuuggccccuguuuccaauuuaugaaugguaauucugguucuuaaggaagaaaggauacaccugguaaaugaaaacuuguaaaguuaagaucauuucugugacacaaacuaucuucaguuuuaaagggauuuucagagcugcaugcuucauugugccgcgguggaauuugggaggguguuguuuauccaaguuucuucagguguaaggaugguuuuaagcaacagaguuuagccaggcaguggugaugcacaucuuuaaucccagcacucaggaggcagagagacaggugaaccucuugaauucaaggccagccuggucuccagauugagcuccaggacagccaguaaguguuggaugcagagauucuuggcuguucaaaacagugcauguugagcuuuaaccagaucacuuuuacuauccccuagaaggcuuagggaauaucaugggaaaucggauagaaagacuaagaggagagagagaaggcugcagagugcucucuucugugcaugcgggaggaggucauagcagucaugaaucccagcagcccguugcuuucauuggacauacccaagagcgggccuggaaagagucacagaugguggaagaucagggcccacucuucccugcugaaugcuucuggagaagggaaguccucaucuucagaugcgugcacaggugagcccacccggaugcucagagaccaccugguuaagcuuggugggucacaaaacaaaggcuggaagggagccgguggggaggauugacaggagugggcaggugaggagaggguggagccuagagugaucaguguguuguguggaugaaguuguugaggacaaauuuaguuaucaaaaggugagguacaacaauccccagcagcucuagacuaccaucucuccuguucucuggauaaggaaacugaaucuuugcaaaauuaagaaacuaugguguguauauggcagauccaagaucagagugcagguaauuaucccaggguauuuuaauuuugguuugguuugguuuugguuuugguuuugguuuugguuuugguuuugguuuugguuuugguuuugguuuuucgagacaggauuucucuguauagcgcuggcuguccuggaacucacucuguagaucaggcuggccucgaacucagaaauccuucugccuccugagugccuucuuuuuacuuuuauaugucccuuguuccuuuacguuuguuccuuacaugguugguguauaagagggcaguugacuuagugaguguguuuuuguuuauccuuugagaaucuuauccgugcagaggaugggucuugaucacauucacucuaguccugucuccgauuccaauuucaugucuaucuuccaguccuuuguuuucucucccaguuuccuuucgccacuucuggugaguccaguuaguacugcucacaugcucauggguauagggccaucuacuguugcaccuacagggcacacccuggaagaaaacugacuccuucccuagcagccugugguucuucagcucuggugggacugugagcacaccaacaccacucaccuggucugugcugccugccgugcuggcugcugugauugugcgugucgauacacacagccacagccgcugugcgcucugcagucuaguggcccugccgugucuggaucauacuguuagcggcagugcucccugacuucaggauccuagccgucuuucugcuccuugagcacuggggcaggcggcguguuaaagaaugucucguuuaugcuuggggauuccagacaguuguagacauaguuguaaggcuaucccuuggagcaugaguaacuaacuuggcaguagcuacaucaucaaaggcagugacuuucuccuuucuaguggcccucaacugccucagcuccccuggucaggauggggccccgugcgccuccccccccccccuugauagauagcuggauguuuauucccagucuuguucuggcccuuugcaggcagcugcaguuauugugaguucaugagagcucuggccauguuggucucugagacaguuuuucauggcauuucucugcagucauccagcucuucaguucuuuccaccccuucuugggugcucccugacccaggcuaagcugucagcacauucuuguucucagcaccuugaucagcuaugguucucccaauuagcugcccucaccguaaagagucacugccaagcuugagguaugucauauccauuuaauaaaauaagaguaguugguucauuaccucccugaucguggaauuuuguccaaauuuauaguaauagacagagccuuucuuccuccugcaaguggaccucaguucaaaccaagucaauuggugguuucuguagcagccaugcugcuuuugcaccaggaaacacccgagccuguaagucgguaauguguguguguggugcaaaacuaauagugaucauuguuuuaaguuuuuuccucccaucugucugcauagcaguuugaggcacugugaagaccagccugcagggggaaggaagcuuuccacucuguucuggccuggcucgucuaucacugcaaccaagguguguaguggcuuuagcaggggggucuuaucauuccacucuuuggggcagcagagggaagcagccauaaccuggguaguuuugagggucucuguggcuuugcuagccaacaacaccaggagcugcccacuaccugguacuaagauuuucacucaaaacccagagcuuugggguuggcauuauccacccauggauguaucuguucugucuuuuuuaaaguuuuuugguuuuguuuuuaauuauacaguagugagcuuccuuaguuuuugcuaacuucuccccuguaucccauuuucaccuuucaccauuccuguuaaaacuugcaacaccaaauuacaugucaccugugcucaccauuccugcuuccaaggccuuuugccugcauccacuaugccccaaguuaaaucugaaaauuccaagcuaugaucugcaguugagagaaaccauguggcgguauuugacguucugggccuggcuagauuaccucacuccguacaguauuuuccaguuccauucauuugccuucaaguuuuauuucauuuuucuuuauagccugaguauacauauuuuccccuuauguauguguaccaguguugcauuauccagucauuaguugcuggacauggaggcugguucgguuuucuagcuguuguaaaugaauagagcuuuguuggugucaaaaccuauugucagguuuuuuggcggucuuguuacagaauugagguaguuuccaucuguccuuguuuauugagcauuuuuagaauuaguaaugggaaugaaauuucauuuaaugguuuuucuuuggccuuuuugguggacuguuaguugacuuuugaauaauaaaggcagccaaguauacaugggcuaaauaacauuugguuauguuuuucuuucugcauuguuagauuugaguuguuguucuauagaugauuuuauaccugaguucauugcagccgaugauguaugauucuuuuaauaguuuguuuggcuuugauauuaaggguaaugcuggucugaaaggauaaguuauccuucgaucuucuggaggauaguguagacaguuaaauucuucaaauuuuuaguaaaauuuaccaauaaacucaccugggccugguguuuucugguuuugguaguuauuaauuauuaaguuucuuaauagauuuaguuaauaguaagaaaaaugaguuggguuuuauuuucacauuccucuucugaugugcuucauuucuuuaucuaguuccaaguuucuuuccugagucauuuuucuucucucuaaaggacuuuaaacauuucaugcaagucauuuccauuggacagaaauucucccaauuucuacuuuccugagaaaguaugaacucacucacucacucacucacucacucacucacucacucacucacucacucauucauugggucuggcuguuuagcuuaaggucucaguaagcuguccaagcugacuuugagcucacuaaggcaggccgugaacuuaaucauuuugccucagcuuucugagugguuggaacuuagaacugggccauuagaccucacuaacaagugacuacugauaucuccaguuuuauggcuaacagguugcccugugacauuguuucuguuauggcuggaagaagaguuaauuuguuugauuguuuaacaaaguaauaaucacaauuucucguagcucagacuaaaagcaguuuuguuuuguuuuguuuuguuuuguuuuguuguuuuuugagacaggguuucucuguguaaccuuggcuguccaggaacucacucuguagaccagguuggccuugaacucagaaauccgccugccucugccucugaagugcuaggauuaaaggcgugagucaccacugccuggcccugaaagcagauuuuugauaguauuuaauaucacccaucaauauauuuuguuuugguuuguaaaauauauuuuaaaguaaaauauuuuuuguauuuauauuccccuauaauauauaaaaaauuucaaaguugagaaaauuguauugucaguacucauacucauuacuucguccuacugcuuauagagucgauaugguccuccuguuucuauaguauacagaguccuguuuauauagucgguguuugcuuugcuuucuuuacuugucauucuuuuuuuuuuuuuucuuaaauuaguuuuuguaauagagaucccagaccugagcacaaccauaauguaaaguuaaaacuugguauaaggauggggcuggagagauggcucagcaguuaagagcacccgcugcucuuccagagguccugaguuuucaguucccagcaaccacauaguggcuuaucacucacuaucuguaauuggaucucaugacuucugauauauugaagguagugauaguauacccauauacauuaaauaaauaauaauuaaaagaacuugauaaagauaagcaauuucaacuauagucugauuccauuuuuaugugcuauuucuuuuaaaaagagaaaaauuccucuaggcauaguuucccuauguggcuggaacacacucugaacuuguuagccugacucuggcuccugcauguugggugugugcugccaugcucaggaaggagucugucauguagaaauaacaggagcuaaccacacuaaaagaaagugauuggucugucugauucugaauuuugacuuuuuaaauccucaaauacauuuuuuuucugcuuucucuguauuguuaguauuugauacccauacuuaaaguccucuuuauuuuuauaaacucauuauauaaacugauuuuucaacaaauacuuuauuuggaagucauaugggguuauuucuucuuaaaacagacaaaugaaaaacuagacguccuguagacuaggauaugugagcuggagaaugggucucccccuucccuuucuuucaugaaucaacuauuuuagauuuguauuuccagguugguaauggcuuauggcuaaaggaucauucaugucuuagguaaagaugguagaaguguuccucugaacccagaccuuacaggaauagacuauaaggaauuuucuaaguauacaucaagagccuuuguuauggaaugagcauauauuuaauaaggccaggaauaauugucaaaauuucaggaaacaagugggcaauugcuguuacaaaagaauguccugccuugcucauuguccauauuuagaucagcugaucagcugauggugagacucagaagcacuugccacacaggugcagugcuccuccacacaggugcagugcuccuccacacaggugcagugcuccuccacacaggugcagugcuccuccacacaggugcagugcuccuccacacaggugcaguguuccuccacacaggugcagugcuccucagcuguuggagacauucccuccucccgcucccuccucuuccguagaaucaggcuguuuaauccacuaauguuagagguggauuugcacauuugaguguauauauguauaugugugugugugugugugugugugcguguguguguauguguguauauauauauauauuugguaauuuacauaguugcauuuuacugcuuagaugacuugaauuuuucuuaggaccuaguuuaaggucauagagugguguggguuuugucguguguguguguguguguguguuuucuuuuggcuuuucaagacaggguuucuccauguagcccuggcuagcuucaaacucagagcccccuuugucugccuccugagugcuaggauuaaaggugggcacugccaugcccgggcuaguucacagagcuuuagaacugaaaaaggcugcucuugaaagcccccgucuagagggagaguuugaccuguaaaaugaaccgagaggagggcuuaucuuuauucuuaacuccuguaacuaagcggacaagaggccuagagcugauacuuguuugcgaauguguugcuuugcaagauaaagcuacguggucgucacagcacuaaacugaggaguuauagguucuaggaacucagaaaagcagucuugagagcuggugcuuuugagcugagcaggauagucccgagccacacuacucaugcaucuaucuccuuguguguaguugagaacugguuuugagagguucuccuuaccuaagaaccuacaguguaucuccagcagcagucuucuagccauuuaucuguugguuuugauguguucuauuauaagguguuaaagcuuaguuacucaacgucugaaagugcaagggaaaaaugcucuuugguuuuuaagaaauagaaaauaccuuaguuuuuaugguuuuuauaaugagaaaguauauagccuuuggagucagacauaaauagauuuuaauuuuguugggaauuccauuaacaaaauuuaugcacauuuauaucaaggagguaacuuaacuuuuuaugggucaaugucucacucagaacaaaauguaguaauauauucucuaaaauagugguguuguauuaauugaggcacuuuaaaaugugugucaacaagcuagcucccaguacaggagugcugcagcaauugcugucccuugaaagggcugcacaguggucaggagauuggaccucucugauaucagagagacgagccuucagccugucuguucuuuaugucuuuagcaccacacuucuccagguguugagggaaagaaagaaacaccuccuaguuacaucagacugucugguugugaagguacuaagacuacucagggucagagacgaggagagucgucgugagcuacagaacuuccacauccuuugugcuuguagcugcagacuugacucucagagcggaaagaaagcagagaacauagagaaugacaauuaccaggagaagcaaaugucuagaauuuuccugggagaaauacauuucuguguacugugauuuacuuuaguucaagaugcauagaauagaaagauaugagugcauccugugacacugauugagagaagcauucgauagauauacaacugccgauuugucuggucuuguaaguagauacuuagucacuaaaugcuuagggcucuuagacuuucuccuuauuacaagugcuguucuuuaaaaaugugaaguggauaacuaacgcuucuaguuuucucagguuucuaccuuggaguaaaauaugaaaaacauguuuaagaucccacuugccgacuuccuuaauugaucuuacagucucagucgcuuacugcuugcugucuguuccacuguaggguauucuaacugcacuggcuuacuucauuccaggacugacacaccaaacauguaacuaccuuccagccuuuguguucuuggcuggucuuucugugacuaaccuucacauuuuagagagucauauggcauguucuuccaggagucuauugaaaugcuauuggcggggagggguuucucugauuaucuuacuaaaaauagcuucuuucacaaucaagcccuauuguuuccaucugaaauacugaggccuaucuggcauguauggauuuuuagcauuaacuuguuuauuguuucuuugaaucucuguagaagauaagugccaggagggcaggggucuuggguuccuccagcugucagugugacaucacaaaccuagacagaguuggggagaaggacucucagggaagaguugccucuauaagaguguccugugggcaugucugcugggccaguuucuugaucgcccacuagaacggugcccugaggagugggguugggcuguguauaggagauguaguuugaguaagccugugagcaggaguccuucaugaucucugcuucagguccugccuccacagccuggggcuaaaggauggacagacagaaccuguaagccaguaaagccuccccaggcugcuguggucagucucuuaucacagcuauagaaaguaaacgagggcaaacacguguagucacucggugcccagacucgcguugcccagcgugcagcacccagucucuucccuggcacuguggccccauggaguccuuucagccaucaguguauuugcuuaagaguagcacauacuuuauaguauccugacuuauaaccuguucauaguaaauaugugcuuaggaaaacauaaugguugguaaauguucagguuaaaaacuagaaaaaguuuauauuuguugaaagcuuugacaaaacuaauuauauuuuugaaauugguaacggaaguuuagagaaggaaaauaaaaaauguaccaucuuaaauuuauaagcuaaaauuuaggaaaccacugggagauuuugaagaucaaauuacacauuuuaggaauuugauuuauagucauuaauguaguuuaaaggaaagauaagucaaaguacuaaggcucuacacaagaagaguuugguaucugaaacuugaaaugacccggagagguccacgguuauagaagaggaaguggcugaacugggagaauccgagaaaaggccguggugugagccccagagaagcauagggagaagacagcaguguggagggagccgcagcugccugggccuuuaggggaugggaaccacucugcgaaugccuggcauugcugcaggggguaagagugaggacuguagcucccucaggucuucugaaagaagagaccaacuaagaaaaaaagaaagagagagagagagagagagagagagagagagagagagagagagagagaaggaaggaaggagggagagagagagagagagagagagagagagagagagagagaguucggcugucagaugcucuugagacauggguccucucugcaguugccacauuucuucagguuggucaccacugacgagaaucucugugggguuuuaaacauaaaaugcuucuuuuugucagugaagaccagacagcuucaauuaaguauauugguguuuuaaaaauacuaaagugauuugaggaaaggaagaugugugagcgugccucuucauaaaucugagugagggcugacauacuuacuguuuaagacuugcuacgcuuacaaagaguugccuccuaaaaggcucuauuuuauucuuaccauucuuaauucaauuuauuaugugucauuuguuggcauuugaggggaaaauauuaacugaagggcagaacgaauccccuggcucuuuagauaugucagcucuccguuuucucagucuugaaucgcaaaucuggaauauaaaaggcauuaguagcuuucaacaugacuuuuucuguguuucuccuucugccuuccuaguccuucugacaaccucccccagcuucuguuagaauuaacacuauuaccuuugcaacacagagcaaaauagacauacauguggcuugacuuguccaacacgaacucuacuugucuccauccauccaggugugcuuugcacuggugccuguugugagcagcucgcagaggagucugcaggcugauuuacauacauucugcugucacagacacagacacgcucgaguuuguauagcuuuauuucagagugcucagauuucacauuaaaaaucagugcuauuaaaagcacuuugcaauccaugugcuuugauucuuuuaacucaauuuucugcucuauuuugagaacuucugauuuucuacuuuuuaaaaauauuucuuucccagcauugauaccuuuuuauacagaaagguuaucucaauggccauuugaaaaaucugauaacaggauguaugcuuuuuuccauugcuuuuuaauuguaccuugucagaauggucuugugcaugaacucucuuagaaucaggcaguuccugguuccuauggaacguccuguuuucucaaauaaaaauagaaaagcucucagaaaggaaauguggucggugugagcugccuacgagagcagagcggugggcuucccugugccaugcuuguauaguauacgcucugugugaaaggaguaagagagguuucaagugucugugaacuugugugugcguguguguggggggucugaguaauugugagacauguuauauauuuaauuauaaucuggcaucacauucauauuuuggagauuuuagguagagaaagauuacauggaaaauacuguaaauucccuuuauaauauuugauugucaaauacuaaaaucuaauuguuagcuacuuugaucuguuuauucuuuuuuuccuugccauuuuucuagauguuagcagagagucagguuuuuguuuguuuucuuuuuugguagcuacuagaaguuugaaugcugaaagaacuauuuaguuuuaaagcaacaagccauguagaaacgugaucuauuuagugauaauaaaguggguaguauuuacugagagcauagugagugcuagcuagcugcuguugugccagacauuuuauaggguugucucauguaguccuuacgggauggacaagguaugugccauugguauuccuccuuuauagaaaaacuagcggacagugagcgaggcauuaguuuaaggagguauuacuuaggacuggugcagagacuugaaucaauuccuuguauaacccuggcuuucaguugugauggcgaaaaccaugaauuuaaagugagacugucuagcauaguuggccuuccuuccuucccggcuucuuaccucguuuguuuacauugguuuguguaugugcauugguggaauugcaugugcuggcuucucaggguacuuguuuaggauugacgugcuggagugaugcuaauaguucuuuuuucuuucuuuuccuugauaguaaaaaaccccuuugaugaaacauuuggaaaaauacaaguaaguaaaagaucauaaugcuuauaauguaugaugucauguuuuaacugaugaaaauacuagagugacuguaaacuaaggaaaguaacuuuaaggcccuaguaguuuggucauuaugucugauguagagcugcuccugacaauagaauguuugcuacuuuuauguaaagacaagugccccaucacauaugaguggcccugccaugccuugaucuggcucuccuaccuaaaaguaccuguguugucuaaggccuuugcaggcuuuuguuuuuucauuuuguuucuuuuuggaucuuuguucuguuggugugaagaaggaucaggaaagcaaaaaaaaaaaaaacaaaacaaaacaaaacaaaacaacaacaacaacaaaaaaaacccaaggcuuuuaaaagauucuuuuucaaaggaugauugauauaauaacuugagccaaaauuuuauuuacaucaaaauacuuuuugcuuaccauagaauaaacacuucagauuuagauauuuaaagcuaaaaugaauaguauauuacauaacucucugcuaaguuuucauugugggaacugaccauuauauagaucuauaucaacauuauuuguuuuauuaagagcauauaauaaaguguagucagacggaauuauuucauauuguuaggacugggacuuuggaauaauucuccaguauauucuguagugaagacguuuauuugcagugaauuugacaacggagucuuuaaaaugcgauaguguuauaguugagacuuaguacaguggacucauggaaccuuggaaguagauuuucuuuaguaauuuguagaaucacagauucaguuuaagacucucggguuucagcccagguuuuacuuuuugguguuugauuauuggaguuugaauuuuuaucuguugauuuuugaggcagagagccuuuauuuguguguuuauuuguuuauuuauuuaugaaugagaugaucuuguuaaauaggccacccuggccuuagauuugcuauuuuccugucucagucgccuugugcugggcuaacagguguaagccacucugcuucacacuuuggguuuguaacuuuguaugcagauaaggauugccuugauucagaguaaccuagggaugaggucagggaaagggugauguggcaaagcuuggaaggaaacaggcgccagcuggagggaugaauacugugucaaucgagacauaggcgagggcaugaggcggggaucugaaggcuucuuccuccaucacagaucaugguugcauugacaaaacuuuguuucucauaguguggaagcuuguuguccuuguuuccuggacaugaguguggggacaaaaggguagaugcagcuucaugucuuuagacuuauauguauggcucacauucuacagcuucuaaccaugccugaacuugcuccaugagcguaugcauucagaaaucccgugcucaugaagacucccugauaaucauggcuuuaucucagggugauaaugucucagccuuugucauuaccuacaaagguuuaucuuaguuguaguuguucuuaaauuuggauaucauuguuuagacuaguugauagauuauauagaccacaccauguuuucuucauagcaucuuuaccuucuggucagagcaauauuccagacaugcacaaggcuggcuuacuuuucucuuaaauuuucagaauaaagccaaacucuuuuucuucauaucuaggguuuuguggcagucaguucuaagccauguuuccuucagcucacuccugccuguguaagaagucuaaccagugcuuucaugccucuaccucugcuugugcaguucccucugccuggaaugauggagucucuuuucuuccuaugcagcccagcucuccugcuguuacacagauggcuuuguugaccucccucccucucugcauugggcagucacagugugacacugcauggggcuuuguggcggugcuccugagaauaggaaauaccuuguucguuguguuucacuuugcucugagacgcuaacucuuuacuccuuaaccucauugcaugcuucacuuuaaugauaauuaugcacaagggucaucuugaaagccuaggacaggauguaugucaaaguaacaacacacauuccuauaguuaugugauagagucagaguaaaacaaaccaugaggggcuggaggauggauggcucaguggcuaaaggcauuugccagcaaacaugucaauccgaguuggaacacacauggugaaaggagagaaaccauuccuguuaauuguucucugacuacaaaggguguacuaguguacgcaugugugugcaaucccauguccguacauacauuaaauaguuucucaaccaugaaauguaagcuagcuagaagaaagacaagaauagucuguguugaacacagcauguaugaaugauagugugggguucgaggggcugcucugauaguuagaggagguguauguguguaagaaccauuuauguaucuauguguguguauguggguguguacacaucagugcuggugcccacagaggccagaggcaucaaauccugugaaucuuagggaagguugugagcugccugacaggggugugcuggacuugaacucuggcucucagucauugagucacuucuccugcucccugugucagcuuaguucucaggaaguaaaguacuuacagugauaacucaguuauguuaacgguguucaaguagagcagcuacuguuuccauaggcucugccuuucacguuauauggcuuuaaccauuuuagcuugauuuccuccuuuuuuaaaaacuauacuuuuaaaaaaaauuauuucauaauuuuuuuuuuaauuuuaggaaagugaaaaaaaucuuuugaugagcacauuguacaaacuucaugaucgauuggcccagauugcagguauuauuuuagcauucauugucucccaaacauuucuaacauuagccaguguguguuguguugugucaguagugguaaucuugccuaaauacaggcuuauauuuauuuauacaguauuuuucuuuagagauuugaaaaaaauucauacagguauaauccaggccauuuuucugcuugccauauauguuagauguuauuuauauauauuguguacauaguaacaaauucugaugacuucaauagcaauugaauuggauaagugugauuaaugucuucuguaacuauguaguugucauuucuuuacuuaaaggaauaaaggauucuguuuuuaauuagauucuuuucaugcucugcucuuaagccuguuucagugcucagguaucaacacaucugcaauaugaauaauuuagugaaauuauuaaguggguucuuccuaaguuugagauuugcaacuuacaguaauaguuugcauuuauccaauucaugcagaggauuagcauuuuacauauaaucugaaagaagugacuuuggaucccucccucuaggugauugggaaaacagaaauggagcuuuccagggcuugcagaagcagacugcugugugcagcugggguccuuggcagaagucuaggggacagauguagugugacuccugcuuaaacagaagucuuuacgauccuuccugauguucacuuccucugucugauauauuuaucuuugaguccguaguuuugcccaguuuuuagucuuaaugacuguguauaguucuguguacaucaucaaaugcuucucuugcacacugauuugccuucauucauauacuacagcucaugacauuuauuugguaugcucuaguaccuggaaguuacgucgaauguauuuuauagcuagcuuaauccuggauggcucucaauagcaaauuuaugagcauagucucugguuuaccagaucaggacgcaaggguugcuuuuagagauguaguuuuccucacccagaguggguauuggccaguuuuuuccuaugcaaugccuguaguuaauauuguagguuuuguggacuagacugccucugucauuacuguuuuacuuugcuauuauagcaugaaaguaaccauaaauaguauauuaaucggcuaguuugacucuaugaauaccaacagaccacauuugggccuugccuguguuuugcugacuucuguucuaucugagucucugggaagccuuauaaagcuugaagacuuauuuauccaguagauaccccuuaucuaauuaugcccauuacagccuggcuuccggaguaaacuauaaguaacaauauacuuucacuacagaaaggguugccagaguuuuacuuuaguuacucuauuuuuauguugcagguauuuuuaaacuacuugaaaguaauaaagcagcaaaaacuuagaacugaaguucaguaugaggaaaaauaucuguaauaaccacauguagucuggggaaaaaaagcuuugaauucucugcaguuauauuuaaaaagaacguuauuucucuaacuuuuauagcacaccccuuuauaacagcuauaucuuaguuucacaggucgacauuucuaagggacauguacuccugucugugaugagcaugguuaugcucugaaaguagacaugcuuaguacgacaguaagauacaaugcgauaguaauuagucuauuugaagcuuuggauuauuagcuuuaggaaucuaugugugaguuaguagcgagcauuuccuggaugcuccccuuuaaugugccuacauuggcuuauaguuuagaacacaagaagaagacguucuauagacuaaaguucauuuaaaaguagugguuuauggaaggguaguuguuuguuuacacuagauauuggaauuguuucuauaaaauauaaguaauguucaucaauauuuauugauuauaauuauauauauaauuguauaauugguaaaauacuuuaaguucuauuucuucugcuuaauauuguacuuauuccaaauuaauaugcuaaucuuuucaggagaccaugaauguggcaguucuagucaaaggaugcuuucuguccaagaagcagcugcauauuuaaaaguaagcagugacaucagaguuuuaauagccguguucuuaaagugcauguccuuagugcugucaacaguguuaagcgcuggguuacuuugugugcuguguaaggcagucucuguucuucauugcucgagagucugcucccugcaccaggcccucccucucucagguuagccucucucucccacgccacuccacccacuugaacaccuguuuacuuacuuguauauguuuggcuagguuccuguuaagagagaauacgaggggguuuucuuucugagauuauggcuauaacugguuggaguguuuuuauaccuuaaggauggaaagcuaacugcuuuccuagcugugcuuuugcccuggauuguuuugggggugaauaaguguaugccggguacuugacacagaaguguggugaacgggaagcucuaaagccucgaaggaccuucuaacagggaguucauugaauuguguagauuuugucucuuguuacuuauacgcaggauuuuuuuaaaauaauaaagcuuauaaaauuaaaagucuuaacuauuuagugccauguaagcagauauaauaaaggacaaugagauuguuaguauuuuuguuuuagaauacuguauauaagaaagugcacauaaguguguaaagggcuugaagaugggcuguagagauggcucaacgguuaagaacacugacugcucuuccagaggaccugaguucaaaucccagcaaccacaccguggcucccaaccaucuguaaugagaucugaugcccucuuuuggugugucugaaggcagcagcaguguacucauauaaauaaaucuuuaaacacaacaaaacaagacaaagggccugaagaacacugugcuacaugccugugccuguccucaaagcugcuuuguaggcugaagcagggcaggugcuugcaacccaguuuugaggacagccuggacaaguuagugagacuugucuuaaaacaagauucaacacaaaucucagcacucuaaggaggagauggagauagaauuaagaugggugggcagcauucaggaaagcaagugaggcacuugcuuuuagucagaccugcucagcucaguucuuucagggugcuaagaagacuugcaggugagauucucugagcuguuacaaguuauccuggaacuaggaaagaaaauaagcugaaagauggaaaguuccauucuugugaaagggaaaaauggaauucaugacaauccaguuccauguaaguagccccauaaagaugcgaaugcuugcaaaccgagaugcuguuccagccagcuuuuagacggcucuguggguucagauguaauugugugucaucucuccuacccccuucaaauagcaugacuuuaaaagggaacaggauuuuuccuauuaauauuuuaaguguacauauaguacaaugugguaauuguauacauauuauuuaacauaaauaaucucuaggacauuuucauuuuaggacugaaacccuaugcucauugcauaguagccaccuauuuuucucuuuuaaauucugucaaucacugcuuucuuuucuauaucaguuuuguaacauuuagauauguaacuaugcucauugauaauucucugacuuacuucauuuaaugucuuccaaggccauaugauaacauuugauaguauuuuucuuuuuauuuauuacaccuuuuucauaagauuugaagucuaaaaaagccucagcuuuauccuuuuuuaaucugauauuuaaaaguaauuuaaauccaucugucuuagucaggguuucuauuccugcacaaacaucaugaccaagaagcaaguuggggaggaaaggguuuauuuggcuuacacuuccauacugcuguugaucaccaaaggaugcaggacuggaacucaagcaggucaggaagcaagagcugaugcagaggccauggagggauguucuuuacuggcuugcuuccccuggcuugcucagccugcucucuuauagaacuaagacucccagcccagagauggcaccacccacaaggggccuuucccccuugaucacuaauugagaaaaugccuuacagcuggaucucauggaggcauuuccucaacugaagcuccuuucucugugauaacuccagcugugucaaguugacacaaaacuagccaguacaccauccauccaugcauccauccagccaaucuguuuuacugcuggggaucugaauuuagauccuuauguuuguacuuuaccuaucaaucuuuucuaagacccaauauagugugugugagaguguaauaucaucuggagcaggagauuuagcuguuauaaacugccugauaaaggugcugggaacugauuuugggcccuuaggaagagcaguaaauaaaagcccuugaccacugagccaucucucuagccccucaagauuguuuuaucuacugagccuuaggggagcgcccucucagaggcagccuuaggggagcacccucucagaggcagccuuaggggagcaccucucagaggcagccuuaggggagcgcccucucagaggcagccuuaggggagcgcccucucagaggcagccuuaggggagcaccucucagaggcagccuuaggggagcaccucucagaggcagccuuaggggagcaccucucagaggcagccuuaggggagcaccucucagaggcagccuuaggggagcgcccucucagaggcagccuuaggggagcgcccucucagaggcaaaagggagggagugugaggugaagaacucuggaaggggacaacaggaaguggggggcaacauuuggaguguaaauaaaugaaauaauuaaaauaagaaagaaaacagaaucucuagaaauuguaagauaaguauuauaguuaggccuuuuauagucauaauuuauuagaugacuuuuuauuuaucuguaucuuaauuuugguauauguauuuuucaucuccuuuaaguuuauucuuaaaaaaaaguuuauucuuaaguauuuccuuuuugagcuauuauaaacaauuuuuuucauuuccuguugagauucuuugcuguuacuauauauaggaaacaauugauuuuuccauguugauuuuuguacccugcaaguuugaugaauucauuuacucuaaggggacuuuuuuuaauuuagaauuuuuagagguuuuuuaaaaaauauuuuuauguagauaauuauaucauuugugaaaaggaauaauuacuuuuuucuguuucagauuuuaaaauuucuugcauaaguuacuccucuagacuuucuagucuguguucaauagaaguggugagugggcccccacuuucuugucuuugcguucucccuguuagaucugacugcucacucguguaugggccucaguggguguggcuuuuugacauggacauccuuuccuucuacuccugggcauuuuuaaaacucauuguugaaggacuguuaaguuuucucaugcuuuuucuguagcuauugaaauaaucauuugauuuaaauauuuucauuuauuuuuuauugggacugcaauaugaauacuacuucuaauuaacaggauagauaaggauccaauaauauugugguuuuuaauuuuuuugaucuauuuaacaacaaaacaagagguuuaacagauuaagaaaauacugcauugauauuuuuuguguugaaaugucuguguaccacaggacccugcuguuauacuuuuaauacgcuguccaaguccccuuucugguauuuuauuagagacauuuguguuuuuauucaucauuaucuaacauugauaacaaaaaccaacauaucuccagcugcauauguagcagaagauggcauagucagucggccaucauugggaagagaggcccuuggucuugcaaacuuuauaugccccaguacaggggaacgccagggccaggaagugggaguggguggguuggggagcagggcggggggaggguauaggggacuuuugggauaacauuugaaauguaaaugaagaaaauauuuaauaaaaauuuuuuuaaaaaagucaguuugggggcuagcaagaucaugcauuggauaaaugcacuugcugccaagcuugacggccugaguucaaucccugagacucguggugcaagaagaguccucuuacugccacaugugagccauuggaugcucauggccaugcauguauacacgcacgcacacacccacacacacacacacacacacacacacacacacagacacacacacacacucagaguaaauaaauauauaaauuaguguuaaaaguuuaagaaaguuugggaaaguucuuuuuguucuuugaagaauuugaguaguaauuuuuuuccuaaugaaguaaguaagaaaugaauuauucuuucaugccugcccaggaccacaccaauuaguguuccagcacgaauggagaaggacacauaaaccccauaccuauuugacuagcuguagucaguggcugagaggaggagaaucagugcucuucaggaagcucccauggcugguuggccauguucacgugguuaguucuaaacccaggcaacacuaguggcuuugcuaagucacgcacaggcaguuuuuagaaggagagggcgugcguuuagaggggcguuuguuuguggagggucaggggaagacuuagagaagcagggagagguagguacagugaaaauacauugugcucauuucugaaauccucaaaaagggaaaaauauguauuuuucuuugaaugaaauguuugucugguuuguaguauugaagccaucauuuuccucacugaucuuuaucuguguauucuguccaguuuugaaaguuguuuauagcaaucuacucucaacagugguaugcucucccuccauccugccuuuaauuccucucucugccugugggcucucuaauguguguaugccaguauaacugcuguaucuucugaguggauugagcugccugucugugugacauccuuaguaguuagcuauucccauggacucucucuccucuauccuugucagccugugugugugcccuuaaagcuaaaguggguuuccuuuacauucauccaucaacccaacgauuaggugcuucuauuuuuauuugacgucuauuauugacgggacagacuuuuuguuguuucuacuugcuuucucucuguauggaaauuuuguuuguugguuuuuuuuuuuuuuaagauuuauuuauuuauuuuaaguacacuguagcugucuucagacacaccagaagagggcaucagaucucauuacagaugguugugagccaccaugugguugcugggauuugaacucagggccucuggagagcaagcagucagugcucuuaaccacugagccaucucuccagccugaaauuuuguuuuccugucguacuucuuuuuuguauuucuuuuguaguaaaaugcuuuaauugcuuuugaauuuauuauccuccuuuauguuaucaaugugucuuuuagauuguauaaccauuaauguuuauagcuuuuuacaugaauauauuuauagcuuuuaaagcauaauuuuguucuuuaacuuguauauuguauuugaaguguauauaucacuuuuacaauguuuuguauuuguuuuguaugaaccuuuauaagugaauuuuaaauuuauuuaccuuuauguugcugcuugcaucuuucauuuaauauuagauaccuuuugguauuuuuuauaagacaguuuaaugguauugaacuucauaaauuuuguuuauaugagaacuauuucuucauauuugaagguuaguuuucuggauaugauaugauaugauaacccuggcuggcagguggguggguggguugguugguuuuucuuccucucucagcacuucauguguuuuaucuuacuauuccguagguucuccuaugugaugagcagcuuuucucuucuuuaaaagucucuuugccuuuugacaguuugauaauaaugguguguguauguguguggacaugugugugauaauaaugguauguguauguguguggacacgugugcauauguguggguagauaaaugugcaggcucacacguggggaaggaggccagaggucaacauugucuucuucaauggucuccuccuuucucuaaaaaucccaagcugccugcuucaccuaagcuauguggccaguaugcuccagggaccgccuccuggucugcuuccccagcucuggggacaggcaugugccacugaaggcggcagugucuccugauguguugcuccuguuauuuagacuuaacauuccugcuuacuuguuggguuucuucaaucugaaugcauaauuccuuacccaaauuugggggauuuuuugauucuuauauuuucauuuuuucuucucuuuucucauuuuaugcuuccauaauaucuugagugaaacacuuugccuuuuuuguucuuuuuaguguaccucuaacuauuaacugaauaauaucaaauggugggguuugcugauucuuuuguauauucuugaaaacguguaauuaauuuucaaugaacuuuaguuguucuguuacacaugccugucaucaaaaguaaaccgaguugggguuuuguuguuguugagacaggguuucucuguaucccuggccgcccaguccuagaaauaaccuuguugacuaggcuggccuugaacucaucgguuuugccugccucugccuccugagugcugggauuaagauggccucccuaggugaaaguggacugaguuuuuagcuuacuguauaauuuacauaugcacuacagaaagaugcagccggugucuucuaaucaagauuagaccuagauucagacucuagcucuguguauuuguacucuccguuaaccuuucugaauauugacauuuugaaagugaaauuuuaaaaaguguauauuuguauguguaugaauggcuugcuugcaauuauauaugugcaccauuggugugcuuggcccuuaggggucagaagaggguacaggccccuggaauuauaguugagguuuugagcugcugccaugugggugcugugaauggaaccuggucuucuguaguuuuacgaugauuuuccuaaaauuauuuuauacuuccuaacaguuggauuuuggcggugguggguuuggucuggucuagguuuuguguugcuggcuuuuuuauuuuuuaagacuuauuuauuauuuauauuuaaguacgcuuauuuauuauuuauauguaaguacacugguggucuucagacacaccaguagagggcgucagauguuauuacagauggucgugagccaccaugugguugcugggauuugaacucaggacauaagaacaaucagugcugagccaucucuccagcccccauuuugcuggcuuuuuuguuuguuucuguuucugcagugcuaggaauugacccuagcagaucagaccucuugccuugcuaggcaagcauucucucacuaagauguguccccaguuccuguuucaugguccagaaugagggcugggguuacuuuuguuuuuaacucuauagacuuuuuacugcauauuauaaaaagagucgagauuccauuucuuaaaguuauuuucaaauauuaauacucauuagguucauauguaugcacaucuguguuagucuauuuggccucagauugugaaauauauguuuaucacaucauagaugcaguuucgagagcugccaauaauacccccccaaucaauaaacaggaugggggggggugucaaaaauaaagucucaaauucuagacaagucucuuaaggauuucuuaaaauaguguuuuauuuucaguaaaaauuaccaucauaauuuaauucucaugagaaauaaagggaaaaaguuuuaaauucacuguauaauaguaaccuaugguaguauuugaucuagcuuucuuuagucuuuuaaaauuaguaugacuauaaauauuccuauuacaaauauucauguguuuauccuuagaaucacauacauuugccucucccauuaagcagcuuaaguuuuuaaauugcuggguaauauuuuacuauguaacuaaugugcauugacguuuuuucuagucauuuccuuaggaaauaguccugaaaaggaaauuacuuuuucaaagagccugagcuuuauaaaauucuuuugauaauguucauauuacuuccuaaucuagaaugacaguuugagcguagccuagccccaguugacuuuuuuuuaucugugcagcaguauaagaaaccccuacuugguaucagacaaggacuguaagguauacacagcaagcuuucuguuuauggagaauucuuguacauuucauuucuagguauuucuagguacuuauauuaugauuucaucugcacaaagugaacacuuugggauacaguagcaaaugaggcagccacucccaccacuccuccagugcucaccagcaucccuggcuucugguucaugguacagaagucccagcacggagcuucuguuuuguugacuuugacaaauuacauuuuauuaguauuuccuuacucuuucuccuucaaaaggaguuuuaauaagcguauuuauauagauauauuucugacuuaccaagugcuuucauugagcuuucguaguuugguaguguugggaaaguugagaggucccucugguggagcacguaggaaacacacgauguguuuguagcuggagcacucacggcaucccugugggccggcugacgagugcugccucgguuucuaaggugcuuucaaaacccgauggacuucugacacaaugcacaauaccuaagaucugugaagacuuaaugggaaaguagaacuuugugaacgugccgagugcuggcagauaagaguuuacgguucagccuggccccuugaucucucucuguuggugaggcuuuauguggggaugaaggguuuucaagaggccugugacgcgacagggcggguuacucugagcagaaguucucucuucuggagacagugugucuggacaugcggugucugcgccaucgccacuuucccaaccucauuccaguuugcuugucuuuccaucuugaugccuucauccuuucucaguucucauuaugcagaguuaaaucuucuaguagaaauuugguaaaaggaaaagaaguauuuuaaaaagugaggcagugagacuuguauaaucguuuuuuuuaaguaugcacuuuaugccgugugcuggucucaaguucaacuucaucuaacaagguggaggacaggaaaccuacuuuaugaacaaauuaaagcuuagagguauaauaacugggucacccggcuagacugugaccagccuaggaguagagagcguguccuccguguaacaucguuguacuucuuugaggaucagcuagguccauaacccgucaguuccaguguggauaagcaguugacacuuuaaaguuguugugaacaccuugacguggcaguuaacaauggcuacaugucaucgauagcguacaccucacuaaguauguugugcauauguaguuuguaauggaacugaaaucuagucucagaucugcuggauacagaagucaaguuuccauugaaucaaugguuaagucuaguuuuuguuuguuuuuaaaggcagggucuacugugcagcacuggcuguccuggagcucacuguguagaccuggcugaucucugccucugccuccugaguccugggauuaaagagauccaucagcaugccucgcacagcguuguuucuuggcguauagcauauagcaucucaaaaacaaacugcagucucuagguggaggugcauagagcugucucugccuggcagcuccuuugcaugggcggccccaucacauuucuaauucuugguuguauucuuuuguuuucuuuuucuuuuuuuaaaguauagaacagaauuuauucagggcauggggagaggaguuaagaggguaguagaggcagagagagaguagagaaguagaagaguagaggaauagagacuggccaugagcacuuggagaggggggggggagguuauauuccuuuaauauacuguaugcauguacauuuacacacacuucccuuuccaggugcacuuggucuuuaaaauaacugcugaaaauuuauguuuuaaaacauuaucagaugcuucaaauguaaguuaaauuucagaguacgaaagcaauugaaguuugguucagucaguugugagaccaacaagccaggacugcauagccagaccauuucaaaaguagauaauacuguuuuauguaaaagacccggcuucuuuuguaacacagaaagaugaugguaagaagggugaaggcuauauucuauaaagcaaauucaaacagauggccuguaagccaccuuuauuaucuuaaaaauccuagcaaaaguuuugugucagucauuuaugaucccuggcagugagcggugcuuuguagaauuugguauguuugcagaucagauguauuaaagcaaaauugccggugaauuaggaagucgaagugugguccaaugaaaacaauuuccagugucauuggagaaucuauugguaaaauaauucaguggacauuucuaaaaucauuuuuaaaagagauuucuaaaacuucaaacacagccuuugcacuauagaaagugcauaaagugauccuuuguaaagggcuuuauuagcauaggagaccucagcugcuugguuuaguguugugcuuguaguuucuagcaaaagagcuggugcgguguggaucauaauuaaauauauauuguauuaagauaaacagauguuuuuuguuuuucaagacaggguuucuuuguauagcccuggcuguccuggaagucacuuuguagaccaggcuggccucaaacaaagaaauccgccugcuucugccucugagugcugggauuaaaggcgugcgccaucagauuuuuuuuuuuuuuaaaaaguuguuuaagauaugggggcuggugagauggcucaguggguaagagcacccgacugcucucccgaaggucaggaguucaaaucccagcaaccacaugguggcucauaaccaucuguaacaagaucugacgcccucuucuggagugucugaagacagcuacaguguacuuacauauaauaaauaaauaaaucuuuaaaaaaaaaaaaaaaaaaaaagauauguuuaagaacuugaauagggggcuagagagauggcucagcgguuaagagcacugacuguucuuucagagguccugaguucaguucccagcaaccacaugguggcucccaaccaucuguaaugggaucggaugcccucuucaggugugacugaagaaauguacucauacacauaaaauaaagaauucuuaaaagaaauugaauaggguuugggugaacagugcuaguauauuggcuuacccagcauguguauggucccacuuuuugaucccuagagccaauggaagaaaaguaaauguuuggaguuuauuaaaguacaaaauacauauacaguggauacaaauuggcugaaaaaaggaguuuucaugugugugugagacccucuuuuccacgauaagcggaauuguagcaugguguauaagauacagcgccaugcauuguuaucugacuguccuggcuucagugugcacccaggccaugcgcuggccuggcgaugaccuggcucaggaggaaaggugacacaagcaugagaaccucaguguggucuccagagcccacauucaacacaggguacaguggcucugcucggugguagcgggaagaggggcaggcaaagacacuugcauggggaaccucacugcucaguccucuaacugaaugucagguuuacugagagaaccugucucagaaaguaagggggagagccauugagcaccgugugucaaccuuuggucuuuccagccacaugcccauauaugcaccacaaaaccccauacacauguacacacacugcacauaacacacacaauuaaaaacaaacauaccugcccaucccuaccaauuaguaagcuuuuggauuuucuauaauuuuuaggaccuuaaauggccuuuauuuaugaaaaaugugccuauauuuguaccuuuauauauaaacuuauauucuugggauauuuuuuucuuuuuccaggcaaggucuugcuguguagguguggcuggcuggcugaugugguuaauguguuaguauacacuuaaacaucacauuaguaacuaaaacugaaaacauuuaaaauuauucauuugaaauaauaaugagcuuuguacauggcacaguacuuauaaaauguagugucugugagcuuucuauauggcaaaaauacuuuaaacuguagugccugugcgugcacguauacuuaagugucauggcaggcgaugaccuggagcagugcucaucuggucucuccuggcuguccugcguacuccagccuagcuggcccacuuccuccccugggucugcugucucugccucucaucuugcaguaguguuucugucauaaauguacccacuacaucuagcuuuuuauauagcuucugaagaccaaacuccaccugucagguuguucaacuaaaguaugugaguguguggauguugaguaucuuucuuccuccuuuuccaacuucuauuuggagaacaugucucucacugaagauggaguuuguguccugacuaaauuagcuuuuccgugugccuagaauuugccgcuacccccacucccccagacuccccagguucccugugaauguuaguauuccuggccuuuguaugggcgcuggguauccgaacucuguuccucaugcggucucucaggcucccugcccucugagcccaaguaguaaugcaguaguugccacugucagugaaguuuuguauucugcuucauaaaguucuugguucucucuuggaacgagugggccuuuuaccugugugugauuauuuucuacaaaaaauggguugaaaagugcugguuuacugaguugcuaacaucuuucuguuacacuguaucaaagucacacuuguuaaugucauaucaauuuaugaaaagucuuuaaguacugugaacuuauagucauaagugacaaguauguuuuucugcuuuauacuuucucacuuggaagcuugaauuuauaauuaguuacaguccacauuuuugagcuuacaggcuuaaugguuucacuuguugaacauuugaaucgucucaguaauuugccauaugcuuauuugaaaauacuguuccauuuaugaaagguaaacuuaauucauuaucacaaugauacuugaaaauaaacuuaacaaguaacuaaaauuuguaaauauaauaaaacuaaaaagaaagcauagcagaauauuaauagugcuucuauuggaaucaugagaagaugguguuuuucauuuuuuauuuuuuaguaccgaguuguauguuuucguuacuauguuuaugugguuaaaaugaaaacaaagcauguuguuuaugugacgguuuacauaggacuauugagaaugggucucuguuuuucuuguuagaauuuagguccugaguaugaagauguauuuaauacuucauugcuguggauuuuuaaaaaugggaaagauguuggaauaagguacaggauuugauuuacaauuugaugauuuuguauuguaagaagugguuuuugaaauuuuaaucucuaccuuaauuauuuuuaaauagguguguugguuacgggccugaggaagacuugacaaacauaacugaugugcaguuuuuacaguccaccaggccccagaugcccuucuggugccguuuccggcgugcuuucauuacugugacccauagguuauuguuguuauguuuagguaaguuguuaggauuagaagggggcugcacugcgcccaccucacagaaugccagagcugagagagagcuuacuccuugcuucuggagacggugcuggaaauuacuuccaggagucuucacugaguuuuaguuuacuuuugugugacugugaucagauaccugacagagauaacucucagcaagaaagguguaucaugagaggaggguugguagagcagauagcaugacagccaggaagcggagaggagagaguggccagaggcaagugucccaaaguccugcgccagggacuuguuuccuccagcuagguccacuguggagauguucacaguucccacguuagugcugucagcugcugacacaggcuguaugaggacacaucuucaucuuuaaaugauaacagcaaaguuggggguauuuaugacaauuguggaccuaagggcuugguauccuaaaaagagagagaaaaguuugucaugaacaugucauagaaggagcauguuuaguaggaugaguguggaaaacuacaaaaccuacucguagaacgaagagugggaaauacaaaagcugaacccccccccccccccccccccccguagccuuggccguccuggaacucacuuguaaaguagccuggccucaaacauagucacucugccuccugagugcuggcauuaaagugauguaccaccauaucuggcuaaaguuugaauuuauuuuuaaauaaaguaaguccuuaaauuuuugguuuaaaauguuauuuaugggaaauaauuuuuuuaaauuuagguucuuggauuuuuuuggcggggggugggggggguggggggggguggaggugguuugagacaggguuucucuguauagcccugggacuguccuggaacucacuuuguagaccaggcuggccuugaacucagaaaucugccugccucugccucccgagugcugggauuaaaggcgugcaccaucaugcccaacuggaauuuuuauaauaagaaaguauucuuuucuguuuucuuagcacucuaaacauaauucaguuuauuuaauauuuaguguguuuaauaaaacucaguuuuugaauaguuuagugcuaaaaggagaaaaaucugaaacaguuauuuuuauuuuuaguaauugggauuuaaacacucaacuguuaaugcaauggaagaauuguuuucgagaggggugaaauuuugggaaaguacucaagguuuucucaguguagcuuuauuauacuguuagauuuacaucuuugcacuccauuauuccaugaggccaggggcacgggucacuguuagcagcugucaugugaccauucccaagcacagccuuaacgccgaccccaaauguugcagguguagugcuggugugcguugcucuccgguacaugagauaccgcuggacuaaggaggaggaggagacgaggcagauguaugacauggugguaaagauuauagguauggaguuucuaaagcccuaaacuguuuguagaacaaucaccauaugacaaagcuucaacgcaguugauuuauuuguaaaguuauuguugguuuauuuucagauguuuugcgaagucauaaugaagcuugccaggagacuaaagacuuacagccuuacaugccucuuccacauguccgcgauucccuaauacagccgcaggacagguguguaagccagcacggauugaaaucagaguguagauaucuguggaagacuugcauuuuacugagacuuguggcuccucucaacugaaccuacuugacuggauagaguuuuuaaaguauuucacccucuccucucaguguguaguaagacagcugguuuaucgcucauucucgucccugcaucuguuuaucccugcuucucagucucccucuuuaucccugaggacauugagaaacagaagaggcuagcuaggauuugaguaauauuaaggacugaggugguuauuacugaagcuuuuuaaaugaaggcuaaaaccugacuuuuugaaaaugaaaaaagaugcauauuuccauauucugcaagguacggcuucucagucuaguagcucaucucuaucuccagugaagagcagcugcucacaguaaccguugcuucaguuauuaacauuuccaaaagacgagaagccaaggggaaauuuguuguuugguuugugugauaggaaaaagaugaagaaagucugggauagagcuguugacuuccuugcugcuaacgaaucuagaguccguacggagacucgaagaguaggcggugcagacuuucuagucuggcgguggauccagcccucugcgucuugugacaagacauuaguuauacccucuaaaguauggcaaggucaagguauguaauuuuaaguuuaagcaaaaccaaagauuuucuaauuuuucaaaauaugcaauauagauuuaauugaaacaauguacugugaaauaugugaaugcaaaggucccuuacagcucugccccacagaaggaauaaauguuagcacagagcugcuuugucuacagcaaugaagaccaauauuucuuccugugguccaugagaugguuguuguguuaucacaaucauugcuaauacauauccgggacacaucaggugugcuguggaaccguggccuucauagcccgaucuccaguugugacugccuuucuccuguaucucauuaagaccccuuugcccgacucucuccuuuuccaagugucuuuuguagcugucauuacaugcuuuucuuaauaguauguguaguuucugccuuucuccuguaucucauuaagaccccuuugcccgacucucuccuuuuccaagugucuuuuguagcugucauuacaugcuuuucuuaauaguauguguaguuucagaacagauagaguagaacauauaaggagucuugaagauuggcugcuuugugugccuguaccuguacuguacaggagaaauguggguauaaaacaguauauaaggggguuguaaaaaauaaguccucucuccuaccuaaucauauacaaagucuugcuuauuaauauuugcuaaacauaguauuuauagagaagguguguuuuagaacugcuauuuuaaaaauagccauuccauuuuuuccuucuaauuuuccuuuuuaaaacuuaaauacauuuaggggagggggguggagaggauccaagagaaguugagggagggaagaugauaaucagaauauauccuuacaaaaauaauguuuucaguuuuaaaaacugauguaccguuucaaaugcuaagaacaaauuuuccuuggaaaguuaccugcugcagggcccugugaaacuggaaauggacuuacuuauuuccuaugacuagccugagucugucagccgagcccuucaucaagcuuuccuaugggcuuugacaguggcaccucuucccugguuucucuuccgcccuggucuucuuuuccagucccguggucguguccaguguccucugcuuccuacucugccuuuccaucuuuugguguugccguucgucagcgcuguccucucuuuuuuccuuacuuuuucucaugccaugccucugucuuauacaccagcucucaugccugugccuuguaucugugccugccacugagcacuacacugcacaugccgugagugugagcucaccgugucuguguuacuucucuaaguccccugcucuagguggcagcacucacucucccucaucugcucugccauacucccggaggucagccucagucuuuaccucugacugcaccauggcucugcugcccugacuggugcacagcaucgccaucucccugugcacagcaaauaaccuggcugguucuaaauucacuuugccuaagugacuuuccacacaguuacuuuaauuuuguuucaauauuaaagguagaccguguugugcgaucccucuacuuaaaacacuugugugguuuugcaacucuuaggauguuaucgggauacuuugaugcagccagcacagucuugaauaaucugacuucuccuuuucggggcucaucuuucuguucuauugcagcuacacuggcugacuuuuaguuacuugaaucugccuuuucccuucuugucauagggcuguguacaauuggcuccaccugugauguccugugcacuuaccuuccuccacuguuuaguuuaugccuucgcucucagagucagucucacuuccuugaggaaaucucaccuuacacugaggagauguuauuguagagucuuccugauuaucacaacucuaaucccugaaagauaacugucacccaaguguugacucuagauauuaaugacaagcuuaauccaccuuaacacaggaauuggcucauuaaaagcauacaaauaauuuuuuggaauauauuuuuuaaaauuauauuuauguacagagaacuuagcagugugcauuuagcccaguguaguggcgacuucuuuagccuuugacuuuccagcuuggcagugcgagccacagacucaggacccaggacguugccucuucacgggcagcagaucuugucauaucugccauuauaauuggucccaauagcguccaccagcuuagccagggcacccuugucuuccgaguuaaccugugugaaggcaacaguggagcaugucuucuuauggaccaggugccccagccuggccuuccccuugaugaugcaguagggcacccccaucuuucagcacagggcaggcaggaaaaccaccagcucaguggggucuacaucaugggcaaucaccaccagccgagccuucuuguucuccaccaagguggugacuguauugauuccugcuuggaggacagguggucucuuaguuaggacauccccuuugccagcagcuuucuucucagcacgggccaguagccuuugcuucuucucuugcuuugucucuggccuguacuugugggcaagcuuaagcagcugaguagcuguuugccuuuccagggccucggugaacugguuaauggcaggaaguaccuugagcgacuuacagaggauggcaguuugccacugcagccugauguagcagggccacuugaugaaguguguuagaucucuuuugggccggaugcccugcccaauaccgaaguuuuugggccuuuucucaaacaaaagauugaccaccucucugccuccuguuucuugacaacagcagaggccaaaaccaccuucuuccuuggccuucuuugggcaucuugcucagcuggaguagagagaaagaagagggaauuguggguaguaaguaagcagccuuagagaucacaaauaauuuuuuaaugaacuaaaugauugucuuucaacaaacuggaacaauggcaaguaauacaguugcuuuuuuuuuuuuuuuuuguagcauuucauuuagauagaagaaauucaccaccaaauaguuugacuccauguuuaaagauucgaaauauguuugacccgguuauguaaguauuaugaucaggcauacauaauuguuuuuauuugaagcaucuggguauaaaaugcaugccauaucuauuauacugugugucuaauuuauaacuauaaguguuauacuuuuccccuuuuguuaaauucuaagcaaagguuugaccuuugacacagagaaauaaggacuuguaaaauguuuauaaaucucuguauucagugugacuccuaacauaaaugcaugaagguagguuaauaacaaauaaugcaugcccucugucaaaugcaacguucauuuuauauggaauuguuacaguuuuaccuagguaggcuaccuuaguuaaucuuccagaaauuucuaguuccuauaaaaacaaacagaaaauagaacaacccccuacaaagcaucacaccuuauucuguguuuuauauguacacaauaaauaauagcugaggaacuuuucugaccaacauaaucaucacagcacacauccagagagugacagugucagcaucuacuaccuuagaauaccgcgucugucugucugucugucugucugucugucugucuaugugugugucugugcgugcgugugcguggggugggccacagaugcuccagagggcaaacgggaaagcaacuugacuuuuaaucugccuaacgcauuaaugcuggacugcaguugauuuucuaauuacuaaagcaugcuguagauucccuacagaaguagcaagcacuguuaaaagcagaucggugugcauguguauuuacagcagcaggaccuuccuacaucuaauucauucugguaucaccugucauugcacguaacaaccacaagugagugaccauaacaugggaucagcagcuauuuuucuuaaaacauaauuuccacugucaagauuuggggaaaaaaaaaaaaaaccaaccaaaaaaacaaaaaccaaaaaaccacccaccucuagcugaagagcuauuggcauugaugguuucuggggcaggaagagucgguccuuuuuaaagggcguggucuuuauagcuuuacuacacucccuguauagcgccaaaccaaggacuguauagaaggaggaggugucuguguauccaugcaugggccucuugcuaaacuugaagggucuccuaggcuguguggugagcaagcucuaaggaucugauugucuccugcuuauaacaugcugguuacaggcauaggccgccuugcccagcuauuuagaaagagcuagagauuugaacccagacccuugugcuuauagagcaagcacucugacccauugaaccaucuuccuaauauauuuuaguuaucaguuguaauaacgggccugguggacuguaaaaacugcacaucaguuauguuugucaagucuuccucaggcccguaaccaacacaccuauuuaaaaauaauuaagguagagauuaaaauuucaaaaaccacuucuuacaauacaaaaucaucaaauuguaaaucaaauccuguaccuuauuccaacaucuuucccauuuuuaaaaauccacaaguugauuucccguuugcccuccggagcaucuguggcucaccccagugcaauuggagcaugcgcacagcagaggcgcuccuguagcucucccggagguggggugacccagcaccaugcuugccuuguggcguuucucuuuuuguuuuggaaagagcuuggcauauaguguuuauuaagaaauaaguuacaauuggaagacguuauuaacaguaaagaaaacaguguugcucuguugcagcagucauguuaacacuugucugcgcagagcuggaacaaccugcagcauagagcuacacagacggacuggacuguuugguuucgcugcaguguggggcacaguaggugcagcucgggauagcagggcugauguuguuucuccuaauuccagggaaauaggagaucacuggcaccuggcgauccaagaagcgauuuuagagaagugcagugacaaugacggcaucguucauauugccguagacaggaacucgcgggagguaagcggaguccagucguacacgcgcguuucgggucugcggcuauuaaacuaagaccauccugucucuguuuucuguuuauguuacagggcugugucuauguuaaauguuugucuccggaauaugcugggaaggcuuuuaaagcauugcauggcucuugguuugaugguaagaaauuugacucuuacaaagauuugggaaggguaauuaauuaguugguuuagauuaugccugacuuuuuaaaaaauaauuuucgguuaacauuuuuugaauaauaauuuagauaauauuuuguguucauuucuuuccacaguuaauuuucuacaaauacuaagcaucauuuuacagaucuaaaauacucuuuuuaucuuacaacaggaaaauugguuacaguaaaauacuuacgacuagauagauaccaccaucgcuuuccccaggcccucacuugcaacacucccuugaagccagcaaauaaacauaugaacucucugucucaccugcgccugcggacuggccuagcuaauucucaaggaaguuccugaaaagaugucuucacuccuaggacuguuaauuuaaauaggaaauucccauuuggcuuccugucuuccuuugaaaaugcuuuuuguauguaauauuuuuauugcugaagacagcuguuugagaguucugcaaaucuucagguuccgaaggcuuuggcagugaggcaggcagugccuaggaggcagagaaggacgucucacucaguuugugcggcucagguaugccaggcugcacaugaggagcaccggcuugacagcaagcgguuccgagauggugcuuguaggcgugcaccaagaguguuagagaaccacggacaagcauggcaaagcagcuuguuuuguauuuccauaauuugugaacuaaugugaauuuuuguauacaguaagccgcaucguuccuuacaggccacugugguaaaaccauucacuucccacuuuaaccuuagguuccuauugcuuguaaaagguucauuugcugcagcuggaauauggggaaauuuauuugguuuuaaugguuacauacauguaagaggguguacauguacuuacauuggcuuuuguauauauguauaaaugcugaugauagcgaaagucuuguuuugugagaaugucugcauuagcaguaaaauaagcuuucuauuuuacucauaaucuaaucuguauauauauacauauauauauauguauaugugcguagcugugugucuauguacauauguagcugcacauauguacauauccacacagauauauacauauggcuguacagucauagaugaucaaacagccaaauaccuggaaguauuagauacauguuuaaaauaucuuuuauagauuuuauauaaaaauauccgaguaugguuuuguguagaaguucuggcaccagcuguaaugaguucaaauuuaugugagcaauaaagaagcaauuggcagauacuggaaaauauuuugugaaaagcuguauuuauuauaaauacugggacugugacagaacuaaagggauuaugucauuucccagucuguuuauagcuuaaagaacuguuagcuccuguucuguguccaguguaaaacagggugcauuguugcagcaaaauguacuagacaaauuuccuuggaauguugggccaugcaaguuugcaguguagaucgugcacgaaugaccauugguuugugccucaguguuuauuucaguaugauuucagaucagaauaguuacugaucaagguuuacuuguaaccuaaaaauuggcuuuuugaaaaauaaccugcuggauagaucauuguugguccaagggaagaugugaaacagcuggaauuacaugaaucuuaauuuuuacguuaaguucaguuuucuuuuuguuguguauguguuugguuugcagcaugaacuugcacagauaaugcacguuuucugguuaaguaaacaugaugcacacuauucuguaacagaaaacccuugugccuuaccugugugcuuuugugggcaccauguuuaugaagaauaaaugauuuguuaucagaagagaauaaauuuuaaauucucaaucuaugucucagaugcuaauguguuaaaauauauauauauaauauauaaaguaaccaaucuuucuguauuuuaugugcaucauagugauuuauuugagcuuagugacacaaucuuguaaccuguugcaagagugaauguaaaauaauauaguuguggcauuuaaacaggucaccuuuugaugcagaugcauccuuuucuugcuucuaagauauauuucauguaaacauuguacauuuauuauuguaauauauacuauuaugcagcuuauuuuaccuggaacucuuaagccgaccaagaguccucccuguaagacagaugggaauguguauaauaauuagguauuugaaaaguucugcuuugauguaauuuguuucuuguucuguuuuaaaaaaagaaggaaaacauucuaauuaaaaauuuauuagguuuuuuuaaaaacau

SEQ ID NO: 5763 - RNA, 32172 nt, Mus musculus
ugccccgccucacgugaucucgccuagggagagaaagccugaccccgucuccugcgcucaccggcgucucuccgcagcucucgguucccccgcggagcuuggccgccaugcggcucccuucggcagccgggccccggccgggccguccccgccgccugccggcgcugcugcugcugccgcugcugggaggcugccuggggcucgugggggcggcucgcaggcccaacgugcugcugcugcucaccgacgaccaggacgcggagcucggcggcaugguaacucguguccacgcccuccccuugccccuuugcugggccgcuuggccguggguggcugugcgcggucacuccgggcccuccgggagcuuggacgagucaugggacccggcuuccucccccgagcucacccacaggcucgcaccgugcgcacggugccuccagccuggaccuuacugcugcaguggacacucgccgcucagggcaaaccuguggaggccagugauugauuagggagauccgaggccacgucagcccucuucacggaggaccugggacgucggcauccgugcuucugugguggcuauaaaaguggguuuguaggcugucgagcuguuauugacagagaguguuuuugcuuaagaagcaucaaaaccaaaaucaauuggccuaaucgaacaguuggcugaggcauuacugucagggcuccaauuuaggucuaauggguguuagucaugaagacugcauuuccuucccagucacuucugcucuuucgagguuccggaauuugaccuuugggaacaugaacgccaaucuccauccauuggugcucuagggauuugcccaaagcacugagcgggaggaggcagauuaggaccaacccuccaaugguauuccguccugggucagcauugcucucacuaaaaaggaaaaagaaacaagucgagacucucucccucuuucgguucuccuucugcuuucagcugauugcgguagcugugaaaccucuaagcaggaggguccuacuuuuuccuguguggucauuaacccuggcucaauguccuucaaguugcuggucccagcugaucagugaguugugaaaugagucuagugagccaacauuuugguuuuccacgugucacaugugauaaugguuagcagagccuguguauuucugggcugggcaguaacacuuugccuuccgcgaacugucuuuuucuagaugguguucuguuaccaauccccuuggcccuucucuauaucuacauagaucccauucaucgccuuguugcuguugugguauccccugagccauaaggauguugaaucucuucuccccucccacccugcuggagggccugcuaagccaguucucucucagagcgagcccccacccccuguaccaaaagucuugacuuaauucccucuuagguuuuauuaucccucccuccaacaguucccauagcucucuucucuuucuuucucuuucucuuugcuuuauuucguuuguuugguuguguuuuguuucguuuugagacagggucucacuguauagccgcggcuagccuugaacucacagagauccaucuucuguuucaccggugcugggauuucaaaaaaaaaaaaguauuuuguucaggaaaaaaaaaaaaaugcugucucucccagaguacucaacaggucagccuuaauacugcuguuggaaacaaaauccacuacuuacauauaaggugccccagcuuagugacugucacuuagcacagcuguugucuguguauagucgaggucuuucacuuuguguuaaugguacuugccucuagaacuuucucuuuuucuguuugcuucuuuauaccaguaggauguguguauagggggagcguaugugcacacaguggccugaauagaguggagguuagaagacggcguccccccuucuccacgaguguccugggagcuuaaacuccucaggcuuggcagagguuugcauguacccuugagucaccucgauggcccugggcucuuuuuuuaaaauauauauaaaguauuuguaguagccagagaaaccaaaacaaaagaagcuugcagcuucccacacauguucugucaacaacauggguuccuucccuggaucguacaagugccguggacgcuaaauaaaugaggaaaugguguuugcuuguuuuaaagcugcagccccuagcacuucagggaauucugacuuuucugguggccccuuguggagucgugacacugacugucaaauaggauagcagagugacgagcugagccggggugauguuuaagaacuuccuccgugccgggcagagggugaggugucuccuguucguauuucuaacaucacggaagcugccuguggcagacagcugaggggcaacagguuucucugcuuugcgaaaacaccgugguagccccgucucaccacauguugccucaaggccacaggggcgcuuugcacugagucuucaguggcauucuggaaugucgucagugggguucacccacgguacuuaauuuaugaauaaagccuuauguauagugucucuaccagagagaggaauuguguuucagauugacacaauagcaggcaagguaaggaauggggacccccauacacacgcacccacacuggcucacaucaaaaguugauaucccuugauuuccauuuaaugugauuuuuuuuuucaagacaguccacguccuaguuagggauacgauugcugugaugaaacaccacggccaaaagcaacuuggggagcuaaggauuuauuuggcuugaauguucauugucacagcacguccagggaagccaaggcagggauucaaacagcacaggaaccuggaggccagagcugaugcagaggccacggacggugcugcuuacuggcucgcuccacccacgaugggcugggcccuccuccaacaaucacuaguuaauagaaugcucuacaugcaggcuugcuuacagccuaaucuuauggaggcguugucucaauugaagcucccuccucucagaugaguucagcuugugucugguugacauaaaacuauccagcacaguccagggugacucaguuaucccuguagcugagguuaucccuguagcugaggauguacuugaaacccuucuccucaugcaucuaccucgcacgagcugagacuacaggaaugcaccacauuuaauaaaaaaaaaaaauguguaugggaguccugccuccauguaugaguguacagcuauguguugcugccugcugccggcgaaggccucaggagugauccagaugaguuagaacgagagcuagagaugguugugagcugucaugggggugcugagaaucaaaccugggaccuuuggaagagcagccagugcuauuuucuauggagccaucucuccagccucugucaguuaucuuuacccuauuuuauguguggucaccucaucuuucacaguuaauacuccacuguauugucccaugugccaccugagagacugugguuuuauuagguuuugcagggcauggcuuuucccucuuaaugaugagcacggguuuuguuuuuuaagucauuuauuuacucuagguaaagggagugggggguuggucaggggccacucgggaacaagggaaagaguaaaugugacauugcucugccuaaagcaagaugacuuccauuguuuaaaggcagucagcugcugaguuacaggaaccaucgaaaccuuuggcgcgcuguugccugagaucagggaagucagugaagccuuugguuuuuauaaagggauuggcuuaggguaaguaaagcuacacguuugcucaggagaguaaaggcggcuguuucuuaauaccgucacaugguuuccacccgaccagccacugucaccucagauuagcacggauaacugucuucagucuagugcaaucucucaacugggacuuguucaaccauacguagaugaucagcguaaaguucuaaacugaaaugccuacgcagccuugccuuccacuccucccuuucugucucuuggguuuuuuuuuucuaccacaguggcuccuuccuguuugcccuguuaggcuauuugccagccucagccagcgagcuccacucccccucgcucggacucucagcaaggcucccugcuuuaagggccuaccuggugccguucugaaguagcuuccugcuuuucuucccaccaggugugucacauggccgcuguacucucucucacuugcacucucugaggucauuggucaccugaggucacugaucaccuuguucagguccuacagcaguggugagggcaagucaccuagcucaguguuugcugagauuagcgcacgaugcaccuauagucucccuguaaaccuaacacuguccguaguuuugcgugcuuaucaacuugaugacuaaaucccucuugguucccauucuuucucugcaucacugguucucagucuuccuaaugcugcgaccuuugauaccucaugucguggugacccuuugauaccucaugucguggugacccccccaacugccaaauuauuuuuguugcuacuucuuaacuguggucuuucuaccuuuaugaaucaauuguaaaucucugccgugcaggguaucugacgugugacuccuccgagggucgagacccacagguugagaaccacugcucuaggcguccuucgccuguccuuaagccaggguuccauucaguccacgguuacuuccugagcuuggcaccggugauaaguuaaggacagcuacugccauugcuucugcagcuuagcacagaccuuccauggcgucucuugagggucuacuacuggcaucaucaaagcuugacuagaacaaguuggaaugguguccuuuggagacuacaagcagcuuggucuuauaagucaauggaaaaggcuacucacauauuguugaaagugagacuuuggugagccucgguauguaucuggaggugcagucucuaagaaauuacugugccacguggacauaagacuauguacaguccguucuugggucugaaagguauuucagaaucaucacagaccuccucaugagccucauccaugguaguuuuugcuguccgggaagugaagacagagccgagugccuuugaaggauaguuacacaacugccuucgcuccucugccuucugggguaaaguuaacuuccccccuguaccuuuccaaaccuuaggggaugcacaaaagauggcgagugcagaugaaacacacugacaggccugcacauguggcucagugggagagugcaugccugaguaugcaaggcccuggguucaauccccagcccugcaacagguauguuuauguuugacagggucugugugcaccucuguacccaugcuaucaucugguucaggugccacugcagugggcuagccaguagaguccuuaugguguuccauuagugaauguguaagguuggaaguaggcugugugagccuugcaaccuugucugucuuugaaaauccaaguguugccuuauuucccguuaaugauggauguguccuugcugaugcguccaugccuuggggcuauuggcaaauaagagagcaccaugauuuuguuacuugcggacagaacaaugcuaucagcuaugaacuuucucuuccugcuugcacaggguuuaccugacuguagccaaaccuguuugguucaccuccacaaucauuucucuugacuuugugucagaguugaccauuuggagguaaaugauuaagauaagaggaagggggcuggagagauggcugaaugguuaagaguacucauucuugcagaagacccaggcuucccagcacucacaaggccucuaacagucugcaugucgcuguccauucccaggggaucuagugcccccuucaggccucugcagacgcugcaugcaugcacauggugcagagacacacacaggcaaaacugccguacacacaaaauaaaauauaaauuuaaguuguaacaaaacacaaacuuugauuucuguguuuuaucagacauuguuuaacgaggaauuguuugcuuuguagacgccacugaagaaaaccaaggcccucaucggagagaaggggaugacuuucucuagcgccguaaguuuagaagccagugugauguccuuagauguccuauugcaucccaggaauauguggguggauuuuuuuuuguuuguuuucuguuauuuuguuuuuaaaugaaauaccuggccugaagaauuuuauuuuuuaacuaaaaugauaauuugcuggucuuuuuuuugguggguggggggggaagguucuugcuuguuuguuuugagacaaggucucccuugucaagcugugguuguccuagaacucgcucuauagaccagacuagucuugaacucacagacuggacuugccucugccaaaugcugggcucaaaggcacgugccaguacaccugacuaaucgccgguguuuucuaagcuagacugcuaucacuaggggauuugauugaaacccuuacuguucaagggcugcaacugguuuguauaaaccaagaacaguuaugcucuguaaggugcuccggggugaaaguuucaugaacucugcuaacucacccugacaaaggucaugauacugaagacacacaugcagcccguauggaaucagagacccaaaacaaaucuguuucuguaagugccugugugguggcuucacacggggaagcccacugaaggguggguagcagcgcugugcucggguuuaagcauagccuccgcagccaggcugccuaguucugaauacauuuuuauuucuuuauuuaccuguuccuagcucuguuuuggguuuugguuuccccacuuuaaaugaagucaguaccguccaccucacugugguuccaugaaucagcacaggcugaauggaucaguguaaggucacagcgaguucuacaccguaccagaugguguccacagaaggaguaauuaaagggaggaagaguucauuuuaacccggaaaacgcaguccauguaucaacuuaagauugaacccagugugguggcacgugccucaaauuccagcacucaggaggcagagacugggagcucucuguggguucgaguuccaauccagcccaggguuacauagugagacuuuaaaaaagaaagaaagaaagaaagaaagaaagaaagaaagagaacaagaucaagaaaaaauauuggagagauggcucagagguuaauagcacugacuguucuuccagagguccugaguucaaguucuggcaaccacaugguagcucacaaccaucuagaaugagaucugaugcccucuucuggugugucugaagacagcuacagugugcucauuuuauauauauauaauaaauaaauaaaaucuuuuaaaaaagaaaaacacaaaaguuccacuuaguagcagaaaagucacucuaagaauaacaggcacuggccaaaaauggauaugacuucuucaaguaagccaggcauaguggugcaagccuuuaaccuaacacucaagaagcaagggcagguagauuuuugugaguuuuaagccagccuggccuacauaguuccaggacagccagagcuauguaguaagauccuaucucaaaaaaaaaaaaaaauauauauauauauagauagauauauagauauauauacacacacauacauacauacauacauacaagcaacaguacuuuuugaaaaaugcuugauaucuuaauaggaacaucauuucuauguaaagacauauaaaauauacuaauuaaaguuuuaagacuuuuuuucaagauccaacuaagugauucuaaauacuguguggguaagaauagucaagauagcguauuuuguuuggagagucagguaugcugugcauucacucagccacggauuagacacccaagcccaagguugguuggguuuuaucagcaccagaggucaaacccauaagacgauguuuuagcuagguacuaagaugaaaacucaguaauagugugaaacugaccauaaaaggucaaaaagcagaaagggaaauguucuaguuuccuuucugcugugguaaaaugcucugaccaacggcagcuuggggcagaaagcaauuauuuggcauccauauggucauaguucauaacugaggggcaucaagaccggaauucaagcaggaaccaucaaggaagacugcuugcuggccuugcuggcucaguggccagcccaugcuuaacugccaugaagguuguguuguuguuuuuguuuguuuuguuuuucaagacaggguuuuucuguguggcccuggcugcacuggaacuugcucuguagaccaggcuggccucuaacucccccacaggucagucugaccugggcagucccucaauugaaacucccauuuugggugacucuaggcugcaucaauuuggcauccaaggccaggaugaagaauggccaauguagaagaagucaggacuggaaaggagguuccgcaguuaaagcugccugcuggacaauccugacaacuggaauauagguccaucaaccauuagcaggccaauggccccacuaugaggguaucacccucucccugcuuccaugugugcacccacacacgagugacagacacucaugaagacacauauacauacauaugcauauauaacuaauauauuuuuagagcaaaaacuuaaaaagaauuacagaagacaaauaacaucugguuuggggggagggggugguagagggagugaguguucguguggagacagucacccucaugaguauuuuaaaaugccagucagaaccggaggcuuagcucagugguggggcguaugcuuagcgauugcuagguccugauuuuuuaaguccuggcaccaaaggaggagaaaagguuaaauccaacuugagaagcagaaacagcagcaaaaccaagugaaguacuuaaagggaccaugaugucagcacagauccuaggcagucgguuuucgcguaggcaucagaagggauggguuuaauuauguuauuuaaccagccccgcaucgucccuuccaccugcccccugguccccuggucucaaguaacagcuaguucacugacuuuguuuugcacucugcuguguugucccugacgcacgcgcacaggacuccagcagcucuggagugccguguguaaagagcgaugugugcucagggagaggcugaacugaaaaggaggcauggcgccuuccucuucccucucggugaaucucacccuuuggcucccacuccucuccaguaugugcccagugcucuuugcugccccagcagagccagcauccugacuggaaaguacccccacaaccaccacgucguuaacaacacuuuggaagggaacugcaguagcaaggccuggcagaagauccaggagccguacaccuucccggccauccucaagucggugugcggcuaucagaccuuuuuugcugggaaguauuuaaacgagguauguggaaugaucuccuuccuuacgacggcauuuaauuaaugggaauuaauuuauuuccuugguaucaucaguucacgucaugcuauucaacaguuugguucuaugcggcuuuugcugauccgcccauuaauuagacaagcacagugugugcccagcucugugguuacuuucuuuucacacagcccccacagcaucuauuuacaaacuguccuaaguguugggacaucugccccacuccccugaggacaucugggauuccucagucauguggcugucacagugucuauguuccauuuccucuuuuucgguaacaaggggggaugggacuagacacuuugcucaguuuucuuagaucaccucugaauuagaacaguucaaccuacggcucauuuuuugaccugcagacugaggacagacauaaagcgagcccagccuguggaggguguaugcugagaggacagugccccgugggcugcgaggcuguggaagcauagggcugagcgguugacacuggccucgugggccugugucggguguggugccucacuguggcccgccacucagggcuucauagccccaagugcacccccuuaucuugguuuucuuagaaucuauguuaaaaggaaaugaugcauuggggguguuugggguucucucuagugauaauuaacuggggugcccgggggaagaggugugcguuuucugacuuucuuuucccguaguagcuacaggucuucaugucacaugaauuuucugugucccuuccucccugucauuuagggggucugugaacugugggcuugagggaggaugagucaguuugaaagaaucgugagaagcaggaagacgcucuguauugggguuggggcaaaucgguggucauaagggaaguuaggcuacuucacauugaaagucauuugaggggaacaguguagugugagacagucuucagagguuccgcucucccuacaaugggcaguacuaaacuguauuagauggggggaguguacugucgucucuucuaauaguuuuaccaaauaaauggagccucaaaaguagauguuauaaggauggccaaagucacaggcaagcaggcaagcaagcgccugauucucuuggcugugaacgaccaaguaucuuuuagauuauucaguuguagcucagcacucgcccaugaauaggucccacguaauguccagauggcauauguugggcuuaaaggccacacgucucccagagcuucugcagugccaccacaguagaaaugcagcuguggacacacucugugggugaguuugccugacugugugcuaacaaaaccauccgcacugacaucugaggucugcauagcucacauuucacaagacagucuucucuagacagcucuguacguuuaaaugauugaaugguacacuggccauccgagacagccggcaggccaggucagcacagcgacacgcacgguuacagacucugcugaggagaagccucgggucacaggguucauuaugcgcuaggucguguguuuggggaagcugagccccuguugucucaggcacuggcugaaagguguucucggcugcugguuucucucuggacucucuaaggagcucuaauaccccgcucuacuguccuugcaguauggagccccagacgcaggcggacuggagcacaucccccugggcuggaguuacugguaugcccugguaaguggcuauggaacugaaugacuagacggggccccauacugcacaaguguuccaccagaugauuugucucuaacgaaaggcuggugagucaccucgucccaggugguucuccugccauuaguggccugagucacaugauucccuggucuucuugagccacgucuggcuuuuaaaacagcacggauuaacaaagcccugcuagucuaugacaaugcuccuuaaccccagcucagugugacacaggcagacgccccucuucugucuugucaccuuuaaacagugcacuuuagccagcaggaggucacacuuuggcuuugaauagugaccuccucacaacuuuuacuuccuguuucauauaggaaaagaauucuaaauacuauaacuacacccucuccaucaacgggaaggcacggaagcacggcgagaacuacagcguggacuaccugacagauguucugguaaguucugaggcucagcagccccgccucacccaugacugcuucgucuagacagcagcagauaugcaucggcaaacagaaaugcgcaacgacuuggucugucugccaaagagucuuuccagcuuauuaaagaccucuaggcuguuuuucucuguauaagagccaagacucacgucucauauucucaugauccagagguaaaugccucugucugcgacugugguggccuuuacaggccucugggcgaggcugggcauaggugaagcacuagcgucaggugacuccuccccuccucacacguuucuaaggaaacuuucugcugaguguccaccacacagugacauagcagauguucacuggagagggaaaggccaggccuuuggaaggcaaccucuuccggcuggaacucucacgagggccgugggggcguggcuauguacgcguaguuauuuguugcaaucacuuccuacucugugaggcgcugcugggugacauaaggcagaaagguaaagcgugagagguggcuucucagcggacaccugaaagauggggggcagggguagggggaaaggggguguccggaugaggaggaggcagcuugaccgagcaugccugagccagggagaggggacacagcucauuggguuugguggggggggcaacuuuaccugacgaacccucccacuggccccuccuaccauucuuuuuuuuuuuuaaagauuuauuuauuauuauaucuaaguacacuguagcugucuucagacagcaccagaagagggugucagaucucauacggaugguugugagccaccaugugguugcugggauuugaacucagaaccuucggaagagcagucagugcucuuaaccgcugagccaucucuccagcccccuccuaccauucuuuaaggcaucauugcuauaaauuaauacuaaaguggacaguuuacuauuccaccagcccccuccuaccauucuuuaaggcaucauugcuauaaauuaauacuaaaguggacaguuuacuauuccacauuuuuggcggaacauagucucugggucuuauagguuaaggucucaguugcucuccuugguagacuucucaagcuccacaccagauguguuauagcagcagugugcugcacaugaccaugaaaugaaagagauuaguauccacacugaccccaccugcucucucugucuaccaagagaaaccuccccauuggaugcacgguugcuaggacgguugcuaggcaggccuaggagaugacagcucucugugugugucaggccaaccucucccuggacuuccuggacuacaaguccaacucugagccauucuucaugaugaucuccacuccagcgccccacucaccguggacggcugcuccgcaguaccagaaggcuuuccagaaugucaucgcaccaagaaacaagaacuucaacauccacgggacgguagguuccucugauccucgaagugagucguucccacuguauccagccagucaggaagcgucaagccuuggaaacgggcuccuuugagccuggagggacugcugcaccuguccccaguauaacagauuguagacauguucuuaaagguacagaucaagucccuaccacacauccugugagcagcuagaagagaucccuaggaauggaaaggcacuauggcuccugggcuccugguuggccguuagcaugucuccugccuccucuaucccagaaguagcuaaggcaagucucaaggacauucacacuugcagcggccuugggugauucuccccugaggaggcacauucagugugcagguaguuaacagcguuugucccuuaaauuuaccuaauaugccacuccccuuucuucauucuacccaagguacugggugcccagauuccugggagaauccugccagaauauuuccugaaacuucaguccacaucugaagguucuuucucccuccaacagaagucauauuuucagcaacggaaacauugccacacaccauucucuccuucugcucacugucucccaaacuguggguuuggugagacacugucucucuguguagaccacacuggccucaaccucacggcgacugugccuuugccuccuaauugcuggggucagagaucugugcuaccgagccugucuccucaaagcauuccucaggcaguaacuuaagccucccuuggcugagcguauaaggagaucgccacugccugagucuuaccuagaagucgcggugcuuguagcgauacagaaggagucuuaaagucagagcaggagcgugaguuucucccugugagaugagccagaugcugucccuccugcuguccuccauaaggaggcagaggucugaagccuuugauugugguaaugauugaaauauagagaaacaucugcacccugggccacggcucaggcgugugcuuguuaaguuagguugagaagcugacuuuaagcuaguggacuggccucaauuuuguguuccaaaaagagguacuagaagcauuuuaguaugucaauauuacugagugcaguaguuccagucacgcacgagcugaugugcgccuccaucaacaggggauucaagauggaauuucugaagccucuuaaccaaaaaacgguuggagaaaugcaguuucauugugaaugcugauggcaucugaggguccuucuguuacuaaaauguggcuuuuauguaaauaaaagggcccuccagaacuggaccugaagggguuuuguuauuuuuuuuuuuuaagauuucauuuuuauuuuuaagcguucaugcaugugucugccuuugggguggguuuguuuauguggugcaguacccaaggaggccaggagagggcccaguucccccagaacuggaguuacaggugguugugaacugacccaugugggugcuggggaccgagcuuacggccucugccauuccagucucugcagaacuuaaaguuuuaaauucaaguacaggauuuuccccagggauaucagucucuugaguugacagauccauggauaguagggccuuacaggcagaauguagagagagguaaguuagcacuugcccguuuguagccauaguugccauaggaucaguuaccagaugaaccucacguuagcaggggacacucacaagaguguccuggugccucccagcggaaggcuguggagugguggaguucaucugagaggcugccaggcugcuguagcagcucaggaggaagaggcaaccugaccuagucuuaacauggcuucaacagcuucuaggcaucuugauaaagugugagugauccuuugucuuaccgacccuaggaaucuccuagugugaccauggugacuugcuguuaacguuuguuucuucugaaucuuagaacaagcacuggcuaaucaggcaagccaagacucccaugacgaacucgucaauacgguucuuagaugacgccuucaggaggaggugagugcagacacucuguucucaguguggggcucugagagcagacagggaggugggccagcaggagggacgcucugggucacugucauugggccucacaggcaugcagacacgccuuuauguucaugggcaugagguaccuuuggaccccaagccugacuaaaccauccauguuaagaccugguaaagaauaugacaaacuggaacuauuugcuugacauuuuuccccaugcuuaaagaaaagguuauauaaaaaucagcccauggagagauggcucagcaguuaagagcacugacugcucuucuggaguuccugaguucaaacuccagcaauuacacaaaggcuuacaaccaucuguaaugagaucggaugcccucuucuugugugucugaagacugcuacaguguacuuacauauaauaaauauauaagucuuuuaaaaaaaucagcccaaauauugagcaacguguuuaaacuugauguuuggaguuugcaagauaugauauaucgauuuuuaaaaguucacuacuuucuuuuagaguauauugaauuuggaccagaagucaguaaacauuuuuuuuguagcaccagauaauaauaaaguaaauguucuaagacugcaggccgugugucccaaaacaacggcagccuuagacaauauggaaauauugcugugugccaauaaaacuuuauaaaaacaggcgaugggcaagacaagcuuuggccucuuaccuuaggccagugccuaguauuuggacuauuuuaacaagauuguagcacagacuuaucugaaccaaucuguaguaaucuauacugaauuaccaucuuuccguucugaaggacuuacuguguucugggaugcucagugguggagccugggggaccggguugagcauuagcuguuugcuuuccugggaugagcguuucuguguggccguugccccugacgggccuuccaccuguguccuccagguggcaaacccugcucucaguugacgaccuuguggagaaacuggugaagagacuggacucgaccggagagcuggacaacacguauaucuucuauaccucagacaacggcuaccacacaggugagggcaggcggggugagcgcugucacgcccucgcuguagcagcuagcgcuuuacagcugcgcacccgccaggccgaggggcucauccucgggacuccucggguagaaagcauuuccacacaagaagccaggcuucuguaugcgcugugggagaugcuaggccagcuggucucaggcaggagugcagaaucguuuaccaaguuagagacagcgugggaaagcgagacgaucucgcaucuguagggugaguggaacuuagggaauguguugcuguagacggggaaacgaaguuuuccugcaaucacaguuuuaucauuaaucuugugauuuggagagugcuucuggcuuuugaaaacugcagugugagugaacuccaugccuuugacuuccagccuucuagccuggaccccgauagcuacagacauguuuucuguuuucuguguguacacauuugcucuugaguuaacacuaggcuugcucucacuaggacagacagacugacugacacagcgucuguuacguuauaguguggguaucuuaacaggcagcguggaaacugguguguguggggguguagguagggugauggugugugcuguuguauuacuuacugagaaggcugaggcagagggauugcuugaguccaggagucugaggccagucuggucaguguagauccugccucugcauggcagagagaacuaauaaaaaccuccuuccugucuucccacucaagguuucagcugcagaguccuucccuccuuccucguguuuuucuguguguguguguguguguguguguguguguguggcgggauagggaaggcaggugggaucugcagacgacauuuagacugagcuucuugugcacgcccggcaagggcgcuaccgcugacuacaaccccagccguggguggguguuugagcagggucucgcuucaucucuuagguuggccuuaaccucguauuccugcugccuugaccuccagagucuugggauccuggggucccaugggauccggcugcuucucuaaaagcuuugaagcagcucccggcacuuaggagugcacagauggucccgggcccaucuaaucuaucaagcagauaaggccuggaauuuggaggccucuaagccuugguguugcuugcugauggcugaggaaagugcucuuccuuugcagcacuucuuaucccggcuuggcugcuugucuugugaggccuugcgugcucauucccacucaguauuuccuguagccugguaaugagagcugaggccugacgcagucguaccuucaggccagaagucugccucagugaugcagagcuaucucaaccagcucagguuaugaggcccaccguguggcuggcucacuaggggugccaguguugaugggugggucacaggguggccccuuccugugacccugucauugccauucccuuugcaggcuguugcuaaaacucuccucagacugaacuugccaaccgcugacaccucgcucuguccuuauuguggucuguggguuccgcgggaaggucuuuccucguuccgcggcccugcacugcagugcucaggggacagggaauguuccucccuuauuuggcagugaugacauucgcccaggucuggccucgucuacauaaaugaguguguauuugucuuucaucccuucccagacacuauucucaauuugucguguuuagaacagguucuuuuuaguuauuuaucuggcaaacucuuuuuuuucuguccuguguugaaaagaaaccgaggcaagcguaagcucucugugauaaaccuagaauuaaggcgcuagagauggcucgugcuuaaggagacugaaugcuuccagaggaccugaggucagugcccagcacccacgucaggggccucaaggcugcccaucccuccagcuccaggagauccagcaucuccugcaccuccuagggcgugcacacaugugccauacauuacacacacacacacagaggugcugacuguguuuuguugcagggcaguucucuugacucuguguuuucuugcagggcaguucucuuugccaauagacaaacggcagcuguaugaguuugauaucaaaguuccacuguugguucgagggcccggcaucaaaccaaaccagaccagcaagguaggugcccgaccgcaccugauccuguguguggagcguguggcuugagaacguggcugucccucuuggcgaggaaggcgggccauaugcucuucugccuguguggaccuugggaagaguggccuguuuguccugcaaccguccacugcccucugugaauuuccacugccaccucauucauuucaaaauuuacuuccagcacuggugacucucaucagaaucacugugugaaauugugugggguuucucaccaguuuucaugugagugcauguauguucugggaaugaauguaggcagguacgugcauguguguauacaugcaccuguacaugaauacauguaggggcccaagguacgaacucaagaacaaaaagaaaaaaggguucucuaguuuuuuguuuuuguuuuuauuuuauuuuauuuuauuuuauauuuugguuuucgagacaggguuucucuguguagcccuggcuguccuggaacucacucuguagaccaggcuggccuugaacucagaaaucugccugccucugccucccaagugccgggauuaaaggcgugugccaccacugcccggcuagguucccuaauuuucauugguuaagaaaguguuuucucuuugauaucaguagucauccuucauucauguuggcucacagauggguguugguucaugagacaguucacuggggcucucuccagaaagcagacggcuccaccgagaaucugcucucuuccaccugcugaugcuuguuuauuuaaaccuuaaagggaguaguuuaugaaucuuagcauuuccugaacuuguaggauuuuauuucccaaguuccugagucuacacaucgggagcgaggaguaucuagggauguccccucccuuacguccccuucuguccccuucugucacgugaugugcagcaucuucugucgcugccauugguucagucuuucccagccugucucguugaagcacuuuguucauagaggcgcuggccgccugauccuaaacacuuuucccuaguggucaggaggugacaguaggcaaccccggcuaugucuucucuccuccugauuuugcaucaucaccuaagcucugagaccagagaaaagcaacacacacauaauugcauuuaaagccgcaagauggcccagacauccggguagugggugcucugggcugucugugguugguggagggcaccaguacuccuccuuccccaccuuucccugcuuccuauuucagcuucuuggugcuucacuguuaaacuguccccagaaagguagaacggccuuccuaccuguccuacaagucucggcacuuucucaacaggccagcugggaggucagcagaucuuaagugugucuuaccgagguuggcuuuugaucugagugcaaaguccauauuaguagguagguggugcccuucugagaagcauggcaccugggacaucauguucugucagaaagaaacugaaaggaagcggagugacuguguccaccagcugcgggaagaacagaccguuccgucuucuccgccgcugacucgugccacgcaagcgggaaggucagaggccucaccucucuaagcaggcucucuggggaaagcauguggggccuguccaauuggccaggacagggguaucggaagauacuucaucugcauacucaggagagacagggucugaggggaaaauccuuauaaagucaaacaaggagugaggccugacaguugucaggggagggaauucuuacuugccgugauaguguugcagccgacuuuuuggugccaggcuggauuggggaggaagcaaugcuuccuuaugugagauaccuggggauagaguucuccuccaccauuccucauucaucccacagaggccagaacggcuaucaaguccucugcaaugguucucaacuuguagguuauggccccuuugggucauauaucagauauccuaaauaccagauauuuuacauuacgauucauaacagcagcaaaauuacaguuaugaaguagcaaugaaauauuuuuauggugggggcggggaucaccacaacuugacaaacaguauugaaaggucacagcauuaggaagcuugagagccacugcccuagaacuauagguagaggugccugugagccacccaauaugggugcuuggaacugaacucagguucacuggaagaucagccagugcccuuagccauugagccaccucuccagccgcuucaucucuaccuaagugugauaccccggcuccuuccuagcuacggaagcuaaggcagacccacccacagcagcucagccuuugcuggugcuggaccucucaagugcucagagcucuuggcaaauggacucuuuggagccuucugggguguucugugacuugcuuguagcagcccugcuuagggugccuuguggggugcuguaugccgugccuuacgcagccccuccuugguuggcuuuagugucugagaggacucaccuuguuugcacagcuuaucagaagccugugugagaccaagguagacaauucccacuugacuuuucugcucacaaucuguaacuacaucaggucucuagucuccuuacauaaugugggcagauuuugaagccaucgcccugcauguuugucguucuuaagccaucuuagugauuugauuuguacuggaauugucagccuuagccacugagcaaaaggcuauuaaacagcgucucccauccugcagcgcugguauuugaagagaguuuuggugagacuaacaaucaccauuuccauucugggcucuuacugcuuuagcucauacaacuuaucuuguacccugcuuugacucccaguaccaaugacacaggcuccuccgcacaccuccuggacucucggggcucguguuucuccuauggugaucucuuccuugucacacccagacaccaacugugaaccaagcugcucgguucaccccgcacccccccagggccuugaaagaaggaagccgacccgugucugggggggaggggggugucuggguaaucucuggagacagcuccaguacacuuucagugacauaaggacugcugcuuccugaagugucuccauggaauggcaacccacgacagcugccgagaggcacuaauagauucagagccagguuguguaucagggcucucccagccacccggaaaccugagccccgacccacaaugcucugcuccugucugucauacaggccuuccaauguggucuuaaauuaaaaaugacaguuacuugauauuuuuuuuucgaucucuguuuggcugccuaaaauggcugucuucuccaauuucaaagacauauuuuguguguaacacaugagccagaggacagccuuaguuaauguuccucgggagcuggucaccgaggucuuuuguuuuuguuuuuuuguuuguuugguugguuuggguuuuuuuucggggggggggguguuggggggccagacggggucucacuaugucucccuggcuguccugcccugacuguccugcagcucacaauguagaccaggcuggugucugucccccagagagccucccaagugcugggauaaaaggccugagcccucaugccuggcuucucagcucgguuucuuagacaagggcucucuggccuggggcucacccuguaggcuaagcugccacguaagugugaggacccgaguuuguuccucagaaugcacuugaaaaaagccugugacuccagcacaagcagccagaggcucucugaggcuggugaucaguaagccaggcccgugagagagaggcucuguacaccugacguacucuggcugacacacacauacacuugugcacacacacacaauguaaagguuuuuacaugaacacugacauagccccacuggguugaaauggagccaugcagcuuuaggagcucagaaguguugaucacagaaggaaaaccaccuucuaaaccaggagaauauguugagguaaaaauguaagacuuuuguuucugguuucuagaaugcuuguuuuaauauagauauauagcuauagauuuuuuuuauuuguaugugugcacacacgcaugugucauggugugcaugucauaggacaacuuguggggacugguugguucucuccuuccacugugugggacccaggauugaggcuuagugaccagcacccaggcccuagaguguuuucgguaaagcaggguuugugcuauuuaaggaaacauguugaccaguuggaguagcuuuucugcagccuucacagccuauugcaagaccaggcagguggaacacaccuguauucccagcauugagacgucugaagaaggaggaucaugaguuugagaauagccugggcuacauggcacacccuguuuaaaauuaauuggggacagaguaguaguaguaguacugucacuuugaagacuauagcaugaacucaucuuccuugguuuguuugugggugggggacagccuggucuaccuagugaguucuagaacauguccugaguuguaguuggagucuggcccugggcgggagagcagguuuuccggaggcgacggugccaggcuccugguggguggcuuaguguuucuuggguuagaggagcaugagacagcccggccucagacaguuugcuucacucacgcagaugcuggucucaaacaucgacuugggucccaccauccuggaccucgcuggcuaugaccugaacaagacacagauggaugggaugucccugcugcccauucuggugaguuuaaagccacagccaacccugcgccgagcuccggaguuaaugccagguggacauugacaagcuacuaaaucugagaggcagagagcaggauugucucuggccuugugcugggaagcaguuccccaaaggaaaagucugacuggaccacgugucaccuucagccucuguauucucuuccccucuccucccagggggggaaaaaaaaaugggucugagagcguagagguugccguccagggagagagcagugaggaaccuucuguaaggcucagggaucgcccgggucacugugcaaagauuaccuuagagucagucagagagaugccugugcugcuggcagaguggugaggacuaagacugauagccacuguugccgacgucugggggacagagacugcucgcacaggcagauagccaaccgacagacccauuuacucaccugaguguuagcuacggacgcagcuacaggcagcauugcauagcaugcagaggccuugggcuugguguccgguaccaaagacgggaggagagggggagaagaggaaggaggagaaacauugaaaggugaguguuaaccacguuggugcgucuccucauccccaaggacacccucccauugguaguuaucgauguuaccuuagacaguuagggucuugcuuugaaccuucacacacacacauucacacacacacacacacaugcacacacacacggggaggggccaugcacacaggcacgauacuggacuagaucucucucugggcacuuuuuaagauucaguauuguuuccaagcuggauccauauuguuccgggcucccauuaccuaaaggcauggugaccugguugcccgacucuucccaggaagggaugucuuugguggccuaguucuguccuguuugcugccuucacacacguguccccagugaccugcacgcucaccacgaugagaauucccuucauccuguguaaacugucgguuuaguuaguacaagcuggcccagugagugaagagcaguauuuggucuccauuuugcauuuacuuguuaguaaggugaggcucucuucugucagcuuccuucgugugccacacagugcgagagcagacaauuccauguggugcaugagagcagacaguucggucguuucugguguugggccaucacaaccuaauuccagagcaucccgccaucccagaucauuggucaccccuccgccaucucuuccccgcccucaggcagccuauaacccuuuaccucuguggagucaucuacccuggacgccaaguguaugugcagaacagaaaugcacaggguagggcuuccccugucuugacauucaaggccuuguauaagcucgcucccauuccccacuacauguccucagcuugacaccacagaggccugugggcuugcuaagaccugugauucagagcugauguagcagcacacugagagagccagccugggaguggugcugcucagcuuccugugcaccagugugcgugugaaaccccgcaucagccacuagcaccagaaagacaacccuaggacacgagacggcuggugucacgugugcggcacccagcugccaaggaagauguuagacugacagaagggucccuucuagucugccugccuucggccuuccucuguccuuggcugaugucugaagcggccuugcccccucucacucaagaccacccucucucugcccaccuccugccuguuguccugccuugugccucagccucccgagcagcuggugcugcagaugccccuggcccggcuugccugcugcuuguggccugcugagguuuaggcccuggcucucccccccagucuguuccugcuuccuccucuuagaugcugugguucacaacccacccaggcuuuuaaacccuagcuugcuccuguccuagaggccagaguguaugucccugucucagauguuuguuuccagugcugucuccuuucuccacacagacaacaugugcagagacugaacgugauuguauggguuguacgucaucucaaggccucaaccccacaccccagcacagccucuguguguguguguguguguguguguccugcugcccagggcacgcagagcgucugccaggcuaggcccccguguguucucccaccuugaccuggagccaccugcaccgccuuggcuuucauccccucccgcuucacauaccgcccuuaaagggacaguaaagcauuccaggcaccagacuguugcucugaagaccguaagcaccagaaacgacauuagugacuuuccuacacauccggccuucccauucccuuuguuacagcugucuaaggcccucaggcagcgcggugagaacugguggucacuuaucaguccgugccucacgggacccccacaucugcucuucuuucuagaaaggagacagaaacuuaaccuggaggucagacgugcugguggaauaucaaggagaaggccggaaugucaccgacccgaccugcccuucuuugaguccuggagugucugugaguagcuugucuuugaucacagcuuccuuaccgcaaggcaggugcuauuuagacagcucggucaccugagggaccugagugagugacgcugcuggcaucaggcucucccaguuacauagacacgcccacacccgccagcuucuccaucuccuaauagcaggagagaugggguuuguccccguggcugugcuaucacuguggcagccaggcaggccacagaggugacagcagccaugcugaccuggcuuuggggacagagccuugguucuccugacagcaaagguuccgaguaaaggacccagcccagugugcugcacccacaucugaucucucggagagcaggggcaggggacuucugagucccaggccagcagggaauuacagucaagcuguuucauuuuguuuaaacucggaguguuuaaagggcacagcacaaccaccugugggcuagcagagccuguggagaccguggagucugcuccucuguagugccaagcgcacggggcagucagacaguccuucagagugugucucuuucccggggucugccuucugccagccugugccagcauugccaccugagaugcugaugcugugucagaacaauccucauuaacuuguaaacugucccuccagcaauguuucccggacugugugugugaagacgcguacaacaauaccuacgccugcgugcggacacugucaucauuguggaaccuccaguacugcgaguucgacgaccaggagguaaggaccgugugccugaacaccccucccacaccacaccucuuguuuaggcuugguggcaaaagaugaagccagagcucuacccagggaaggccuguuucuucucugcacucccccaggucuccuguggcagcaagucaggcucaugcgggcagcuucauucugaguuuucucaauggaguccucuccacucaccaccuccacucaguuggccugguaauagggcuaacagugaggugcuuggcgugugcagagagaggagcuggccagccucugacuuacccaggagggccguccugggagaagguggggcuugagccucacugacacacgugggucaucugaaggcuucuguggacgcagggaggcaguguccgcaggugcgcagcguguccugucuuccuguauguguguguuagucugagggcugaggcuuaaagcccuuagagccacccuuuaccuccguguccuggccuucuguuuggagaacagcgugcugcagaaagugcugauguccgcuguguaaaugaggccuucugccugugcaaaccaucccagacuacuucuuaaaauaggggaugacugguguaccacaagccaggaugcuucucacuccauccuguugcuuaaguguuaggauucugaggaaaacauauggccuccagcgcuccccgcggaguagcugcagagcugucuuguugcugaggccaggccaucgagagcucaccugugcucagccugaggacagugguccuccuccuuccuaaugcugcgagucuuuaauacaguucucaugguauggugacccccaaccaugcaauuauuuuauugcuucuucaugacuguaauuuugcuacuguuaggagucguaauguguaugugugguuuccaauggucucaugugaccccuggguaacaccaguugugaacugccacucuaaagggucaugagucacuuuccugaagauaugggguagacagguagcugcagaucagcauggggcugugugucuaacacaagugcacccugacacagacggcaugugaucacguguggucugggagccuuagaccacaugauggacaggccuuggcuuuuccucuccuccuuccauuuccauuuagaaauaauugccgcaggaggauucucucaauauaaccuucgcucucuucuucccuccuuccuuucuugccucuagguauuugucgaagucuacaauaucacugcagauccagaccagaucaccaacauugccaagaguauagacccugagcuuuugggaaagaugaacuaucgucugaugaugcugcaguccuguucugggccgaccugucgcacuccaggggucuuugacccuggguaagugucuuuccucagugacucugccacugccucgucuugagaggccaggcucuucugaagacagaggggagcuaggggcuccuuucugcuuugagcuguguuuguucuucugcucuauugagaggaugcugcguucccucugugucagcuuguuugguugggaaaauaaacuguuugggacuuggcucuguaccuuugguggcugcugugacuacaagcucagcccugcuuuccugucccagaguucugcuugguggcacuggauagcucuggcccacccuagccccggucugagagcauacugcuuuauuucucagaguauuaaacacuuaggaaaacgggugucaaauguaacugacguggcuuaccuguguuacccagccugccucacucuggaucugcuuacagggcuggggcugcagaacacugccugccacugcccaggaguucaggcugugaacgaguagagaaauggcucauggacugucacacuguaguccacacacagccaggaacacagaguccacacugucagaaagggcugucaugcuggucaugcaacucucaccuccauccccaaggcaaccccacggaucaggccccagcuagaaauugguuugagacaggucucucuguccuggaauuugucauguagaccaggcuaccucuuccucccuaguguugcugugauuaaagguguuagccaccaugccuugcuaaaauggaaaacguuuaaauagcuaggccacuguguaaaaagacaauacaugucgaucugucuagcuuaaaccaaguaauguuugaguggagugaaugucguaagccugguccgucacguccuuuauccagccuucaccuuccccagugucugcgcagacgucagcucacaguguguaucaaaccaaacggacuuaaugcuucuagccgugaguucuaggcugguuccgggaauugaaagcuguaacuaagcccuugaaaggcgaguggagaaaucccugggauugugacauauggccagcagucccugcuggcuuagcugcuggagcacuggccagccagagcagggugguuucaggugcuguccugcuuguccuggacaucuggagcggucgucggcucccuagagcccagcgcaugcaugucgucaucaucagacacacaguuugcccgggguucacuggcugcccgcaucauguuucuccagcguuuuguuuaugucaacccugaugagaugcugguuaugugugcuaucgcuagcccaaguacguaaacaccaacugaguuuguuucuaauuuaucaucccaggauauucuuuucugccaaacauuuggccuuccaggauccucugcaguagggucaucggacuggauccuauaggcacaagcucuuaacgcagccacacauguguguuguacagugucuguggcuggaugguccacaguccugaccauagcaucugacccuuuacaaaaguguugcugcagagaucggcccacaggcagaaggaguguaaauucauugccagguuucugcucggcucauggaaagcccauuucuggccagucuggauucuuuauagccacaaacucucagcuguucccauggagcacuuacagagaggguuccauacauucuacaugaaugccucucuguuugauggccagagacaacuuggaguuguuuaaauucaugagccuggcucaagcacacaucuaagacccguguuugugugugcgccaaagugccagcggcuagaaaagaagaagcgaucucagagcuugaguggagguuaagugagggucagcucuuccaucuggaugcuuuauaccugagacucgcucaccucccguagccugccugccugccuuuauucccagcacucagaagccugaggcagcagguuggggagucugaggccagccuggugcguagcaguuuccaggccagccaaggcuguguaguaauguuuuguugcugcuguuuucugaaggaaucucccuccugcuucuugcaguuaaccguguugcucuccucaggucacagcuugcauggaaaaugcucucggcuacugaaaccacauuuaugugacagcucccugcuuggugugucagucccucccggcagcucucugcugcaggauaugccuuugaagucacauggcuagcgagcauucacgugacguccucccuuugcuucccucagguacagguuugaccugcgucucauguucaacagucacggcagcgucagaacgagaagguucucgaagcauccgcucuagcagccucugcguuggauccuugcacagccuuuuccggugccgugguuggagugggagcccacgccucgggagcucuggccuugcucuuucaagucuuguuugaaaaauaauccagucagcugacuuccaguacugugaauccgccccugucagaaguggcugacccuguuucuccucagaugacaaccaccacuccugaggucuuuguccucuccuugucccuucaucuuggcugggcacaguauaugaguccccacguggucgagucuggaucuguaaaacucuucugauaauggcaauacuuuagggcagagauaaaaccuuuugguauuuuagcuagcccccaaaucaaaagcacuguauagcauuucacaccgagccccucaccaaaacucacacaguugcgagaagagcugcugucuguggacacguagagaaaggacauucaugacaucccuguggugugguuaaugugcgacgugucgcccaagcucugcccuaagaagcuucuuagugacuccagccaccugagagcgcccaggagcaccagggggggccagaugcgcuuccugagcucuuggaucagugcgcugaagggccgcacuuacaagugccugucuggaggguucucaagugucagcgccacacaagucauccugccuggcugcaguuagcugucauugucauugaaaaucuuagugucuccugguggaggggaaggaccggcugccucaccccacucccugaucucacaaaagugcgaguuuccaguccugacuaacuagggcuccagucaguauuccccuggccggcuucccagaugcccuggacggcacucuguuccuuaaaguccaguuccacccugacguccacagaggcagcacggaguggcgaaacucgguuccagccugucgucggcagugagcggguuuagcuuuacacagccucugcccagcuuuaacuuguaagacagcuaugagucacuuugagaauuccagaggccauguuggggggacagccauugaguuuauuccuuuaccucaugugaccccagcaacuuuggugauacugagaggccagcaggcaguagaguggacaccucggccguggccacuuuagagggggaaaaguuuaaguuuuaaacuaaaaguuacagaauugaauguggauaccggcuucauucacccccacuuggauucuaaacaugaccagugaaauagugaaagcugaccacaguuguucccaaauaaaggucggcagcuccuaccaggucugggauugagauguuagagucuucaguuuuauagccggcuccugaaagcaggcgacaucagagugguaacagucaguaggcugcaguagguguccuaccucgaggcccucagauggagguaacacauuaggauugugggacacaagauccucucugaaccuccugguuaaggaacguuccugcaaacauucaaguagaccuucuauaacagacugcagcgugcauggccucuacccacaagagaugcacugcaggaggccggcccuguucucuguacucagcauuuugacaucuccuuugaaggccagguauauguguaccagugcucuucaaagggagaaccauuaaaaccaacauggaaugcagggacuucgccuuauaagauuuccaguuuuaaaacugccccucagauacaauuucaaaguaggguacacauuagagugucuuugaguucaacaaguugguacuguugcaaacaccuucugaauugccagcgcccggguuuuuauguaaaaauagaguggcuauggaaguuacaccuucaucugugggaaguauucucaaacguagggguaucuuuaucuuauguuuucuaauggaagauggcagcccagaauccucaagacaaagcaagggguaucagcugauggccgcgggacugauggguguccuggguucuuuagcucaccagcacuuugcgcucaauggacuuuguaaauucucaucagcuguuguagaaguuccucugccuggagcugucaucucagccgcucccuuagaaagugcccuucaacggacccuguucacugcugcacuucucaaugaauuaaaacugacuucuguucuaguggcaaug

SEQ ID NO: 5764 - RNA, 1375 nt, Mus musculus
aucagguucuggcuucaucugagagaauauaaggucaucccagggcaggaggagcagacuucugggaggauccacacuuacggagaagaucuggaagauggggacgguuuuguaaccauaugacacaacuuggcugacacucuggauggcguugcuacacaacaacacgagucuucugugaaugccaagucucaggacugagcccagcugccaaaaagaguccagauaauucagugggaauggacaguaagugaaagacuguagaacagugauuguuugaggaggcugggaaugguuucucuuauauaaaaaguguuuggauagcaagugugugugcauggaugccugcgugugugugcaagagagcauguguguaugugcacgugugugcucauguguacguguguguguucacauguguauguguguguguucacacguguguuuguguaugugugagugcagcaccugugugugcaccuguguguuugugaguguaccuguguaugcauguguguguacgugugugugcgugugugcgagcgcguauguguuugugugagcauguguguguauguguguguacguuugugugugugcauguguaggugugugaaccagaccagauccaagaaucaaagugguccccagccugaagccaacugagaugaguuuguuggaacaaaacuaaugugaguauccuggcaaccucaggcucucauuccuucagagaauggcuauucuuagcauuacuuuauauuaagucccaacuggggcagcuucucaaaguggacgugucaagaggggagauucaccaucuguccucggcauuggcaagugcuggggauaauauuaaguugucugucugaagccucaaagguugaccaugauuuugaaaguucuuacuaaaaauaccuuuuuuuccucccuagagagaaaucacuucaugagcaucaauugugagguuuuuuuggaugcuuaggagacaaauaaauaaaaccaaguuucucuugucaaggaugaauaugccaguaagcuaaguuuucuaugguaaauuaguuggagcacaacauucaaaauuuuugcuauaucauuucaaucgauuacaugauauuuuuucuaauauaucaacuuaccuuuguccuaaagaauguuugagagcucauggaauuaauguucuaaaaauauguauauguaugagauguauauuuauauaugcauguacauauauagacacuuaacaauaaauacaaguauuugacauuuaacaauuaacacuuuaaaaaugcuaaccuuuuccccccagauaaucuaaaauugucugguaucucuccccacagaaggaaaacaucguaauagcagaaugagucggcuc

SEQ ID NO: 5765 - RNA, 1813 nt, Mus musculus
ugaaauaguauauuuuauuuccuuuuaauuauauguguagggggaaggcaugcgcaugugagugcagucacccauggaggccagaagagggugucagaucugcuggagcaggcaggggucacaggugcuugugaggcagcugauaugagcccugggaacugaacucagcuuaggcgagugcuugguacucucaacccugagccauuccuccaggcccgagaugaugguguggguucaucauuucacaggagcuggaagcagagugggggagggaggggagaggacaaaaacguaaaaggaauguggcucaguuugaguaagggccagauuacucaaggucuuaaauaccuucuuaagauuuugaggaaagugauuuuuaaaaaguguuagauacucuuuuguggcaaaugaauuuaugaauucagacugucaucugccaauuuaaaaauuuuagauuuaauuacaaaauaauggguuucaugguggcaucuucuuacauaggagucacuuugcccucucccccugcccugugcccauccuccugcuggagggcccuucaugcuguaucccugugcuccgugggcccugccucgccuuggccaccauuuuguuuuuaaccaugguuaacuaugaaggggauuagaggguggaauuauuaauaguucucugguaagugcuguaucccuuuauuaaauguguuuaucucuugagcuuugggguuauaauguuuauauucaucuguaaaauggguccaugaacacuaaaacaguuuaucuguggacagcggaugucucagaauuguuuuuuaguugcacacccugaaaagaggauuccuuguucugaugguagucacacaguucucagagugagugggugaagaauuagagucagugucaguucuccuuaauuuuggacaaaaguuaguuacuuugauuaaaagaaaacccacaaaauucaagcuauugccuaggagaauaagaugaaaugcucaagauacaccagaguccuaaaaaugauccagccuaggcuccgccucuuucugccccccccccccccgcgccccugcccaccauccccucucccacugagguggcccugucauagcacuugccuggcaguguguuuagggguuuaugcuguugcugucuugauacugugaaggguuucucagugugaaguggcauuuccaugauuuccgccccucccuccccucuagauuucaccaccccauccucagcccucuggagagcaguuuccagcuggaagugggcgugcugagucaucuccucaaggcgcaggcgcagaucucggaguggaaguuccucccgucccugguuaccuugcacaacgcucacacgaagcuucagagcuggggccagaccuuugagaagcagcgggagaccaagaagcaccuguucggaggacagucucagaaggccgugcagccgccacaccuuuuccucuggcugaugaaacucaagaccaugcucuuggccaaguucagcuuuuacuuccacgaggcgcugagccgacagacgaccgcguccgaaaugaaagcgcugacggccaaggccaacccggaccucuuuggaaagaucuccaguuuuaucaggaaauacgacgcugccaacgucuccuuaauuuuugacaaccggggcucagagagcuuucagggucauggcuaccaccacccacauuccuaccgagaggcccccaagggaguggaccaguacccagccguggugucucugcccagugacaggcccgucaugcacuggcccaauguuaucaugaucaugacagaccgagcauc

SEQ ID NO: 5766 - RNA, 1045 nt, Mus musculus
aauggugaaggccagugugaacggauuuggccauauugggcgucuggucaccaggaaugccaucugcucuccacauagcaaaguggagguuguugccaucaacgacccuuuucauugaccucaacuacauggucuacauguuccaguaugacuccacccaugguaaauucaauggcacagucaaggcugagaaagggaagcccaucaccaucuuccaggagcgagaccccgcuaacaucaaauggggugaggccggugcugaguaugucguggagucuacuggugucuucaccaccauggagaaggccaaggcccacuugaaggguggagccaaaagggucaucaucucugcccuuucugccgaugccccuauguuugugaugggugugaaccacgagaaauaugacaacucacucaagauagucagcaaugcauccugcaccaccaacugcuuugccccccuggccaaggucauccaugacaacuuuggcaucguggaagggcucaugaccaugguccaugccaucacugccacccagaagacuguggauggccccucuggaaagcuguggcaugauggccguggggcugcccagaacaucaucccugcauccacuggugcugccaaggcugugggcaaggucaucccagagcugaacaggaaacucacuggcauggccuuccauauuccuacccccaguguguccauuguggaucugacaugccgccuggagaaaccugccaaguaugaggacaucaagaagguggugaagcaggcaucugagggcccacugaagggcaucuuggacuacacugaggaccagguugucuccugcgacuucaacagcaacucccacucuuccaccuuugaugcuggggcuggcauuguucucaauaacaacuuugucaagcucauuuccugguaugacaaugacuacggcuacagcaucagggugauggaccucauggccuacauagccuccaaggaguaagaaacccuggaccaccuaccccagcaaggacacugagagcaagagagaggccc

SEQ ID NO: 5767 - RNA, 4871 nt, Mus musculus
ugaucgaaacauauagucuuuuauuuaaaauuuuuuuaguagguauuuuccucauuuacauuuccaaugcuaucccaaaagucucccauacccuccccacccacuccccuacccacccacucccacuucuuggcccuggcguuccccuguacuggggcauauaaaguuugcaagaccaaugggccucucuuuccagugauugccaacuaggccaucuucugauacauaugcagcuagagucaagagcuccgggguacugguuaguucauaauguuguuccaccuauaggguugcagaucccuuuagcuccuuggauacuuucucuagcuccuccauugggggcccugugauccauccaauagcugacugugagcauacacuucuguguuugcuaggccccggcauagucucacaagagacagcuauaucaggauccuuucagcaaaaucuugcuaguguaugcaauggugucugcguuuggcggcugauuaugggauggaucccuggauauggcagucucuagaugguccauccuuuugucucagcuccaaacuuugucucuauaacuccuuccauggguguuuuguucccaauucuaagaagggacaaaguguucacacuuuggucuuuguucuucuugaguuuccugugcuuuguaucuuguaucuuggguauucuaaguuucugcgcuaauaucuacuuaucaguaaguacauaucaugugaguucuuuugugauuggguuaccucacucaggaugauguccuccagguccauccauuugccuaggaauuucauaaauucauucuuuuuaauagcugaguaguacuccauuguguaaauguaccacauuuucuguauccauuccucuguugaggggcaucuggguucuuuccagcuucuggcuauuauaaauaaggcugcuaugaacauaguggagcauguguccuucuuaccgguuggaacaucuucuggauauaugcccaggagagguauugugggauccuccguuaguacuauguccaauuuucugaggaaccgccagacugauuuccagaguaguuguacaagcuugcaaucccaccaacaauggaggaguguuccucuuucuccacauccucgccagcaucuucugucaccugaguuuuugaucuuagccauucugacuggugugagauggaaucucagggcuguuuugauuugcauuuucccugaugauuaaggaugcugaacauuuuuucagguguuucucagccauucgauauuccucaggugagaauucuuuguuuagcucugagccccauuuuuuaaugggguuauuugauuuucuggaguccaccuucuucaguucuuuauauauguuagauauuaguccccuaucuuuuagguaaagauccuuucccagucuguugguggccuuuuugucuuauugacgguguccuuugccuuacagaagcuuugcaauuuuaugaggucccauuugucaauucucgaucuuacagcacaagccauugcuuguucuauucaggaauuuuccccgugcccauccauaucuuugaggcuuuuccccacuuucuccucuauaaguuucagugucucugguuuuauguggaguuccuugauccaauuagauuugaccuuaguacaaggagauaggaauggaucaauuccaauuuuucuacagaaacauagucuuuuuaaaggacaaaccaaugccaguuacaagagcagucgggacccacagcgccaucuucaggacacucuugagaagcaauaagcuucugagagaaaucaaggaagaccugcagcgaggcuuugagaauuguuagcuuuuuugaggagugcuacagggugaagaaaacauugccuggggcucggcuccaggucugucaccuaagaguuucuuugaagcuccauuucuucacauguaaaaugaggguagcaguucucuucuguaggaugacagcuuuaacuaagcuacuaucuucugacaaaguagcuagcauauggaagaccugugaauguuucuuacuagaacaaagaaaccacaaacccgugaauuuugcaagcuggagguaccugugcagacaucagaaccagugcauuucacgaggcaguggagacucagggagaguuugugucuagcccucccauuccagagugucagggguguucagacuauaacuuggaaccccagccauucaaaaagucugcucuggaacauucuagaaaguaaagauaugaacaaagaggaaaagaauaagaacuucuaucaccuugauauagacauuucauuuuccuuucuuuuaaagguugggcuccggucuggggagauaguucggucgguaagagcacuccugcaaaagcauaugggccuaaguuagaauccuuagcuuccacuuaaaacuuuaucaggcauggcugugcaugccuguaaccacaagauggagaggggagggaagauacaggggacccaagaacucacugucgaaucagcugagcuaaaacggugaauuucuguuuugguaaaagacccuguuugcaaagcaauaaggcagacacugauagaggagauuacuugcucugcugcucuggguugugcgcauguuucuaacauauguacacacagagagacauaaaaccauaugcauacaggcauucauguguaugcucguucaaaggaaaacucucauaggcaaaaagaaguuagaaaauguuugcucugugccagcaagaaggaagucagcagggcagccaaugccacacucaccggugcuguguguccucuugucagucugaagccaggcuggaggcacacauuucuccucaggaggucuggguguuucugggcuucaaaguggcuggcugaggccacauacgacauggagaauaaccuguuucauucagagucuguugauugaaugauuauuauugauagauggguagaugauggauggagagaugauagauaugauagaugauagauaugauaggugauagauaugauagauagauagaugauagagauagauggauagauagauagauagauagauagauagauagauagauagauagauaugauagaugauagauaugauaggugauagauaugauagauagauagauagauagauagauagauagauagauagauagauaugauaggugauagauaugauaggugauagacagaugguagaaggaaagaaagaaagaaagaaagaaagaaagaaagaaagaaagaaagaaagaaagaaagaguuuuccaucucaauauauaaucuaguguuugaauaacugggcacaauagccuggguuaaccuauaaacuucaccaucauuuuugauauaugaaaauaagauguauauguuuuuuuuucucauuaauguuuucuuuuguuguuuuugcuguucuuuggggacaugggagagauuuauuaguuuuucugaguuauuuugauauuaauguauuaucugaguaguguggccaucaagcuacugcaaggcauccugacacuaaauucagugguugaaauuggcaaauauucauuuugugaaugguucugugggucagcacuuccggcugaguuccauggauuuacuuaugugugugaggucaggugccgacugauuuagaauggcccacgccaacucuacaaaaucacccaucuucuauuagcccaauucaggguuguuuguagcagagauuugucccuacagauagcaaaggcaucugaaagccguaagacuguaucauccccagauaagucaaaaaggccugucaucucaaccugaagucacuugaggagcuguaaugauggcaagagaccauuugaccuggcacuuccuacacauaaagacgucuucauagggaagguagugucuucucagaacaggucugagaaaacagccuuuaucaccagaggcugguauuuggggucucagcggacaugcguaaacaagcucauuucuacucccuaccuccugcagcuuccuaacacgaguccaguauggccaugugucccagaauuacgguggcagacaaaagaggaucuuugggucuuguuagccaccagccuagcuccagauucagugagagaagcuguccccaaagaauaagguggagaaucauaaagcaggagacugaacagucucauucuccucucagcucuguggaccaagacaugagaauccauucauauacagguaguuauacaccacagauacauauauucucugucucuaucucugucucugucucucugucugucucucugucucucugucucucacauacacacacacacacacgugcaugcacaugcacacacauacacacacacacuuauacacaaacaaaaagcaaagaaaaguucuagagagcccuacacuaugggcuccacucccaaacauacccauaaucauacagaccuccuuaaagaccuaaagaugaauuuucugccugucucauuuuacuauaaaucuguaucuaggucauguucaugauucccccaacugagcucguguuagacauuucuccuauucauugacuucaugguauuuuaaugccguaaacgcaccaucugugucuuugcuuuaugcaaaagaggcagaaggaaagcuccaccccccccccgccccccaguuucaccaacuagaggucgcugcuacugggaauaugcaaaaguuucuacuucugcccacgacuauguaugaaucaggaguggggccacugccuagcacgugacugccuagguuagcugcccagaaguacaaagaaagagagaaaaagaaacgccucucugguuccuaccuaccauguggcagaaucacaccucaaguuccaggauccagcucgaauaauaaauca

SEQ ID NO: 5768 - RNA, 591 nt, Mus musculus
caguauucugcuagcagccuucagaugaagauguagaacucuuagcuccuccagcaccaugccugccuggaugccaccuugaugagaauggccugaaccucugaaccuguaagccagccccaauuaaauguuguccuuauaaguguugccuuggucauuguugucuguucacagcaggaaaacccuuacuagacagauucucuccaaagaacagugcccagagcaggaauacuuuugaaggaauguagaagucagauagacacugcuucagcugcucacguuccggggaggggaaugguguuuuuauugauccaucugugagccagagagucgucaguacuucaccuggaguaaccaacuccuugcauguucuggucagcucugugaggugacuacugcugcugucagaggccaguguaguggaggaguggcagcaugcaugugagucacugccacauaccucaaguccucaguggcaucucaggaauuaaauucaggguugccaagauauauguugaacagggggauuuuauucaccuaaauaacuggguaauuuaaaacuuagaauucaaacaauucaaauuuggaaag

SEQ ID NO: 5769 - RNA, 2085 nt, Mus musculus
guggaaaagugauucguuaaugcccauggcagaucugcccagcacugauauugcucugugcuuuggguuuaacucugugugggccuuauuguuaccccagacuccaagucacccugucccagaauaggaugggucuguguagcaaguuggcccuuggagaauuccugggaaggccaaagaaacaacacacucagaauucugcaaaauguauuucggugugugucuagaaaucaugccugucugacuuccagcuggacuugcuugcccuaauagccucagaggaagccuugagugaugaagugcguuugauuuccaagucuagucuuuacgggcgucuuggggguuguguggcuacuuccuuuaaugaaaggcucacucaacccuaaaucucuucuucgcucagccugcaucugcucuucugacuccuggcacuucccugaagagugugaacccugaagcgucuuccuaagugacaacuaaagcuuuguuccucuaacaccaacagucaccacacaaaggugcgggagggaccugcugggguuguguaugcccagugacugcccuuuguggcugggaaggaaggugacaguuaggcuggaccaauaggcagcugucugacugggacaagccaaagaaguuaguguuucagcuaguuuucacaguauucgauuuugacagauuugggauguugaguuuuuuuuuaauucuuagcaucuuaccuccauggggcuacaugaagccagucaugucuucccaccacucgccccugaaagucacuuucuugaaggaaaucaugccccuagauggauauugaugaucaagaauacuuagagacucaggagccaaauuucacucgagaccuuggccauuuggguagggaguccaguacucccaggacacuaguuuggaauccuuuugggaaagugucugauuuguucucaucucccccucccccgugcccuuuccucaucugcccguuugcuuuuuuuuuuuuuuuuuuuuuuuuuuuuuuugagggagcaaguggcggaugcuguugugugcaauuguuugaagguuuuuacuuuuuccuaagugagccaagaucucugaugcuuucagagcacguuaugcugugaugagauucuaauuucagugagucaguaccuccagggcagcuggagaaagcaaugaaauugucuaugcaaggaacaaacagccugacccuaccagaucuaauagagucguagggcagacuucagccacaggacaggauuuuguguugggagcuuaugaaugucagggcucaugaauacagagaaguauuacagccugcagaccacagcccaccucucugggcaaucuucgggugcuauguggcaauguggcgucaugugugugagugugugugugugugcacuggaacuuucagaggaugcuacaugggcagccugacuuccucucugagccucguggccccugucagaugugauugccacugcucuuucaaauucaaaauguuaucuguguaaauagcuuugguauuucuuuuccaugucuuaggugaaguuuuguucauguaacaaccagguacgaggugaccgaauaaagcuauaaacauacuguucaguugucgugugcugaagauggagaaccuggguccuccaucucuccucucucucauuagaugaguaucuugugcguguuuaggggguccugccguuacuucuucauuccugauucgccucuaauuuucuuuguuucuuuggaaaccccaggaggcgccuacuaaggaucaauuguaagaauauguauauggugaucuggguuuccaaaaauuacccuauauauagugaacugagaagaaucugccuggagauugguuuucgaaccacguaccuuuaugccucgugauugugaaacauugacuuuuguaaacccccaaaugaaaaccuguuuaguaaaggggauauauuuuguguguuuugaaauuuaggugcaauguccccuggaaaaagcucaagaacuguauaugcucaauggcauuuuaaauaaaauacuauauauguauauauaaauauguauauaggaaaucuuuaacaaaau

SEQ ID NO: 5770 - RNA, 88370 nt, Mus musculus
ugguacagaccugccggcggggcggggccggggacgccauucccacaaugcuccggggcgugccgccgccgucgccgccgccuccgcuacggcuaguggaagaagauggcggaaggcggagcggcggaccuggacacccagcguucugacaucgcgacgcugcucaaaaccucgcuccggaaaggggacaccugguagggaacggggucgcggggcccgcgggggcccgaggcuggcggagagcugggcgggagcggugggcuggugucgccggcuggugacaggugcggacagguccggcggcggccgcucaggcagcagauuuugggggcaaagguuggaccggcgcagagggccggggcucgcggugggcggugcgcgcccggggcugcgcggaagcggcggccggggcucgcggggcuccggguccuccucccuccggcagugccgcucccacuuggggccuuggcggagcccgggugcaguggcucggcgugagccugccugccgcugguuuuuuuuuuuuuuuuuuuuuuuuuuuuuuuuuuuuugacagaucccggucgcgccgcuccuccucgcucgcccgccgcgcuucucuggucacuccuuccccggcgucguccgcacccaaguuccccauuauuccgauccuuguagucuuccgggagccgggcuucaggauguuugcggcggggaccacacagguggugugugucagggcuccgcugaaaaggaaaccccuaauuuccacuuccuugucaaaaaggagggagcgguguagggaccuuguuuuuuuaauuuuuuuuucuugagagagagagagagagagagagagagagagagagagagagagagagagagagaggcaccacgugguccugugcuuugcuccuggcucgauaggagccggcagcgcuucuguuuggaagugcagcccuucccuccgguuugaaggauaacguaggccugcagaaaguagauaaguccacuugaagcuuaaaggcuugcucauauucaaacuuguaaaaugccaaaauaagaggguacuguaccuaaauaacuagaggaagcauguacaaaauuuaacacucgucagccaaagcaguuaacuuacagaauuauuuaaauaaagggaaaguucuguuuuaggggaagggcagugugccuguguguucuuucguucuuucuuucuuucuuucuuucuuccuaaguuacuuuuccuuccuucugucuccguacuagugguuuauagcgucucaagugccuguuagguacuccaguguggcuaguggaaagagacuuaagaccugauuuauucacaguucucaagugcuuguuaggcacuccaguguggcgcgguggaaagagacuuagaccugauuuauucacagguccaccucauacuuugcagugugacuuggaagcaaauucauccaagccauugagccuccgcaucuccaucuguucaaagagcaauaacgauguuauuguguuugcucuauauuaauucagcuaaauauucugaacuaucugguauucaugaaauacuaaguuuuagugaucuuuuuuauuucugccauuaauuccagacaagugcugugggguuggaaucauuuucgaguuagcuaauaggcgacagcugggggaccugaauugaaguucuuggauccuuaguuuguaagacggcaaacacuuuguguaauuaagaaccuugaugauggaaaacacacuuguugcauuacagccuugcagaggcuuaagucauuauugcuuauagucugcuuuuguuuuucuuacggaguuuauugcugagaagaaaucgggcauucccuagaacaccuaugcuccccuuggccugugcgaucuuaacagauaaauucaagcuucuucucucugguauauugaagaacauuuuuuaaaaaccaauucacucauuuauuguaucauacaaauauaaauaugacuaccgauaaaauagaaauauuuuuuagaauguggauaguuuucucacuaauguuuuucuguugaguaauaucacguauaauugguguucaugguaauauaugauuuaagaaauaccuguauuguggauauuaaacuacuuuuaaaguugguuauuuuuaagcgaguauauuuuucuugacaguuaccguaaaccacgucaaaauguacaaguuaagucuauacuuggguuguuacaaugccuuaauuucaagaaagaacuuaaguccaguuuuuaggcagcagcuaaauaugcaaguuuuaccuccuuguuaauuuucuauuuuguguaaaucagugguucucaacauuccuaaugaugcugccuuuuaauacaguucuucaugcugauucugcuacuaagaaaaaaagagauaggcuuaccauaaucuggaaaucuucguacagaguuuugaaauuauagugaggugcguuaaauuucaccacauuagcuccugagcacuuugcaaacuaacucaacuaccuaggcagauauuuguauuugauuugggucuucaugaauacccaucucuguuuauuuguuuauggguggugauuugaguacacaaguugugcugagauaaagagagcauucuguacgacuggcacuggacgugcaguaagaaguagguaaacagugguacaagaguucucccuaugacaggugagcuagcaaggugacacucauugacaaggaauaaaucgguagucucacaaugcuaguuguuugucuguuuccguucugacaagacagugaggaaaccauaagcaaaguuaaauuagaauuuagaaaauuuaggaaaagacuugagaaacucaaguuuagcuuaggaugaauaaagacacuuuaggaugcacguggcgauggguuuccugacccugguaagauuaaaccccaugugcucagucacuugugggcucuuuaggaaccuaaggagugaagugaaugaagugcagggaaagcugugggagguaaaggguuccaaaucggucugcacugaguagcugugcacaucaucaccacaauauuucuuucaaguuuuacuaaauuaugucugcuaaucaucuucagucauuuuuguguuauguuuaauaauaauuuguuuuuaaccaaaauagcugcgauguuuguuguauuuauauagccccuaguaagugcaguaccuuuaagguaauuugagagaguagccuuacuuuuauguagcaugucaauauuuuuguuucaauacauuuccaaagaaucugaucacugauguuuggacaggagauauugauuucaauguuuagagauuuccuccaucccuucugucuuaccuagaaaccuuugagucuuuaauugauuguuuagguuuacggaauuuugacucuaacaagauaaucugagagaaaaugugcucaguuacuaaagacaccauugacauaaauuccaaaguacauacuuacaaaagaaguuauguguuucccaucaaaguagggcauauauuauaucacagaaaaugaaaauaggaagcaaaacuuuugaaauacuagcauauuagcaaaacuuaaaauagaaagucacauuaaagccuuuuuuaauauuuuuauuagguauuuuccucauuuacauuuccaaugcuaucccaaaagucccccccccccacuccccuacccacccacucccacuuuuuggcccuggcguuucccuguacuggggcauauaaaguuugcguguccaaugggccucucuuuccagugauggccgacuaggcuaucuuccuguucuugcuuguguauuaagaugacauuagcuuuccaagcaagccuguagcguauagauuuacauuucaaagcauuuacgugcccaggagcuauuacauguauguguugacuaaacgacucauuguuaaaauucaggaaaccgcugcuguugcucacauuugacaaaauaggaagccuagacccagagaccuucauacagcaguugcaauuucaccauaacuaguauggaucuuagguuuaugcccuuaagucacuguucuaaacugccucuuguuuuucaagauuuauuuaaaauaguuauacuuuaaggagaaaaaaauaccucuuuuccucuuuaaagaaagcccauuuuauauuuagcaacggaauucucgcguuuuuaucccacacuugucucuuguggcuguuuguuuagaugugauagaguauguagaauaucuuagcaucuugcuuccgaaaaauaaauaauaguuaaugauugacaggcaaauaacugaauauaugggacaguugucauuuuguucgaaugcucuugaccaaauuauccgugaucauuacugauaacagacuuuugaauuuuaauuaucaguaaucauaaaauuauauuauaggugauaaggcccauucuuacuauuuuguagaacuaucacaacaaacaugguaguaaggucuugugaaguauuuuguuuuaguagucugucuguaucuuaaaagcauuugcuuauugccacuacacaaaaaacauauaguuuaugguucauaauuaccaacugaaaaguuuuaguacuguuuuaaugaacuuguaaagucaaaaaucauuuugcagaaaauggaaggcauagccauggugccacaucaggaguguccugaggaucugacaggccucagggcuccauggcugccgagcaaucuguggggcugucucaucacugggugcgucucuuucacuaugagcauaaaauuauauuuuccucaccugaggaucacuuuauuauuuuccaucuuauuguuggaagguuaagucuaaacuguugggcauguggacugacaaguaaaagggacuuugugaaaacaaucgaugcaggcugaaugcaagcaucuuaguccauccuuaaaaucggccccaaaauguuguugugagucuuucuuguaggcgaggaguuugagaggaguggaucacaggauaacggccagugccagccgcuguuuucaauguuuucaacguguaugccugaaagcgcaugcauagccuucuauucuguuggugucugaguuuguuuaaauacacaguuguaauucuaaagucauaggugcuaucauuuccccccuaguaauaauuugaugcuauuacuuacuacuaaacguaauccagacaguagccguucuguuuucuucuuaguucucacacagaguguuuccaauugcuaggguuuuggcuucugguuuugauucuucgguagugucauuccagcuugugcuuucuguuuccauucucuggguuaucaucuaauucauagucagccuucguuuauuauuccccucaggucucuucuuuagguuuucuuaucuagucuuuagguggggagaugacuacauccuuacauuuuaucaucuaguucagacagacagacagacagacagacaaagaccgcuacuaacaaaccccagagaagacuagcaacuagauggccucgguuuuuaguauacauuauaguauguaaggaagacauaaagaaaugcuguuuggaaauaaauucagauugugaaaucagguaggaauuuguaauguguauuugacuucguguguaauggcuuccuucuucaggaacuaagguuuacauggauuuguuauuuuccguccacgagagugaauguggucuugugaaugcuuugggugcacaugaggugggagaacagccaugggaguugguccucgccuuccaccuuaacaugggcuguucaucucugugaaggccaggcuggccagcgcaggcuuccagggagucuugugucugccgccuccuccaggacagcucugguagugaggacacuguuccucaggccuacaaaggucuuuacccaaagagacuaaauaucuccucaguccccacaugguuucuccccagcuuuccaaacucuuuagcaggagggcuaaaaauagugacugccccgucuacucucugguaguuugacaggcccagguucuagggugaauucucugcuguuacuggaaauuguuuagcagaaguauccacaaaaaagcucccuuuguaaaaaacaaaauccccaaaggcugucguagacaacccagagucuuuaaggcuggauggacuguuguuacagagaugguuauaucaaagccuggggauauucaagacaaagaggaacaggguccuuuauuuuggcaaaagauaauuuauuugauaauuuggguuuguuuuucuauucuguuuuuacauauugacaaaguaacagauaagucaagagguuuaucauugauagauuuagaaaaauaauguucauauugaaauuuaauguugaacuuugugauucuaagaagauacauaaaucuguggugugguuuacagaaauaucacuaguguaugaacaguguucuuacaugucugaaauaaguaguguuguuucuauagguagagaacugaagcguuauauggacacagucuugugguggauuagugagagaggaaggauucugaccuaggcagucuaucccccagaagacucuagcuagaucaucuucccaugagugacuggagccauacucagauuaacucucuaagaguagauaauuaaaaagcauugaaaucaagaggugccaacuuagucauacuaguuaagcaucguuucaucuguacauagagggcaccuguggagucuucuguccucacagucugucuucuaucuucugacuugaugcaugugggguuugcccuuuccuguggguuauuuacugccuccugugucauccuguguuacuguacuuuguguuacacugacuucaaauacaucuuccugauucuuuucuaaaaauuccaucacacguguuuauuguguaagugugugggcgguaugugucagggugaggaucaggacagcucccuggagucugcucaucugggucccagagaccaagcucagggcaugaggcuuggcagcaagcaccuguagcuggugggccaucguaaucaauauagauguguaaccccuccacacuuugauguaucaaaacagaaaaacgacuguauuucgauauaauuuauguacuacauaauauucccacuaaaaguggacagcccucuggauagcagaguauaugucauaaucaaguuuagaauaguuuucaucaucccuaaagacauuccauauaguuagcagucaccucccguuucggcccagacucuuccagcaacucuauuuuaguuguuuuggcuuucccgcgucaguaugcuauauugaaauuauguaguauuuuaaguauauauaaguauuucacuacacauuauuaguaagcagauuaucuccuccccuguauuucuuggcgauaauugacaguauuuacccagugaauauuguguaugauagcugacaguauuauucacacuguaaauguuguacaucuuuuuacccagacaucgcucuccugacuuuuuaccguauaugaccuaaagauguaaacacuacuuacugugugaguagccuauauaagggccagguaggugccugaacagguaaaggacuuugcagccaagcucagugacaucugugucucaggaugcucaugguggagagagccagcuccgucguuguccuccucucaccacauacacuguagcguguguguagccucacacucucacuggcagugaggagacauagagggaugcauggagagaugauagguagguggguagguagguagauggaugaauagauagauagauagauagauagauagauagauagauagauagauagauagauggguacauggguagauggauagauagguagauggauagauacauagauaaauagguggguggauggauagaggugauaaaauuuaaaggaaaaggaagacagggcugcugacuaucaaaacaacaucaaaugguuuucauuguuucuaucugauaagguagaaggacaccguaacacccucagcaacgggaaaucauguggcaucuugcaugggugcuucacccacaugaacuccucuaguggaaaagcagucacucacacuugaacuuugaaaacauuaaguagucuauauauuggguuuuaaauacacuuauguuuuuaaaaccugaacauuugugcaauaauaaaugcuaacuucagguaagagugagcaaagagggauccagaagggcugugugcggugcuuuuguucacguguuucaguaguaugugcauggaugauuccuggcgucuggacucugaugugugccugcaaugaagucguuguuaaagagacgcugguuguaggacuuugguucagaggcuguccugcauguccugguauguuuccuauguucaucccgucccuucccuccguaccguccucuguccuuccuuccuuccuuccuuccuucuucccggagaaagagaaguuagagagagaugagggaacugaugcaguaagcgucucccauuacuaacauugguucuuucuugcuucuccuaacucacaugucagagcuguggggucaucucauuguggccucuccauuuccagguaucagugagugugccuuugcuuucuggaugaacaguuuaagaacaaucauacuugaccuccuucuuguauuccuuuuuguguuagcuuaggcuuaaaaaugggucauacaaauuaguucuuucuaagugauggaguuaaggugcagagcagaaaauagguuagaaaugccugaaaucugagggaugaagagcagugaaccaggccacggacuaccugggaacuacuuuacaguugucuuugcuuuuacuaaaguacuggaagucucuguucuagugguauuuuucuuuuuuaaaaucuugcaauggguccaguaaggugacugaacaaguaaaggugccuaccacacaugacaaccugaguguuauuccugggacccacaugauagaaagagaacagcaacucucacagguguuuucugccuuccgcauaugcucagucguucccaccacagccacccucgggacaagguaaaaacuuguaauaaauaguaauucuagcugcagaauggagagcagaguuaaguaagaacaaucagaagcagagagaaacugagcagcguuuacaguaauuucugccacuaaaagugagggagugggaggccacagauaaggagcuuuagacaguaaacaggagagcuacaagugguucaguuguccuacacaugcuggcuacuguuacauaggaucagcuagcucaggaaauuaaaucacgggggaaauaauuuauuugaaugauaauaaaaauuaguaaagauggaggugaggaagauugggguugaaguuucuauggaaaaaucuaguuguauggccuauuaacugggucccagggggggcugcagcaacgggcuuuacagaaucgcuuuucugacacugccacucaagugggaacaggcuaaaauccagcauuugucccuccaaccccgcaaaaaucagcaugacaaguuuuacagggugagcagguuugucaaauuguaacagccuucguuugguugucuguugacugugugugcagcugguguuggcauaggaagaccagccuccauacuagguuggagggaaagaggaaacuguggaaacugaaggcugaugguaaagcccugucagaaaagugagaaugaggcaggcgggaaguggaugaguugggaagugaaccuuccguacguaugcuggcuguuaaacaguggggaggaauagagaagaagcugucugcugggaaaaccuccacagagacaggaguguguuagagccaaagcucagcagccagauagguggucugggauuuaaagaguuacacuguccacuaacaggaagaaugacguugggacagaugucacacuucuagcuuuucugcacaguagagagggaagcagucuacuguccucaugacaucagacagaauugucagaaggaauauaagcaccuuguaggccucuucuacuguuucccuaauccuccuuccucccgcuugcucagucggccaccauucugaagaggcugucacugucuucccagccucucaggaauauucucauccaacuguaauuuuuaugccagcucugcuguaacacacuuguaaucuguaaaccaccgugcuaugcaaaagaugacagggauggggcuggagaagcagugcaacagggaagaacuauucuuccagaggaccaagguuugguucucaggaaccacacgacacucaugacucuccaggacuccagccccaguggauccagugugcgccucaggcgcugagugcauagagcacggacggaaacgcgugcagaaugcccacgcgcauaaaguagaagaugguuucaaguuacuagacacauuggguuuaggguacaacacucaagcacagaacauccauaauauugggcuuaggguucaaacacacuuaucuuuauuuacuuuaaaggucuuucuuuaaaagccuuauaaaguuaugacaguuuuaauguuaaaugguuaagaaauacacaauugccacaauaaauaugaaauuuuauuguggaagaugagauuugcucauaguugggacugagaaguauuaugguuugugugucacugugaguugugugucacugugaguugugugucacugugaguugugugucacugugaguugugugucacugaguugugugucacugaguugugugucacugaguugugugucacugugaguuggcgcaaaguggaagauucagaucaacaccuauuggaugcugagcuucaggaagauccugaugaggaaguccaacaucuguuaaaaaaaaaaaaaaaaaaagauucagaucaggugagaagugcacggcugcagcccaugguaaaguaaguuggugccugagcugugcgcacuuguccacuccuuaggcugaguccagcaggccguuuucagauucaguugucucuuacaagcaguuagguuagggcguggccucuagagcaccagagguaagugccuuucauuucccaguuccacaggcaugccacuugcuuccccccacuucugcccaauuguauauaaaauacuauucaaguguacaacgcaguuugcauuggauucaaauuggauucaucauuaucacuuuuauaucgugcuaagaacuuuuaaaaggcauuuucuuacaguuaucacugacuugggggugguaugugggcaacgcacagcacucauguggaagucagaggacaaguuaaaggauuaauuuucuucuugcacuauguguauaucaaggaucgagguccggcagucaggcauggucguguaugucuacccacuuaacugucuccuggccuagagauaagaacucuugacauaagaucuacccuacgauaaauacagucuuguuaccuuuaagcacugaacagcaaguuaugucuccucucaugucuccugacaccuaccaucuacucuccaguucugugaauauuuuauauacuucauguaaauaaauccuggaacauuugucuuuauaaccaguauuucauuuagcauaaugcccuccaggcuuaucuguuaguacauauaacaggauuuuuuuccuguaacaagcugcguauugcaucgugugucuauuccacauuuucuuuaauagcuaucuauauguagauauuuagguuuuugugucuuaaugcuucagugaacauggaaauguauauaugucuucagcucuugauaguauauaucauaggaaguggguugcuggaucauauauacucugcuuuuuuauuauuauuauuuuugcggaaccuccaugcuguuuuucacaaggaaugcuccauuuuucauuucucccaaagcucaagagcucuacuuuguccuccucuccuccacauccucuccagcuccugaacuaacaacaccuguccuaguagauagaagaugguacucauuguuguuaggagucaccuaacauaauaauugcaucuagcauguuaauguuuccaaaacauucccacauaauucugucaauaagauauagaagccuacaguagaaauguaaucuuuagaaacuaguguugaaagaaguuaaauaucacagaaaaagucuauuauaguaucaguauauagaaaguuaauacugcuacauaaauucuacauuucuuacauucugcacuuuuaauguaggacauuuuaaauuauauuaauggcauuucaaguucauauuucugcuuuuuaaugcuauagguauuuaagacaacuaguuggggaaucugugucuccauuuuaaagguaaaagccaaaaguauuuaagaacaauuaacuagucaucaaacaaguguagucuccccaacagugauauaaggacuaucagaugcccagggacugaccacccccugcucgccaaaggagcuucucugacauuuuaguagaagaauaaagucaugcuaaaugcagaaaauuuucacacaauagucauuauaguaugaaaacucauuaaauagaaggcgguuugucuaacacaauagcauauuauuuuaucaaaugguaaaaguuuagauaguccuauuuaaaaaaaaaaaaacaaaaaacaaaacagauuuuggcuggaugugguagcgcagcagcggcaggcaggcaggcaggcaggcaggcagaucucuagaagugcuaagccagccuggucuccauaccuaguugcaaaaugaccuugucucaaaaauuaaaguuuuucuucuagcuuaauguagcaguccuggucagugcuuagauaagaagugaaaauugaauuagaaaacuauuuacagcaacauuacguguuuuagacucaacaaaucaagaagaaccuaaugcaugcuggcauauccacuaaucccagcacuccugggcugaugcaggagccuccgugguuuccagguuagacugagcucugugguugagagaacaggaaagucucauaggcauggccaacagaacagacucaggcagcugcagcucgcuuaagaaagcuugucuuguaaacagccucagugucccauggccagccagugacuggguaaagaaaacacugugcagguacacaguagaaugcugcucuucccauaagacaggguaaagcccuguaaccagcagcagacaugguaguaaauaaaauaaggaaggaguaaaaaaccgcaaaccacucaaguguggaucuaaaaguuaaucucauagcaguuaggaguugaguguuuagaggcuagggagaguuuggucuguggacacuggauuguuuggauuaaguucugguguuacacuaugguguuagugauacuaauuauguagugcauauuucaaaaagcuagaagaaagcacuuuauaaauaccugaaggaaugcucuucaugcugauuuaaacaucgcauucuguacgugaauaaaacagcacaggguacccuauaaacaggguuucuagauaucaguuaagaauaacaaaacuaccaagaacuauaaaauauaauugcagagaauaauuuugguuugguuugguuuugagccugcauguguguguguugcuggcuuggauauccaggcugacgucaggcuugcucucuuccugcugagucuccugugcugggagugcacgugggccccgcaccugcugacaaguaagacacggcagggacugggcugcucuaugcuuuggucagcuuuugcucgauagacaaggguuuuucaugaauuguuaacguguggauguuuuuguaaagugcaaaggggauuguuuuuccuucuugaccccaaguauuaacugcuuauuuaacaaugaaauauuuuguaugaaugaaguguuuucuuccaacaaauuaacuuggauucuuaugggaagaaaaucuuucuauuaauuuuagugcacucuaaucauaaucuuacguuuugguagaaccugauaaaauucuuuugaaacuacaacacauaacagccaaggcaacuauaacggugagcugaaggaaguguuuuauaugguaucuugauuaagguaauuaaaacacaauagaauugggauaauaauaaauguagaugaaugaaauagggaaagugucucuuagugugacaucuugagaaaauaagucacauguuuuaguaucuuaacuaaauugaaaaggcagaaaaaucuaaaauuuacuguaugauuuccuuuucuuuucuuuuuuuuuuuuuuuuuuggauguacuuacugguuuuuuaaaaaagaauuuagguggggaagaucauauuuucaugggaaaaauaucaaauuauuacauuguacugugauuuuuaaaccaaguacagguuuagaaauggauuguuuuaagaauugcuaccuaccucagaaaguuguccagugugaggagggcccugaguugcauaacugcagaggggcuggguagagcagacuuccuucuucagauccacugugagggagggagacugcucaugaauauucuuaagaauuaggaggguuuguugggucggugccuuugcuuuaucuauuuucagacauagcuguggguuuuucauuucuccugugcuguaugugguaagcccaaaaauguuagaauggugauccccucagaguugcagugcacaccaagcuucaagcaucuuguuagcuuuuaccgcugcuucggccugcauuuggaccuggcuaaaugguaauguccagagggagguuguauagugcacucuagcaagucaggacagaggaggagaguugaaaacuugggugauaacuauugauucuaagugugauuacaauuaacauagucaacuuuuaaaacccuuaguaacaaguuuuccuuucuuaaaaacacguuaaaccauaugauuauacauauuguauuuauaaaucucuaauaaagagccauuuuuauaucuuauuacauuguacuuaaauucuuauugauucguacaauuuuuguucaagugacaaggguuuucuuggcuuuaucauuugaaugcuuuuguaucaugcuacagagaucacuuuccauucuuacaucagcccauggccucaaguagugaguacucgagaaugaugaaaauguuuuguacaaccaagucuuuucccccauguauuaagugcagugcggcuguaaccacacaguacucuuguucuuagucccuggaaggaggcauucucuuuaaugcagcgcagacuaacagagcagauugucgcucuccuuguacuugcagguauuuuuauuaaccagcgucuugucuuuuuuagguaucuaguagauagucggugguucaaacaguggaaaaaauauguuggcuuugacagcugggacaaauaccagaugggagaucaaaaugucuauccuggacccaucgauaacucuggacuucucaaagguauuauuuucuucagugaaguuguaaauguguuaaguguaaugaauaaguguccauggguauacuaauggagaaaguuaauguagauaagcugguaguuagcaauucguuguaaguaugguagguagcacaccugaauuccuuggauaaaacgggagaaucccuacuguaagucugccuugaauacauaaugagacucuuuccaaaaaaaaaaaaaaaaagcugggguuggggagaaaaagauaguuaucugcaggucacucuguaauuguuugguauguauaugacauauuaccccuucauauuuaugaugugauuaugauuuagaauugaaguguuaaaaugaagcauguaaauuagcaagcacuauuuuugguuuggggaaauguucucgcacaugcuguuuuucuuaauggagauaggacauuuucagaguuagugaucaccaguauacguucacauucuugacuuuugcacuguccuucuucaaccuuccccacuugccggaacuccuccagcuccuacauuuaaagagagggagccguccaucccagcaucacacugugacccagugggaucagggaugagacagaccauagagcugaauaacugaagcucuaaccuccauccaccuccauccaugauccacagugggacauccgccugcaccaccauguguaacacagugauauaguuuacaauuauguuuuaaaggauuauauaaccacgagaugucuccauuuaagagaaagacaauaaagaauguguauuuaacuuccuagguuugaguuugguuagccucuaaguuccauucguggccaaguugcuuaauguuucacuucauguggagcacugaauggaccaggcuaguucugaugucuaagagcugaucacagaggccaauaguacccgguuggcugcuguaacagaagacucugagguugaggcuuuucugccaggacagacaguaagaaacaaggcacauuccagcaucuuggcuugcuggugacaguggcaggacugguuucugucuaagcuccguauguagacacacacuggugugguuugcaugccgagaagugaagaacaaaggacagugaggaagacacuggcuuuaguugccacagccugugaauuagauguugcagaacuggacgguuguuccccacagucacggaauagacuaagccuauauccaugugcuuaccugaagacuaguuucuguugugucacucaggggcuacugggggcagcuuaguuuugacagggaaagauaaaaauaagagcugugcuacaccuagcacagcuccgcaagaugaaggaaugcucagaccagaaaguuuucuacagaaggagcaagaagaguagaguaugccucugaccugugguuuguaaguugaauauuaaagaggaagagauuauagaauccuggacaaaauuuaaaauaagaaauaaacaagcccuuguaguugaugauauccaugcaaaggacagaaaagauacauccauagaaagacugaaagauucugagaaucucuagcccgacuaauggguacaucugaaggacauuuaacuaaguggcccgcauucuacgucauaaaaccugucucaguaguuagaagcauucacaucaaaguauauucacauacaaugaaagaauaaaaccugcuuuuaagaaaacauugagcccagugggaaaaaaaauaggcaagaaauuugaacaaaucuuuacccugacuuuuucagaagaggggcuggucaagucgcagaggaguaaguuguuagugugugcagaugaggacuugagucugagccucauguaaacagccagacaugcuggugcacacccaccaucucugugcuguagaccaggagaccugagcucgcuggccugccagucuacucugcuaagucuuaaaugaguaagaacauccuaguguagccuucccucuauauacaugcacaugcaacuccacacacaugaauauacccauacaauuugugcauccacaugguaccaugccaaagaagaaaauaguuuuccagaagaguagguauaaguguucaccuuuauuaguauaaaagaaauggggaguguagaggcugaagaccuggcucagcagaugacaguuugugcuucucuuucaaaggacccaagucagucugcagcaccagcauugucagcuuacagcugccuccgacuugacuuagcucagggguauugggugccucgccuuaugguacagacacacaaacauaugcauucauacauacauaccacacuacauauguauaauuuaauuaaaacuuaagagaaucacuguugacacuugcugacuagcauggacaacaaauuugaagugaaacaucugucagccauaguacccaggcacgguaugcgagguaauuacuaagagaccaugaagaaguaaagcaguuguccauaaggaaaguuccaccugauuguucacauaguguaauccauaauagaaaaacgugccagcaacccaaaugccagucaauaucuaaauggauaagcauaugauaguauguucauauaaugaaacccuauuagcacuuaaaaaugaauaaauugcugauaaaguaucuauagaucucaaaauauaauaguauaagugaagccaaacaaaaagagaauguauuguuuuauguacauuuauaggugauguagauuuguuuacaguaacaaaagacagguaauauuuucauaaaauucuaggaaguacaaauuaauccauuguaaaacauaaauaaugauuacuguaaccauagaaucuugacaggcagagaggagguuccagagccacaggggaacuuuuggagugguagaugaguugucauuucacacuuguguagcuaggacagagcuuaccucugcuuugcccauaggcuuguggcaggagacacagguuccuuugccccugcaccaugggacgacccugcaagcaagugcaauaaaagagaacaggagcuguagagaaaaauaccaggaucugagauguagagaacuagcagaagaguaagauggucugagaagguccuggcagcuggaacacguagacacuguguuacacuuguauugcacaagcaggaucauacccuaggaaauugucucucuuacacaguacagaagaaccaggaaguggaauuuucuggcuauacuacaaccgauccuugagaacaaaauucauuugcacauucagaccagaggugcuuuuuugacuguggagccauguuugaaaggccugagugagcucguuaauaucaucuagcccaugcuugacacgugagaggccagcauacgggacugugaaggugaaacgugagccuccauucugguucaucaugcaagggacaguagggcugucuucauagauauguacaaccgagacuuaagaauuugugauuccagugugugcuguccuguagaaggauguggcucuaacuguuagcucauuacagccacuggaaccucugcaaguguaaccuaauaaauuuucuccucuguuaaaaaauuuaccaauuguguaauuuagguaaauauaguuuauuuucaacaguuacaucucauuagacacagaagugauaaacgguaaucccuucucuuuaauuugaaagguguucucuacacacacauacacacacacacacacacacacacacaaaguaguuauuucauucugucuacucaguauauuauugugugaauucugucacauagacuguuuaccuaaacuuagauauauagaaaauaacacaugagucuugaguuuuaaauucuuccaaaguuuucuucagguuauauuguacuauaugacaaagcacauggaauuagaauguaugcauucauguuugaauucagucucugcaaauguguguuuauugaagcuuggguaacuuaucucuuggucuacuugcuagugaaaauggaacuaucuaauucuuacuguuacucugaaaaaauaaacguugaauaaaauccaaggauuuuaccccuccucuuuuuuccuuccuuccaagcucaguuggccuuugaacagaauauacuauguagccaauggccuucgucuccaccuuccaagugcuggggaguuaaggugugcaccaccaccaugcccagcuaauagcaagguuuucuagacuguaaugcuccauccauugcucuugacuuuguaugauuacccuaggcaaguuacagucaagacacccauccugcaaggcuguuuagagaauucacaauagugugucugucauaguuaccugcugugcgaagucucaugguauggcuugcuuacuuagcauaugucauuuucuuugauccucagaguuucuaacaaugcauuccaaauuguauuugcugacaauuuaaaaauuacaaucacaguuaaagaggcuauguuuaaaauucauacucagggcuggucaaacagcuuagauaguaaaggcaccaagacugaggacaugaauucagccauuaggguccaugugguugaagcagagugccaacucccacaaguuguccugugaccucccuccacaugugugccauaacacauauguguaugugcuacaugacauacauacguguauggcauacauacguguaugugcuacgcauacacaauaaguguaaucauuuuuaacuagugcuuguuuuacuucuauugaagaaaauguaaaauucagacauugccagcuuuuguuucuauauaaauaaaacauaucuuucccaaacuucagaaauccacagaugaauucuaaaagaauaauauucuauuacucucuugagcuuuuuuuucuguaguaguaauguauugaaaacaguguuccuuccuuugaugauuaaaaucaacucggggcaagaaaauuaccuuuagguuaguugagcuaguuuucuuucaguacuuuggaaccucaaaugaccaauuaauaaaugagucccagaaugggacagugacauuguucugacucaggaaauuauuccuaaguuucugcccugaauuauacaaaaguugugaauuuagcuuagacauuuuaaagcaucucagaacuaaagucacuucugugcugcuaccacugcuuagcuucagggacggcuccagauggugggucuccuggaaucauguagaugcuuugcagaauaacguuuuaaagaccuuuaucacgguuuccaaggucccauauauuagagucauuuacuauguuguuaauuugauaucagcuuguagcaagucuguacuaaaucuugggagauugaggcaggaggauuacaaauucuugucuagccuggaccucaucacagacccuguccuaaacaaaagaaguuacugacuuacucaggaacuuccuacacuuaauuaucuaacguaagaagggcucccucuggaucacggauacucacauauuugaggaaccucuucuguugguaucuuagcuaguauuaauguguuagcauuuuaggaaucuaagaaaauccuuuguaaguuuucaggcaacaguuuauauugaaauauguugauuugaaccuucuuggagauuuuuucagaguucauuauuguaaauaccucagacuguguucacaagucucaguauuuaugucgugugcagccaugcaugugggcugagagcugagugcugugcuguccugcucugugcugaguuuauuucucccccuguagauggcgacgcgcagucacuuaaggagcaccuuauugaugaguuggauuacauacucuugccaacugagggcuggaauaaacuugucagcugguacacacugauggagggccaggagccaauagcaagaaagguauguuugagaaguaccugaguauaaauguauuucuguugaguagcucauaucaguaauucaaugaauucucaacccuucuuaacuuacacugggagaaaagccagaaaaucuuuccuauacacuggauucuuauaacagcugaccacaaacacaggaacucaccugcauuuucaccauucuaaggauguaacaaugcaugugauuagcugauaaacacagcauuaaugucaucuuuauugugcaguugaggacauaagaacaaaauacauacacugcuuuuuuuuccuaagacaauuaaaaaaaauaaacuaaaaguugaaguuguuuuggaacauaaaauauuuuuuaaaaugaaaauguaaucucuuucaguguuuuuugauguuuuacaauuauaauuuagagaaaugaacauuuuuuuuggaauaaaauggguauuacuccuguaaaaugcaaaauuucaagcuaaaugagguaaccauauauaucuauugaauaauuuauucugguuuauauaauauaggucuuuuuuuucuuuugucaauuuuggagaauugaaugcucugaccuguugaaagacagccuauacccaugaaauggcgcuggaagaaaacuucauuuaaaaaaauuuuuuuaacaauuuccuauauaauauguugugaguaucuuuacccugcuguccucucucucgucccccggaacucacuuguuacaggaaauacauugguuacauuuccuuaccagcacauuccaguaucuuuguagcacauuggaugcugcagacuucagugugaggcuagaccuaccaagcaacuuguugacauguaaacauccuuagucuuucuaaaaagauggacugaagugugguuuuugaaaacuauggaaaugaaagagcaaggaaaaagaaucaaacguucacacagagcgaagaaaaguuugagaagucugucauacauuuguucuuaauaaagugaaauuuguuuugaaaaaugcaaauuuucaacauguaaauuugaaguguuaauauacaugaaguuguuuggaugcaucuugguuagagaugugucauuccuccacauuaaaugaguaggucucaggacguccugcaucuuuacccauccagagagaaguugcuuuaagaaauauacacuaacuucuuagaguccgaugucaagcucugaauuuuaucagucugguuacauuaacaaaucuaugauacauaaacaaaguaauuacguauuggggacucagucuucgaaguauuucaacuucauugucaggcgcucggccuuaaaaacagacugcccagaaagcaggguaauaaugagagaggcaguguggccaaacuagaaaaguaacaguagagaggggcuccuuuggaguccagcuaacugugauguuagacguaguaacaauugaaaaguuguacaagacuauucaacaagaccccaacacuugugaaacuaauaagcaauguacugcacuuuacauuucagugucgugcuaaccagugaaaagugaaucuugaaaccaguuggugucaguagaaaauauacaauguagaauuuacagcaaagaccuuuaaagucuuuaaaauucacaguuguacuugguguggcgacuaagucuaaugugcauccgcgucacugaaaucucagggagaggaguggagcagauagaggacugccugacggacgggggcagagagagagagagagagagagagagagagagagagagagagagagagagagagagagagagagagagaccacagcuagucuguuucaggcugccucagacugaagaaauauaaacacaucaaaaguucacaagacagcaaguuacuccucaguagggcuaggauacauuguccucaaaaaaacauaaaucaaagaaaugguuucccagcagggacagcggaagccaggaaacaguguacuacccucaguagacaacaggacaagaacuguggcccaaggaaaggagaggaagagaaaaagaccuuaaauucuuuauccuccucucuguuuuccugaugcuaauucccugguuuuaggauaccuggccuguucuacuccugcugugauauauuuuaagauuagcuuacacacaacccugcagguuaaaucuuggguguauuuuuuuuuuucucccuuccccacucugugcugugcauagcaaggauaugcagauacucuaggaagaagccuaccgggacagaaguguggauaucaguucuaaaugagucuugagaugauggaagccacagcccagggcuugauaggaacuucaugagaauucucaccccagacgagcauagcuuaaaucuacagguuuuuacccucagaaaugauguggggugcuaucauguagugcuagguggcucauacuaguuaaguuuucuggguacuguaauauuaacauagcaagaacuauggcuuuggcuacacagugagcagaagguauaaaacaugaguaucaauaaaaaccuaagcggccuuaagcagacugaggagaauuugggguugaggagaauacuuaaaggaaaaguagggaagccuuggaaacuagagggauauaaccuuugcaaaugucucuacuguaaacugaaagauuaaaaacacugugucaugaauuuagugauuugccaaaguaguguucaacaucuacuuguauugccuagaguccuuguauaaggauaauaagcuaaagauggaaucuuaacuauaacagagcaauaauuuacuagcuguuaaaaccaaaguguggccuguaaccuuaccaugggaaagucagagauaugucucacagaaacauuugacaaaguccauuagacauuaggaugccauacuuaaugacagucacugagacacugguaaaauauccggggucaucaaacucccaaaauaacaaaagaaauuauccaguguauuuccaagucccuaguuaggauuaagcuagaaauuuauaaugaagagauauuugauaacccccaacuaccagcggagagacaaaaaucaugauuuaaacuaaaugauaauaaaaauacaauuuaagaaaugguuaaaaagcccagucugccucccaaguacugaacauugaaaucugugguggaguggggcuggcuucagcuccuugcugacacucuguccauuccuacaaagggaaagaaaagcagugcacacucacuguggggguguuuacagguaaauacagaugucgagaggaaggaaacggcagcagucuuuuucgacuuaagaaguggaaauuuaauuuuaguagagcaauauuguaauguagacaucaguaaaguaaaauguaaguacagucguguaguccugcucagcuguggaggcccaggcccacauuuguugguagcaguaauguuugguaccuaguuuuuuuuuuuuuuuuuuuuuuuuuuuuuuugguuuuucaagacaggauuucuuuguauagcccuggcuguccuggcacucacuuuguagaccaggcuggccuugaacucagaaauccaccugccucugccucccgagugcugggauuaaaggcgagcgccaccacgcccggcugguaccuaguuuuuuaauuauuaauuagcuacaagaaaguuauaaaaauuccauauauuguuguauccuuuaaacucagcaucauucuguguaagagauuuaaaguaucuuaguugugucaaaauuuaaguuuuacacuaugaauuaagccuauuaaaauaugagauagguagucuguuagacuguuuuaaagauuuguaacauaauuaagagaacauauccaaggaauuaaauucauguuggauuauacagaaaacuucagauaaacucuuuuauaaccgugaguugaaacaguuuuuccugaacgugaaagaggaguuuguaauuccugugucgaguuugauaugaggcugcuagucugcguaagucauuggagccucccuuugccauaucugucuaauguaucauguaucaggccaauuacuauuuucagaaacaguguucaugacugaaauccuacaguuaaccuuuagaagagcaaaaggaaauacccgucuuuacaaggugaaacuaagaugaaguguuuuaucauugucugcuuuacuuacucgcaugcuugccuacuccuuuacuugcguguguguugucguagacuuacuaaguacacaucugaaggucagacagagccagcuuagaaugacauggauggaucuacuacagggccagggcugucauuuuaaaagccguuuuaacagaaauaguaguaacagaccucguagauacaguuacauaaagcacaaaaguacuuacagauacauguacguuuucuaucucagcauuguacaugaauuguaucgagaaagcuuguguacagucauuuugauuaaacgaguaaguuuauugugacauaccaaaauauuaacagauuaguagaaugccuuucuaaacuguuaauguucuaaauuaugauuauacuugcuaacuuuauuuccuuggcuaucuguaguuuuuucuuaagcuuuguuaaagagauguguuacuaugagaaugcauuauauugauggaauucauacuaauuuguuucuuuuuuuuuuuaaggugguagaacaggguauguuuguaaagcacugcaaaguagaagucuaccucacagaacugaagcucugugagaacgggaacaugaacaauguuguaacucggagguuuagcaaagcugacacaauagguaauggaggcucccgucccagaugaccacugccuuagauguucaguugugauucuuggucguaggcuacugugguguuaacguuuugagaggcuauucauaagcaugguagcaucucagcuuccuuguauacgugucuuagcuuacuagcuuguuucucacuauguuuauuaaaugaacuuaauguuugugccacuuuuaauuuaagaaaaccaaauacauuuuaaaauuagcauuugaaaaguugcaugccauauuuauaacaacaaaauauaaauuuuaaucaaaacuugguaaaguauggagaaggaaaagccaggugauauuuccuucacugcagguaaguagcugaggccgcaggcuugguguuauuauaucauauugaggguuugucugugaauaaguugaaaaacagucaagcucucaguagaccuacuucucuguagccauuaaaaaaauguacaaauacugacagugaauuuaaaaaauuaaacuuuguaauugcacauguuaauuuguaugcuaauaacugugaaaaguucauauguauaugugauauaaauagauuuuauuuguccccauuagccugucuucuccuauuaccuuuauaaugcacagugcuaacaaauaagaacacauugaucuucaaauaaaguauuuauuguauuuauuaaaaaaauaguaauaacagugaucucauuggaaaauacaagccaguaagagacuguacucacaguuauaagaagaaauacucuaaggcaacuggaccaguuuagcaaaguaguaauaguaaauugccaugaacuugugugacguccagccccaggugcucguucagguguggcguccccagcaugagcugucugcugaguuagcccucgcuccagucacacagccgcuggggaccugcaggguguucuggccacuguggcacucagaggcaugucacuggcugggucaggcugcuggaaacuuuguccccagcaccugccuaccaccucuuggcucugggaaagccagcuagagaucaauagccaaguggaauauagguaagcuacauuuuaaguaaucauaaaaucuauagcaauuuauaaaucuuuauuuuaacaaaaauguuauagaaaaucugaguccaucagaaacuuuuguuuaggcgauuauuuuacuuacaaacuccagaaaucaacugauuuuaauuucuacauugaaaacaaccauuaggaaauuuuuacuugacauacuaaauaaaauuuacagaggauaauuuuguaaauaucagagagcuugaucugacacagcuuuuaacucaaauacuuuagauaucguaacgcuauuuaaggguacagacauugaauaggugucauaaaauuauaaaugaacugaguuuuuguauaacuugaaauuucuuacucuauuaaauggaugcuuuccaaauugcuuagaauuagaauaauauggaaaacauggauauauauacuuuccccuguggucuuuuuaaaaacuugauugaaacugauguuuuaaaagcuuuacuaaauugucuacccaaaauuagaaaauuaaauuuccauuuuuguguugcugcuaaauuaauaaagcacucugcucucagcuuguacugcccauaugacuuauaguaaaauaacaacaaaagacuaaaauaguuugacaucuugggcugaaauccuuguccuugaugguuaccuucugaguuguuguguuggcccugagguguccacuuggagggaaaacucaacauuauauacuugaggccaacggcuaaggacauaauuuguuguaagguuuccuaaaaauucuuuauuaauaaaaauuaauaauuuaucuaauuuccuggcuuaaaauauuuuacuacuguucuacccaacacuuuuacuuauguuugcuaacagucuuaaucauauguaaaguuaagcuuuguuccccugccggcaagucuucuauuugaugaucuucccugccucgguaauuaacuaccuucuccugcggucacccaaguaaaaaccucgggugcacugggccagcgauguggcucgcagggaaaguugugcuugcagccacacugacaggcucugcucauccccagagcuuccaggguagaaggagagaaccaaccgagucaaguuguguucugcccacagugcccgugcaugcccaugcccccgcacacgcaaauaaggaaacacacauaaguguaucaguugucuuccugucuaaaaagaaaucuuuaaggaaaaaaaaugugauauuuggauguauuuuuaccaucucacacauaaccucagcagaaaguguuuauuucagugugagauagucuucaguugauuucauugugaauacgaacauuuuucuauuguugguauuuccuucccauaguuuaguuucuaacuccuccauagucuuagaaauacauugauuuuauauuguguuaaaaguuuacccuguggaacaaauuauaauuuaguguuagacaauuuaauucuucccucuuacaaucuuaaaauuccucaaauaaucaugucaguguuaaaaugaucauucccccuaacagcacauagaaaugcuuaagacaaagcuuuuaaaauguuuucuuacauauuuaucuguuuuuugcuauuuuaauccuuauuuuaauaaauuuauaauguuuagucuuguaagaguuuagcucuguacuguacuuacauaucuucccuccuuaaaucucagauacgauugagaaggaaauaagaaaaaucuucaauauuccagaugagaaggaggccagacuguggaacaaguauaugagcaacacauuugaaccacugaauaagccagacagcaccauccaggaugccggccuauaccaaggacagguauucauucauuagcaaucauguuuuuaagauuuauuuuguuuuauguguaugugugaguaccugcauguaugucuguaccacauacaugccuggugcccauggagaccugaaggcagcguuggauuccuuggaccuggagucacccauggauguaagccaacugggugcugggaacugaacuuaggugcucugcaagaacagcaaguguuccuaaaagcugagccaucucuccaucagugaugcuuauuuuagaugcaacuuuuugcagugaaagccuuugugggugucguguaguguauggucgguucugucucacgcuagcucuuucuaacucuucuccagccuccuuggucaauaacagcaauugcuaauuuccuucuggcacuuggaagcacucuauuucuuaagaguguuuucaguaacaacagcuaguguuguaagaucagcagauuuccuauaaaggaucaaauagugguuuucucucuacugggcauacaugauaaggucucuguugcaguuguaacucucccauacuaacaguauaaaaguagccgucugugaugcauacacccgcauuacaguuaccuaacggagcuguaggcuaugugaaccuaguuugcccaucccucuuggcucuaucagcucccaauuucuucaucuucccuuaugauauaauuuuuaaaaaucacuauauugagaauguaggguauuuaaugacagugaggaacugguccuaccuuauagcgaucucuuuauuucuguucccgucccagcacuuaccuuucaggcucagcauaucagcuaccucuaguuucuuccauaguccagaguccuccuuuaccagaacugauucugaaauacaaauccaguuauuugccuuucagaggucguuucugcguccugagggauucugaagugcagaccccuuagccagcaugcggguccuaguugagcuucuugucugcuguccaucuguagauuauucuugucuuuugguuaccauaggguuccuacaguaugcuuuuaaaugcauuaucaucugccugguguaccauucuucccacuucccugcaucuauccaggaaaaugugugaaccauuccaauggucaugguagccaucucaucccauucuguaggugcauaaaaucacguuaauuuacccuucagagucuaacccaggggucauagugccucuucagcugucccucuuuuucucaauauccauugaucuuacuuuaaagaauuuuucccuuaauuucucuauuacuaguauuuuuaaaaauauacuuagacuauaagguucaugcuuugauuaguuuguuuuuuuuaguagcuaguaccuaacagagugacuggugauuuaguguguagauggcuuucuuuaccggcuuauuugaaaauuauuaucaacaucaguaaugugauagaguuauaaaaaaaaacucagagaaaguaagauaaauuaacuguuaguaaaugccugcuauaugucaaguucuacuaagcuagcaaggagcgaguccagugugccagguguuugcuaugcaagcguaaggaccugaguuugaucccuagcacuggagcgauggagacaagcaaaguccagguuccagugagaccccacguccaaaaacaagaugaaucacuccugaagagugacaccuggcauugcccucuggccacacaugcauguacacacauacgagcacaccugaacgcauacaauuaaaaucuuucaaagaaugaaagaaauggugcuauuagccauauaccucucuccagaaucgcaaaaacuucaaagcaacgauuuucaaacucauuucagccauuauauucuuaagugaaauuacaaaauucaguacacacaguaggaaaguuccugauggaagaucaaaucagaccuaguccaucuccucacugcuaaguucccuucauccccaccagacacaaacccaugcucugauuaccuaccaucuguugguacuugaaggaagcaugcuguuugaaaugaugcagaacucauucacucaauguuuuaauagccuuaucuaauggauguuauuuucccagacauagagaaaaugugcucuuagaaagugaaagaauuugauguucuucauaaauaaacauuugucaaauugaagacuagacuugaugagagaauuaagcuaguuuaaugagauuaaauauuuguggcaacuucuguucauuugggaggagguaugauucaaagaauauacccuaaaguuuucagaauaaaaguauugugcauguaaugugaauacagagaccagagaagaauaucagugucaucuucucuauguucaccucauucucuugaaccaggagcucaguauuuugaguucccaaaauauacuuuucucaucccaauacccagcuccuugugcuggggucuaggcacauacaguccugcccagucuuauuuugugcaugccgagcauuugaaaucagagcacacaagcacuccuacucacugagcugucuccuaacccacacuguauucugcccacuccacucuuacuguagguaaagcaccuucauaaaaagacagacagaaugggauuugagaaauggcucagugcugcggagcgcacacuguucuugcagaaggaccugagcuugguucucaggacccacauuggugacucacagccaucuguaauuccagguucaaaggauuccaagccucuuugggccucuucagguucccggacucauguguacauaucaguacauauacacaaaaauguacauuacuuaaaaauaaacagguaaaagaaaguaagagagaaagaauauugauuuuuuuuccccugucucccuuuaaguuuuggauuuuucaaaaauuuuaacuaagcaaaaguacucaaaaacugauacauuuauauaaaggagugaauuuaauuauuucuuguggcuuauuaauacuauaugacuauaaaauauggaguuuaaguaaaagugcuguuagauauugaaauguugcuaaacaauaguaaaugcuaacugggaguuucuaauggcugaaauucuuuuguuuuauaccugauuuaacuccucuaaaugaucauaauauuuauguauauacagauauaguugauaauaugucacuguaguugcaaguuguaguaaagauaaucuuaagcugugaguuacucaaauccuacuuaauaagccuuguaaagcgcacgcuugcacgcugagaugagaguuagagaguucagacugugcguaauugguaggcagaagaggagagagaucaggggucggugccuggggcacuuacucuuugagagccacacacaccgcagaaagcuuugcgaguaugaaaugcguuaguuaaagacaacuuuagaauuuauacaucuauacccguuucauuuuaucuguuguguuuuaugacuagcgucaacaagcccauuuauaaaugguuuugaagcacacagucaccaaugaauauugcuguaguaugcacaguacuuugugaacuguaacuauaagaaaaaguuaaugaacuaaauauguaggauauguccgaguuuguaguuaacgacauuucaguuuauguuuauugguuugcauuauaguuuuagauuuuuaguuccuugcuaguaauaucacaaacuucuuuuaaguauuuuuaaauguuuucuuccuuaccuagacugacccuucaggaacuacagaagggcuucuuuauucaucuagaauguaaaaggaaagagcuggggaugguuuaaaguagcuguguuuggcauagauucuauauugacggagauguuuuuugucuaccugacacacgcugcagcagggaacuugagugcucauaauuuuauuaugagauucuuaaugugccuaucaguuguauaguaaaagauuucauaauguaaggcuggcaagauggcucaguggguaaaggcucuugcugccaagucugacucuuugagguucauguacacuaauggagggagagaaaugacuccugcaaauuguccucucaucuucuucaaggcacauguaugcccauauaucaugggugccuaaacacauuggcaucuaugcacacuacagauaaauacauaaauguaauaaaaacaguuccaaaacaagauuucagaauucauauaaauaauauaagugaacacuaacuucaaagcccaaaauaaauuauaaguaauguauaguucagaauuauuuuugccacaguuucucaguauuugcaugauaauaauuaaauuaucauauagccagugauagggcauuguuuaauuguauauuauauuuuacaaguauaaguacaauuuaaaagaauacacuucaaacugaaacaacguuuauucuauuauuuggcuuauacuuucuuaaaguuauagaaccagugauauuuuccccuuuuuucuucuucacuaucaaugcugacuuauuucggagcauuuugucuuguguccuuuaaauaaucgguugcuguaguccuuacccacuugucuccugaagcuguucugccuucauagcugugccaaacacccuuuguugugucguguuugcagguguuagugauagagcaaaaaaaugaagauggaacguggcccaggggucccucuacuccuaaguaagugcuccuccuugugguuuauugcaugauguugggucucauucagaugcugaaguccaaauuauagcaaaaccuaacugaauugcaacaauacauacauucuucaucuuuuauaguucacucuuggagacaucuucuaaguuuauacuuacacuuagauuaauauguuacagauuucaagccuucaaggucaaauagcuuuuagacuaaguuacaguguaaaucaauguugcguggucuaauguagucagacccuuaagcacucuguaacguuaucuuggguauuuuugugauguauaccuguuuuuuaaaugcuucuuuaugaaaggcagucuggggcgagaguaguguuuuuauuauucaaauguuuuagaguuuaaauaaaugaagauaauaucuagaauauuaagagugcucuugaugguaaacaaaagaagaguugaaaauguuaagauaugcauuaucaaaaacccuugauccugucuguauuucaguacauaaacuucagcucuccgagaggucacccaugccucuguaguugugauaucucuguaguguaaagggcguguacacuuacacgauggcucuucugcagacacugugcucagugagaggagugagagcuguggacagcuagcuucauagccguucagccuuagcuuacugucaggcaacuggaggacauuuaauuguccauaacucugaauuucagguucucugaugagggauuggagaucugaauuuugaaagacuuugaaauaaugauuuguaauuaaaugaguaauuuauuaugugcugauaauagcaaaucuguaagagagaauggacuugcuacuugacugcaaauuuucuucuaaagaaaauggcaccuucaggaagagguucuaucuuuuuuaucuuaggugaaguuuuguuguuguuauuguuguucagauaucuugugaguugcuuccuaaauauauuaacuacuuagagauauauauugcucaguacucugcuuaguugaacauaauaaaggauauaauuuagaauaaaacuagaaguuuuaauaggaagaguuaaaagcaugugaguugaaucauggauaucuuaagagauagaaaaucggaaguuacacacuuauaaauauucauuuuagugcuuaaucaaaaucauauuuauuuuucucaauuagguuuauauugucauauuuuuacugaaucuuuaaacaauuuuaaaguaauaaaauugucugauauucagauaucaugagcucuaaggcuugaaaaaccuuuucuguauaaauuuacugaguucuccuggcuguuuuccucuuaucauuuccucuuuuuaaaaucaagagauugccuaugcugaccuugaacucaggagcucacguaauucucuuaugucaguuuccaaauuaggugggggcuacacucuaaagaccacauucaguccagaucaguuuuccauaauuaucaucaucuguucauauaacuaaaguauuuguauuaugucagaguagaaaacaguuucucaguaccuaauauaccauacucauguaauaaauccuaauauaccauacucauguaauaaauccugauggaugaagauguaauaauggagaggcagggaaguacaguagaguaucuguuaguucaguaaggaugcuaacaaaaauuugaguacugcuuaauguaagaaauaaugcuucacuguaauguauugucaaaugauauuggucagaauauaaaaugcuuaauauugcacuuguguaugaaaggauucuuagaaagcuaacaaaggaaaauucuccuagcuuaagaaaccuuauguagccaaaaucaguaguaguacacaguauauuuccuugugaaauaugaacacauuucaauuaagacaaaagauagauaaauucacuauuggcacauacugugaaagggccuuguaacacuagugaccaaauaucucgauagaaagagcacaccaauggucguucaaugccagaggaucaccaaugguugaucagugccaaaaaaucagcccugaaaacauauauacaaguaacauaugagcuguuugcauauacauauauauacacauaauaauuaaugaugaagcugugacucugaaggaagauaggggguacaugacaagguugaaggagaaaagagaagggagaaauguuguaauuacaugauaauccaagggaagauaaauaaaucaucuagaugugcagccugcugagagcuggagaaacugagcacauuggcauauuauaagucaguaggccuuuucugugcccgggccagcggucuuuucuugguaggauaacugauugagauuuucaguuuuauggaucauaugaucugcaacuuugcugauggggcaugcaagcacccuuagcauuguuaccacaaaguuguauuuguauuacaguaauuuuuuauuuauauauaaacaaaaggcuagaauuuauuuuaugauccauacuaauacuaaaccauguagaaaauagauuaacaaaaaugguuaaggaugcaaaaauguaucugguagauaacugaauuaguacaaaaguaaguaaaagaccucuaaugccacaccacccagaaaacggggguggagggggacagaggagccauaaagcaaaaaaggcaacuggccuggaagaaaugggugagcucggaaagaccauuuuaagucagggcagucggugguuuaaaacaugaggauauuauucuuccuagagugugcuggggucugguuuuguuuuauacucugugugcuguuuagaggcagggcuuaggguuucuacugguaaaguaccaucaccugaagcagcagaggaggagcucagaaaggaggcggggccaggagcuggagagaugccaugguucacugaugcucgaggcucgcucagccuuccugcuuagacugucuugugaccgccugcccuaguccacaucaguccugagucaaagcaauguaacacaguuugacuauaggcaggcucuaccaggcccauuuugaucauuauugaaaugguucgcauuuguguuaaaucauuuauuuuuaaguggcacuugaagagaagaaauguuaaauaauauaaauauuaaggagaaaacaucauuuugcuuaaaacagcuaaaauaugcauuuuaguuagcaugaaaagcaacccaaaaauguuagaaaucuaaaaauguaagaaccccucaaaugugauuuaaaauuucauucuaaauaucaacauacaauuugauguuuuaauguguauguguguguguguauacauauguauaauaaauuuaaaauguuccauguuuauuaguugcuuuagaacuuagauguauaauccauguuuugaguauacacugucuuauacuucacaaaaaccagucuuuuccaguuuuaccuguaaaaguuuccucccaaauuucuacuguguugauugugucugcuuuucaaagacccuaguguuagagaaggagcuguuguaagugcacgggugguuaagcuguguuucaaauaagaaacuguaagguaagauaacugugggagcccugcgguuccuaaaaggaaaagcacagcagugcaaccaagcuagaaagcacucuuccugagcuguggcuucgagggugcaagcacaugugacuauauuugccauuauaauuguuucuguauugcuucauuuagguaaaacuauuucaaaaugccuucagucauuauuaaaauuuauauagcagagaaaccuagauuguuuuucugaacuaguaaaaauucuucuuugugaaaauaacaucauaauuuaauacauucauuuuuauuauuaaaaauccugacaaaaacgugagaagguauuuagagggaagaaguuggaaugugaugguucugugccucacggauaaauaaacaucagagggggucaucaacaaaccgugugugacugaaagguaaacugugccauaacucuuuuguuuuacauugugagugauuugcugcaugcuuguaugugugucacaugggugccugguacaugcagaggucagaagagggcauugcacagaaugcccuugggacagaaguuaagcaagguugugaagcccucuacacgacugagugcucucagcugcugagcccgccuuccgugacaguagcucuuaccacugcguugucucucuguuccuuaugguguucugaugaacagaauucugaaacuacagcauagacuuaaucuaacauugcaguguuuucauauuucugcuaggaaagaagagacacucgagguaacacaagugcuuaucuccuuguuggaauacuuaauaagccuggaggugacuaguaauugucucugcuucucugccacuguauaaaguacuuccuugaacauuuaagacaagaagccgcauuguauaaccagaaggauaaaagaacauagaaguacauagaaguaacugggcuaaagucuuuugaagugcaugcugggaaacucagcccacaaagugcgugcuugacucuaucagucacugugcugagaccucugcaugguugccuuuuccuucuucccauugcucagacuuguaacguguaagacaagggaacagccaacccaaaaccugguuggauauaaauucacaaaggaagccgagcuugaguauaagaacuguggaucuggauaauaaauugucucaagucuuguaggugauacacagcaaaaggaagguagaagcaaucacaaaguaaauauauuuaauacuugaagaaauuuaaauuuuccuuuaaguacuuguuuuagaagaaucgguagaaauaauaaguuugucuuauuuuugguuuuucuagcuuugucauuagauuucauaaaguuagaaugauuguuuuacucugucagaacaauuaccuccauuuuagcugcucauuagugugguguuaguuuuuaauauauguuaaauauuuaguuaauuuaacaagaacaaguugacaaguuguguuuuccuuuugaaguaagaauguaggcuuaguauugaauugcauucauuuaauuagaacaccauauugggccuaaaauccagauacuacagacaugggacuguugagguuuaguuuccucugaaauuggcaucugaccuuucugacuuuuaaagagauaaauacacugucuuauauuacauguagccuacacuggccagaauuaguuuacugcuaggcaaauggcuugucccuauguaguauuccaaacauuuccuuuguucucuguagaaaaaccauugggacauggacaggguaauuuucagauuaggucauagugaaagccacgugacacugaucaccucagaagacugacugacuuauaaauaacauggcauuaacucaaaagucgagcuagaaagggcuguguucaaggccagccuggucuacaaagugaguuccaggacagccagggcuacacagagaaacccugucucgaaaaaaacagagagagagagagagagagagagagagagagagagagagagagagagagagagagagagagagagggagggagaagaagagaagagaggagaggagagaaagaaagaagagaaagaaaagaaaaggcuaugugaaaucugguuuagaagucuaaaucaaugcaugagcuguguucauuuaucaauaguucuuuaacagcaaacuucaacuuuaucuguagccaacaucuguccuuuuugcuguaauuuccuugaucuuuauuuaaggacaaccuuuaccuguguuuuguaucagugcguccuagacuuugcugcuucucuuacugauugaucuugccuaugcguauagugccugucacacuguccauguaggaggcccuaguuuaucucugcuccuucucuagugucacuuucuuacaaauacagaaaaccccaccacauuaggaaacaaggcaucaguuucucccaagucccuuuugggcuuuuguuuugguggucuaccaucacuccuugccugucuucuagacauguagcuguuuccaaagcuauccuuaacuaccauucacgacuuaauaaaauccuguuucucuuuuggggaaaucauucacauugagucucugagacccuuccuggcuucaccgagucucugcagugcgcuccuuguaucucugcacgucuuaguaauccucagacuuaugugacguucuuguuucauucauaguaggcgcucagagacaagaugguucagugccgagccuuucuauaaaggaaggaaagcaagcugauaccgucaguaguaguaggacuuacagcaucaccaacaucccugguuuuccugcugucaugcaggacacuacaucuacuugaaucagauaguuuguucucuguuuugcaugccuaaaucucuaugcucccugcaccaggcgggcaccgucaggcuucugauuccucagcuuugcuuaccuaagucgcccaucucccugacuccacccgggaauggugagugcuaagcauugcugcuguguccuauuguuucuagccacccaagaguuucuuuuaugugaauguuaugaguuugucguaauuaaaauuaaguguaaaauauuuaugaauaucaauauugaacaauuauauuuuaacaucagaacauauucauaaaguuaacuauuuuaaaaugaagacacucagaguagcauuaaaacacuuuugcaaaacuuuuuauuuguauucuuuuuucauauaguauauucugauuacaccuucccuccucuaaucccccgacccuccuccccaccuccccauacacucagugcccucccuuccuuuccuuauaaaacaaguagacaagcaaacaaaagaaaaauguguaagaaccacacaagacacuuauauuggaaaccauaauaugcaaacaaaagauuaauaagacaaaaaaaaugucaaaacagcaguaugagacaaagaguuacaaaaacaccauuacguucaucuuguguuagccaucugcuacugggcauggugcccacccugggggaggcauccuuaauauucucagugagaauguuaaguaucauaagugucagacagcugacuugucagaguucugugugcaguuacugacacacugucuggcagaguccaugcagacagguaguaggaaagggaagcacuuugcagguaaaacagacuuaacacaagauucauugcgauauggaaaucugaaggauaaucaaugacucguaaucugacacuaagaucuauauuuaacuaugcuuuugaucauuugaaaaauauucacuaacuuauacaagccuucagaacacugguguuuuauaauacaaugcucuugugaacucacacuuuaaaaaauuaguuuuaugggagaaguuugaaauuaccaacauuaugguugggaagucagcauuauuagguaucuugcuugaacguucagacuuugucacuacuaguuaguauuuucguuuauuuucuuuggaguacuaagccgcuucugccuguuuuugagagaauguccuguagguacacuugucugaggaaccacaggcagucauugaugcagaaguagaaugggugaggccuacuaacuaguucacacuuggguucacacccgcugugcagccucagcaugcagcacaucugcuuuaugcuuuaugcuuccaguuugucagacaguauuuaaaggaagugcugugggcggagagaaggcucaguaguacauacuguucuuccagagggccugaguuagaguccgucccagcacccgcuucaggcaacccucaguugauuagaauccauuuccaagggaucaauagcucuggcuucugcuacuucagggaccugcacuugggugcacacauauccaaauaccuacaccccaguaaaggucauuuucaagugcuuuuuugguauuuuuaauggggucaaggaagauaaacuugucaaacuguguuuuuucuuuuuaacauacugacauauuuccacagguuuccaagaucaaaucucccaagccuucagucuguacccauggccccgagucaucucucuuuucauaguaccagucgaacuauuucuucauugaaucucaucccuuucccacucaggauugucccaaucuuugucacacccacucccaucuuccagaucuuuucucaugcgugccacaaugucuguugugaaguguuaggaacaagguucagaguguaaagacugcaguauggugguguguucuaacucuucccaugugccaggaguuugaucaacauugacuuugaauaucaauccagaaaaagcuaucaaauaacauucuguugucucacgucauaugccacaccaguauguugggucuucaugcacacugcucugagaacucccucugagacacaagcguguuguccuugcgugcuccacuuuguuaaccccacccuuuauugaguccccucugcugccuugaugguuuccuguucuauacucuguucaccacuguguuucucucuccgccucguaaguaaucugacuagaaugcaaaucugauuacauugaugguccucauuaaaauuuguaaugguccaccaguuaggugacauuuugaucccuucauagggcguaaaaggcuccuuauuaucaucccugucuuagcuccuccucuucuuaccaccauauaccuaugucagccagggacaauuuacuauuaguucucuaaacaaaauugugucuacaaucccacacauuuacauaugcuguuuucuuccuacuuugaauacuccuaauuccugcaucauuuuuccaguugcuuccuguacaccuacagaaauucucauuagaaguuauuaaagcaccuaguggucuacaucuauuuuacuagaucacaagcuugaggucagggguucuaucuuauauucucagaugcacuaaaaacaaagcauacaguagucauuugauuaguguuaugcguucaacuacucaucaagaggaaaaucucugaacaggcaagaaaugucuacauaugucuccacucaaauggagaccauaaaauagaagggaauuuuggaacauaguacugaacuaaguuuugaaaauuaauauauucaauucauugcugcaacucauacucuaaucccauuagauuuuuuucccuacauaaaaauguuuaacaaguggccaguauagugguaugcacccucagucccuggcuuggggcagcagacagguggauucugagaucgaggccagccaggucaaggcuacauacugaaacccuaucucagaaagcaaacaaacaaaagacuuuaucaaaggcaaagauuucuguuuauuaauauuggaaaagcacuagcuaaaauguuaauggcauuaaagcuuuaaaauguuuucucuacuguauuuucucuuaaaacucagcagacaguauauucuauuuuagcuuagcacaguaaaauauuauucugugaagggucuccuguuggaaaggcaccuaacauaauccaucaauaggcgauuuucagugagaagaaucuucuucacaaagaaaggcaauuuuuacuaguauuuuuuuaauguuugcacuuuaauuuuuuucuuauauuuaagaaauuucauugccugccauuuauuucauguaauauauguuuguagaaagacuaaauauaaauuuuguagauuauauuguccugccuauuuggcacccgaguggaggagauucagagucugucuguuccuuugggccuuguuuaggacagucaccagcuagauuuacauagcaaauaggaauaguuuacagaacucaaggaaaacugaguccucagacaccuuuauguauuuuaguuaucuguuugaaauacauuuauugauuuuuuucugucuuuaaauuacacuuccuaucugaaggccauucauguuagagauuaacacccucaccacaggagguuucugaauuaaugaagugucauguaucauguaucauguaaucaaguagauagauguucuugaguuuuucuggagacaguuuugcccaaacacuguuucuugggauuauguuuggaguucuccguugcucuuuccaagugaccucgggauuuaugagucagugacauugucugaggcuuggcugggucagcauuguguguaucuacaguacccugguacccacaaaggaaguaaauagccucaccccuguaccugcacagaugcuagcuguaaagugcuaggaacuguuacccugagaagugguauguugaguuaguagauuuauaagaguagcagcaaguuuuauaauuucauuugaaaaaguucccuuuauagcauuauauuucaaaggaaaaauacauuaaaaauuaaaaaccaaaugauacuauaauuaguuugaccauaaaaucuguuuuccaguauucauuuacuauaaacauugucaucuguuucuuuucuuuauuucauaauuucauaaauuuucauuuuuuaucuaauuugacauuuucauauuuuuaaagguccccaggugcauccaauuuuucaacuuuaccaaagaucucuccuucaucucuaucaaauaauuauaacaacaucaacaacagaaaguaagcgcugaaucuuaacccucuuuguuuaauugguuggcaagacaaucucucuuauccaaaguuaggggaaaaguccuggggaaucaaaauuugcuuuccuuuaaauugcugauaguucuuucaagagucacuuuacaagaaauaaaacacuuuucaaaaacuacuugacuuaauaaagaauaauacaauagcugacugaaaaaaaaaugaauuuucauuuuagaaauuuucauuuuaaauuuuagaaucuuguauucuaaaauuuagauuuuaacuguugaaauuucuauaggauuuucuuacugcucaaagacaaauacagcucuccugugucgccuuaguccagucagucacccauaauaaagggugugacacugaggcuuacccggagagcagaccauggggaagcacuuuuuaaauauuaaaaagguuuuuuccauguuaagugauacuuagaauuaugcaguuugugaaaauaugugguuggcuucauuguauuuuaaaagguugaaagucacguggaccuucccguaccaugugaacuguauguaccaugugaacuguauguaccaugugaacuguauguacacugaacucagguucucaggcuugcuuguaugcuaaacaguugacaugcugagccauuuuacuggcaaaaacauggcauuuucauuuuacugggaaaaagaaaaaaaauuuuaauugugauuugcccaacccagugugagaacuucuguccaaaaaguccacccgucuuuauuagugggugugauguaugcccuguggucacauguuacuuuaacacuucagauggcuuaacucguuaguacacuucucaaauggcaucacauuuauaaauuugaaaacacuaaagcaguuugugaaguacucauaaaugaagcaguaauucugcuugccauccuaaccucccuguuaacauucuuagguuuuuuaggaacuugguaaguaaggugcuucugacaugucuggguuucaaguagaugauaguagcuaagauggcuuuaacggggagacuacugaggaggguuagaugggacauaguagaaacucagccaugugaacagcacaguccuccaaagugcgcaugcaggccaguggcucagcgacccagagccccuggaaaggagcuccagacugcagucuucugcauggcuucucuguagaacuuccaauccaagauuaaucaagcauuuaaagaagggaaagaaauaaaaacagaaaaucuuuuuuuuuuauggauaaacaucacauuuguaaagguaagacauuuucugaaucagaaaacuaaauaauauaaauggguaauaaaaggaauugaguguaaguauuuuacauugucaaacuucccacuaauuaauguuguaaacuaaaaccauaaaaaugaaacuauaaaaucuguuccuguaaggcuuuuucugaguggcuggaguauugacacaccuuuuuagugauguuucccaacucaagcaaucuuaaaacauaacuucauuucauaauucacaaaaaaaaaauucacuauuagcauugcacugccaugcaguagagaagcaugggcagugugucucuucaggugcuguguugauuucccuccauguaaacauucagaccagcacaaacgacuguccaacccggcuuagguuuucuuuggauuuuaauucaucaaaauuacuuucuguaggggauaaaauuuuguuuauaccaguugcagaugguuuccacguuuacuauaaaauaaguaaauuucagguguccugugcccuuauacuuguuuuagcaggauacagugguauuuacuaacagacuguauauuggcuagagucauuguguggguguauguggucucuuguuuuucugcuuuugucuuaauuuuuuuuccuucauaaaauaaaaguauccuaguguacucuagucucagaaccucggaaagaagaaacuccugagggaacuggaggaccugugacagaggcuacuuccugagccucuggggaccuuugugagcugaaaaggaaguggggugcaucauuuaccuuucugagugacaaacagaauuuagaggugugugugugugugugugugugucuguguguuguaauuugaauuaauauacuuagugacuauuuuacauaaggcuaucucuugauuuucauuugaguugaaauaaguaggagccaaagacuuugagauagaaauggugcaguuucaguaagaguagggugacaagauagugaccgcucuagguuauguccaguuuuacaacuugauauaugugucuacagauuuaaauuguauguuagaaucuauaguuaaacugcagauauguuauauaggaagaacagcagauaagauuguauaaaacauuuacaaguccagaaauaaaacugcuauuguaaaugugauaaagaacacaugcacuuauuuaauuuuuaaaaucuuuuuuauguaaaauauugugaagcaucuguuuuuagagugcacuucacuuacccuauacagcagugucaccucuuagacgauaaaauaucucuaccuuuauuuuaacuuauaaaugauuuuuaaaucugccaauuuuuuaaacuguuagaugguuuuauuaccuuauuuuucuacacuacuguauuugauauauugcuaacauuguuacucaagguauuuuaaugaucuacuguuuagacuuuaacacuccgugucaaaguagguguuuuguuaauuuuauucaaucuccuuugaaaugaaaugaugcccuguaugagauuacgucauagcaguaauuguagauuuuauagacaucuaggacuugucaucuguuuuugcuaaauauccugguugaacacauuuucauuaauugcagaguaagcuuggucauauguuuacaaugucaaacaguaauacugauugaaaauucaaucugaaaguuauauuaagaagucagauuccauuuaaaacuuugcauuuucauguauuaaagagaguuuacaauacagaguuauuuaacacaguuuacuuguuuuuuuguuuuuuuguuuguuuguuuuguuuuguucuugagacaggguuucuuuguguagcccuggcuguccuggaacuugcucuguaguccaggcuggccucaaacucagagaucuuucugacccugccuccugaaugcugggauuagagacaugcgccaacacugcccagccuaacacaauauacuuuuaaaacuccuauuaauauuuuuguaaauugaauuuuccaaaguagcauaugcuucagagaugaugagucgcuucucagcaugagcaaagagaaagaaagcgcgcggcucggaggacagagcuuuuuaagucccuguauggcagcuguuagcuucuguacuuucccugacaagcuuuaauguggaauauaaaucagaagaggguacaagcuaaguguuuggaauucauuggcuuucaguaucaucuuugaucagauagacugucuucaucuuugaauauuuaagccaaagaaaguauagacacugcuuaaaagauucugauuuuuaaaacaaugagaaaacuacuuugcucauaaguuuuucccauuucugaguaaguaaaaauuuuagcccaucaaaauagucuguuuuacuuuuagcauagacuguuaucauucuaaugaauaaaaaguccccagcaccugugaccuguaaggaaagacugcgcucgcucccccccccccccuuccuucuaggauaagcuuguaagugcgcuuucauugcuguggcuacuuaaacuucacuauuguuucacagccagggcguaucuguuuuucuuucucugucauguguagaaaugugcacaaauacuggccuuuuaaaaacuguagagaagaucuugauuuuaauuaaauucuggugaugauacauuaaauugccaacauguaccuagcaagcuuuuaguuacuaggacuagaaagcaggaauaauaaggcaagcaauguuacaaagaagaaacuugaaggcaggcucugugucugcuuuauaauuaaguuugaaacaaacagcuacaaguccugcacugugaauuugauuucaucaagcuugcauuucucuggaccuuaauauuuucauuuaaucuuugaguuagaucccuuuuaggaagacuggaagcugacauuuauucauuuauuuauuuauuuauuuauuuauuuauuuauaagggggugugauuuuuaacugaaagaaucagcauagacucauuaaaaacuggcucagcaggaugaucuuacuggauuguauuagaggaaacuuacaggguaaacaggcugaaaccaacccucaccgucagcugggaggaugggagugaggaaugggccagagaaagcagcagaagagaggcaaguccuuuacagaaggccugagacaguccugacuggcagggcaagcaugcugaggagugaggauuguaucaggagaggagcgagagaagggaggggaagaccugaacagagagaaagagaaagaggucagggucucuuaggcuugacauugaagauuuguaagcaacuacaucaaaucucuuaggacagggaagggcagugguauguuuuuguaaccuuguaaccuuaagggaaguuuagaauggcauguuuccacucuggaccagagaugaagcucagauccaguucuguugacuaaagagcugacaaagaagauuuaaaaguaaugaaagaaagcuaauggaauaaauacagaguagccaugcuuugcugggagagcgcauuccuagaaagugccucagccaagcucggaaugauugauguuccaguccuagagacaggaauuggggucauguccugucuuaaacuuagugugguaggguggcagugcugcagcaccugaggacaggaguuaaagggucugugcuugauggugcccagcugcagguuggcuggcuggcacacugccugucacuugucuacucuuaggcugacuuguucugacuuuuguauuaccuguuugguaugguguguguauguuuacuaaaaccuuuuuagaauaagcaguaauauaguucauggaaaucauuauaauacccuaaugagaguauaauuauggaacaauaaaaugaaauauuuuauuuugaaaugagcuaucaaaaauaaacuauaaccagucaguauuacuaguuauugguuuauuauacuuguaaaacugcauuuuacuuacaucaacauuuacuuuuagccccugacuuugauuugcguucaaguucggccuaagaaauaaaagaaucuuaaaagucugauauuuuaaaacagcucuaaagaaucucuuauaaauauucuuauaaaacagucagucccuaaaaaaauuaagaauuuaccuuuucacagaauuauuauauguaaaaauaagauuuagccuauugacuuaauucuuucuaaaacuauuuugacuugcuaaauuuucgauuacagagagauuuaaaacagcuuuugaguagauaaagugaaagugugguacugcagcagcggggagaaagggcagccagcagcacuggcucuccuggcacacagucccuucagggcuccucaucaggaauguucucugcaucagugcugagugugcuagcggagcacagaagcuauaaauagaacuuucagugcgucucaacagugacgucacaguggccuugggcuucucagugcucaucuguaacuaaagcccaacucuuccugccccugcaguccucacccuuacacuagcagacuccuucccaagggacaucaaugacaugauugauugcugcagguggugucuaaacucugacuguuuuaauuuugauggagcgaugcagacuggagcaagccgugaugcuacucccauuaccgccggguagaacgauguaauggggguuacugaguaguuaaugugcuaggauaaagaaugccauagcuaaggagguuucuuugaaagugcuaccuuaaaaaguaauaguugaguguucaggaaaagacauuuaaugauuauccacauaucugaugaauagauuuaaaguacucuuuauuguaacuauauugugauguaauuggccacauuuuuauaauuuuuucuuccagugugaaaaacucaaauuauugucucccgucauauacugcuuauaagaacuaugauuauucagaaccuggaagaaacaaugaacagccaggccuguguggcuuaaguaacuugggaaauacguguuucaugaacucagccauucagguaggucuuuccaagcagagggaaacuuguguucauggagucacugcuacuaaaagaacagaguuauuuugucuuuaucuuuucauguuaguuccagaacauuacguguuuugacaguuuguaauuugugggauauuuaggcaugugcaucugcugggauuaggauguuauucugccacucagguagugugguuuauugcuguauucagacugguuguuacuucaugcaaaacgucacuucaagcaggaacuguaauucccaaaguagaagcaaugacacuucuccuuuuuucaguagagcucuguugcuuuaaaaccuuaacuagggcuugauauuuaagaaugagacauguuacaaccacuuucucuucuagagcuuuuuuuggguguacaagaaagauuacugcuuucuucccaugucuccuguggagcuuuucauuguguuguguucuguguggccuuccauauuuguuagcuauuuaugucucuuaauucugagguaaugaaagaaauguauauugagguugcuauccuauauauaaauuggagcagguugcuccauuuccuauuauagauaaaauuuuguguuuuuaaaagcccgaaggaaggcuagacucagguacagagcauggcugguggauuaccacaaacggcguggcuuugucaucuagacauugucaucagucagcugaguccuaacuuaauuaacccuucucuucgcaccuucucagccaauuaaaguguagcugauguaucuaggccgggaguugacaauaaacuagaggggacagggacacagguaguuucuuagugggaccacacaggaaauacugagugucaggcagagacugcauaaauuaaacuguuugggaaugagcaguucaaggacucuuagugucuggacauuauuuaauaagacaguacccucauaguugcuuaggaagcaguaaaauaaugggcacugagcucccagagaagagcagaggaaaagcaagcuggcucccucugaagguugugugcuggaggcgaguucuaauacucgaguguagaagacuuaccuuguguuuaucucacaaagaccuagugucugaagaagauagaguugacaugcguuacagcugcuguuucuauuauguauucuuuagagaaacaagcucaucauauuguagaacaacaguaacagaacaacgcugacagcagcguuccuuugccuuauuccauagcuuuagauaugauuggucuugaggaccucuuuuucguuguugugaugauacaaaucucaaaggcccacuuuaacauggaacguuguaauuuugguuaguuacugauuuuugcauuguaguaggaacugacccaguacuucacacacaguaggccagugcuuugccaccgcuggccuuggcccucuuagguuuugagagaagauccagguuggccuuaaccucgcucaaauugccagguagcugggauuuauuacaggccugcaucaccaggccuuuuccaacuugauauuuuaaaauaauuauucugcccaucaaagaaagaaagaaaaauugucauuccugagacauaagaaaccugaaaacaauaguuucagaucuuuuaagaaaauaauuauuucugacaaccuaagaauucaguuacucagguccuucuacaaaaacuuggaaaacaacuguuaucagaaccaccuguaagacaguccacacagucagagccuuucucagucaggcaaucacugugcaaaugugugcagggguguggccacuuuguccucucuggauuccggcuuuacagacauguugaggaaggagagccugugaaccacacaggugguuuaggaaacacuguaucuguaguauacucuugugagaauuuaguacucaacuguagagaagaaagugugccucuaaaacaacauccugcaguuguguggcuucaacaaugcugguuucuuguccugaaaauaagucuuuguuucagcugaggagaaagaauguaacuucucgguccuauccuguugcccagcacauuucucuagaaccaguguuuguauuaaauguuuuucuguaucaugagagugacacacuguuauagaucauaguagaaacaauauuccaaagaaugauaaauaaguucaucagauuguaaaauaccgacugugcauacccuggcugacauggucagcagugauuucaaaauguagucaaccuccuggaucuguggguucuggguccacagacucagccaacuacaggcaaaagcuauuucuaacuugcauaugaaguuggcauuauuuuugucuuuaucccuggaacagaccgugcagccgcugagcagccuggcacugugcugccgaguuaagugauagaaggacggaaacucacggaggcugcaggagaaggaauaaguuacaugcagaauacugucucaugugaagaacuugagcagccccagguuuuagcaucccuggauauuuaagagcugacuuacugaggagucggaauggucacaucugugagcagcacuucucacgaucaguaggcugaagcagccugauuuuuuuuuaaguuauuuuaauguaggaaaauuuugccucuaaauuuuuucacauuaauuuauuuauauauauguuugugugcacaugugcaugcauaagagaacaacuugagagucagcucucuccuucugccauguggauccaagggauugaacuaaaguccccaagcuugguggcaggugcucucacuugcuaugccaucucaccagcccccauuguaugaucuguguggggaguuagagaacaaugaaauuuuacuuauuucuguaauauaaaaauguuauuuaaacuaaccaccuuuaccaaauaaaugcuuuucagcaucaacucauuuuuagggaagguuuuaaauuucagacuuagauuccuuuuuucuuuuaaaaguuaaacauaguugccucauuuuucccuuuuccuccuuccagucccucucacaacaaccccccacucccucguaaaucauagccuccuuuucuguguuaguguuaccgaaacaucacgcauacauguaaacaagucguaugugucuguaugauuccagggccggcugcucggcagugaugaccaguuagaggucagccgugaacgagacugucuucccacucucuacccuccuucggugcuccgagcucuuuguguagaucugagggucugugaaguuucuuccugccauauuagcauugccuuuuguucacgugaggcuuaggcagccaugucaacaaggugucuuggaugacgcuucccuguccuuucuaggagacacaaacugagcagcucccccagguucucugcucucagucuuuucucccccucuccugcagucagcccuguagucuauaguaauuuaaucuaccuuaguaucaucagauaaucacucuaaagugugauagaucacauugguaaacucuuggaagaaugagaaguguacugagcccaucaucguccugucuuuugcugauucccuuuaacuggcgcuauuucagcucuaauugguucggcauugcuugaggacaauuuuuaagcccuuacuucucuccccucccacccucaccccacccccacacacacuuuguucuugacccugucuucuuucucuuuuuuaauaucaaaaagcaguuugugguugugcauuuuacacaaagucagcucuguguaaaguucaguauucuuugcaguuuauguacaaaccguauacuaaauaauaucaaccacuguuuuacaguggcuuaaaaaaccuauaguuuggagcaagaaaaggguuaaugaauuguuuacuagaaccacaguucaggacuaucuucaaaugaauuacaagcucucaaauuaagccauagagagacagugccaguccaagguugaauugggucaucaacuaauagugccagguguggucuguaugcuacaagguauuguccaugccauuuucauguccuagcuuccucuccagacaggucagucaguuaggucuaaguagcccugugugacuacuaaggaaacagacaagaggaguuugcaugacugagauaaauaagugaguuguuauauagaauauucugagauaacaucgucuuucaaaauuaugcuaauccgaggcuaaaaaauuggccaacccguuaaguguacuugccagguuuggcucccaugacccacauggagacucacaaccauccuuauguccaguucagggaauccaacacucccugcgaggucugcaggcaaaguaaaauaaaauuucauucacagaaaauaaaaaauaaauauuuuuuaaaugaugcuaaucagcuaacaaauuuucauuuuguuaugguaaacuauacauaacaaaauugacuauuuuaacuauaaaauuaaagguauucacauucuuuuugggauuuuuuggggguuuuuuuguugggguuuuuuuuuuuuuuauuuuugagacaggguuucucucuauagcccuggcuguccuggagcucacuuuguagaccaggcuggccucgaacucagaaauccaucugccucugccucccgaaugcugggauuaaaggugugcaccaccacucccggcagguauucacauucuuguguaaccauuacaaacauauuuguaacacaugaaugggccauaaaauucauaguaauuucauaauauagcauaauauaguuuuaagucaucagagcaguuuccuuaaaaguuauaugcgcacauaaugguuugaucagaagcguggucgaaauaguucacacauacccuugggauuucauucuucuuauaucauugcuauuuuuauuccauuuaugauaaauaucuuagauuuauauaaucacacguaugaaguccuaguugucauuugguuuaaaauaguuugugaauauaucuguuuauguuugucagguauauaauuaaaaucaauuuuccuaugauuuuucaaaaaacaaaaguuauucugaucauuauguucagaauauuauguuaccaaauguaguuuucagguaagcuacauuugugaugucauuuguuaauuuacucugcguauauuuaaguccuacugagcaucuuucacucugagagguacuaauuauacugugggaaugcaguuuguuucugucagguuuagaguguacaguaaggggacacguggggggggggguggaaugugguuguaacaagaguccagauagcucuaauugauucugagggccaugccucagaaucauugauucucaggcauucacauuugagcuauguccaagcaacgggagugacauaggcauaugugaguucaaguuagaugcaguaaaaacaugucucaagccccugaaguugaugagguguggggaggacaugggagcacugaggaguaauaagugagguuugugaggacagaaugagcugaacaaaagauacaaagccaggucaccagaacuuuccugugaauguguuauggagcuacugagaguuucaggcugccacgucucauuucuucgcugcuuucauuguuucuacccucaguccugucuguaaagaaagcagaguuccucucaagccuagggaaacuucccugcuacucugaccuguaacagugccuugucagcuugccaagcuccgggcacuaggaaggauguuuauuggguaaaguacuugccaugcaaguuugagggcuugaguuugaauucccaggcacccaaggguaaagccaagcaagcaguaccaguguggaaaaggaaguagaagaggguccagggguuuucugucucaaagauaagauggaaagcaacugaggaauacaccagaccugccccucaggccuccacaaaugugucugaaugugugugcaugugcacauacauucacacaacauugcccauccucagaacagugcagaguccuauauuaucuaagcugaugcauuauagcccaccauuuuaugagucuacuuuaucagaaaugacucauuguguguuuccgucucugugucuaugauaaucuuucucugagugucugcaucuuuacccuuuaacuuugguaggucuguaguagcugaaggcacuaccuguagaaaagcauacugcuuuucugcauugugacaagcugaugugcucauuuguauuugagggggcuuuguuccucucucauccugcuccuagcucacccacacauacagcauaaauaaaaaaggguagguuuuuuuaaugcagcuauuuuuaguuaccacuauaucccuauuaccuggaauaacaucacacauauaucgcagucuuauuuauaauagccagaagcuggaaagaacucagauguccuucaacagaggaauuggauacaaaaaauuuacgcaauagaguacuucuuagcuauuaaaaacaaugaauucaugaaauucuuaggcaaauggauugaguuaaaaaauaucauccugaaugagguaacccaaucacaaaagaacacacaugguaugcacucacugauaaguggauauuagcccaaaagcucggaacacuccagauacaauucacagaccauauaaagcucaagaagaaggaagaccaaaguauggaugcuucaguccuucuuagaagggggaaaaauacuuaagggaacaaauauggagacaaguguggagcagagacugaaggaaaggccauccagcauccagagacuaccccaccuggggauccaucccauauacagaugccaaacccagacacuacugacggugcuaacaagguacuugcugacaggagccucauauagcugucuccugagaggcucugccagagcugacagaugcuugcaggcaaccacuggacugaacaugggguccccaauggaggaguuggagaagggccugaagggucugaggcuuacaauccauaggaagaacaacaauaucaaccaaccagagcuuccagggacuaaaccaccaaccaaagaguaugcauggagggaaccauggcuccagcagcauauguagcagaggauggccuuguuggacaucagugggaggagacacccuugguccugugaaggcucaaugccccagugcagaggaaugccagggcggggagacaggagugggggaacacccucauagaagcagggagagggaggaugggauagggagauuccggggaggcgggagggcagagaaagggcaugacauuugaaauguaaauaaauaaaauaucuaaauaaaaaaaccacacauauauagaaaacucuaaggaugaaaggagucuuaagugucuguaguuugucuuguguacuauaguacugaauauuaacauuguugaguucauaguggaaaagagggcaacauuugagugagggaagauuaugaauuauagauguuucuuucauggugcuuuaugaaacauacaaauaaauuauaaguagccagauauucuuguuugggaguauaggucaaaaaccuugauagaggaaggaaaauguguguagauaggaagcuauuguaucuaaagagaucaucuuuaaaagcccuacaguauuuguacagaggacagacacuuuuguuugguaggagaacaaaaagaauugugaaugcaaauauuuucuagguuuuguaaugaguucuuuuaucucugaaaaacaacauucaaucauuugcagagaacuagaagauugggggcuuggucgagaugaggcagcacugacuugaaguagaauucauugcucgcuugaaguuuuccccccagaauuuaguuauaugguacaugaaacaauugacuaaaugaaucuagaaaaaaaaaugagcaaaguucaacugaaggugaagcaacuaagaaaaauaaacuaauuguuuuuguuauuuaucugcucaaaaaauaucuauuccagacguuacuaauacagaauucaaaggcacugccugucucuaguaguucauggucuggugaauguauggucuuaugaauaccuaagauauauuagaauauaugaugugcauaauguuuugagaaagaagaaaagaaagccaucagaaaauaagugucaccaggaaguggguauuuuguugcuuuuuuaaauacuuuauuacugccaugcauuguuaggcgcauguuccagcacacuucagcagauguugccuuuugaauuaauuuucauuuuauuugguagagaaaagugcaucuugauucagguuauccauaguaugauacuauagcagagaauuaccagacuuacagacuauauguuauauuucaugucuuauuuccauuuuuuucuccauagagaucucugugacagaauccuauaucaccacagcgaaagcauaccacucauacacuuaauacuuguauuaaaacccuccaugcuaaugaugcuuuguuacacuuaauaauugcauuggaacccuccaugcuaaugauacuuuguuacacuuaauaauugcauuggaacccuccaugcuaaugauacuuuguugcacuagauaauuaccuuagagcccgcccauauuaaugauacuuuguuacgcuuaauaagugcauguuagaacccuccauacuagugauacuuuuuacauguuagaaugcucuuuuaacaaaaacaaaaaaaaaaaguagcauaaaauauuuagaguacuuacaaugcuuauuuguagugcuuugguuguaugccagauuuuguguauaccagauuggacugccucaguuauacugacauuuuauuauuagggcuaagaauaaauugcauagaguuuuucuaaauauuauauaauuuuaucagaagaauucaguuuuuguuuuuccaaaaaaccaaaacaaaacaaaaaacauuauuacuucauaggaaaagucuuaugagagaaaugaaauguaauuccagcuuuuuacacuuacaguacuaucacugaccacuaaagauaguaacauguaaguugccaugauuaucccaccaccuuccuggaaucgccaugcuuuggcaggcucuguuugcauccccugcauuuuagcuucaucuccucucuguucguuuccgcucauguacaguucuccccuguuuucuaaauggagcauguggguaggaugacccaucuccuugaaaggaguagucuguccuuccuccuguuuucucaucacuguuucagucagcuaagcagcauguugggccaacacauggaugucaaccacacugccuaauucaaacuggagcucuuccgcuuuuaaccuguaucaccuugaguaaagaaacuugguaguuucuucaucuguaaagauaaggagcuuuaagauguguuggacacgcugugggcugucugccagcuaaggccauucagugcauucucagaugucuaucuauguacugacauaucucagaucuaucgcuuucaacuuuaacauacaauguaaagugcguauuugugccaagagagcuuaaaugacugagacuucacaugucugccaaagcugauccugaucuggacuguuuggugguugugggucccugucugccccuguacuggaacugucuguguagaagcaguuagacugccgggagagucuuaacuuuagacuuuuaguccauauucuaucaaccaaagaucuuuguggcugaaaggauaauuucgugcuuuaaaugugaagaaaugugcacauauguauauuuaaggagggacuuguucuuuagagcaccguguuuaauagcagcagucuaagcagauguuucagucaucaaagacuuuuaugaguuuaagauaggcucauauaaaaacuuaaaaugauggguucuguguaauaauuucagaucaaacagcaacacaacaagaauuuaagaaccugguuucuucuuuucucccagaaggugcuguugaauguggauagaggagcuccuacggcaugggggcauuggaugcuuggccuuuacucuggcugugcccugacgcuuguacgucaguucuaguaaccaguccugacacgcuguaaagaacagaacuucugauggaccaguauuuucaaaauucagagaauuuucugauaucacuuuaguuauuaaguuauugugauuugcauugguucaacaauagcuauuggguuucuauauucauaugcucucacaaauaauccgaaaaacccaacuugaaaguuuucuaacacauuauauucagcaaguggaauguguaaauucaaacauuggcuagggcauuuccauggguaauacaggcccuacuuguuaaaaguauuuguauuucauuauuuaauuuggcaguacugaauuauaaugaguucaaacuggcauaugucccugugaaaauacaugcuagccuagaaaaaucgaaagagucugacuguaaaaccaacagaaaagaaagucagacguagcccuuugcuucaucccugggcuuugagguacuuuugguacuuuugauaccauuuguaauaagcaaauauauauuuaccacgugugcaaagauuucguuugacaaaaaucaauugaguauugugugcuaagauugagaggaaaauaaaggcugagagaauaaaggcauuaguaaauccuggcagaagguuguuaauaaacauguauccguauuaugcauggacuaagugauaagcucaaugcuaagaguacagauacauagacugucuuggaggucacagcccacaggacauagaccaacaauaacaucacgaugcgagcugggcuccgggggaaggaacacuaggcagcacgggugcagcaggaaacgccugcucucagucaggaaggcaggaggcugcguguccagcagaggagcauugcaguccagcagcuggcgacgggcagcacaaggggauuggcaaggggcaagggugaauaaagaggcucgucuaagggcugagccaguaugaaugcagggcuuuauuaaaggcuuuauagcaaggcauuuacaugguuacaagcauauuuaaaagaucacuggguaugaauagagaguuaauuuuucuucaguuauauuuggaaggucuuacaagucaaggacuuauagcacaugaauaauuaagcaaaagugaaguucagaauuuuuucauguuuguaacacuuggguuuuuuuagcuauuuguaaagccauaaauuuggugguuuguacauguguaguaauagacuuuagugggauaaauuuggugguuuguauauguguaguaauagacuuuagugggauaaauuuggugguuuguacguguguaguaauagacuuuagugggauaaauuuggugguuuguacguguguaguaauagacuuuagugggauaaauuuggugguuuguacguguguaguaauagacuuuagugggauaaauuuggugguuuguauguguguaguaauagacuuuagugggauaaauuuggugguuuguacauguguaguaauagacuuuagugggauaaauuugguaguuuguacguguguaguaauagacuuuagugggauaaauuuggugguuuguauauguguaguaauagacuuuagugggaugcugcauuaauauaacccugaccacaccacagaaugaggauuugcaaacuaagugcuaacugucagacacuacugugacuggccccuuugcccaaugucuucuuaccguugauccugcuuguggcagaucagcauacuucugcuaagcaauggcagcugugaugugguguauccauguggccuguccuccucuagugcugggauuguaguaaaagugaagugcaauacacaaggagagaaugagacucaggugggacaugaggaccuggggagaagcauaggaaguguccuucccuuaaucaccauccccguuaucuccccacugcccgaugcguagcuuuucacacaaagacagagucuauaguggaagcaaauguaaacgacucggaagcucugcagcgcgcagccugagucauagaguaucugugagaccucaugccacggcccuguaaagccagcugcucuagggacugaggaaaggaaaguaaaaguucaugcgcuguuugugaugcagagugagcucaaggccagccugggcaacuuaaaaucuugucucagaaucagaaguacaguaagagguugggagcggggauguugggaacucagagugacugguuccucucugccagccgagggcaccucaggcgagcauuggagagucagaacaguacauuccgugauacaaguuccacguucauccugagggauggggugcaacucaauuuagacaacauccaaacuguggcgguauuaggacgagucaguaaacauacgagucaguaaauauauaauugaggccaaaaaaaugaguagcauaagauacuugaaagaaguaaauaaaaguaaaauaugcuuguuuuggccagacuauguaauauagucauaauuuacauuaccuguauaaacacccagcaagcugggcuuuacauagcuaugaagccuauuuaacuucaugcaacaugguggcaugccagcucucaaaaacuuugauuuccaugaauauuaauugagacucaacaaaauggaucuuuaaaacuuuacguacaggcaacugauuucucauacagcacuuuuucacugucuccaaggcauuauuuauauuggcuguugaugugacuuaccugaguguacacgugugugaggcauugcauaucugaaaccucguucguaaagcagcauggucucccucuagggaaucauaaggcagcaucgaccucaccuuauccaaaucauuuugaaauaaaauauuguggaaaaauauauuucuaccaucuuugaaauuuuuuauuaggaauuuauucaaaaaggauuggauuaaaacuuugcaguuuuucauaaaugaaaauuaaauuguuauuguauuaagaguuuugaaagaacauauccagaguuugccuaaaguugguuuugguaggcuuuccuggucaguucuaugcuuucuaaucaccacuaccagcugaaugacaggcuuaaaaaccgcaccuuuaugauaaggcgcuggcugcagaaguaguaaguacugucgucgugaugguauccgugagcuguugguaucgaaauccacaagcgccguauauuaggaggcuuauggucaucacguaagucaucuuuagauugcuuauaauaccuuuauguuguccugacugaaguacaaugaccaaaaaacauuuuguucaguaugaaugcauuuuuuuuccaaauuauuuuucuaucugcaauugauuugaguccauggauaccauaaaccaucuguaccucuuuuaaguuguuuuguuuuguuuuuuccuugcacaccaucucgguuuuuaccuacccaggcuacuuuacagugccuggggugcuuagacaguccauaguuucugcccaucaagucaaggaaacgcugagcuucacccccaguuaacagguaguuuguugugauuaaaauuaugcagauuuugcagcaacaaguauugguggcuuuguuuguuguagugacugacuggaaguuugggaagugagugcucagaaagccugacuggcauguuaacuguuacucggcacaaggaaccguuucuacugcucugugugaauugacuugcuucucucgucauuuuaacaguuuaagugugcauauuuuacuucaaaauauuuuuuguuccuuucaguguuugagcaacacaccuccacuuacugaauauuuccucaaugauaaguaccaagaagagcugaauuuugacaaucccuuaggaaugagaggugaaauagcuaaaucauacgcugaacucaucaagcagauguggucuggaaaguuuagcuacgucacuccaagagcauucaagguuagugugguaaacuuauucucagcuagugugcuuuugucuccagaggaucaacacaacaacagacuccucaguugagagcugagagucccaucgcauugucuccuggccucacaaagacagagacauggcauucagcaaauuuugcagcaacaaguauugguggcuuuguuuguuaguaguaacugacugaaaguuugggaagugagugaccugaaagccucgcuuaaguguuaacuguuacucagcacaaggaaccauuuauauuucuccugauuagggguuuuuauuugguuuuuguuuucuuaaugucuagaaauggguuggagaggaauggcuuagaguuaagagcaauugcuacacucccagaggacuaacaugagguggcucagaaaugccuguguaacucacacuggagaaggucugaccccaugguguuugcauucacgugugcgcacaugcucagacacgcacaguuacacugaugagguucagaagggucaaggcuaucucuggaaacacuacaugaauguuuuaagcuucacugggacaugccauuaaguuuauccugugguuauuguagacuguaaaaaaaaacaaaaucagaaugaaacgaauuuacaaaacaacugucaaauagucacugauuguauuuucgaucugguuuuuacgcuuggguguuuguauguaugagggaguuacuuaggucuuagccuuagggagaaguuauuauaagccauggucuucacagguaaguggcauuccuagaucaucugcuaaggaauauuuuguuaaucaucuagcuguuccuaaaaaaugaaucagcgcugaagagauggcugugcuaagguuaagagcgcuggcuacuuuuccaggggagccgggcucaguucccagcauuugcaugguagcuaccuaccuaccuaugucuguaacuccaguucaaguggacaccguaugcaaaugcugcaaagacacugcaggcagaacaccaguuuucauucuuccuaaguuauuuccauaaagggaaaugaacagaugaacaaauacagaagcacauucuagggaagggcaagauucgagucccucgagccuugucacauugucaucagucacugacucgggguuuaguguauggguaacaugcuaauccugacuucacaaccaacccuauauauaacucacugcuuaacaagaugcaucuaauuguauuuucccuguaaaguacaugacuaccccuguguuuaugaauucuagaugacaccuuagcgcucugcgugagaacgguuucaagcacuagcuagccuggcaggaaaccacccacguauaaagaagaaaacacuaagaaaaugacaaaacgaugcugaaacuucaaggcaguauagcucgcucacguucuucccagaggguuuacuggaacacuuugagaugguuucaguguaucacagcuugggggcauagaaguaauuuauaguaaacugagagcaagcaugugcuuuuucaggagccugucucuagccgguugugugacuuugugucuuacagacacagguagggcgcuucgcaccucaguucucuggauaucaacagcaggacugccaagaacuacuggcuuuccuguuggauggacugcacgaggaccugaauagaauuaggaaaaaacccuauauccaguuaaaagaugcugauggcaggccagacaagguaaaugaaugagcguucuggcguuagugucuucaucguuacagucuucugacaccucguaguaacucuguuccuuuccucuguaggugguugcugaagaagccugggagaaccauuuaaagcgaaaugauuccaucauaguagacauauuccauggccuuuucaagucuacguuaguguguccugagugugcuaagaucucggugaccuuugacccuuucuguuacuugacucuuccauugccuaugaaaaaagaacguagcuuggaaguuuauuuaguuagaauggauccacuugcuaaaccuaugcaaguaaguaaugacuccuuucuuuacauuugguauuguaacuucuugaugggacgauuuuaacauuuauugguuucuccagcacuaauaaaauguauuagauaauagauuuuauaagcuaaauacucuggaaguugcaccuguuuagaauuugagaaguuaaaggauaucauagaaaaauaaauuuaaucaaauuucuuugucacaucaaagacagcuaagauauuuguuuuauaauuugggauggauagccgcuuuaaaaaaaauaguaguauuauugucuauauuuuuuucuaucaauaaauuuuaaguguauuuauuuuauauguuauggguauuuugccuguauauugcucuguaccaugaguaccaugaguuuuuggauccccugggccuggaguauuagauggcugugugcucccacgugcgugcugagaguggcuccuggcucuugaggaggagcggccagugcucguaaccacugaaucgucuucuaguccuccccuagucaaauucuuuaugcuguagguuuuuuccuggucacuuucaaaaguaaagcuacuguuguauuuugcuuauguguuuauuguugucuauguaugugucuguuauguauuuauuaucuauuauauuuauuguaagucaugauaugaucauacagaaguggaaauaaccuucaggcauuccaaaauuuugaugagaaauaaaaaauugguauaaaaauacuugguucaggaccggcaggauuccucagugagguaaaggcagucgcugccaaaccugacaggcuugagcucagucgcucacucacgggcgguaggagagaaccugcucccacaguuccacucugacucccgcacuuguggcgucgcaugcacguaggcacgguuagcaaaccuuacgagugagcgcuuguucggugguuguucuggccuuuaguauuaggcuuugcuuauucugugcaaggucccugugcugcacguuaaugucagcugaugccugaugccuuugccgugugcugucacuggcuuccucaguguuuugugagaaaaaagcuacauuuucuguuucuaaaucaguuauuccuucacaugugaccccuucuagugacagcgccuccuuugcuccgcuaaacucuguuacagcaccucaaagauuuucguuucgccuuaucuuucuuucucaacuacccagggcucuuuucaggcagggagcuuguaugccucaugcuaugacuugucaauauuagugcaaaaaugcauccagaucuguguuacccagugcuuuagggucuggccagauaucucagauuguagauacauaguagaagugaaaaauacccugugaacaaaacuaccuuuacuccucguaguaagaacagugucugugaggucaaacagcuccuccuuugaagguaaggaaaagcuccaggcaggccugagccuggguucagugucacagcuguugggagccauggggaaauacucagcagggcuggaguuagacugagcagugggugggcucuaggagauaagggcacuguuaggggggugcaguaaaggacuguuguguucugggguuugggauuauuuguuguguuuuuaaacugguguguauuucagcacuuauaccaaguuaagguagauaaagaagggguaauugcuggguuugggcaucaaaggaaggagaagacagaauucaggcucaggugcuagggucagguaugcacagacacaaagaaguaucuccucacaggcucagagaggagcaaccaccucuggguucaaacuggacuucccuaaucaaagcagcuuccguuuccuaagugaaguggguguucugcagcuagugagacaggaagcuaaagaaugguguggauuucaaauguuuucuguagggugaacaagugagcgacacagaguguucacugggcaguaggagaagugucaaauuagacugucauuugcagcucaccaccacugaaagugggacauuuccuucagcauacacgaacagcuaggagaaaguucaugucuuagugagaguucuauugcuguguagagacaccaugaccacggcagcucaguuaaaguuuccgagguuuaguccauuguuauccugguggagaacaugguaucaagcaggcagacaugacgcaagacaaguaccuaggaguucuagaucugaauccacaggcagcaggaaaagagagcuccugggccuggcguggaguuuuaagcauggagcuuaaaacuucaaagcccaucccuagugcuacaaguccuucaacaaggccccaccuccuaauccuuucaaauagugccacucccugacgacuaagcauucaaacaugggccuauggggaccacaguucaguaaaaaauagaaccgaguuuuguagcagggaaguugacagcauaacaauguaggguuauggugaaaugucaucaagaaaguagagagaauccauccuagagaaaccucuauacugcccaagagugggcaaguaaccuguaggcugugagucagugagccaagggagagcccagccagcaaagcuguccugggggacguugucacgcaggugcucacuccgaggcucagagagaugcucugagccuccugacugcggcagcccaggcucagcuacucacuguuuuuccaauguaauaaauucauuacacauuuuuguuuguuuguuuguuuuuuaguacaaaguuauugugcccaaaauuggaaauauacuagaucuuuguacagcgcugucugcuuugucgggaguaccugcagauaaggugagguguuucugauauuaaaguguguaaauuagucuuuaguuucucaguauuguaaaaccagcuuaauagacauuuauuuccuucuagaugauagucacugacauauacaaucauagauuucacaggauauuugccguggaugaaaaccugaguaguauuauggagcgggaugauauuuacgugugaguagaguauccauucacaguguguuguugagggaaagucuacagaacuaacacaaaacuuaagaguuuauggucauugucgcccgcguagguuugaaauuaacaucaacagggcagaagacacagagcauguaguuaucccugucugccuaagagaaaaauucagacacucaaguuacacucaccacacuggcucuucacuguucggccagccuuuucuuauggcuauaccacgaaacaauacugaagauaaacucuauaaucuucuacucuugagaaugugguaaguaccaaauaaguauaguuauacaaaauaagcauggcaauauaaaauaucuaaagaaagucaucguguggggugcuaccagaauguuaaacaagccucuagucagcuuuuuucuagacagauagugaaccagauagaaaccagauuacagccagagaagguggugauguacaucuguaaucucagccuuaggugugacccacugcgugaacaggacuuaggguacauaccuguaaccccagcacuucugacacagaacugggacaaccagggauucuuauucuaccuuuugguuuucugagacaggguuucucugugcagcccuggcuguccuggaacucagaaauccgccugccucugcuucugccuccugagugcugggauuaaaggcaugcgccaccacaccuggcuucuauuuuuuuuuuuuuuaauuuauuuauuauauguaaguacacuguagcugucuucaggcacuccagaagagggcaucagauuucauuacggaugguugugagccaccaugugguugcugggauuugaacucgggaccuucggaagagcagucggcgcucuuaaccacugagccaucucgccagcccccuacuuuuuuuacauagcaaacuugaggacaaccugggcuacaaaaagaguaccaaaguaaauaauaaaguaaaaguaaaauuacauucuaauccauugaccuggucacauaaaauucauuacugauauuucaaauuugugaacccaauccuuagcuguuuuacaccagugggaaggcaguucugguuggccaaugacuaauauuaguucagagcagaaauccuaguaaaucucagauggcagcugguucaaaacgucacagcaguauuaacaggugacauggugagacaguacccccccacacacacacauacacacacacacacugcuuuuuauaaaccuuaaugugaauaagguaauggcaaauaccauuagacgucuucucuuauccuuuauaccugacauauuuuauauuuccuauauaccaaagcaugguaauuucaugacccauguauaaagauaacaauacacacaugugagggccgcuuaugaaguucuuguuuuaaguugagaaaugauccacugugcuacaucuuuaauauauaaaauaugggaaaucccaagaugaagagacaauucaguagguaagauaaggcugcuugccaccaggcuagcaauccacauucagucccugaggccaaugugguagaaggggagaaccagugacuacagguguccuugggccuccaucuccacacaccugauguacaugcauacacacacacacacacacacacacacacacacacacacacacaaauguaauuaaacguaauuaaauuaaagcagaccgugcagcgaggugugggggcaaauaccuuuaaucccagaacugagauggcagagcugagagagguaggaguucaaugcuagccuagucuacauagaguucacgccagccucagagagacaaugagaccugucucagaaacaaacaaacaagccuacagguauaaggggggaaaacccuagaaguaaacaguccccuuuuguauuaaaaccacacagauacagaugaugacucagcuuuacuucagugugaggucuugagguuaaguuaacguagcugguuuucuuaagucaaaugcaaaguuaauuuucuagcaggcucauuuauuaccugauuuuuaaaaauuucuuuuuguagccgguaugucaaaaugucuacugaaacugaggaaacagauggacaccuacguugcugugaggaccagaauauuaaugggaaugggccaaauggccuacaugaagaggguucaccaaguaagacuuguucuaaguccuccuucccccacccagagcacacgagucgcuguaggagagcagugccagugacucggaagugcacugcaggguuauuuaaaggccucccuucuuccuuacacuaaggugagauggaaaccgacgagccagaugacgaguccagccaggaucaagagcuucccucagagaacgagaacagucagucugaagauucagucggaggagauaacgauucugaaaauggauugugcacugaagaaacaugcaaaggucaacuuacgggacacaaaaagcgcuuguuuacauuccaguucaacaacuuaggcaacaaugacaucaacuacaucaaagacgacaccagucacauccgauucgaugacaggcagcuucggcuggacggugaguaucugagaauggcguggacacugaacuugagcagagcaaauuauuguuuaggucagagaccaugaaauuuagaccugucuugaacaaaaggacguuugcuuaucuauaaguaauaauuaaaagccuuaaugaaugccuucaacaguggcaguguuuaucaaagucuguguguuuaagcuuuguaucacuucaccgcucagauuauuuaugucagcggcaugggugcagcucucaggcuugcccugaccgccuagugcaaguagaaacaugcugggguuccucuucuaugguguauguguuggcacgaagauacgcuuauuuuaacauuuaaaucuuacaacauuuuuaaugaaaaaaauuuuuucaccucagaaagaucuuuucucgcuuuggacugggacccugacuugaagaagagauacuuugaugagaaugcugcagagguaaggccuugucgucuucugcucucucucacucucucucuguaacuaggaguuaaugauacucuuccuucuaccuuugcuucuacggauacguugauuuuagcagaaaacaagguuaagcuacuuagucguuaagguguaguuggucuugaacaugcuuucccugagguuagucagccagaggcucacucagaaggggccgcgugaccugucagugggcguaagcucugggaugcuucugaaaguuggcauuguugauaagacauaguucaccuaugacuaagaguaguuucauuucacuuguucucauaacucaagaaauacaucucuuuaggauuuugaaaaacaugaaaguguggaauacaaaccuccaaaaaggcccuuugugaaguuaaaagacugcauugagcucuucaccaccaaggagaagcugggugcugaggaccccugguaagagccggacacgcgcugucugcguccucccuggagggcgugugcugggcgggcgggcgggccggccaagacuggcuuuccuuggcauuugagugcggugucuuuauauaauaagcucuggucuaaagaaggaugcugauggcucugugaaguaucagaguggaaccuucauucucaggacuguauugucuucucccuaauaaaccacuuucauccuuccucugaguauuucuuuauaaagcucaugugaaaauguagaggauuaaugucgugaggaauugcuugcauguucauuucuguuagguuuacaauaauuacucacugcuaagauggagaaccugcccaugcggugacuuugguucauaguuuucaguaaugcaggcaugguucugccucugucaagcgcuaugauuucuucuugauagguauuguccaaauuguaaagagcaucagcaagccacaaagaaauuagaucuguggucccugccuccaguucuuguggugcaucucaagagauucuccuauagucgcuacaugagagacaagcuagauacauuagucgauuuucccaucagguaaguucaacuacucaguaaacaagaggccuucuuuuuuuacuaauuuaugugaugauuuccuuauuuugcauuaggaaacaucagguauaauuaaaccaguuuaaacauugaaguuuugaguaguuauaauaauuuauuagaauuaguauuucacaauauuuuuucauaagagauuuuauuuuucauggaccaaaggaaauguuuuuuugucuguguuuuuuuuaaagauacguuguaacucagucuguacugaauuaccuuacguuacaguaccauuuauaagauacuuuguuggcuuaguggcucuauguuuuccuaauaauuauuuuauuauccaucagucacuccuaaauaugcuuuucuagaaaaaaacuaaaaugauacaaaaguaucagggaaggcuuagacugcaccaucagaugcuaucuuuggcauccuucucagauggugaugcgugaagagaggacagucugagggcacaacagaguuaauucucaaaacucugaggccagccagcgugucugggguuuuguugguugguugguuuuuacuacacaaaauuggaaauugagaaggugaacaguuagcauuauuugccucccacacuaacuuauuauuauuauuagagcaggacacuaugguguguguaagaggacaugacagugucuuucacccuguguaaaguaguaggcaugccaauggcauguauauuagcaaagacagucggaaggauagcgggaaugcgaaugggaagagaguuaacggacucaguauuuuacugauauuuauugauugaaaacauuuugcaaucauugagggcgaaagggcuagggcugaguggguaagugugcaccucuacaccauccuugaagcacugggucacgaauguguucaagaccaugcugucuagaaacucaaauaaggcauuuuuaucuuaaaauacugagccauaauguuucaagaguauaucauuuuaacagugugaguauuggaaagcuagauucaauagcaguauauuuaaaauugagaaacauuauuaccuuuuaaugaugcaagcauaagaaugauucccagaagccgggcggugguggcgcccaccuuuaaucccagcacucgggaggcagagacaggcggauuucugaguucgagggcagccagggauacacagagaaacccugucuuggaaaaaaaaaaaaagagugaugcccagaaacaaggugguuuuguucuugacuuaauacacaauagauaaugaacaguauguugcauucaaaagaugcugcccauuucuaguguaugagucaugcagacuacgaagcauaggauaaaaacccuacauuuuaauauuuuuacuaauacuuugaaaauguaacacaauguauuugaucacuucaagacucuucccaacuccugcagucuacccucuccuguacacaucacccccuuccuguccucuuuuuuucuugagauuuaguuuuacuuuguagaugguuugcauccuaggccugugugccacaugugugcagugacugcagaggccagagcugccguguggggacugggaauugaaccuggacccugugaaagagcagcugauggucucucaugcugauccauuuccccagcacuaccaccccugucguugucguuauaagacacaaucucuuacagucuuucccuccccugccaugaucuuccugagauuuaaguggagggcuggauuguaaaugcacuaaguggaaacaaguaccccacgguuggcccguuggucucugugucuaaccaguugugacuggauggagccaccucgucugugagucugugagcagggagcacugugcaguuagaggguauacuggguuacagaagcagcugcaggggguucucucaaaguuuuuaauuuauggguauuacuaagaaaguugauuuuuacuuuucauuuuaauuuuuuucucuggaacacugaaaauuaauguggaaucaugaaaacaucaaucagaauaacauucaguguugaauuauuaaccccuaaacacuaaaauuucaaggguacauguccaauucauuugguaaauuaucucuggguaauuucuucuaugagguauguguguuuguugcugauguuguuguauuaaugcacaugcaugaauacauauaggagagucaguauuagcagaagacacuauuuauugcuuuagaagagaaauauuucaucacuuuuaaagugugccuuaaccucugauuuccuuuuuaacagugacuuggauaugucagaauuccuaauuaacccaaaugcagguccuugccgcuauaauuugauugcuguuuccaaccacuauggagggaugggaggaggacauuguaaguugacauuuuacauuuuaaccuuuucauguacuuuuuccuguaacauagucaguacuuuuaaguaaauaaaaugucaaaugaaucuugcuuauaaucauuguucaauagucuuaggugaaugaaucaccuguauagcuuguauuuuaaaagccaguucuauauaggaauaguuaaugcccuucagcugaaggccaggaaggcacaugcugucugucuaagguccugucccucccacccaucagccucgcuccuuuucagguaucugcagcugugcucuucugcaacucuuuucuuuuuuaagauuuauuuacuauguacacaguguucuguaugccuguaggccugcaggccagaagagggcaccagaucucacuguagauguuugugagcuaccaugugguugcugggaauugaacucuggaccuuugaaaaagcagccagugcucuuaacuauugagccaucucugcagcccugcguacuuugaaaccauguauauuuauuuguuaagcaauagguacuguugaucucaauaacuuccucuuguuauuuaaucuuuugcuuuuuaugauuacaauuauggcauuuaucuuuccacuccaaauuacacuuaacgcucuacuacuguaagacugaaaacgagucaguauuuauggucuguuauccaaggaugccucugagcuguccauagugccgcuuccucacacagugagcgugcgugccgagcggaugggaguugaggcugccugugccagcucacacugcacugggcagacgacugccauucccguggucaucguuuuauccuucucagugcccgcuugauugcauuaacugaguagaguucuuaacgauuucagucauaagugaaauagucuuuuuuauauauauuacuucacuuugaaaucaaaucuaucgucccaaaacaagcuacauugcuuuuguuuuucuuucugaaaucaccagaacaauauggacaguaacuaucccaacaagucuacuagaauauaucccuacaucugggccugacccguggguuuucugucucgugucauuauggacugucagucuucucuuguuguuguuguuguugcugccuacaucuggacauuguuaccucugugaaaggcuacccucugcaccccacuccggcuuaccuaggacuggcucuucauaguugcuguugggcuguguguuggcuuuaucauucuugucucacuguugcuuuauaaucacccucuccacgggucuagcuugcuaagauuuucaaagaggguuacgaaauucuuuauuuagucuaucucacaguuuucucauuuucuuuaagacugagaauauuccuucugugggugcgcugucuacucugcaguucucuugaguucagacugacaagcucagcacaugcauuaggccucacgccgcugagcagauuuaagaagggauacagaacgaaagacgugaggcuguugcaugcaggauccuagagggaacacagacagaagauguucacggcugguuacugugaaucugugugguugcaaggagggaaaauggcugaaggcuccccaggggaagcugucaugccacccuguuccucagcaccucggaauguugaugguuaauguguauguguacagcuauggucggagcguguucugguagcacauggggguuugagcauccuuuauacgaagcauggaguaaaaaguaccacuugucaucuuucccuguucuguacucuauuaaaggcagggaaauccuaguguguaagagccacaggugacugagcaagguugucagaaaggaaaaugucauaggaacuuaaggaauaaagaugcuggacuuaggcaucagacccagccugaguaacagcuccacugccuggagcaaacuguccucuggaagccuaagguuccuaguucuccagugagaaucgggguggugccugaauguggaugcagugcacaguauugcaccugcuuacauaaccacuacauaaauggaacuaucucuaauuaccacugguauauuuuuaugugaauuuuuuuuuaaaaauuauuuauauuauuauuuuaccauaguuuuucuuccucugaaaaaugucacacguuucaacuuagaaaaaaaaaguauuuaaauuugcuagaaaugauucucaaaggcuuugucaaaucacuugaauguguucuaguuuuauauagauacuucucaucacaugaguguguucuacccucgugaagauacuuaccaucagguuaauguacacuaccucuuacagauguuuaucaugccucuaguaaauauuucuuaggcaugcgaucacagaguugugaggguuccagucaagaaguaacuguauucuuucauuagauacugcuuuugcaaaaaacaaagaugaugggaagugguacuauuucgaugacaguagcgucuccacugcaucugaagaccaaaucgugguaaguaugucuucaguuucugaagucauggggucagccucuuaggaagacauguaaguaaacagaagggaagacuggggcuggaaugugcucauguaccagggccaggcaugguagcgcaugccuguugaggccagccugauccacacagugaguuccaggacagcccaggcuacacggaggaacccugucuccgaaaauaagaggaagggggucaucagaacacugugucccauacucuagcagcuuguugcaaacgguguucauuuugacuucaagacacagaaaauugcuuguuuggaaauuaaucuugagaauuuucucagcacaaagucacacugugaacaacuuucuuaggggagucguuuuccucgggagaaaggggaguagcccugagcucucagacauuggcuacugugguuggggugcuagagccugugaguuuuagucaggagucuuuuaagcuugacagcacgugacagcucaugagugaguaaaagaauuuacagauucucuggucaugugucacucuacgagguuagcccugauccacugucacuuucgcauucucaguagagaaacuggucagcuguucucucucugcacugguguuuguuuuauguaacaacaacacauuuuuauugacagaauugauugauagaagcugacuaugguguguuuuaaaaagaaaacaguuauuccauagagguuuguccuucccugaauuuuaguuauuacaauauuauaaagaguaagaaauguaacaaggcugaagagauggcucagaggugaacgcugaccgcucuucagaggacccgggcaccuuucccagaacccacgguguagccugguauucuaauuccaaaucugcuguccucuuggccuccacagcaucagacuugcacaggguacacagcagacagaauagcuauacauguaacaaaaaaccuagacauguaaauuuuugaauguuugggguuuuuuuccuuacuuagaaagagagguaguaacauuuccuugugguguuuccaauacagguguccaugauacuagaaaugcuaacugacgccuguguuuccagauuaaauacuaaagaguagacaguaguguuuauaauauuucaaggauucacguucuuaaagcaaauuaauaagauucugaacccaucuacuggcacagauuuacucugugaaacaaacaggucaaaaauaacuugucucucuucccuccuguucacccagcguguauuugugacugcucuacagucucauagcuuguaguguucugaaacaaugaugccauuguaccgaauguccuuacacaagccuacgugguaacaccuuccuacauaccuaggcaauaaguugaaugcuauacuagcuuuuaaaaauagguaaauggccgcuuuagcaccucccaucuguguacgaaucccacacuucaguucuguuucucugauccuuccgcccaacaucugaaaaugaacuguccuaauccugccuuucacaucaaaauguaucuuguucagguuuggcugauagaggccauucguuuccacaccgcauaagccagacuuagugcuacacuccuuagucccggaacccaggcagugaggcagccgcacaucaggaauucaaggaugaaguuaauguuguuguugcuuucacaugagucuucauuuagucaaggaacacuugaguauguguguccggcacagccuaguuccauucugaacagccaugcauuucacugucucuaccccuuaacaacccggacacagacaaauuaacaucaucauaugacagagacagaaagggguugacugugcuggaggaaguaaggaaguacggaaaauuucagucuaaacacaaugcuuggccuuccccugcuccuacgaauauguaaguuaaguaagcgucaccaagcacaagcucaccugaaaccugagaagcccaggaggccuggcaagggugccauugccagugugaggcaugagagaucaggauguggggacgggauuagccugcaggucagauuagcgcuugggaaagaacgugguaucguaacugcucucaccuucaacuugagcggcucucgggugcuugcuuggcagauaguguaauagcaccguguguucuaucuucauagcucgcugguaucaugagagcaagggagacugaagguacugagucggcagaaaggcuacacgaggcugacagcgugauuuacggacuuaaauuacucugcucaaaagagaaggagcgugugaaauauuugaauagaauuaguaaaaccugacuggaguuccuuauuaagauagaaaugcaaugauuuaucaaaguuggaaggaaguuugccagugacauucgaaguguaugauaaccuaguuguagaacuaaauucaguucaggguaagaacuggauuauuuuuaccaaccaugggcucacuguguaguccaggcuaaccucaacuugcuaagugcuagggcaugaccuguuauucuuagcuagcaguugaagccacaggcucuuuugaaaugccaagugagggacacaagcugagacagagcagggcgucuuuaaaggauuuagugagaccacagaagaaugcccuaggaacuggaagaaagauguagggagaggcagugucacugaagacagaaguuacuggagagaaggcugugaaauaucaaguacgacugaaugauggacuacuuuaaagacagccaguugacucugacacugcuggcccuccugaaagccauuugguuacagugguuuggacaaguuaggugacauugaauuggagcugauuaugaggcgcuggguagacucuggcagcccaguggagcagaggagagguuguaagauuggaauggaaguucuuuccaugguaaggauuuuugaugcagaauaaaacaagucauuuuuaaaccagcaagacgugucugguacaguacguagugcacauguacauaauccacauggagcucacacuguggcacgcgucugcuauuuuagcauuggagacucaggcugggaggucacaaguccuagaccaucuuguacuacauggcaaaucccaggucagcaugaacuauguuguuaguuuacagaguauuagaucucauuaugacauuccccugcccuucauaccccugagccccauaggugccaugugugccaucccguuugcucaaaaccucuugucccuuucuuguggcugccauaugguuucacggccuguauccauucucacacacacuuaaauaugaacauacauacauacauaccaacuuuaaacaguuaggaucugcuuaugaggaaauguggguuuuugucuuuuugaguccauguuaucucacuuaauauacuuuuccagaucaauuuaucuucaugaaaauuuauuauuuccuuuuucuugacugcugaauaaaaucugauugugugcauauaccucauucgcacuaugcggucggucauguguugaugagcaucuggacuggucugguucacuguaguguggagguagcagcaguagacauagaugugcagugucccugguaagguaugugguggguccuugcagauggcccagcaguggcucagcugggucuaugcugcuucucaucuuagugucugccaagccuccguacugaguccacgcucccacugcagugagggaagcuuccaccuucccuacuuccucaccacacccgacaucugugucgggaccucagccauccuggcuggggagagggacucagaguuugcacuuuguuguuggcuaagcauggcugauauuucaaacucuuuauuaucuauucgagguucuucuuuugagaacuguuuauuucacuggcccauuuauugguugacacuuugggugugggguugaauuuuuguacuucuuuauuuagauuucaacccuguuugagauagaagucauagaaaagaauugcucccguucuguaagcugucagcucacucugcucaucguucccuuugcucugcacaacucauguccuguagacuccaguguucauucccacuagccugggcuaccucuucaaacaacacaggagccaugaagauggcucagguuaaaagcacaggcugcucuugcagugaacccuggguuccauucccagcagccacauggcagcucacuacugucucacuccaauuucaggggauccagugcccucuucuggcuucuauagaaaugggguuucucauugaugcucacacauacauacagaccaaacaccuauacaaaguugaaaaaaaguaaauauaaaagauuacagugaugauugcugaaccaucaccuuuuauuggacaugagggucagccacaguugaauucuucauggauaggaguggggcaggcagucaugcucaggugugccaggcccuccaccgugagcccuuguuagugguaacuguauuaugggucaugaccucuaugaaaaccuccagcagugccugccacaggggaugaaaucccacagcaguaucuagguggcaguucuccaggucucaucuccaucagcugcuuccccugcaguggcucggccauaacauccugcaguccugggcuuggcaaaacccaggugccugcgagagcuacugggaaaggaauacguacccuggaaaauaguccuuuaaaaugaguauuuucaaguugggaugguaguacacacuuuagucccagcacucaggaagcagaggcaggcagaucucugaauacaaggccagccuggucuacagauggaguuccaggacagccagggcuacacagaaaagcuugacucagaaaaccaaaggaaaaacaaaugucuuuaacauauguuaguuauaccaagaacagguuucuguaugacauuuucagggaugugagugguauccuucaguaagcuuuauucucuguaauuguccccauccacuccugcccuuuucuguucccugauugucccucuuguacuuucuuuaaaaaaaaaaaaaaaucaguguucuuccaauaaauaccagagaaauguucaacauuuuuaacccccaagggaaauguuauuuaauagggaaggugcacuagaggucaggcauaagcugaagcuaaugguguuagauagaaagacauucaccuucaaggaaaucaaaaacacggguauuuuaaaacaaguacacuaguuuguauuuuggcuguauauauuucuuaguccaaauuauauagaauuaaccuguuucauuuuaaauauagaaauaauuacauuuagccaauuuuaguagcuuccaugugaucauguguaguuuuuuuuuuuuuuuuuaugucauuaaaauugguuacuaguuaacaauugauaccguagcagcugugauguuugucuguugccaccgcugacacaccuugcuuguucgacaguccaaggcagcguacgugcucuucuaccagagacaggacacuuucagugggacuggcuucuucccucuugaccgagaaacuaaaggugcuucagcugccacagguaucccccuggaaagugacgaagacagcaaugauaaugacaaugaccuagaaaaugaaaacuguaugcacacuaauuaacgaaagugcaagaagccauaggagagacuuuccugcugguggugucuauggagaugaaguuaucaccacaugaaacagaagucugagaugaggaguuucagauacccgaauguaaauccuuuaucagauuuuaacuugugcaguacuugaagugaaacacaaugaaaacuuuaacagaaauugucucuuaauacauuuacagucuuguauuuacaagcuaaauauauauaggaaaucacaaauaaaucccuuuuaaguuugcugcuguuuugaugaauuauguuuucuuuaauuuuuuggaugugacuuaauugaugacaaauguuaaauuuguggauguuggucauuaauuuugcucuaauaauacugcaagaaaaccauggcugaacuuaguucuuggguaaucuaguuccugcgcguuaggcugccugucugcgccauccggguacuuagcugcugugucgguguggcucaaauacugcaguguccuugguacaccagauucucugaucugucccugguaaucagugugggucuguucccaccacgugaggaacagucuugaggaaguucccuuuuguugucucauuaaagugcaggccaugacauugacuucccucgcugugggaacgaacgccuucuagauuucacaugccaucagaaucauuuucagcuacauguauguauuuuucacugcaauuggaaucuauuuaaauuuuucaauuuuguuuugguuuagaaugcuuaucuucacuccacuguugguucaauauuaaagguuuuugcuauuagucccuacuccauuuugguaauuuggcaacuuuuuagcucucccaguuacuguagcuuuaaggcgggcugguuaguacucuguaucuguaguaagaauugcaucacaguuaggcgaggcuuucuguucacguacuagccuuuaacucaucgauaacugggcuauagagguaggucuguuaacuuucucuguguguuccugauggaauucaccauagccuuacagcuuuucucggaagguaaccuguauaagagaaauagcguuugcauguuccagagucagaaccuugcagcacaugacgcacacaaaccuuggguuucauuuagcuucucacagucaaggauccaagacgccaaaucuaugugugagcauuugacacauucucauuugcugcuucucucucccucugauccaguugaaggaauguaugggugacuggcaggcagugcugccuucaauaggaaacuaaacgcuggggcccaucucccacccgacuaccugagaaaccgcuuugugucccacuguuacuaaagcagaaaguauaguguucuucacuugaacuaaucaaauacaauagauuauaaauuguguauuguaaauaaaaguucacucugugagugcacauuuugguaaauuauuuauuuauguuaacauuauaaaagaaagggaaaaaaugcauuuggccaggauaaguaagguauguuggucauggcuuugcuuuauaucuugauauuaaagcugguuuuugauccuggucuuuuaaaagcugcuuuagguaucgauucuuuuuuuuuuuuuuuuucuguucuuucucuuuuuucuuuuuuuuuucuuucucucucucucucuuuuuuuaaauguaaacugaccuccugcaugacagagguuaauauuuugucugcacuuggguucacuugaguuuacauuugaaaugugcauguuuauuuauacagauuucaauaaagcuauugacggccuuauuuagucuuuuauuucuuacucugaaaccacugaaguaaauccaguuuucugcauagacgacuugacuguacagugacauuauaguuaguauuacaaagggaaucaaauccuauugaggauguuuuaaacuugggucgguguuguuuuaacucacauacucauugagcagacagugcaguuuucugcuugccuuuggagcauguauucguucugcccuuaaacuuacuuucauauguuuaaaguccauguuaacuucucauagaccuagauuauaguauccacccugacucauuugcuuucuguuguauuuuguuuguguuguuuacuuccuaauccauuugcuuggcuauugagagggucuuaggcugaccuucaccgccccugaagcccaggccaggcucaaagucuugaucauccugccuaggccucugaaaugccgggacugcagaugagaaccaccaugcccugacucagaccacauccuuucaaugcaugccaucaaguccuuuucucacugagaagaaacauuuagagaaugcuguggaugccguugagucugucagacgaucgcuucaucugcaaaaauuaaccuuguagcauaaaaaaaaaaagaacuaaagagauguucauauggaauacagggucauuaggaauagauuuagauuagaauucuacugguaacuuugccuguuaguaauuguaugauuuugaacuuacucuuucuuagccugucucuugaccuauaaaguaaugacaacuccaguagcagcuguuuauggagggcuugcucuaaaccagucacucuauuaaaaugugugugugugugugugugcgcgcgcgcacauucucccaucucaucccucaagagcugugugguagggaccagaccauucauuaucuucaccucccauacguugugucccaaaguucucacaguuauuguguggugacguccgcaucguccccucagacacauaccgccucacugugucacagugccuuucucaccacacaacucaaaugaggucaucucgucuuccagcaggcaggcuuuugugaacaauguggcacuuguugcugauugcuucugucugcguggaaagugcuguuguuagagaauuuagcuuccaguaggaagaguagcagcugguacacuuagccuuucaccuuucauuccacaaugaacuuuaucgacguaucacacuauucgcuauuuugauugcauguuaaauauuacgugguauaugauuuaaaccauuccccuaauuucaaccugaauuucaagucucuuuaauuuuuuuuaacuucacauguaauuucucuauuauauuucacuuuauuugggaaggagagugcaugucauggcacguguggagaucaaaggacaacuugcagaacuguggucuccucuccuaccacgugggccccuugagaucgauggaagugccuuuaccugcugagccaucuuaccuuaauuguuuuguuaguucagggaagggcacagguauacuauggugagcacaggguggcuagaggauuaguggcaucuuuucucuccuuccagagaucgaacuuggaacaucaggguuucauagggagcgccuuuacccacugagccaucucacaggcccuguguuuauauuuaaaugaccucugacaaagcuguagccuggugcuuuuaaguaauccuugcuuuggcuuauaaucugauuuuaguaauucuuguguuuuuccuugcauggcagacaacaagguauuaagaaccacacaaaacauugaguucagcauaaagaaaaccaacucguaccuaaauuagauguugcacaagggcagcgcuuuuuguggcuaucuuauuagaagaaagccacgagagauucugagagaaggugagcguugcauaccaaaggagaaagucaaagaagagccugccugaaaggaggcaguucccaccuguggccaugcucagcacugguacccagccgauuuucagucaggcuuucugccuuucaacucuacgggcugcuguuugacggcugcccgcucccggucccgcuguuuguccgggugcacaguugcacagguuagauucucuugccagugucacuaagauaggaaugugaagagaccuugugucccauugaggagucggguccuccaaaagauugaaugccaccuugucugaagccaaagaacaguaguagucuuccuaguucuuacucuauaacagaauugauuucuuuuacugccugaagaauuuuaaaauaguuucuuuuaaaaauaauguugaugcuuccagguaauucuuuugagugcugcuugaccagaagauaaagaaaaaaaccaaguguguuuauacccuugguggugcaggugcagguguguguuauauauuguuucguggccagauuuuccuaaugagaaaaaaauauuuuucuuaagcauuccagauuugggacauuuugauucaguauguauaugcuuuguguauuuaauucauauuuacuauaaauuacagaagaaauugcuaaauaguuuagauggcauguuuguuuagagcuaaauauauuaaauuuuuauaagggacaugguuuccaaaauagcagauuugggaaaauaaaauauauguauaguaaaaauucaaauacuaagcaagccuuguuuucacuauuagaaagaucaggaaaucuugucuuuaaagaaauggcuaauauaaaacacaguccaaagauuauuuguggcgaauacaagcacugagauacauaccuguaucauacugugcucucaugauuccccagcuauuuggggcuccugcaacuagccagaguaguugaagggaaagacccuaaauuacuaucugaauucaaaaguagauaaacuacuaaaaaaucaaguuguuuuuuggacaagaguuucaagaaauaaaggaaaaaaaaacaaaaaacagucagauggguuucacuauugguuuguuguugaggucugguccccugccaaauuuugcaaaggugcuaaaaauacaaccaucucuuugggaaugguauuuuaaauaguacuguaaaaauaaagcuacauuuuuaaauaau

SEQ ID NO: 5771 - RNA, 2282 nt, Mus musculus
ucucuguaggaagcuauuuuuacguccaccaugacugucaaagacaacuucagcucacacuucacuugggagacugagcuucagagcccagcaagcggucugcuucaucuuucucuucacagaaaucuguuuccauuuccaguaauggauaaauccucuugauggagauaauauuuaacauacaauaaauguuuuauaagucuuaaauaauguaaauuuaaaucauuaauccucaaaguuaaaugcuauguuagaguccuagauauuauaaugaaaacauuuuuguaauaucaagccauauauuucuagaugugcuuaagagcuuauauuuuucuuuuaauaaaacaagugcauaguuuauggaaauaucaguuccuaaacuugagcucugggauacauuuuccuucccccuuaaacaccagcucauuccacaccucuucucugcuuuaucacuuucaugccuucucagaaucucagaauccacuccuaggaaagggggaaggcugcuuuucuaacagcagcugcugcuucuuucuucuucuucuucuucuucuccuucuucuucuucuucuucuucuucuucuucuucuucuucuucuucuucuucuucuucuucuucuucuucuucuucuucuucuucuucuucuccuucuucuucuucuccuucuucuucuucuucuucuuccuuccagaaagaggucaucucagggauucuuucuuccaagaaauuaaaaaauuuauuuauguuacccaauuggaaccccaauggaagaaaugggggaagaacugaaggaauugaaggggauugaaauccauagaaagaaugauaucaacuaacugaaccauccagagcucccagggacuaaaccaccaaccaaagaauauacacagagugacccauagcuccagauacauauguagcauaggauggccuuauuuggcaucauggggauggcaggcccuugguccuguggaggcuugaugucccagcauaggggaaugguagaguggagagacaggagugggugagugaguagaggagcauccucauagaggcaaaagaagggggcagagagaggaugggaugggggguuguaagggauuaacuggaagggagauaucauuuuaaguguaaagaaauaaaaugauuaauaaaaaaaaagagcaaauaacaauuacuuguugggaaaccccgcuaauuaagguuuuagucuaccaugucagaaauagguccucugagaucagcacaaaauggaggacucgcuuuuugagcagagcuuccucuucucagccugaccuuaucugggcagccugaccuccacaucuucuacuugaggaaggucauguaguccuuggcaaaauuacagguucaaguuccucuuuccugcucagucuguaccugcgauuucuggcaagccucucaaugcaaaugagguauucucaguacuuuaaucucuagccagugauuuacauucacccaaagacuccuuccuacuccccaagguucauauguagcucuuauucaccccaaugaaagugaaugugcaccagcuguuugccagaauguugucaaauagaaagugcugugaaacugaaauccucagggaaggccuucuccccaucagcugcaggccuggacccagauccugcagagcacaucucuucagggcucagcuucaugcuuccagccuggugugcaauggccccaggacaccucagagaggaagugguacucagagccacagugacucaaaugaacaucuuuuauuuaacuguauuuauuugugaaaaagcuuaagacacuuuugucauucuacuuucuuaauuugaguuaaaacaauguaugcuuguguguguacaugucugugugccuguguguccuguuugugugccuguugccaugugucaagcucaccuaugaaacaaauuagcucugguuuuacuaaguuugagaaauccccucccuguuuauuaacauacucaccuuucauuggacauuugucuaugugacccauccucaaugcauguucuuucccaugcacauaaaaaaauucaucuuauagguaauauuucuacauuuaaaauauauagucucucucucucucucucucucucuguauauuugaaauaaaagaguaaaacaauaaugucgccuaggagauagaaauauaagcuuaaggcaaccucuagaaauaguaauaaaaaaaccauaaauuaaaaacaucuuuguuuuucuaccacacaaagcuauuauauucugacucugucaccagguucccuuu

SEQ ID NO: 5772 - RNA, 7256 nt, Mus musculus
gaagacauggaacgcaagauucuuaggguguucuguuugugacaggggcuuccuuuugaguggcuggacuggaauucacuaugucaaccaggcuaguuucaaacuugcaauaguccugccucugucuuucaagugguggaaugaugggucuaugcucaaccauggucagcaaggcuuacuaugugcacacuagaaucuaaacugcuuuaccgugugacacuugguuguaaccuccaccccccaccccccagccugaaaucuggcugaucagguuugacuguuaucaccaggagaucaucggggguggagccugccacccuaucguucugccacucccacugcugcuaccugccgccuagcuguuccagaguauucauguggucaccugcagcuggacuccaaagaugauuuggugggaaugggccccucccccuucuuuauaaccccguguuccgaauauuaaaauugagcuuugaucaggauguugucuuagcuccgucuuucucgcgccaccuagauucccuccagaauucuuccagauuccaagaugcuuuccaggcucgaacccggacaugugagccgcuggccugccccaacacuugguaucccugcauugucaaggccaggaacacugaagucacuccucaucugucucugcauaggcgaccacaccuggaagacaguugaggcaguuguaaacacuaaaagcuuugacccaagauagguuaccaagccacuuguaguucaaggugccagagagaccaaugggggucauguugagggucacggaaagcguugaggaaaagcacaugcacagaaaucugugagaaaagaguagcuagccaggcagagguuuggugagaaggcaagcacucauggaagcgcuggggaagaggaacgugacacauuuaaggugcuauuaaaggucagguuaccugaagcaugagagaggaagagaaggaagaugguggucacacgccauugccauuguguaagguccgcuaacaaaaacacuguauuuacuccagugggaauggaaaccacaaggauuuaaaucaagacagugaugucauggaaccugauccagucugagaucaguuuggauaaggugcaggaaacaguuagugccccucuguuguauuuuauaacaaagauagagaagaaggaauaauuugguggaggcgagguuaggugugggagaagcgggugggcccaugcugaggcaucccuuccugcugagggaccagccacaugacaguauaguauagaauagaguuuauucagggcauggggaggggaguugagagaguagaaguggcagagaaaggcagagagagagagagagagagagagagagagagagagagagagagagagagagagagguaggggaguagagggguagaggcuggccaugagcauguggagagagggagggauuguaauggggggagagggggagcaggaacaagaggacagagcaugagagccagaaagcagagagaagggggccagcagcuccuuuuauagugagucaggcacaccuggcuguugccagguaacuguaggacaaagccuagacuaaccgccaacacucucuuccugcuacuuuguggguucuucuuucuucuaccuuucucuacucccuuucuuccacccuuucaacccccucacacuagauaagugagaaaaggauagaggggaauguuggacugugaaaggcaaucugcaguuuggucaagccaggcuuacucgggagacucaguagaaaaaaaucuacaagggaccuaaccuuaagcuaugcucccagacacaagcgccugacaccacaucaacuccucaacuccauaaucuugugacuaucagucacauagacaaugucccaagcuccugguauccaggcuacagccagguaugcuccucccaacaguuaccuggcaacagcaagguagcccaacccacuauaaaaggggcugcucggccccuccucucucucuuaagcucuugcucucuccuugucucuuaccucucacucuccuucuccccuucccuucuccccucucuccauguggccauggcugcccucuacuuuucuucccuucuucucucuccucucucugccuuucuacaguaaauaccuucaaaccaugaacugucucugcucauugagaucuguguuagagcaacagagcaggucucucucuaacaagccaaaccucccacugggaguccuuccuaugcuccagccauggccgccugugcuagccagacucucauuccccccgcccccccaagguaacaugcuagagcucucccccuuuagcuccagggccagaguccaucugagggcccauucucagcucucuugagacauacagcagucugggaugucugagagugagaaccaguuguccuggaccacugugaggcccaaggaccccaaaacuggcucucccaugcuacccaguggucuguggugcccaagacugcaccuuccccaccccauggagcaggguuguguggccugugaggccugacgcccgucccgggugguuccgaggcagucuacccgagcucuggcaggacgcuggucucuuacccauuuauuuccucauguguggcauccaacaggggaagauggugacauuguuagacuacuuccugcugauuaggggcauugagacccuuggggcaaguuugaucuaaugucuucuucuuguuguuucuucuuugcauauggauacuuaacaaaugaugaccaacagcaaccaacaaccccuccuaucagggcucuagcauuuaucuauccucugaaaauuucccagaauuccaagugucacacacuugcagaaacagucugcagcuggcaaaaucacaccccugccagagcaugaggcaaaucauagucaccugcuuccagacaaucugaagcagccccauaucccacaccugggauuaaaaugagaacacuuucuuauaauauuucuauauuucuauauuacaaaauugucacuauauaccuugucaacuuuaauauguuaggcuguaccugcccagugucuauuuccuuagaucugguuuuccuuuagaggacucauagccccagccauacaauucuggggggacggcaccuuauccccccuaugccuaugcuaaucaggacuguggcugcaguugauacaucaggucauaugcuugucuuuguuucaaaucagugacagacuugaaucucagugaaucucagggugguuuggaagcuacuccuuugagguuaugacuguucaaggggagaguugggagcuguugaaacgugguauuccggaguucuauggcugugaagacacugaccguggcaacuuuuaugaaggaaagcacuuaacugggucuggcuuacagugucagagguuuaguccauuaucaccauggcaggaagcaugguggcacgcaggcagacguggugcuggagaaguaguugagaguucuacauccagaccugaaggcagcaggaagaaagagaaacacugggccuggauaggguguuugaaaccucaaagcccacccacuuccuacuaagaccacacccacuucaacaaggccacaccccuuaauucccccucaagcagugccacucucugauggcuaagcauucaaauauauggaccaaugggagacguucuuuuucaaaccaccauacauagugagaaagcaaucaagaaacaggguagggagggagggaggaggggaccugagucuuccgcgacucugugugaacucuugggucaagcuugaagucaccucuuuccugaacuccacaguaaggugaggugauacgagcucuauauuguuuaagcugguugaguugggguuuugguuauucuagccuaaauauucccagcggauguagaaaccaguucaacugagcuaggcccuaaaagcggaacuggcucagucagaagagucagaacccagggcagugagaccucgcagaggcaagcagaucucugugaguuugaggccagccuggucuacacaaugaguaccaggccagccagggcuacauagagagaucccccaucucagaaacaaacaaacaaacaaacaaacaaacaaacaaaacaaaauggcuaacauccuaaaaccuggaaaaguccaggaacuuggauuuaagaugcacuuguagguagguauauuguagcguauaguuuugucuacacgguggcuuuggauucccugcugauuggacacacacauccaucuaggagcuaucucagaucugcagauaaaagacacacacauacauuagcucauuuuaaaccugccguauggcucaguggcugggcucuucuaagccucccuuggcuagugugcccuaccuuucacuccuugcucaguauucuaaaucugcccucagcuuaguugcauuucuaaucuccugcuugcuacccuagacccaacugaggaaguagccaauggccacuccacccaagaucucacauccugguggcucucucccccucccgagcacgguggaucuccucuuccuuucucuccucucccagccuagggaaccuggaagucccaccuuuacugcccagccauuuggcugcuagcaucuuuauuuauugaauaaaaaccaaucagggaacaggaccuucagcauuuacaugcagaucucaaauuagaucaaaguauuaagaccacuuccucaaaguaugugguccaucccgaggcacucaaggaaugugguccauccucaggcauguggacgcagagaggagaacacaacacacgagacagacuugggugcccacgacgcugcuccccaucuccuuccugacacuguuugagagucaccucuaaccaaggagaccguauuccugugacagaugugagaggcacagccucagugggaggacaagaugcgacgcucucccuucacguuccuacaauucgcucugagguguaacuuaggacugugcuugaagcuggggguuugggaagacuucuaagccucauugcuuagaguagugguuccuaaccuuccucacacugcaaccacuucauacaguucuuuauguggugguggccccaaaccauacaauuucauugcuucuucauaacugucauuuugcuauuguuaugaaucacaauguaaaggacuaugaaaggaucauuugaccccacccccaagggggucgagacccacagguuaaggaccacuguauuagaggaccaaauagcacuuugcuggccugaauggggcacacagaggauagcugucagcaucaggacuacuccagaugcagaggccacuuucaucuggauuuauaugcuaucaugcaggcugcaagaauaugccucagugauauuugguuuuauaugauagcucuuggaaucaucuagaagcagagaagccugaaaucagggcagggagucgcacugccagagagaugccaugcugagaugaagacauugggcaggagauguugcagcucccaacauauuucuccuucuccgucucccaaacaggaugagucagucuucuuagggcuggaauacuaaagcucugguccucauacuuucagaucacaagacguucuuuaaaaugcugcuucuugcagcuggggagauagcccaaucaacaaagugcuugaggaaccauucugagcugagcucaaucaccaacucaugaggaaaaaguacgugugccagcuagucgguccagcggugaggagacagaaugugaauccaugaagcuugucugagagacccggugucaaaggccgaggugaaugccucgugagaaacaagcucuugaucucaggcuuccacacgugugugcauccacgcauaaaacgcacccuucuguauacgcgcaaauacagcuucuuggguuuuaucuccaaguuugauuccugcccuguaagauuuggcucagggaucuguguuacugauccacacuccgggggcuaggaagacucaccuugggaaugauacuuuagggcuguuacauacuccuuagucauagguaacaggauuugcauucuguccuugcaguacuuuugcuauguguagggcauagacuaggaguucgaaagaaccuaauuuauuagcccccaaaaagcacggguuuccccuugucgaggaaauugcucuuugcaaaagagaccaccacagaaaacugcaaccaacugaaaugcagaauuaaaaagcccaguucugaucaaccaaucaaaaugcagaguucggaagcccaguucugauggagacaccuacaaagcaacuccggcaccuagagcucagggaacauuucagaagaugggauagaaagguuggaugaaccagaggaucaggguguuggcugugagauugugucuccuaaugucagaagcuauaccucucggcaacauggcugcccaagcaugagcugaacaaaggcaaccgcaugcugaaguggauagggaaagaauaggcuucaacccuacacaaagaaccacaggcaacuggggaaagcugagagugggagagagagcuguccccagggaagagcacacgacuugguuauccaauagccaacggucagcccugaaaacauacacacaaguaauuuacagauugaguggguuacauuuaggaguauuuauauauauaugcauguaacaaaaauuaaugaaaaaagaggugugggacuugaaagagagcuaaggcagauauaguggagcacuugaagggagaaacgauaugauuauauuauaaucucaaccaaaccaaaccaagccaaacaaaaacauagauuccugagcccagggaauuggggagacaugcaggcugcaacgucaggggcucaccugcccugagucucaggucuucaagcaggcuuuuguucuacuuuaauggggccacuaguccagcuacagaguagcaacaaguaugucugggcucuucacuuggugucacugcacaagcagggaauucuagguguguguuugugugcacacauacauguguguaugugugcauuguguguguguauauuuaugugcuucugugugugaguauaugugugcuuguauauguguauuagucaggguucucuagagucacagaacuuauggauagucucuagauaguaaaggaauuuauugaugacuuacagucagcagcccaauucccaacaauuguucagucgcagcugugaauggaaguccaaggaucuagcaguuacucagucucacguagcaagcaggcgaaggagc

SEQ ID NO: 5773 - RNA, 19268 nt, Mus musculus
gccggcgucccgucugugcgccgaugggcgggagggccagagggaugucgcuucugcggucgcugcgcuucuucccggucgcgugcaccggccgcucggugagcgcgcgcgcccuucccuucucccgacccuggccccgcggauggugcucccccuccucccguucugcuccgggagcucaucccuuucuccuuacucuccccaggcgagggcuguccugcuccagccgucccagccauggcucacguuucacgccggccccucgcuguccucugcugccuccagcaaggagcuccuuaugaaacugcggcggaaaaccggcuacuccuuugucaacugcaagaaggcucuggagacuuguggcggugaccucaagcaggugggaggaggugcugcgagauuuggugcuacggcuccaccccauucuuuccuuccgggggucacucugcggagcauagacaugaccugcugcugcccaguguccugugcgacagaacuggccaaagaggaaaauuuggcuuaaacgagagcuuuacccuucgacugcguuuucacuggaagcaguuaaccuagaaacuuaacuugcugaauuccauguuccuuauggcuaugagauuugcugcugccuggagaucgguguuuguauaaauuuaggaguuagacuccagaggcucucacacccgcucaaacucuggagaucgcaaugaauccuuucguguugucagcguugucuguauaaugaaaacacuaccaucuauccuauagugggguuguaaagauuaaaaguagagaagcaacagcgacuacagcgcuugguguaaagcauuuaguaguuucucuuauagaaugugggugugcagaaaaagucauaugggggcuggagagauggcucagcgguuaagagcacuggcugcucuuccagagguccugaguucaauucccagcaaccacauaguggcucacaaccaucugcaguggggucugaugcccucuucuggugugucugaagacagauacaguguacucauacauaagauaaauaaaucauuaaagaaaaagaaauuauaaaaagucauauaugguuuggacauauuuuaaaguaccuuucauuucuaguuccugugacugacuuuccccucuguuucuuuugcauuuguaggcagaggacuggcugcacaaacaggcccagaaggaaggauggagcaaagccgccaagcuccacgggaggaagacuaaagaaggcuugauuggacuucugcaggagggaaacacagcuguuuuaguagaggugcguuguugggaugccacauacuagaaacagcuguaucuuggagaguacgaucugugguggacccuuugcaugcuuaaggaaucuguaagcgguggcucgagugaaguccccaaggccuccguuaugugacgggauuaagaauguaaaugcagggcuugagagauggcacagugguuaagagcacugacuacccuuccugagguccugaguucaauucccagcaaccacaugguggcucacaaccaucugcaauggagucugaugcccuccucuagugugucugaagacagcuacaguguucucauauauaauaaguaaauauuaaagguaaaaaaaaaaaagaauauaaaugucuugaugggaauuguccuagcaaccuagaucauuuauucuaaauguuagacuuaaaauguuagacuguaagugguggacuuagaaacuaguagcagggugcggcagcucucgccuguguucacuccauacuugggaggccggaggauuacugugaguuugagggcagcuaggcuacaagcuggaauccuggccuuuacucuuaaacaaaacaaaacaaaaaacacgguaagaaaguugguaauuauaguaauguauuacucgguguauugaugacuaguaaguagcaggcuuagaggagucuguggggucaaggcguguaaaaaacagauaaagcuacaagaaaggaacaacauaaacaaaugugguuugggagaugaacaugguaguuuguggguguaauucuagugcacgggagguagaggccagaaggucagcucagggucguccuggucuaccuaacgaguucaaggccagccugagacacuuucacaaacaguaggugaaguggccauggugcgagucccucaggguguucuggaauccugcuggguaugcaggccucggcugacuaguucccuggcuucugccaccccggaacugugggccugcagcuuguuccgucaauaccuuggacaggucuccaaccuuaaggcacuuuuagaaacuauuaguaaacagcuuauacagcaauauccaugcauucccacagguaaacugugagacagauuuugucuccagaaauuuaaaauuucaacaguugguccagcaaguagcccugggaaccauggcacacugucagaaccugacggaucggcucuccacguacaguaaggugagcgugagggucggcuccagcuugcugaguuuuugucuuccacauuuuagggucuguucuuuuucuuuuuuuaccuuuuuggggugagugauugaggauugaacccaggaacuugggcagacuguucuaccaaugaacugcgcuucucuuuuuggguggggaaggaguugagacaggguuucucuguguagcucugauuguccuggaacucacucagacaggcuggucucugccuccugagugccaccuucuuuuuugagacaggaucucucuaggccuggcuucucugggacaaggcuggccucacacucacagagaucuuccugccucugccucuugaacucuggaauuagagagaugagcuauuagaccuggcuuccaucauuuuuugggauagggguucucaaugaaccuggagcucaccccuugagccagacugguuaguaauggauuucagaaagaccacugccaccucacugcuagauuacagaugcaugccgucuuuuuauguggguguuggggaugcagcucaugcuguccgaugugaugacccugagggaauacuucccagaagaacuucccucagccauguugaccucucagucccagcuagauagcauugaucgucccuguaaagcaaagcuuucggucagugguccugacucuuguuuaucauaagcugauugauuauucauagcccuagcugaucagaaaccacagauucacaauucaaaauaucacaugaaugauagacuuaaaggaacucucaaagaaaagagagagagggacagaugggcaggcaaaacaagcuacacagugagacccugucucagaagaacaaaagaaauggacuggagagacggcuuaacaauuaagagcacugacugcucuuccagagguccugaguuuaauuccaggaaccacauuguggcucacaaccaucuguaauagggucugaugcccucuucaggcaugucugaagacagccacaguguacucaaaaacauaaaguaaauaauucuuucuuuuauuuuuuuuuauuagauauuuucuucauuuacauuucaaaugcuauccugaaaguccccuauacccgccuccacucuccuacccacccacucccacuucuuggcccuggcaaguaaauaauucuuuaaaaaacaaaaacaaaacauacagagacguaucaaagcugaauuagacaauauacaaauaaugaauuaaauacauuggcauuauuuugguggaccugguugcccaugccuuuaaucccagcacucaggaggcagaggcagguggaucucuugaguuugaggcuagccuggucuacagaaugaguucuagggcagccugggcuacacagagaaagccugucuuaaucaaccaacaaacaaaaggauaagagacgucuuguugcuuuaggaaaacaucucuaucacaucauagcacuggugugugcguguguguguguguguguguguguguguguguguguguguaugggugcgcaugaaggucagaggauaacuugcaggagucgguucugugacagcucagggcauccuguugggcagcacaugucccuaccacugcacugccucgcuggcucccucugacucccuuucaaaugucauuauuuuuauuauauaaacuuuauauuuauuuauuuguaugcauaugggugcccauaaagguuacaagaggagcuggaguuacagguggcugugagccgccaugugggugcuggggacugaacguagguccucagaagagcagccaugugcucuuaaccucugaguucucucucagucuugacucccauucuccuccuuuuuuaacguguguagugcagcaugugugugcacucucgaaggccaggaagggcacugggucucuuggagcuggaaccagaguccucuagaagagcagcuggugaucguaaccacauggccauugcucuagcccccaaccccccugcuaacuauuucuguagaugagcaggcucaucauauuaucgucuuaagucauuucuuguuacaacacuauaauguacauuugugucagguacugauggugacauguagacuugcuuucacuuguccugugucacgaaacagucuauagcagugucucacacagacuuggccagucuugaccacacuguagccuugguuggcuaugagcuucaaauccuuuugccuccaccucccaagugcugggauuaaggcuuguucuaccacauucacuaccguguucacagucauguucacuaccauguucacuaucguguucuaguauguucacugcuauguucuaccauguucacugucauguucuagcauguucacuaacauguuccauuauguucacuaccauguucuaccauguucacuaucauguucuagcauguucacuaacauguuccauuauguucacuaccaaguucuaccauguucacugucauguucacuaccguguucuaccauguucacuguccuuugucuuucuagcugcaugguauuaaguuguacgaugugccaaggauuauucagccagucuccuguguuugggcauuuggcaauugucaaacuuuaaugauuagaaauaauuauucuccuaauaaagacuuguauauggauguacacagauuauuuuuuuaaaaagaaauaauuauuuaguggauaaucuuauguaugugugcuuuuaaagaauucccacuuuuguaucuuugcaaguucaucagcagcagguuacagugaugcaugucuguaaucccagcacucaagaggcagaggcaggaggauuuccaggacuuugagguuaccuugggcugcaugguuuuuccaagucuuacaggauugcagaaugugacccugaccccaaaaacaguaccggaaagggaaaugcaucguccaauucccagcccuagaacugcagagccaaaggccacgugcacaaacaagcucugcucggccccuuccuucucgugugcuucaucaugccuuccuggaaacugcacaaguccucugcuguugauauuuuaugauuguguaaaaauccggcuccuguuucuaggaaauccuaagaagguagggcuagaagaugagcgucuaauagaauuggugugugugugucugugucugugugugugugcaguaguagaguaagauauuuauaagcgugacaauguuaccaauuuuuaacauccuggcuuaguggaaguuucaucuauuuauagauggucgucuuaaguguuuucccaggucucagcucuuucugccuguuguuagggugauuucagccgucagagccagcucacacuugucuccuguauguagggcuuucucaacuccucugagcuuucugaacuugcagcugggcccgacagggaaggcucucucaaggaucaguuggcccuagcgauuggugaguaucugugagggcucuggaaaguuaugauuggguuuuccugguaucuuuggcauuccuccacgucucauucaguaaccgagaugucagcuccagaguggaggcagggagaagaagcaaaugcgauggaaacaugucauacgcauaugcgaaacucucaacaaguaacuaaaaagagaauuacaagcucaugugcugcuaagggcaggacuaugggaguauggguuggccuuucuagggagcgguagacaccacaaagaaccaaaagagguaccauauugagggaacuggaguucugguacagucagaauccugaauuccuuaaaggaauuuagauauaaaucuaaacuaccucucaugguuuuuaauggcuuacaacuaguuaaaauuaucucaucacugugccaacuauaaacaaaggcagagaggagauggcucuucauccuccagcugaccauuguguguguuuuagggaaaaucucacuaaagguggagaagaaaacuuaagggcugggugacagcucauuuaagagccuuggcuguucuuccagagggcagugguuugauuccuagcgucagcuuggacuagugaacaucucuaacaguaguuccaagggauucuggcuuccaagggcgcugcauguguguggcucacagagcguuaggguuaggguuagggcagucgaaacacccuacacauaaaauaaaaauacuuuuggggggguggggaggguguuuuauuuuuuaaagacuggguuucacuguguagcucuggcuguucuggaacucuguggaccaggccaaccuugaacucacagagacccgucugccucugccucucugccucuuugugcugggagaaaaggcauucgccacucacccuuacccacugccuaacaaucuuuccccuuuaaagaaaauggaagaucgucuguuuuagggacuugauagugaguuuaagaaggugcgugucuuuagaagccacguuccagucacuauggggcuguccugagggagggagaaagcaggcuggcuugcaguugcuggggauugucuguggucugcaguuucuagucaaggcguaguuguuuucacaugguaaucucugguucugucuugugagucacagagagagcagccaagccaauggcugugugcagaacucucggaaggaauggcacuucuggaucuuccccugaauggccucuagcuguaacuguggcuaaccuguaucuuccggagucccugcuguuggccucacaucccuagcucaucuugguuuauucagguuucucaggaaggggauccugggcaaacaagagaaacuugaaucaguuucuaguuuugagaaugucacagaaucuuugcaccucugaagagugguaguugggacuguggggugccuggguuuggauuuccugcagcuuuugguuacagaccuuuuccaguugugucagugguggguguguuuccagagugauuuggugauggggugggaguuggagucagcuuugaguugugacucccacucugcuaguauugcccugugggucauuuggaucucucagccugaguuuagugugaugaauagccggguucugagugcccgcucugcaugacacacugcaaugcaugcuccuugccugcgccaccuucuuuauuucucccaguaacccugaaaggugggucauaucaacuccauugaauagagggggaaaccaaggcuugguaguugauaaaugccccaguucccagaaccagggaagacagaaccaugaauuuggcagccagccugagugacagccagccuguuuuagcuagaguacucucagaggggcucugcuccucucccuccuccuuaaacacaggccgaggcuggugucuucccaucacggugcagauagacugacugcacggacagaaaggucaccauccacagcucacgugggugccgccauagucaccucaauccagugguguuguuucuuguuuaugcucuuuuguagguaaacugggagagaacaugauucuuaagcgagcugccugggugaaggugcccucuggguucuaugucggcucuuaugugcacggagugacgcagagccccucccuccagaaccuggugcuggggaaguacggggcccuggucaucugugagacucccgagcagaucgcaaaccuggaggagguuggccgccgcuuggggcagcacguggugggcauggccccucucucugugggcucccuggacgaugagccugggggggagacggagaccaggaugcugccccagccguaccuccuggauccuuccauuacacuggggcaguacgugcagccccagggcgugacuguaguggacuucgugcgcuucgaauguggagaagacgaacagguggccgaggcugaauagguuuuuggccuaaguggaaauauuuaauuuuuauaucuggauuuccuuauaaaaaguuauuuucuaaaccucuucaacccucaaauuuguuuuuuuuuuuuccuuuuuaguuuaaaaugaagauauauaaucauggguaaaguuauuaaauggugauguaauaaagaauuuuucucauuuguauagugcuuaaugugugaguguguguguguuugugugugagugcacacaugccaggcuuuguauaguaagcacuuuuacccaaucucuccaguccccagccuauaccagucuauuauauaauucuggaaguuucuaacacacugucuuguuccugugacaaagaucuccacucuguguugacucugugacauuuuggaccauguaucuucccuggaacuaccuagcaguauuuccugucaucuggauuucaugcuuguuggcauguguuagaguugucugggcgacgugggcuccuuugcugacagcuccagcaugcucucuguagugguguauacauacgcugguaugugccccugaaauaggugugcuggccaggucugcagcagacgggaaugacagcgguacaguuaccacacagcucucucagcauugccuuuauuugcuuugaugauggggacucaaucaggacuugagguauacugcugagcuaagugugugcuggccuucuuuuuuuguuuuguuuuguuuuuucgaaaugguuucucuguguagcucuagcuguccuagaacuagcucuguagaccaaacugggccucgaauucacagaucuaucugcuucugccucucaagugcugggauuaaaagccacuacuuggcuuuuauugucuucuccccuccccuccccuccccuccccuccccuccccuccccuccuuuuuuccuuucauccauccauccgucuguccuuccuucccuccauucauuccuaugguuuuuagagguaggguuucucuguguagcccuggcugaccuggaacucacuguauagaccaggcuggccuugaacucacagagaucugucugccucugccuucccaagcgcugguuuuaaaggcaugcaccaccauugcugccuagauauuuuuuuucucuuuaugcguaagaauguuuugccugcauguguuuauguguaccauucacaugccuguuacagagaugacauuggcuccccuagaacuggaguuucagaugauugugagccaccgugcgggggcugggaacaaaacccuugcuucugcaagaccaccaaguggucuuaaccccugagccaucucuuccaccccauacugcacuuuaaaaaaauugagucagggucuuccuaaguuacucagcucugccuugaauacucucuguagcccaaacaggcuuugaacucacaacuguguuccuaccccagcugagcugguaacggguuagaggcuugugaaccaggcccaaccucaagauugccucuuuauuuucucagcacggaaacguucuucccaugauaacuacagccaccauaagaacauagucacauggccucuuuauuuguaaaguugaacaugcuguggcacaugguagaccugggcguuuggagccuggccugcagggaguguguggucacucuagugcuuuggggauugcaggguguaguuggaagcagauguggguccugaugcauuaaauaagcuuaguuucuagcucuuucugccuucacgcucucugcuacagcuucggcuaaaaaaccaccaaagccaaaaggcaagcugucagcaucuaauggacagccacaaggaaugcaaggaugacuucgaaaggcagucagccauccugagaugggucguaucuaaagcagccgcgugucgggcucaguugguaggugaacucuuugcugauguuggcacugcuaguuugcucucuccuguggccgggcagcagacacacgccuucucuagaaaaggccccuuucuuucuucagcuggagcuguuuccagccaggcagagcagugaacugcccucucgugaugccaaacacagauacaaagucuuguuccgagagguaguucugagaaaacagaguuuguggugagaaagaagacagcacauuucacuaaaugccuacaaguaaacuggagagaggagggaggcugcauggccgcgugcuugccugggcacacaagcuugccaggggacugagcccgagaaccauagucaagugauagguacguagacccugggagggaggugucaggaagccugaaacagcccuacacuguucccuggccacggaggcccauuugagccaguggaggaagaaugacuggguuucccacuugguccugguuccuugccugauaggcauugaguggauuauacauuauguaugaauuauaaacauuugauuuuagauggauggaggaucaaguagaguaucuugcuccaugccuucacuaccauucuuguugaauacuuauuuuuggugcuagcgggugagcccaggacugcucucgggggaaucugagaaugugcucuaucaaucacugcacuguaccccgaguaccccaagauccuuaacaugcgagcuugagaagaucauuucaaugcaguguccgugucaagaucuaagcuacgaccuuuauuuauuuauuuauuuauuuauuuauauuauuauuauuuucugagacagcaucuuaccacagcccuggcugucacagaacucacugcauagcccagguuggcuuggaaccuauggugacucuccugccuccauccccauagucccgggauuacagucaugagccacgaagcccaacugugaccucugcuucugagaacauuguagucuagaugcuuaagacuuggcuagagaagagauuacauuaggggaaacgucagaauccuucaagcaacccuuucaaggggaaaauccacccacucaucugugcgcucagcaugaagaugcuaauucauuuaacuaaguccuaacccaggcaacgaaggagcccaaggccagugugcguugucgggagggaagggcucguugaggggauagaguuaggacacucguaguccaagaaagccggccagaggugagcucuaaguggcaagcagcuggcucucucacacaggaacaccagcaagccaaaggagaaaagcgagcacuggcugaagggugauaaggaagagaguaugugaggucccccaggggcagggucagacuguggaggccuuuggagucuuuuguaaguacagcgggaagccaucugagguauuuuaaaguuuucuguuacauuuauuuagugcgucuaugugggagcauucuuuuggagaucagagcaugauaacuuguggaaucaauucucuccucucguggguccuaggugcugaauuugcaaucaccuuuacccacugacucgucuugccagcccaugugguauuuuauuuuuuauuuaauuuuuaaaaaagauuuauuuauuauaugcaagaacacuagcugucuucagacacuccagaagagggcauugaaucucauuucagaugguugugagccaccaugugguugcugggauuugaacucaggaccuuuggaagagcagucagugcucuuaacugcugaaccauuucuccagccccuuuuauuugauuuuuuaacuuauuuuuuuaaaagauuuauuuuauguguaugagugcucuaucugcauguacaccugcaugccagaagagggcaugcaucagaacucacuauagaugugagucaccaugugguugauaggaauugaacucaggaccucugcgcugagcuguucgagcccccccccccaaccgccccgcccuccagcuuggugcuauaaaccugugggagcuccgcccccuacguucaguucccgcaguuccugcagcauguuggaucugcuccaagccuuuucccaagcuccgagcuuaggcuauucgagcuccgcacaugcgcccuccccuccccucccacgcacgcacaaccacucaccuccuuuuuggcgggguccacauccucaggcagcuccugguucugaccuuucagcagaacuuccaccggguaguacuuuggcucaccgucacuaggauucagguaaaguguugcguucuucauguccuguguaagagaggaacacagacacagauagguagagcgauguuucguguggccucaguucccugcguguauaagauuuacacuuuggcuugugccucugcauccuuugugaacaucuuucagaacgguggucccuaaaccuggaugccugacaaaccuggggacgcugauucagcagguccagugugagccuuuagggccagaucugcgugcacacuacacuuaggucuaaccaugcauuacauauagauguguguuuguguagugcugggaacugaagccaaagccucgugcauccugggcaggugccacugagcugucuaccucuugcuggaagucauuuucaaguacugugaucauauauaucccauccuuugggguuuuuauccagguccuacguuuucaguuguuaaaugcuuucagacugaagcuaugcuuaaauauacuuuaaagacacuaauggcaucccauuagcuuugggaccuggguuagcagagcacagaggacaauguguaaauguuggaccucccugugucaugaauccuauccugucauuccaagcgcugcuggccacaagcuccacuuguaccuguuaaaauagggguccguggccuaaaacgccguggauuucaccauaagaaacuaguaaaauaucaucuggguuagaggcuugugccugaggaauaccaacaauaauccuaaaaggcugaguaauaaaguuagguuuuguucuuauuguucuuucuuuucuuuugcuuucuuuucuuuugcuuucuuuucuuuccuuuccuuuccuucccuuuucuuuucuuuucuuuucuuuucuuuucuuuucuuuucuuuucuuuucuuuucuuuuccuuuuuugaggcagggucacauauagcccagacuggcccuccacucaauauguaacauggaugaccuuaaacucuuuaauuuaguuaguacauuauguauauggggggauaugugugcacaggagugugggugcacuuacaguccagaggaauacacacuucuggagcuguaguuagggucuccugugagcuauccaacacaggggcuucucuuagcugcagagccagcucgacaacccccucccccacauaccuacuguguucuggaaugcaguaaauuaggaacuuggcucugagaccugcuuuucccucuucuucaccccccuccgccuuuccucccuccucccucuccccucucuccccucuccccucucuccccucucuccccucccucucuuucuuaauuucuuucuuucuuuucuuuuuauucuuaaaagaaccaugagggcaucugcugcacccucucucuccuuuaagagugaaccggacucacagcggugauucgcacaauggcaguugcaucucccagcucguucuuuagcugcucauaugauuuuccuuccuaggaagagacagaaaacacaggaggagauauuuauugacaacggggaacaggcgucauaggccugguguguguagguagagccaugaagcgcuuggguauacucagguccaguuaugagugaccaacauuauuugguugcaagaacaagcaggugagcgggcaucagaugccugauuucuugccacuggcccgccgugacuuuccacugacugucaggauugugaccauguguagacagguaucauaguuccuugcugccuccugcugacacagcugggaacugacuagacucccugccagggagacaaagccaaggagaagggaagcaggcaaggguguggggaguggcuugggggaagugagagccugguuuuacuuggcucuggaacagcaugucucccccccauggguucugaggcucagggcagucagaacagcauccucaguuucuauuuuucuuacgcuccaaaugugagggucccaugccaggaaccagccugugaagguggggggcucaaagcccuguuugaugaucagaaucggugugucggggucucggccacuaggaugugugaccagguacuccugagccgucgagagggcccccuucuucuccguggcauuggccuccgcuccuauccacaagaacaccugucgcaccgauuucauauuguuagugcguccguaggaccaaguacugcuguguacacugcucaucccccucgcccccugucagucacagccucauucaugcuccaaagaggaagguuccagaagcagcuugaucuaaguuuuugcauccgaacuacagcuuccugaaugaacagccuacaaaacaccccuuaugcugucuuggugugcuucaaaccucagagaagacaaauguagccguccugucuaagugccuaucccaugggaauguccauucuugguaagccugagcccuccaucacauaggacagaacugagagucaggucuguagcccuggauccagggagucacuggacucacgagcuggaucaaggcaguuaccccaucaccacaccucucucucugugaugaugcagccaauacccacugcucuuggcccauccugcuuucuggugugaugggucaggcccucagagcccauugcuacucucagcuguaucucuaucucucucagguggaccuuaggucuugucuuacgucuuugugugcuuauuuguuugguuuugagacaggaucucacucucuaggcaaggcugacuuccagcccacucuuuccuugaacucacagaaauucuccugccucagccucacuagugcugggacugcaggcacgagcuccucggccaggcuucuuuuauucucugguaggauccugugucuuguucuccaguaccauuuccuuccccagagcccggcucaucucuucccacuuggccuucuccucuaggagucuucugcgagcuccaaacugcauugaacacuucacauaccucaccauaaagcacgcagguuucuuugccuggcccgucccuccagucuguaaacucugaaggcucaucagcauggagggaaauggcauacacaggaagacaucucgugcgccugcugccuuaaaggcccaucccuagucucuagaaucugcugucauccucaaaaaaaggcaggaucuaugcuaggcuuuguuuuccaaaguaaggugagaaaauccccaggguggugagagggauuuuuuguuuuguuuggcuggaacuuuuucuuucuuucuuucuuuucuuucuuucuuucuuucuuucuuucuuucuuucuuucuuucuuucuuucuuucuuucuuucuuucuuucuuucuuuugguuuuuguucuuucuuuuuuuuuuguagaugguucaucauuuuuauuuauuuauuuauuauauguaaguacacuguagcugucuucagacacuccagaaggaggagucagaucuuguuacggaugguugugagccaccaugugguugcugggauuugaacuccauaccuucgaaagagcagucgggugcucuuacccacugagccaucucaccagccccccuuuuuuuuuguuuuuccagacaggguuucucuguguaguccuggcuguccuggaacucacucuguagaccaggcuggccucagaaauccgccugccucugucucccaagugcugggacuaaaggagugcaccaccaucgcccggcuggaacuuuucuauuguaucuaucuauuuggcggauguggaaacacaugugccagaguauaggcguggaggucacaggacaauuugcaggaugcauucuugccucacaucggguggaucuugggaauugaacuuggguugucaacguugguggcaagcucucacugggcccuuuugcugcccccccuucuuuuuuuagcuuuuuaagacaggggugggguagggguggggguggggcuggccuccaacuuuauuuggguccucccaccucugugugcuggcugcucagacuccaggcauguaucaguacccuggcuuaaggcuggugagguuagacaucggucuacucugccugugacauaaagcaggcucuccagcagccaacugaagauguuugacuuagcugguccagcacuagccuguucucauccugggugcaggugucauacagaaacagcccaaacuguggagaccuuugccagcauccugaacuuugcggcugugucuuaccuggucccagguguccagaagcaucacaucaccugggcucagguccuccugggugaaguccgugaccuccguaacaaggaagcggccagucuuauuggaacacucaaagagccggaccuggacguccaggguuucuugcugcagccugccguagagucaugcagaaggagagugaugcauaggaaucauguugugugugugugugugcucaugagagugugugugcacguaugcauguguguccauaugagaacagaaauagcuuugggugucuucucccauagcucuguaguguuugagacagcgucucccaggaccuggauuguguccauuugguuagacuaggccaccagcaagucugaaggauccuguugucacccccacucccccgcacagggauuacaggccugcgcugcuguagcugcuuucagucugcgagggauggagcucaggucuuuguguuugcacaaggacuuuguugacuaaccuguguccccagccuggaauguuuaaagcugugagggaaucucaggauuuguagggaccacuggccagaccagccaagaagacagagcugaccgcucacuuaccuuuugucauuagcguaggcuguuuuuccucccagaaggucccagaacucagguggcuccuggcccucagccacaguguccgcauugccaucacagagaaggucgaccagcuccuuagccaucgcccgcucguccccacuagaccccugaauggggugaggagaacacagguguuagaggcacagggcacauugguagggaugccaggcuucugaaacuggggguuggcucugugcugccgugccccaggaugggggauggggggaggacaggacaugcaggcaaaggacaggccugcucugaaacccacagugcgccgacgcagaagccgucucugauuuagccucaccuggauucuagcacacaguuuccucugaugcacaugcacaguaaaggcucugccucuguaacaagcaagcccuguaucccuagcauguaacuuucauuauuuuuguuuuguuuuguuuuuguuuguuuuuuggagacgggauuccucugugaagcacuagcuguccuggaacucaggaugcucucaaacucugagacuccucugccuccugagugcugagauuaaaggugugugucacuaccgcccagcuuuagucuuuuuuuuuuuucuuuuuuuuuuuaagauuuauuuauuguuauauguaaguacacuguagcugucuucagacacaccagaagggggcaucagaucccauuacaggugguugugagccacuaugugguugcugggauuugaacucaggacuuaggaagagcagucagugcucucaaccacugagccauuucuccaaccccuagucuuauuuuuuuuaauuacaguaaaccugacuguuggguuccacaaggcuuaaacagaucucuguucccacagugaaauuucuuuaguccucuucaauuccucucccuuugacgucaagcccugaguccugaacucuugacauaggcuaagcugugcuccauuagaacauuccuggcauuucucaaguggaagcuugucacauccagccugggagaccgucuuucaguucucaggagacucuugucaccuggagacucuguguugugugcaugaguggcccuuccauuuuuagugcugaguaauauuccauugaaggaauauuacuauuuuugaauuucaucuauuuuuccagaucgcaucuaauuugaggggauugugaauaaacauugcuacugcgcacauguguauacaaaucuuuguguaaggaaguuuucguucacuggugcucuuuaaagauuuauuuuacuugcaugaguguuuuauccacauguauguguguguaggugugugcucaaagugugugcagugccucuggaggucaaagagggugucagauccccuggaaugggguuuacaaaugguugugagccaccgugggggaccugaacccaggucuucugcagguggcaucucuguugagccaucucuccagcuccaggauuuuguguauguguacguagaugugcguacauauguguguauguguuuguaugugaguguacaaauguguguguguauguguggguauguuuguguguguauguagauguguguacauaagugcauaugugaguguaccuacgugugugugugcucugggguuacagauaggaguucccauuuucugacuuuuguguuucuggggauugaacuuggguguacuucugcauuacugagggcugaggguggagccagggcagucgugacucccaacugaccaacuaguaggacccagcagcacucucaccuugccguaccacagguagugcucugccugaguccgcagcagaaagacgucguuggaguugagcgaggaagcagaggccgagaccuccacugcuuugguguuggauuugucguucccguggaucuggaagagccuuacuggaggguccggcuccucguuucccuuccuggaagucccgcccugaaaagcagaguucagaccuucagagugcugcgugagcuggcugcuaugaacgucagauggacuguauaccaucuuugucccucaggaucccccuaggcuaacgggagaggaccacgauuuuc

SEQ ID NO: 5774 - RNA, 4763 nt, Mus musculus
gaaaagugcucucgagcagacuccccaaacacagacaugacccaggcagucaagcucgccuccagaguuuuucaccgaauccaccugccucugcagcuggaugccucgcugggcuccagaggcagugagucgguucuccggagcuugucugacaucccugggcccucuacacucagcuuccuggcugaacucuucugcaaaggggggcuguccaggcugcaugaacugcagguaagggggcaguccuugcccuugguaggacugagcagggagagccggcuuuaauggcagaaaggaccacggugaagaacacaggaaggagggucagugaggguggggaccuguggauuaugaagaacucacgcugggaccauagaagguuccacugccccggagucaauaccuaacucccggcaaagggauguacugucgcuucauacacaguaaacccugcagauccaggacaagcgugcugaaggagggagagcgcugugcuauccugcagaugaagcuuaaagcuacgcgcuccucuucuuucacuagaggcuccucuugagguacaguuaggagaagagcccugaaggaacugcucccccuaggcuagagccagauaacuaaaaagaagugcuaaaugucuacuguuuugccauucucucucaaacuuucaugggaugggagaaaaaguuugccauuugggggcccuacgcuagcccggcacugaaaaagcucccuuuucccaagccuagccaacacccuuggcccuggcacaagccaaacgaaauucacccgcccagguauucaaaugcgccgauucucucaggugcauggcgcugcgcgguacgggccaauauggucuggcagcuuugggacacuucgcacaguuuacguugccgacccuacacuuguggagcagcuccugcgacaagaaagucacuguccagagcgcuguaguuucucaucaugggcagagcaccgucgccgccaccagcgugcuugcggauugcuaacggcgugagucgaccccugagcaccuuauuccugccccgacucccacagccaaguugggcuuggagggaggucggaaguuuccaccaaucuucuggcauuuccccgguucuccagucuguacuccaguccgaacgcagguagagccgauuccucaccccucccugcauguuuggggccaaaauccuacgauuccacgagauaggcgagggcaccagcauuuggcuggaacgugagcaucugugauucaguuuaccauggaacccacucccaucccugagcaggaagugaguaaagaggaacggagaugagagauuggugaggucagggugauuucuacacccggagagagcagacauaauacuccuggucacccuagccuucuccacacacgcucacgucccuaaagucccucucugcacccgggcagggauggugaagaauggcagaggcuccgaagucuucuggccccgcuccuccuccggccacaagcagccgcgggcuaugcuggaacucuggacaacgugguccgugaccuugugcgacgacuaaggcgccagcggggacguggcucugggcuacccggccuaguucuggacguggcaggagaguuuuacaaauuuggccuagaaagugaguccuaaagcagaguuaaggaccuguguagauaguucaggguccuagauggcugaugugugacugugcccccuccuggccagguauaggcgcggugcugcugggaucgcgccugggcugccuagaggcugaagucccuccugacacagaaaccuucauacaugcagugggcucaguguuugugucuacacucuugaccauggcgaugcccaacugguugcaccaccuuauaccuggacccugggcccgccucugccgagacugggaucagauguuugccuuugguaaggcccgggggaggggacuggguaucaauacugcacuggagcagugaggcagcgugccuuccuucucagcccagaggcacguggagcugcgagaaggugaagcugcgaugaggaaccagggaaagccugaggaggauaugccgucugggcaucacuuaacccacuuccuuuuucgggaaaaggugucuguccaguccauaguggggaaugugacagagcuacuacuggcuggaguggacacggugagguucucucuauauugcaagugccauuuccagagugcaguguccauguccaucccugucccaccccacacacacacaccuccugugcucacccuacccccuaccccccaucccgagaacucuagggccacuuuucugauucagggaugaagguuuagcuuuaguaauuccuugguccccgaccacucccucccuaugcuaccccccuucacugggguccccaugucuaacagcucagaugaucucaccuguucccucagguauccaauacgcucuccuggacacucuaugagcuuucccggcaccccgauguccagacugcacuccacucugagaucacagcugggacccguggcuccugugcccacccccauggcacugcucugucccagcugccccuguuaaaggcugugaucaaagaaguguugaggugaugggggaaggaaagcaggaaauagauaaaaugcuagcggggagcagaggaagcuggcaguguguggaaggggguggggggagggaggagagaaaacuggcccccuacuccugcauuuggaagcuggagacaaggggacuggaggcgcuguguuccccagccucacccugcugaauccauuuucuguuucaugaccuagauuguacccugugguaccugggaauucccgugucccagacagagacauccguguaggaaacuauguaauuccccaagaugugaguaaaucuuucugcuaagccauuccuuacugcuuugggcacaagucauucucaaacacuccgggagccuuuccagccccccucccccagcauaaugggaguaguagagggagguccuuaccaacaaccaaggcccacuuuuaaacuggucugcagauccucuucuucacauuccccacccugcugcauucuugggcucagacugaaaacuccgaucccucugcgaggagggguaagguguugagauagagucuugcuauacagcccaggcuggccuugaacucucucucuuccugcuucaguuuucugagggcuggaacugcaaguguggacaugaaacucagcuacugaacugacaagucugucuuucuuucccaccagacgcuagucucccuaugucacuaugccacuucaagggaccccacacaguuuccagaccccaacucuuuuaauccagcucgcuggcugggggaggguccgaccccccacccauuugcaucucuucccuucggcuuuggcaaacggagcugcaucgggagacgcuuggcagagcuugagcuacaaauggcuuugucccaggugagugaucuagaacuuauaccguuuccugucuggaaaggcccaauaaacgugggugaucuugaccucugacaaacauaacaaaacauauaagacucagcagauagacccacugacagucccacguaggucuggaacaucaacaaagauauuuggacuaucauuuucccucccacaacccccugcccucacugaccaagaagucccuuaguggccucagaugccauuccaacaguggccacucuaauguucuuuaccaauuaagguaccauuuuagacccacccacagugacaaccuucuuccccucccccguuuccagaucuugacccauuuugaagugcuaccugagccaggugcucuuccuaucaagcccaugacccggacuguccuggucccugagaggagcaucaaucuacaguuuguagauagauaaccauucggaagacagccaacaucgucucucucaagacaggauggggucuuuguuauacacaagaggcacacucuccuuggaggccugucugaccgagcaaacuccaggaagcagguccugaccuauguguacuuggccugacucagcaggcaucgcagaaccaccaucuuucuccuuccugcucagugccucuccugaucauuccucaggauccaaugccuucagauuuuaacacauccuuaaagugccaacgcagggguuaacuaccaacuccaggcagccuggggagggauucgccccugauccuguaguguucguugaugcucugucuaagcauuuaucacggcacaagcuaagugauugcaucuggucugcaccuggcugcaucucuaccugaccaugugugccuucugagaagaguaaugacuagucuacugggcuuuuagcucuuuuucuuuuugagacagagucuugcuauguauuccaugcuguccuugaacucacaaccuccuugccucaccuucccaaguauuggguuacagacuugagcuaccacuuccagcuguaucagucuuucuaucuccugccagagucuaucccuggcuauucagcaccauacauucucagacugaaccuggaccauguggcaggaucguccacucaccaggcucugcccacccuuuucucucuuaaucuuuccucuagggaaguaaaucugcccuugccuaauuuacagcguuuuuaagccuccgcuaccuugguucuucagccacucucaaguggauccacuucuuaucauccaucuuuuggccugccccuccuccagccugucuuuuuuauauuaaaaauuuuauauauauuac

SEQ ID NO: 5775 - RNA, 5355 nt, Mus musculus
cccuggggacaccugcucgugcugggcagggcggggaugcgcagccgcggccccuucuccuccgcucccccuccccgccccaccccucccuccaucccucaccggcuccccggcucccgccccgcccgcccgccgcuccgggggggucuccgccgccgccgccgccggaaggagccgccauuugcuaccgccgaacgcacgggccgaaccgagccggauccggcagucggagcgggacuggggccgagaggacgacgauggggggcggccccgccgcaggaggaccggggcgcauaagccccggugcccggccggcuccggaccccgacccgcggggcgcggcacccugagcccccuccccgcccccugccccugcuccugcucgggccaugccugcccacccugccguccgcgggcugacggcccucucggccccgcgagcccuggugccccggcggcggcagcagugaacagcgcuugcaggccgcggagaccccggcccgguccugcgcuccggcgcgcgcccccuucccggccugcuccucgccccuccccccgccgcucgggagccccccucgcucgccgccccccgccccccggcgcccggacgaugcucaagucucggcuccgcauguuccugaacgagcugaagcugcuggugcugacgggcggggggcggccccgggccgagccgcagccccgggggggcgggggaggcggcugcggcugggcgcccuucgccggcugcuccgcccgggacggggacggcgacgaggaggaguacuacgggucggagccgcgggcccggggccuggccggcgacaaggaaccgcgggccggacccccgccgccgcccgcgccgccgccgccgcccccaggcgcgcuggacgcucugucgcucagcagcagccuggacagugggcuccgaaccccccagugcaggaucugcuuccaaggcccggagcaggucaggcccgagcaccuggcugggcggggagggugggggcgcguaccugggguguccgcggagaccggggcagggggcggggccagggggagcugggcgggacccaggacccgaguggaaguggggugagguuggccuggcuggagacuccuggagugugucaagguuggggccggguggguggggggucaggggcucccagucgagguaggguuauucuccucggagggcucagagucucugucacccgauaucagacagcucuuagcaccugcuccccucaccuuaggguagccauuagccgagggaaccuauuuuuuggaagugggcagaaaggagaguacauuuguucucaccuugaggggaggggccaggcaggacccugcuccucucaguauuucucccgaugaggcaguuuuugcucccgucuugcaacuuauccacuucauucuaaagagccuucuuuguuuaauuuuauggguaaaguugucccgggauagugccagcgggcaucucugugcagcgagaaaugacugucugacuaaaggggaccauguuccacuccugcucccagagugucuccccauuuuagcguggacaccacgauugguuagccaucccagcuggcaccagaucuauauacuggaaguacuguggaguggaugaagggaugccuagcucagcagcccagccucucuccucccuccagguccuaggcagaggucagcucuuuaggaugucuuaaucaccuuuccgauuucuaggaaaagggaagacucaggcuucccucucccucucgucucaccuuugaucccuucgguuggagaaguuuuucuugagcugugacuucuuacuuuugugcuguagccuuagcaucuugcccuacucuggguggaaagcccuaguuuuuaaguguaauaguaugacugacccgaggaagagguuuccucuccaggagugcugcagaagggguccguccgggugaugacugcugacaggcgcccuccccucucuuccuccagggggagcuccugagcccuugccgcugugacggcucagugcguugcacacaccaacccugccuaauccgcuggaucagugagaggggcucauggagcugugagcuuugcuacuucaaguaccagguccuggcgaucagcaccaagaauccacugcaggugagguguagggagcucucuggaccagaaccuugcagggaaccuauuuuaucuuauuuaguguuuucccaaagcaaccgcccuccaccauuauggcuuuccaagacacauguucuagacacuuagaacaagggggaguguggaaagacaguguuagugguaauaguaaauacacucuguuuucugugugucauuuguuguguguucauaaugaucuuauuagauaccauuaccaugccugucuuuaguaacaggauacagacacauguagagauuaaauacuugucuacacuacucaauaauuaauguagacauuggaguuaagauuggaguuccagucuggguguuugacuuuuccgaucccgccuuucuuggauaagcuaggcaaguggacacuucucucuccccuguaccuguucugcuuaggaucacccauagaaccacaucuuaggcuagaucagggcacagagaaggcagcagauuccaaguugccgcuugaagaguuuagggggugccccugguguccucucucuagggcugcccgucaccccucugucuaacccaaugacuuuuucaagcguuuucucccaaacaguggcaggccaucucccugaccgucaucgagaagguccagauugcugcuaucguccugggaucgcuguuccucgucgccagcaucuccuggcucaucugguccucgcucagcccuucagccaaguggcagcgccaggaccuccucuuccagauuugcuauggcauguacggcuucauggaugucgucugcauaggugaggacgcacgcgucucucccccgcgcuggcuuagcgucuuccuuuucucagucccuuagcuucccuggccauccauucagcgucauggccauaauuccaccaccaugcagaacuguuagggcuagccuggggcccuggucuuuguagcucugucuucucagucugcagaaaucaaugcuaugugcgggcagcgguucacccuguagccccggcuguccugaaacucacuguguagaccaugcuggccuugaacucagagauccgccagccucugccuccccaguguugggauuaaaggcgugugcuaccaugcccggcuucacccugguuuucuuuuuuuuuuuuuuuuuuggagacaggguuucucuguauagcucuggcuguccuggaacucacucuguagaccaggcuggccuugaacucagaaauccgccugccucugccucccgagugcugggauuaaaggcgugcgccaccacgcccagcuucacccugguuuucucauccauuugcuuaggccucaucguccacgaagggucuucuguuuaccgcaucuucaagcgcuggcaggccgugaaccagcaguggaaaguccugaacuaugacaagaccaaggacgugggaggagacacagggggaggggcggcagggaagccaggccccaggaccucacggaccagccccccugcaggggcccccacccggcccccagcagcccagcgcaugcgcaugcggacgcucuugccucagcgcugugguuauacgauccugcaucuccucggacagcugcgaccaccagaugcccguuccagcucucauucuggucgagagguugucaugagggucaccacagucugaccuggacuccaggaacagggaucuuaagucaaugcaucagccagaggcgagcccucccggcugcuggagguacgaccuagacaacguguuuggggcacggugaccccaccacugaggaucucuguggacagccgccagcuuggagacauuguccggccuacugcccacaggguagagaccccugggugacguuccaguucccacagacaccgccucauacucaccuugaggauggccagcaggcaagcggggagaaccacuuuucuuccuggagagaaccaucuuuaccucagcuuuaagccuccaguccccuggcuccaccauggugacuugguaaagggagaccaaugccagaaaacaaggggcuguagacaccccccacuccccaccccauggccacagggcaucuggcaauaagacuacuaaacauugaccucccguucccugcaugaggcgggggacuucccccugcuccgccccccacugcaugggggaagggcauaaagaaucauuuauaugcgcguggggccuccuuucucaucuggggcucuucugcagggauggaggguaugggggggggcuccucagcacggguuggguugcacuucccagaggugcguauggaguuggaagagggaccccucccgccccccugcuugcuggugagugacucaccuuggcugcuaggugucagugcucagagguagcugaggacggggugugggcuugucaccugugaguuuuaugauuuagaaaagaaaaaucugagcuuuuuucuuccugucuaccucacagacucgaggauaaaugggagacagguugaauacuaugacagagaaaacugacggguguauaaaggguuccggacuaguugccaccaauuacuuuagacaguaggugauagagcaaguucugaaaugugguuucugucagaagcggcacagaacuuugguguuuuugagagacaaaguagagaagcaaaagaggaagucgauacugcaacuguguaggacaguggccguuguaggaucgagaacccuucugacccuccaaacaccggaccugggguggaggggcagcugggacugcacagccugucugagaacagcccuuuccuucagguacuguguucccccagaggaauggugggagaccaacauggacucaauuagggugauggggacagagccuccucccucaguguuaugacuuuaaccccaauugagacauuuucuguggcaguuuaggaucacagguuugauccaggugugcccggcuaaugguauuacugagagagagaggcguaagaacucuuauuuauuauagaaaggauuuggggaaugugggucuaagggcuggggguguggguuaguggugugcaugugguccuggggcuaacuccccuaccaccaaaagaacuaugugggucagcuugaagcuugauucccuuccuccugaagccaggagggaggcuggguguuaauaugaaugacggugucuuuuuuuuaagugaaccauucaugagcaauuaaaaaauuccuucauacauugcuaaagucag

SEQ ID NO: 5776 - RNA, 3864 nt, Mus musculus
agaacguccggcgcccgccccgccccccggguuuccgcgcgccucucuggcagcuggucacauggugagggugggggugagggggccucucuagcucgcggccugugucuauggucuggcccgaagcguccagcugcccgggaccgauccccgguguauggcgccgcaggaaccggcucccgggcccagauaaagggccaccuccagagcucuuagccgagcguaaggugagugcagucucauccaggaucgggggaccaguccccgccaccaccagcacccuccagcuccccacgcgugcgcgucgcuggcugauuauggaagguggcccaauggcgggaaguggggccuuuguggucgcgggcaagggugugauuuuggagagugaagugcagaaucuucggugcaaacccugugcacugugugauccucuuugugccuagugcgauguccuccgaaaggaaagaaagcauucuuuuucuuccuccgggacaaaacguggccggaggaggaggguuugaugggagucuuuguguuaccuaaggcgcgggcccuggaaguguggaggggugggauguugcugaucgcguuggcgaggucuugugcaggaguuccuuuguuaccgccgggucaucccccuccuaaccgugagagugaguuugguauuagaagccucugugauuguagauccccugcuucgagaauggcugccacucgauaugaacccguggcugaaauuggugucggugccuaugggacgguguacaaagcccgagauccccacaguggccacuuuguggcccucaagagugugagaguuccuaauggaggagcagcuggagggggccuucccgucagcacaguucgugagguggccuuguuaaggaggcuggaggccuuugaacaucccaauguuguacggugagaagguuggauugggaguggggcggagaggacaauaggacccguaaggcaggagugggacccuagaacgccagaggccacguugagacaaaggggacgacuagcuggugaucauuuguucuucucaggcugauggaugucugugcuacuucccgaacugaucgggacaucaaggucacccuaguguuugagcauauagaccaggaccugaggacauaccuggacaaagcaccuccaccgggccugccgguugagaccauuaaggugaguagggguggggcugggggcgaggguggaccgaucuuugcaauagaaguuguugggauuuugaagugauacauaguuuccgguguucugugcuuucuucuugaaaaacaggaucuaaugcgucaguuucuaagcggccuggauuuucuucaugcaaacugcauuguucaccgggaccugaagccagagaacauucuagugacaaguaaugggaccgucaagcuggcugacuuuggccuagcuagaaucuacagcuaccagauggcccucacgccuguggucaguaaaaggcguuagccgacuagguugugauagggguagcucuuggugguuucccauagcaacugaggagucuuguacaugaaguuuucagagccaggcaggucugguucgugaggucgacacucacucauuucuacuauucucuucaggugguuacgcucugguaccgagcuccugaaguucuucugcagucuacauacgcaacacccguggacauguggagcguuggcuguaucuuugcagagauguuccgucggaaguaugggacuagaaacuuuuuguuguuaaugguacaggguuaguccuggccguagaucagguuggccuugaacucacagagcccugggauuaaaggcaugcguuaccaccgcccguaugggacuugaagcucuuaaccuaccuucaguugcacauagcuuuggcugcuugucuuacugugcuagagguugaaaucagaacucacacacacucaguaaaugcuuccgugccacugaacuucacacuccgucggcccccaagucuuuuacagacaugccuguucuugaccauucgcuuuugugcauguaugguacgggacauccagccuacccaguucauacugaccaccuugccuagaaccaagaaaccauauaggcaugcccuggauuuaggaucuucccguuccucgucuccacacucucuaguugggucuacauaacgguuacuccucaauuuuuuuuuucuuuuaaaaauguauuuauuuccauguaugugaguacacucacugucuucagacacaccagaaaaggacuucagauuacauuacagaugguugugaaccaccgugugguugcugggaauugaacucaggaccuccggaagagcagucuuaucugcugagccgucucuccagcccccacuccccuauuuuugauauaacacauacuuugagucuuuuucugccuuaggccucucuucuguggaaacucugaagccgaccaguuggggaaaaucuuugaguaaguauuugauaaggaaaaggaaagacauuuccugcugccgcggagacaggagcugggaaaggccccuccuaacagaguuguccuguccccacagucucauuggauugccuccagaagacgacuggccucgagagguaucucuaccucgaggagccuuugcccccagagggccucggccagugcagucaguggugccagagauggaggagucuggagcgcagcugcuacugguacuggaccugggcggggauuggguuaagauaagaaauaccguggccuggggaacuggcucaguggguagaguuccuuugcauaagugugaggaccugaguucaaauccccagaacucauauagaaguugugugcuucuauggugcuacuccuuuuuuauuuauuuauuuauuuuuaaagauuuauuuauuuuauguaugugaguacacuguagcuaucuucagacacaaccagaagagggcaucagaucccauuacagaugguuguaagccaccaugugguugcugggaauugacucaggagcucuggaauaguggucagugcucuuagcugcugagccaucucuccaguccuguagugccacucggggcgagauggacagaucccugguaauacagcgcugacagagucuccaaugagauggaaggcaaggacuggcagcccagacucuugaccucugcauguauacacgcacaugugcgugcccgcauuucacacaugagcacgugcacgcagagaugaaacagacgggcccagaccagccugaagcuaagauguagcugugggcaggcuguaguugucacugcuguugggaauggccagccagagugggacaaaggaaacagccauguugggugggcaucagcaucggcuccugagcuguuuucugaccuuuguccucucccuuuaggaaaugcugaccuuuaacccacauaagcgaaucucugccuuccgagcccugcagcacuccuaccugcacaaggaggaaagcgacgcagagugagaagaggggcugccuuucccagucuugguggagaaacccucgcugaagcggcagccucuguuuccccccaaggcuguggagaauccuccaguuuuuuacagagaauauuuuaagccuuaaauaacaaguccccaccucuccuuacgagguucacccccauuacccuccccuagcucuacacuaaagggcagguguaucugucuucuucccucccugauuuauacugggaucuuuuuuauacaggaaaacaagacaagacaaagaguauggucuuuauuuuucuuuaauguuuuuuccaauuggcuuugccacugggagacuuggggaaaacaaaacaaacaaacaaaaaaaaaacacgaaaacaaguucccugca

SEQ ID NO: 5777 - RNA, 3409 nt, Mus musculus
uuuaggaaaugcugaccuuuaacccacauaagcgaaucucugccuuccgagcccugcagcacuccuaccugcacaaggaggaaagcgacgcagagugagaagaggggcugccuuucccagucuugguggagaaacccucgcugaagcggcagccucuguuuccccccaaggcuguggagaauccuccaguuuuuuacagagaauauuuuaagccuuaaauaacaaguccccaccucuccuuacgagguucacccccauuacccuccccuagcucuacacuaaagggcagguguaucugucuucuucccucccugauuuauacugggaucuuuuuuauacaggaaaacaagacaagacaaagaguauggucuuuauuuuucuuuaauguuuuuuccaauuggcuuugccacugggagacuuggggaaaacaaaacaaacaaacaaaaaaaaaacacgaaaacaaguucccugcaaggaccuaggcaggcaguccagcucuuuggcuggcaagaucagagagaaaugcuuucuuugaauauucggucaaaauggcuuuaguuucuaaguucacugguccugcuuugaugagacuguagguggggcugggaaugacaacugauugguagaaaugcuugccgagcacuugugaggcccuggguuauaacugguuuucucuugguguucugacucuguccuugaagccaagggucuuggggggggggugcaguuacccuccuagggcccgaggccuaccuccccucauccauaaucguguucccaucaaaacagacauaaguccaaccaccaguucuugggggugagguaagggaccucuuuucucuaaaacaaaaccauagggccaccccuagguguuuguaaagauggcaaggccaggcaguggugguguacgccuuuaaucccagcacuugggaggcagaggcagguggauuucugaguuugaggccagccuaguuuacacaguuccaggacagccagggccauacagagaaacccugucucaaaaaacaaaaaaauggcaaagccaagucagaaggauccaggggcuggcugaguguggugaugccagcaggaggcugaggcaggagggucuggaauucaaggucuuccuuggauacagagcuagcuagaaacagccuaggcugcagagaugcuaucugggaggucaaaagucucauaggaaggcacugggguuggcucgaggguccuuuugauuccggaaucucauugcuagccaaacaccaaggaucuacgggagaggaagagagaaagguuauuucuggaccaugggguugaaggcuugaguguguacaugaggagucauuaccucugugaaacuaaagaagagcccaacaccuccuaggaucuugagggcuuugucugaauguuuaaggaaccucuccccacacaucuggcauguagagcucuuaguuuugcacaccugguaacagacauauauagagaauucaaaguugcucaccugcccuguccaaaaagcuguagugaaugucccaggaaugacuaauccuucaucuuaccgcacuacaggaaguaucaucuuguaggcgcaggguuguaagguugaacaagccacagcagucaaaacuucucuccaguucaugccggguacuguugcucaagaccgaccacgaagcauugaugacaucugccuagagagcacacaggcauuaacauucguuagaacauuauuagacauuagucuccucacauacccuucgguucaggagucuccauuucccugcuuuagcaaggaaaaccccacagagaccgcagcgugaucauugguaaugugaggugucucagggucucucugcaucuuggggaauuaaccauaugugucagggagcacacaucuguggaagcagugggucugagcaaggaugagaugaaggggucagauaaaaguggagaaagcaagcaaguacaugaaagggcuuacccuuaccuguguguuucuguuaauagccagacaugagcaagagauuccaaacuggaagaugaagaccaaaccuaggaugaucauauacugagaagaaguuagggcaaaaagaccuguuuuccauuuaaaauaccucauucagggagacagacagacaaagcugugugguagccagccuagugugagcuccaagcuaggacuacauagcauaggcccaguuucugucuuuaaaaucucaccacuguaauucuaacugcgauguggcaggcaagggggcagaguucaaggcccuucucuguucacaaacugcacuuuuuaucaaguugggggaaaaccgucaacuuguguggguuacagaguaagaacaaagagacguguuugagguccccugguccccuucccaggaaaagcccgcucaggccccaaucacuaaggccaggauacaaagaagagcagcacuugauggugguucgcggcgcccaccaguccugccaccgcgaugaggagaaggaagacucccacagcaaugacuccuccaaugaugugaaugcuagacaccacaccgaggcccuugccccaggcagccacgccaaugagcaaaaagcccacaagcugcaagaaauagaaagaauacacuuuauucagccugaugugguggcucauaccugcaaccgcagcacagcgaaguuccagguuagucugugcuagcuagcucgcuauacagugagacccggucaucgccaaagauuucuagcaaugcagcacagcccaaggcuauauuacaaggggacguggacuugacaagcuaagcgcuugaggugugcagucaguacuguucaucucuaagcgcacuucccaagcaacugggaaugacugagagagaguagggcaggguaaguagguaccuaacacacaaauggaagccuuggcguugucuaguaacucuaguuugggaagaaacuggagcagaaagugaagacuggaacuauaggcccucagucuccaauccaccccugcccaccaccaaacaagcccccucaucaccggaagucuaucuauccucuuccacggaaguacccaggaauucccucuucgccggaaguuucugggaagcuucccagaacccccaguacaccccucuccacgccggaaguccccuagaaacucccccauucuuuccgccccggagauuuauccauuuccaaaaccucaccauauaaaccacguugagagcgcacagcgcauuccuggaacaggcaaauccgccgcaaaccaucuccccagaucuggggacccaaauggucccaagacuuguggggaggguaucgaggaccgucuuguaggacucccaaccgcgucuaucgcuuuaaauccaagccacccaaaccaauucucugcgccugcaccgucccaccccugcuucuggauugg

SEQ ID NO: 5778 - RNA, 3409 nt, Mus musculus
ccaauccagaagcaggggugggacggugcaggcgcagagaauugguuuggguggcuuggauuuaaagcgauagacgcgguugggaguccuacaagacgguccucgauacccuccccacaagucuugggaccauuuggguccccagaucuggggagaugguuugcggcggauuugccuguuccaggaaugcgcugugcgcucucaacgugguuuauauggugagguuuuggaaauggauaaaucuccggggcggaaagaaugggggaguuucuaggggacuuccggcguggagagggguguacuggggguucugggaagcuucccagaaacuuccggcgaagagggaauuccuggguacuuccguggaagaggauagauagacuuccggugaugagggggcuuguuugguggugggcagggguggauuggagacugagggccuauaguuccagucuucacuuucugcuccaguuucuucccaaacuagaguuacuagacaacgccaaggcuuccauuuguguguuagguaccuacuuacccugcccuacucucucucagucauucccaguugcuugggaagugcgcuuagagaugaacaguacugacugcacaccucaagcgcuuagcuugucaaguccacguccccuuguaauauagccuugggcugugcugcauugcuagaaaucuuuggcgaugaccgggucucacuguauagcgagcuagcuagcacagacuaaccuggaacuucgcugugcugcgguugcagguaugagccaccacaucaggcugaauaaaguguauucuuucuauuucuugcagcuugugggcuuuuugcucauuggcguggcugccuggggcaagggccucgguguggugucuagcauucacaucauuggaggagucauugcugugggagucuuccuucuccucaucgcgguggcaggacuggugggcgccgcgaaccaccaucaagugcugcucuucuuuguauccuggccuuagugauuggggccugagcgggcuuuuccugggaaggggaccaggggaccucaaacacgucucuuuguucuuacucuguaacccacacaaguugacgguuuucccccaacuugauaaaaagugcaguuugugaacagagaagggccuugaacucugcccccuugccugccacaucgcaguuagaauuacaguggugagauuuuaaagacagaaacugggccuaugcuauguaguccuagcuuggagcucacacuaggcuggcuaccacacagcuuugucugucugucucccugaaugagguauuuuaaauggaaaacaggucuuuuugcccuaacuucuucucaguauaugaucauccuagguuuggucuucaucuuccaguuuggaaucucuugcucaugucuggcuauuaacagaaacacacagguaaggguaagcccuuucauguacuugcuugcuuucuccacuuuuaucugaccccuucaucucauccuugcucagacccacugcuuccacagaugugugcucccugacacauaugguuaauuccccaagaugcagagagacccugagacaccucacauuaccaaugaucacgcugcggucucugugggguuuuccuugcuaaagcagggaaauggagacuccugaaccgaaggguaugugaggagacuaaugucuaauaauguucuaacgaauguuaaugccugugugcucucuaggcagaugucaucaaugcuucguggucggucuugagcaacaguacccggcaugaacuggagagaaguuuugacugcuguggcuuguucaaccuuacaacccugcgccuacaagaugauacuuccuguagugcgguaagaugaaggauuagucauuccugggacauucacuacagcuuuuuggacagggcaggugagcaacuuugaauucucuauauaugucuguuaccaggugugcaaaacuaagagcucuacaugccagauguguggggagagguuccuuaaacauucagacaaagcccucaagauccuaggagguguugggcucuucuuuaguuucacagagguaaugacuccucauguacacacucaagccuucaaccccaugguccagaaauaaccuuucucucuuccucucccguagauccuugguguuuggcuagcaaugagauuccggaaucaaaaggacccucgagccaaccccagugccuuccuaugagacuuuugaccucccagauagcaucucugcagccuaggcuguuucuagcuagcucuguauccaaggaagaccuugaauuccagacccuccugccucagccuccugcuggcaucaccacacucagccagccccuggauccuucugacuuggcuuugccauuuuuuuguuuuuugagacaggguuucucuguauggcccuggcuguccuggaacuguguaaacuaggcuggccucaaacucagaaauccaccugccucugccucccaagugcugggauuaaaggcguacaccaccacugccuggccuugccaucuuuacaaacaccuagggguggcccuaugguuuuguuuuagagaaaagaggucccuuaccucacccccaagaacuggugguuggacuuaugucuguuuugaugggaacacgauuauggaugaggggagguaggccucgggcccuaggaggguaacugcaccccccccccaagacccuuggcuucaaggacagagucagaacaccaagagaaaaccaguuauaacccagggccucacaagugcucggcaagcauuucuaccaaucaguugucauucccagccccaccuacagucucaucaaagcaggaccagugaacuuagaaacuaaagccauuuugaccgaauauucaaagaaagcauuucucucugaucuugccagccaaagagcuggacugccugccuagguccuugcagggaacuuguuuucguguuuuuuuuuuguuuguuuguuuuguuuuccccaagucucccaguggcaaagccaauuggaaaaaacauuaaagaaaaauaaagaccauacucuuugucuugucuuguuuuccuguauaaaaaagaucccaguauaaaucagggagggaagaagacagauacaccugcccuuuaguguagagcuaggggaggguaaugggggugaaccucguaaggagagguggggacuuguuauuuaaggcuuaaaauauucucuguaaaaaacuggaggauucuccacagccuuggggggaaacagaggcugccgcuucagcgaggguuucuccaccaagacugggaaaggcagccccucuucucacucugcgucgcuuuccuccuugugcagguaggagugcugcagggcucggaaggcagagauucgcuuauguggguuaaaggucagcauuuccuaaa

SEQ ID NO: 5779 - RNA, 1149 nt, Mus musculus
cguugagagcgcacagcgcauuccuggaacaggcaaauccgccgcaaaccaucuccccagaucuggggacccaaauggucccaagacuuguggggaggguaucgaggaccgucuuguaggacucccaaccgcgucuaucgcuuuaaauccaagccacccaaaccaauucucugcgccugcaccgucccaccccugcuucuggauuggugaaacucguggcuaauccaagacauccaggacuucaaugccaaucaaucugcauuacgucaccagccugccucccagucuugcccuuaguuucuucauuggaggaaacuuaaaaaaaaaaaaaaaagaagaagaagaagaggaaggcgaaagaaagaaagaaaccgaggccaggguuucuagacagugucuuagagaccagaagcuaacuaaaaaaaaaaaaaaaaaaucuuggauuccugaguacggaauuucgagacuaggaacccgaggagauacucaggagacucaggugaacagaaaaaagggguuucguagaggugagaggaaggggcucugcaccucuaaagguaacccuuuuccgccgauuucccguguuucccgaugaucucacguuggugccaucguuucacuguuauacucuggaacagucauacucuggaacagcacgaggagccaaaugcacuaugaagcccagcuagagaggauccaagucgggcguagcauuagcgggcaaauccucacgcauuuguuaacuguguuugcuaguacucacguuccguucugcaucccuuucccugcaguguggacacgccagaaauucagguggaaacagugacuugaggccggcgcauuccuguucgugacaaaaccacaggcacagacgcuggugugcucuacaucuuuagaacacaaacgugcuggaucaggcuuggcacaugacgcaaagugggggcgagucuggaauaugaauaaauaagagccuccauacugucucuuuuuaaauuuuuauuuuuauuuuaugugcauuggcggguuugccugcauguaugucugugugaggaugucguaucccaggaaauguaguguaccccaggaaauguaguugcaaacaguuguaagcugccaugugguugcugggaauugaacccagguccucug

SEQ ID NO: 5780 - RNA, 1149 nt, Mus musculus
cagaggaccuggguucaauucccagcaaccacauggcagcuuacaacuguuugcaacuacauuuccugggguacacuacauuuccugggauacgacauccucacacagacauacaugcaggcaaacccgccaaugcacauaaaauaaaaauaaaaauuuaaaaagagacaguauggaggcucuuauuuauucauauuccagacucgcccccacuuugcgucaugugccaagccugauccagcacguuuguguucuaaagauguagagcacaccagcgucugugccugugguuuugucacgaacaggaaugcgccggccucaagucacuguuuccaccugaauuucuggcguguccacacugcagggaaagggaugcagaacggaacgugaguacuagcaaacacaguuaacaaaugcgugaggauuugcccgcuaaugcuacgcccgacuuggauccucucuagcugggcuucauagugcauuuggcuccucgugcuguuccagaguaugacuguuccagaguauaacagugaaacgauggcaccaacgugagaucaucgggaaacacgggaaaucggcggaaaaggguuaccuuuagaggugcagagccccuuccucucaccucuacgaaaccccuuuuuucuguucaccugagucuccugaguaucuccucggguuccuagucucgaaauuccguacucaggaauccaagauuuuuuuuuuuuuuuuuuaguuagcuucuggucucuaagacacugucuagaaacccuggccucgguuucuuucuuucuuucgccuuccucuucuucuucuucuuuuuuuuuuuuuuuuaaguuuccuccaaugaagaaacuaagggcaagacugggaggcaggcuggugacguaaugcagauugauuggcauugaaguccuggaugucuuggauuagccacgaguuucaccaauccagaagcaggggugggacggugcaggcgcagagaauugguuuggguggcuuggauuuaaagcgauagacgcgguugggaguccuacaagacgguccucgauacccuccccacaagucuugggaccauuuggguccccagaucuggggagaugguuugcggcggauuugccuguuccaggaaugcgcugugcgcucucaacg

SEQ ID NO: 5781 - RNA, 25513 nt, Mus musculus
guuuggggcggaagggacaucucuagcagagacggagcggaagauggcggcggaggugcugcuguccagucuguugggauugcuauuucuagggcuccuguuaccugcgcgucugacgggcggugucgggagccugaauuuggaggagcugagugagaugcguuauggcauccagaucuugccguugccugucaugggagggcagguaagggguguggggcgaggugaggguccugugcaagaggaaggggcgcacgguggaggaggaagggcaacugcgcaccgggcucgggagaaugggggaauggagaagggauggugguguuccugcgguccugcugggaauggcaggcagacccauccucggagaccaggcaccgacagggguagggcuccccacuguagaccuuaguuccccaggucguagugaaaucacugggaccccgccggguggggaagcgagaacgcccucuccuccgcucagccggggcagcuggaggacuuguggcuuauucucucuuccacugggcacguccccagggucugaagagggaucucguuguucuuggucccagccucugccucccugccccucuucccgacccuucuuucccagagccaagcuucagacguggugguugugucuucaaaguacaaacagcgcuaugagugccgccuaccagcuggagcuauucacuuccaacgugaaagagaggaggagacgccugcuuaccaggggcccgggaucccugaauuguugagcccaaugagagaugccccuuguuugcugaaggugaaaggaacuggggugggcggagggaaggcuugggaaccggaauggaggccagugggaguuaaagggccauugguguacuagauauguuugggggggggggagcgugggggguggggugggggcgugcaaagcaaagacucugcugaauguagggaaagguuaagauagaagaucucaaaauagguuaaaccaacaucagaaggacgguggugggaccagaagagcuggagccuaccuguaaagucaccuccugcuccuauugcucauuaccucaggaugccauuguauuccacgaaguucagugaauacuugaaccugugggaguccucauccaagugcuucaaggauaccaugauuucuuaucuuuauggagggcagggaaugauuuaugccugugaucccaggugggucacagagcaucauagcccugucugagaagaaagaagaaagaagaagaaagaagagaagaagaaaagaagaagaaagggcauggguggggaucaguuauacuuuagaugugcgucuccagccacgaaaagaaaacagcugucccuucucacagagucgagaaugcgggaggggagagaaaaagggaggugagaacuaaaugacagguuauauaucucggagccaggagacugugguuucacaaggagaucauuuucuugccuccugauuguuccuuuuuccacuaucagaccaaggacugguggacauaugaauucuguuauggacgucauauccagcaguaccauauggaaggugaaucgcuccuacacucccccuaagccuucaugacccugugugguugguaaccuucccucccaguccucccuucuaggccucaucaugagaauagugggcuuuacugugguuucccuuacagacucggagaucaaaggugacguccucuaucuuggccacuaccaguccuccuucaacugggacgacgaaacagccaaggugacuggggugugggguuggauuggggaccggcugagcggcagauagagggcccaggcaacagggagggucacauugagcuggugugccucuugggguuugguacccaucaagccuccugggcucuguucugugaucccccggucccugcgggaguguguucccuuucucacgcccucuccaccccgccucauguuuucuccaggcuuccaagcagcaucggcugaaacgcuaccacagccagaccuacggcaacggguccaaaugugaucucaacgggaagccccgagaagcugaaguucggguaagucuuccaggaaagaaaagggucccugaauaacaguagucugccugcuaagggaggagaaugcuuaugcccuggagucagaggaucucuuagguguccagcccagucucagcugcaucuucagagguaauuuaacucuucguuuaccacaggcuacccucaguacuucuagccacauuuaaccuuuccagcaucuccucuccuucccccgcuaccuaagcuguaaacguuagcgccugccuuugacucuucuugcucuggguguagcagggagacauuggucuugacucuuccggcagaacggggagugaacaggaagcuccugcguguagggaaggccugagguagaggggaagacagacgcuaaagugagaagcgagucugaaagaagccacaggccagugguucucaaccugugggucgcgacccccccacaaggcccauacaucagauacccugaauaucagauaguuacauuaugauucguaacaguagcaagauuucagcuagaaaauuaucucauggcugggagcgguggugggggucaccacaacaggaaggacuguguuaaagggucacagccuugaaucauagcuaaggagugagaaugagaaggagggagagagggcuaguucucucaaagcacggcuauccuccuaauggccuuuuaaaacucuucagucgggcaaugguggugcacgccuuugaucccagcacuugggaggcagaggcaaggcaggcagauuucugaguuugaggccagccuggucuacagagugaguuccaggauagccagggcugcacagagaaauccugucucaaaaaccaaaaccaaaacaaaacacucccuuuagggcuggcaguggccaugcaagccuuaaauccuagcacuugggaagcagagacagguggaucucugugaguuuaaaggcagccugguuggucuuccaaguggguuccagggcagccccccaaaaccaaaagccucucuucaguuggguauggcaguacuuaccuguaaucucaguaaguuugggaggcagagaugagccuaaggcuauugcgaacuacaggaaaacaaacaaaagaaaacccuaguuugucccguggcugggucucugaauucucaguagccuccucacaggugguccuccuuagucuccugggucauagcugagugcaggcaggugcaugcagaaagcguccccaucuacaccaucguaggcaccgauagagagcuaccuacagccccagcagccguggcacccaccagcacuagcgguaugcaaaacagauucccacagccaauugcgcaguagcaucgaacacuccauuucaagagggggaagacgcuuaccauguuagcacucaucuguugugcuaauacuucauccaugcccaagccaggccgucgguaugaugccugucagccaucuuacagcgcugccaaaacuuugccggucaggucaguccuugacaggggugugaacuagcucuguugugccacucccugccccuuccgucugguccuggaaaccaucugacauuucggcuuuaucagugacugucuuggagcucacccuguagaccaggcugcccuuaacucacagagauccacccgccucugccuccugaguacugggauuagagggagacaccaccauuaccuggcuuaauuuuaauuuuuaaaaaacuuuuauauaaaauaguggguuucauuauagcauuuuaaaaauauuuaaagaagaaacuauuuuaaagcuuucuaaaaaacauuuaggggugugugugugugugucuugccuggaugaguuuuugugcaccauguguauggguacccuuagaaggcagaggagucagauuuuuugcaacuagagguacaggcaguugugagcuggaaccgaaccugggucuucagcaagagcaguaugugcucuuaacugucgagcccugaccaccucuccagcuccucgugacauuucacacguguguauagcuuugugauuugcuuacgcccucucucugccuacguuguauuuauauucugaagguaaaaccaauaagauguguuguuguguuggacauggggcacaguuaagaugaucacggccauuuuagcuccagcggcugaaaguggcaggauuguggauuugaggccagccuggucuacagagugaguuccaggaccgccagggcuacacagagaaacccugucucaaaaaaaaaaaaaaaaaaaaagucaauggugugaccugggaacugagagucacagggauggggauggggaggacuagucauaagccaagggcguaugagaugggagugggcagcugucaggggcaggacacaggcugggagaggcacaguccuugugcugaggcacagugcccagcagccagcauggagucagcagagugagacaugccaccccugcccuggcuuuggaggcucugacccauggccagccauugagagaucagucagguaacauggcaauccugcugagggugaagagagggcuuuagaggggaaagucagcagcccaagaggaaggauuugcacaugacucucuccagggagagaggagggagcuugacggugaguuugguuuuccagaugauacuuuuagugacugucaggcccgggaguagagauuucccagguaagcaaagauccgcaggccuggagagagagcauaucacagcgagaggcguaggagccaugggugugagucagacuucagugacaguugggaaagugagagagaagcuggauaugugagcccgacaguuagggagcugaggcagaaggauagagagcuggacaccagccugagacuugaggaagccaucuuagcaucucagagaguaaguagaaagggacuuuccuacggggccacagaggcgucaccaugccauaggacccaggaaggacaaggccguguugacugcaccuggacuuucaaagaagaggaagacuggaaacgaccuccagcugucaugggcauuuugggaagguccaggcaggcacacggugggaggaagaccaccucucuggugagagugaguccuuuacucccagccucccugaccagcacacugcaaugucaucauccaugaucccucugggagcccugucagcggccugccuacaccauggagugaaacuuuaucucaacaaauaacuaaugccaggcagugguggcgcacgccuuuaaucccagcacuugggaggcagaggcaggcggguuucugaguucgaggccagccuguucuacagagugagucccaggacagccaaggcuacacagagaaacccugucacgaaaaacaaacaaacaaauaaaaaaacagaauaaauaauaaacguaguuguguggggcugagcucuggcuagcaguguggaauccugccuuggguauuuaugauccuagcaauaacacugauauuucuucuuaauuacgacagacaguucgcuucugagagaauugauguugcugguuugccacauuugcucugacuguuuugcuguuguccuuguuuuggucuugggaagagaguguuugaaauagggucuuacaccauagcuaagccuggccuggaacuugcucuguuguccacccugccuucaaacuugugauucuccugugucugccuccugggggcugagacuacaggcugaaccucuccacacugucuauguucugauuaaagagggaguuaagaggcuaaaccacaaucaaaccuucaccucucagggcuggagagacagcucagugguuaagagcacuaacugcucauccagaggacccgaguucaauucucagaaaccacauagugacucacaaccaucuguaauagaauccagugcccucuucuggugagucugaagauagcaauggugugcucacauacauaaaauaaauaaaucuuuaaagaaaaaaaaaacaccucucaacuccucccuccuugguucuaguaauugccccagccuuuuucucuguuuuuuuuguuuguuuuuguuuuucgagacaggguuucucuguguagcccuggcuguccuggaacucacucuguagaccaggcuggccucgaacucaagaaaucggcuugccucugccucccgagugcugggaucaaaggcgugcgccaccacgccuggcucgccuuuucucuguauacauuguugcauuuugcuuuguuuuuguuuuugagauaggauauuguguagcuaaggcugguggucucugacuuacuauguagcugaagcuggccuuucuuaaccucccaccuccaccucuccaucgcaugccugagcugccacuuccgucuguauuuauuguuucgugcuaugguaggcaucagacucugugguagguagcgugcccugaguucauccccaagaccaccaaaaguaaaaggaaguagccagcugugacagcgcaggccuguaaaucuagcacucaggcaggaggauucggaguuccacgacagaugacuuagcaagcucucaucucagaaaaggggaagggaguaaaguagaauauggucuccgcgcccgggaacacugccucgcucuuuugcugauguccugauucagggccaugacucagagcuccagccuggugacuguaagaucuuaccuguacccugcagagaagcacuuucaguuuugcuggguuuugguuugagucagggucucaguauguagcccaagcuguccuggaacucacuuuguagaccaggcuagccucaugcagagaucugucugccucuaccucccacgugcuuggaguucccucuuuuuaugcacggugcugggggggugggggcggggggggggggcagugugcagauucccuaggcaaacgaggagcagagccaggugcuguuuuaugaguugagcuaaagccacuaccccuuuauuuggugaccucucuuuuggacauagagacauccuuuucuagacaugucaggugaguuaguuaggguuucuauugcugggaugaaacaccaugaccaaaagcaacuugggaggaaaggguuuauugagcuuacauuuccacaucacuguucaucacaaaaggaaaucaggaacucaaacaacaggaaccuggaagcaggagcugaugaagaggccauggagggugcugcuuacaggcuugcuucucauggucugcucagccugcuugcuuauagcgccuagaaccacccuaccccgccaaucacuaauugcagagauguccuacaggcuugccuacagccagaucuuagggaagcguuuucuuaauugaggcucccuccuugcaaaauacuuuagcuugucucucaaaucgacauaaaauuaucagcacugggggcuggagagauggcucagcguuuaagagcacugacugcucuuccaaagguccugaguucaaaucccagcaaccacaugguggcucacaccaaucugaugcccucuucuggggugucugaggacagcuacaguguacuuacauauaauaauaaguaaauuuuaaaacauuuaaaaaaauaaaauaaaauuaucagcacaucauguaaguagaauuauaaaauauuuguuccuacuuacccaguguauuguuuccaaccaugacauaguauuuaugagagauauauuugguuuuguggcuucaucuucugcagauacccauuguugcuccgcauguucaccugucacugggugcacacuugugcgcuaccaucuuugaacgacugugaguaauguugcaggcucguguacccacaucugcuugacugaaacaaggguuuguuuuuugucucuaccgaggagugaaguauggcugacugcaguuugcuuaccacguuaggaucuguuguguuuuccacaguggcugcguccuuccacguuccugcuggcagcccugagggucuagauuucaccacacguucugugauacguguaagaucuguguugugaucauggacaggcaccagccaugguaugcauguggaggucaguggacaccuucagcaggggacccagggaucgagccauggugcuuuuacucacucucuuaguguuguguugcugugaacacacugugcccaaggcaacucuuguaaaguagaagauucaacuggggcuucuuuauggucucaggcucaucagcaugacagcagcaugcauggcucugcagcaguagcccccuagugugacgcacuuccuucaacaaggccuccuaauccuuucuaacaguuccacugccuacggacugagcauucaaaauacaugagcccuagggauccauucuuauucaaacccccacacccucugagcugucucuaacccaauaauuaauuuucuuucuuuauguguaugaguguuuuuccaguaugaaugucugugugccacaaccaugugccacagaagccagagagggcguuggggcccuggaacugcaggcuauaaacugccacguggaugcugugaaucaaaccugggucucugcaagagcagccaaugcucauaaccacugagccaucguccagcccaucccuuccuuucuuuuuugagacagauuucucuguguagccuuggcuguccuggaacucacucuguagaccagucuagcccugaguuuaugauucaucuggcucugccucccaagugcugggauuaaaggcaugcaccaccaccgccuggcaaaaugcguagcccaggcuggacucaaacuugucauccuucugccucugccuccuucaucaaauccuacugcugagcaccaccacaaccggcccucuucgugucuugagguagucucacuauguaguugaguuagccuugaauuaugauccuccugcuucaguuuacugagugcuggauuauaggcaagcuuaccacacuuaauggucugucauuugcagauucuuguguuuuguuuguuuugggauuuuuuuuguuuuguuuuguuuuguuuuuguuuuuuuugacacaggucucacuacauagcccuggagggccuggaacucuguagaccaggcuagccucagacacauaggcgauccaccugucucugucucuuuagugcugggauuaaaggugugcuacaacacccggaauggguuuauuagcccuuacacauuuuauuaggacucugaaguaagagauguugcuggugggcacccuugacuuauuccugauuuaacacuuuuauagauuuguguguguguuguauguuugcacuuguuugucuggauguguacacaagcauguagaggcaggagauugaaguuagauuucuuccacuaucacugcaugccuuuaucucugagacagguucucacacugaaccuggagcacaucaauuaggcuggccaaagcccgagguccaaagaucuccuuauaucugccuccccaggguggggauugcagacgaaugcugcugaacccagcccuuuucuggcuuuauuaaacagauguggacuggagagauggcuaagagcacugacuguuuuuccugagguccuaaguucuguaaugggaucuggcgcccucuucuggugugucucaagacagcuagugcacucauaaauagauagauauacuugcuuuauuuuauguguguaaguauuucacauguguguauguggacuacgggcaugcccaguaagaaaagggcauuggauccucuagaacuggauuuacaaacggcugugagcugccacaugggugccagaacaaaacccagguccucugcaaaagcagcucgugcugauaacugcugagccgucucuccaaccccuguguggcuuuaaggggacgcuucguucugcaugugguuuccaguggcucuuuugcugugcugguuuugguuuuaagcaccacucaucaggagagugacaugucgugcuguguccuuggcugugcgugcugugugagggaugauguggcgcuuuccacaucugucuccuguggucguuaacaugaucacgcgcuucuuguuuuguuucuucaucuuugauucauuuauauagugaguugaguuauagucuaaaguucuuugcuuagucauuauguuucuauaguaauguaccucauaaugauguuuaaauauauacaaagggccaggugugguggugcacaucuuuaaucccagcacugaggaggcagaggcagguggaucucugugaguucaaggccagccuggucuacacugagguccaggacagccaaagcuacacagagagacucuguuucaaaagauagacagacagagacagguagacagacauaaaauugcacacacuuauggguaccaugugauguuucaaaauacacauaccguauaaugucuaaaucaugaaaaauguaucuagcuccucaaacauuuaucauuucuuuauguacaacauucaaaauuccuucuuuaagccacuauuuuuacguuuuucuuuuuuuuuuuuuuaaagauuuauucauuuuauuuacauggguacacuguagcugucuucagacacaccagaagagggcgucagaucucauuacagguggucgugagccaccaugugguugcugggaauugaacucgggaccucuggaagagcacucagugcucuuacccgcugagccaucucuccagcccauacguuuuucauuuuuaaaaagcauuuauuuguauuauuuuuaagugugugcaugcacacaccugugugugugugugugugugugugugugugugugagugugugugagugugugugugugugugugugugugugugugugagugugugugugugugugagugugugugugagugugagugugugugugugugagugugugugugugugugugugagugugugugugugugugugugugagugugugugugugugugugagugugugugugugugugugugugugugugugugugugugaguguguguguguguguugcccucagaggucagagaucagaagcauuggauccccccagaauuccaggucuccuugagcugcccagugugggagcugggagcagaacucgaguccuguggaagagcagcaaguccucuuccuugcugggccagcucuccagcucucuguuuuauuuuuuaauaguguuuuuaaauugacauacauucauugcccguggugggucucacacagacuuuauugugagugaguaauguacuuuaaaugucucacccacuuccuccuccccccaucuccuuccacacccgcccucuccauaguuggcuuuguccuccccugcccauaauuuuacccuuacauacaugugcuguguagacauacaugugagcucauggaucuguaugaaaucuaagauccacacauaugaggaaaaugagacauuugucacuuuugauagugauuuaauuuacuuaaggugauuacuuccuguuaaauacauuuuccuauaaacaucaugaaguggcuuggaaaacaguggcccccagcagcuccuguaucugaauguuuagucagcaggguguggaacugucugaaaggauuaaaagguuuggagguguggccuuguuggaggaaguggggugagcuuucagguuucaaaagcccacaccaggcacaagcucucucugccuggagaucaggacuuaaagcacccauccccuauuccagggccacgaugcugccuugcucccugccaugaugcacuaagccacagaaacuguaagacagucaguccccaacuaagugcuuucuuuuauaaaguugccuugaucaugguucucuucacagcacuaggacagugaguccgacacagcauaacuuugcucuuuuauagcuaaaaauauaauucgauuguauguguauaaaccaccuuuucuuuauuuauaccucugguuuuuuggauaccuuggcuauuuccacaacuuagcuauugugucccagagcucaccauguagaccaagcugggaccagaguuacagauuccaggaccucuggaagagcagucggugcuccuaaccacugagccaucucuccagcuccucuuauuaguucuuggcuagcccagucuacauggugaguuccaggucagucagggcugcacagugaacccugucucuaagaaaagaacccuaucuuugaugccuguugcauaguaggaccacauaccuuggcucuccugacuauaaaguagugucaguuacucagcuucucucccugccucugauaaccccucuaauaugcucaccucuauaagauccacguaaaguguugguugagguaccugucuuucugugucuggguuuucuuuguuuuacuuaggagaaugacucagguccauccacaauauuauaagccacaagauucuauccauuuauggcaaguuaguauucuguuauagaguuaagccacauuguaugugugugcuauauacauuucuugugugugugcgcguguguugauugcauguauuuauagaggucagagguccauuuuggguguucuguaacucugaaccacuuuuuaaaaguuuauuuauuuuuuuauguauaugaguuuuuggguugcaugaauaucugugugccugugugccugguaccagaggaggccaucaguuccccuggaacuggaguuacauuuggcuguuagccaccauguagguugugggaagcgaucccagguccucugccacagugugcacguggaagucaggaccacaugcaggagucaguuaucacuaucuucuguuggaguccuggggcuggaacucagacagucaggcuugcuaacaggcaccuuaacccgugaagccaucuuacugaaccuggagaucaccaauucagcuagccaggcuagccggcaaacucgugugugugugugugugugugugugugugugugaacacuuuuacaaaugaguuauccccacagcugagcuaucuccccagcccuuugcaccagacauaucaguugauaaacauuuagacugugccccuaucuuggcugucaugacuguacugcagugucuucagcaugcuuucucucuccuguuuguuuauuuacuuguuuacuuauuugaggcaggucucuuguagcccaugcuggccucaaaguuacuauguagcugaggaugaccuuaaccgaauucuccuguguuuaccucccuaguguuggacugcaagcaggaaccaccacacccugucuaugugguccucgggggcgucugcccaugugguacaccaauacccaugucagcgcaucuccacgucagucacgugacggccuuagcuuugguuuguugaggacucuccacacuucuuuccauaauggcugcaguaauucacaucccuaccaacagugagcagggauuccccgcucugcacagccaagccggcugucggcaucuuuucuuuuuguuaaaaccgccacaucuggagugaggugacaccucacugugguuucaguuugcguuuccugauaacuagagauggcgaacauuuuaaaaaagcacuuccugccguugugugucuuugcagaguaguuaacuugaucuguucuuucuccuuucuucuuuucuaguucugagaugcugcuagacuuguugcucauguuuaaccaaguugucugguuuuugcuaucaaguugugugaguccccuguauguucuggauaugaaucccucgacaaguuugcaaacguuuucuccuauuccgaggauugucuuuccauucuuuauuacaucuuauuuaccgugugugugcauaguguauuucugugcauguguguguccuaggaacagagaucagaggacaacuugagagugaguucucucugcuacucuguggaaccccuaggcuugaacucaggucaucaggcuaggugcaagucccccguggugugagcccucucucuggacucuucacucuuaaaaaauauuauuuauuuacaucaacguguguguaugucuuuuaugugcaagugccugagguuagcggcaucccuuggagcuggaguuagaagcaguugugagcugccuaguguggguguugggaauugagcucugguccucugcaagucaauaccuguucuuaaccacugagccaucucuccagccacuucucuccauucuucugaugacuuuccauaugcagaaguuuagucugaugucaugacauauuuuagcagaugccuguuaguacccuaauauuuuaauugacuuuuaugcaauuuuccguaaguaaauuggucuucaauuuucuuguaucaucauuauuuuguuuuggcaucagcguacauuaacuucauaaacucucaaggaacaugucuaauuuuugaaaacuaauuaauugguuaauuuaguguauguaugugugugguugucagaggacagcuuucgggacagaguucaaggaguuccaccacuuugaggcggucucucucucucucuauguuucucucucugugucucucuuucuaugucucucucucugugucucuaugucucucucucuaugucuaucucucucugugucucucuuucuaugucucucucuaugucucucucucccucuccuucccccucucucugucucucccucccuucaucccccccuccgucccuucuucccuucuucccucucuaucuaucccucugucucugucucuccuuucucucccucucccuuugucugucugucugucugucucccucucucuuucucugcugcugccuugcugcuacuccagacuaauggcccuauucuccuguagaaccauuuccccauucugaguuuuccccuaccccuucuuuuuauucauuggaacauaaauauuuguuuucuuuuauuuuuuccucuuuuuuuucuuuuguuucauuuuucaagacaggguuucuuuguguagccuuggcuguccuggaacucacucuguagaccagacuuacaucuaauucacagagauccgccugccucugccucccaagugcugggauuaaaggccuauaccaccaucaccugguaagaaauucuggggacuggagaaauggcucaguggucacugauuguucuuccagagguccugaguucaacucccagcacccccuugguggcucaugaccaucuguagugggaucugaugcccuucucuggccuccacaggcacuaggcacaaggcacacuuaugguacacugacacaaauguaguaagacauacacaaaaaauaaagaugaauaaaucuuuuuuuuuuuuuaagauuuauuuauuuauuuauuuauuauauguaaguacacuguagcuguccucagacacuccagaagagggagucagaucucguuacggaugguugugagccaccaugugguugcugggauuugaacuucggaccuucggaagagcagucgggugcucuuacccacugagccaucucaccagcccaagaugaauaaaucuuuaaaaaccuuuuuauuuacuagagagugugugaguguucacacaugaguguguguauacacacacgcgugugucacagugagaguguggaagucagagggcuuuuggaaaucuguucgcaauuuccagcgaggguuccggggaucaaauucaagucuucuugcacccacugggccaugugccaguucacagcacacagccuuuuucuuuuuuuuuuuuuuuuucauuuuauaugcauugggguuuugccugaaugugugacuguaugauggugucauauccucugcaacaggaguuacagacaguugugacaugccugccauguggaugcugggauuugaacucaaguccccuagaagagcagccagugcucuagcccacagccugcagccguuuaaaugugguucuaagcacauuucuuauaagcauauaccugcgagcucuuuccaagucaguagcuaaggagcuccaacugucuuguacagccaaggcuuuacugucccacgcccgcagccucacaucugagcgguccuggggguugggugggucuaucuuaagucuuucauuaacacagaaacgcuaccacaaaugguccucuuguaccugcagaguguauauccagcucaggaaccgcucucugcccaacauggaaggaugcuggucucuguacagccugccagccugcucuauuuuuaaacuuuaggaauuuggcuaaucauuggcuaugcaucagauaaagaauguuuuuguuuuuguuuuuuccgagacaggguuucucuguauaguccuggcuauccuggaacucacucuguagaccaggcuggccucgaacucagaaauccgccugccucugccucccaagugcugggauuaaaggcgugcaccaccaccgcccggcuauaaagaguguuuuuaggauggcuuuauuuuguauuucucuaagacuugugagguuacuugucuuuaagaaucucuugucagcucagcacugaggaaucagaggcauaaagaucaccaugaguucaggccagccugcuuuaaauacagaguuccaggacagccaggacuacgucgggagacaaacaaacaaacaagaaucucucguccccuuuacacuguuuuguuuugaauuuuugagacaggguuucucuguguagcucuggcugcccuggaacucaugcuguagaccaggcuguccuugaacucaaagagauccaccugccucugccucccgugugcugguuaaaggcgagugccaccaagcucggcaccuuuacacuuuaaccaugauucccuuugccaguucccuggugacuuguccauucacguauuagagaccauucugguggcuauuuucauagcccucuuucuccuugguacuggggguugaaugacucuggcuucgagcuaagcagagacugcacuuccggccaauccuguaccguccugaguuuacacagcucacucacuuccaggcuccucucccaaaccugcucuaaaagcuuucgcuuugcacaggucaccacuugguugcucuccuccaguuugaacguguagcguuuacauuuucgguagagucuuaguguacauguaaacacauuuacuuuugcugucuuugguuugaucggggaggguuugcuuguuuguaaccuuagccucgcagugcuggggcaagggcacaugcgaucgcucuuucccguccaaguucugugcugugugaaugacuuuuuuguugcgucugcuuaggucuuggucuguugucucccuggauuuuaccguagagguuguugguuccccacagaaagccacaggaauaaggaacuggccacuuccugucaguccucaggaacuacucugggcccaucuuggugccacagugucuuccucuuugccccguuuuucuuccuuaucuuucuuuaccugcucaggaagcugucuggcucuuagaucuuccccaccaucaaucugaguguuaauccuccuggcaggaaucuugccugugacuuuuaaacaaacaccaccagcagccuguggcacuguagacuccaguuuugcaugguaacauuuacgcguguccuuugcugaaugguccuuguucccuuggggucuaaaugacccuucuuguagguuugcauguaaauggucaaaggaaagacuguuccaaaagccaggagaacuccuggcggugccccuccucuuuccgcuguuuuggccguuuugguaaauucccaggccagcucagcaggaacccucuuuguguagcccaaguccaggcuugcacacacaggacucacaagaaccaaagaaccaaccgaugggccaguuguaagcacauuucucugacucugaggccaagccagacagcauaagcuugaguguugggauagguggaugaacacacauucacuucagugugacacauauugcugccaaagggugagagccaggacacacaguggaugccuugugacucagacugacuguggccagguggggcuaggcaagaccagucauccuagauaauucucgaaguggcugcuaguucccuggauuuggguggguuuuguuguuugcugauuguuuguuuguuugguggacagucucuauagcucaggcuagcucaggcuaguuuaaacuguuaugaggcuaaggaugaccgugaacuccuaaucuccccccccccccccccagugcuggaaucauagguguugccgucgucgucgucgucgucgucgucgucgucgucgucgucguccuucuucuucuucuucuucuucuucuucuucuucuucuucuucuucuucuucuucuucuucuucuucuucuucuucuucuucuucuaccuguuuuuuaaagauugauuuauuuaugaguacacggucacugucuucagacacaccagcagagggcauaggauccuauuucagaugguugugagccaccaugagguugcugggaauugaacucaggaccucuggaagagcagucugugcuuuuuaacuacugagccaucucuccagccccaggcuuguuauucuuuuaaugugauauuugcauuugaaagugaaguuucucaaguuaccgacuucugccuucucaccgugcuaggcaugguuaaauguucacuuauaauuuuacuaccugaaagaccagacagcaacacaauacaaggcugcuguccagugcuggagaguaaacucaugcuggacaagccgcuggcccaagccuccaucucaaagagacagacuguauucuaucauucacauuuucaauuucaugccaaguuagccaaacauuuuccaaggguaaaacucucaccacaguggcagauuuggccauuuuaauguccucuucauuuaauauauuaauaauguuuaauguauuaauguuuuaguuugaaauuaugcgacuuguuggucauguacauccccacgauccagagugacccagagucucaggacauagcagaggcuggcuuugaguucagccucccaguccccugaggacuggcgcguguaccucaguuuguuaacuugaauguggcugugcacuuaccaugcuguguguggaggccagaggacaacuucaggucuugguccucaccuuccgucccauuugaaauaggauacuuucguuugcugcuuugaaucuggggcuagcuggcacacaggcauccagggauucugucucugccucccacccuacugagggaguucugccaugguuuggagauuccagguuaggugcucguuugcccuuucauggcaagugcuuuacccgcuaagccguccgucucaucaggacucaugagcugaccuguaauaguccuuccuacucaccaccuuuuaacuuuccagcugucccccaccauuguguuaauaaaguuaugcuaaucucagaaaaguuuuaaaaagucagugcuaugggauagcucaguaguuaacaguucuuauugcuaaauccaaaaggcuggguucaaucccagagacccacaggccauccucggacacgcacagacacacacacauauacauucacauauacacacacacacacacaugcacauacacucucacauauacacacucacacauguacacacaugcacacauacacauaugcacauguacucuuguacacauauacacacucucacacacacacgcgugcacccacauguacauagacgugcacauacaucccuguuugaccuucugagguuuaacauuuuuuucaagcuagcagcucuguuuuccaagcccacaguggucugagagguuuuucaguuuccggauccuggccaguguguggugucaccuuccucaggguagaaccgguagugagugugauggagugucaucuccugugguuccaaugggcacuuccuggacagggucagggucagagcugcucuucucuaaagcaguaucugguuagcucuuuccauauuuuaaauugguuauuuguguuuuuauuauuacaaugcaaacguuuucuuuccuucuuuaauuuuauuuguuuguuuguuuauuuuugugacaggaucuugcccugucacacaagcuagccuugaacccagauucucccgucagccucccuagcguuagguaauaguuacagcccacauggcgcuccuacgccuaagcucacuaguuuaauucguuugcuuuuucaaaccauagcccagguuggucuugaacuuacagcagucguccagcauuggccuccugagugaaguggguauagguuugcccccagugugcuuaaacacaaaaggaagacuuugugaaugcauacuguccuugcucaggggccacgcuaguaucugugucucucuagucuuugugcugcuggguagagcgcacgccacagcacacaugugagugucagaggacaagugagagucaguucccuccguccacuuuguggggcacugggggucaaggccaagccguugguugguugucacaagccauuaggcuugguggcaagcaccuuuacccucugagccaccucagcagcuccaacacaccauguuuacacaggacaagggacugauggaaaggcagauugcugacguacaaugaaguugccuaacuuaucuuccguuuuugccacuuaucagcuggccaccugagugagggucuaaacugcauggcuugauaaguuuccuuguccugggcgaccgagcuggggugcuaaugucuuccuugcuggaucuuugugaaacccugaaucuguguagcaugucauguguacagccgugguccugcguccagcacgguguguccugguguccuguguaagaauccaagaaccauagguguuuugguggaucuuacaagugagccucccuucuugcccugccacaguuccugugugacgagggugcgggcauaucuggggacuacauugaccgaguagaugaacccgucuccugcuccuacguacugaccauucgcacgucaaggcucugcccgcauccucuccuccggccaccagccagcgcugccccacaggccauucuuugucacccagcccugcagccugaugaguacauggccuaccuccagaggcaagcuggugaguacucaggacagcgaggagagguggggacgagacaggcgagcacacacguugaugggcccuggccugugcucacuguuuuucugguagagucaaagcagcaugaagagaaaaccacagaggaaguccaggacacagaccgccaaguguggagugggagcaaggcugccggagcacccccaaagaaagaagguggggugcggccuuggccagccugaugcuggccucuaccaccucccucccacccccaaccccaucuuccuguccgauucgacaguugugaguggcaguauaagagggaguguguucccuccaccuuugcuuccuccuucucuccccccuucccacauucuccucuguucuccguaccccagaugucagcccagccaaggaagagaaggaaucagagcucuggaagcuucaggggccagaggagcaggcagcagcaagagaggaggcgcaggcaggggugagaccaggccucuccgcuggccccgacgagccuggacucgggcccugggauggguagggucuacgagguggcuucugucugucuuggggugaaaggagcauggagggcagaggcaagcccucacuccugagucugcccuuccuccucaucaggaacaggaccugaaccacgaggccgcagcagauccagcuccaagcccucccaauggucagucaaccccgugucucccuuagcucuuaggugggguagagcugagcuacucaggggaggucgggagccuggcagcaaguccacucuuccccgccucccugugucuccuggugccaagaacugaacgcagacucuugcacacuugauguuucccucugagcccuccaccugccuggccccagcuagcucacuguuagcuucuuucugaucagcaggaccacuuaaggaggucaaagggcacuccccugcacuccucugucaguuugcccaccuguagaauguggcugaaggccaugccagagugcuguggggaggggaaaugggaaugguucugucccuucccuugggaggaccaaggguuuuguugccuucugccgcuucccaaggcacagaccacgcucuucaccccucacgucucuccucaggcaucaagagacaauuuaaaaugccaaaugcccacaccuccucucuuucccaucucagauuuucagaauaacgugcaggugaaacucauccggagucccgcagacuugauucgacugauugaggagcugaaagcugcagaaaagguacgggucccggggcccugggcaggcgcauuuggagagagagcuuugccugggauaaacuggcgccaguagagcccagcccugcuccuggcucccauccugcccguccuguggcccccacuaccacguccugccccccacauauuacggcggacuccuucaaacugcaucuucuacccaacucccgacccaggggaagccaagcguaaggcgggagcagccuggagacgauaccacggaggccccccagagggaagcagagggaacgaaggcgaagggaaaggauggugagcccccgggucuuauggaagaggaggauggugacgacgaagaggaggaggaggaggaggaagaggacgaggaggagcagcagcuccugggagaguucgagaaggagcuggaggggauguugcugcccucaaaccgcgagcgccuccgcucugagguuaaggcuggcauggagcgggagcuggagaacaucauccaggaggugagcaacccccacugcggcugccacggagcgcgagcacccgacgggagaguuauuaauggggaggugaaagaaaggacgacaguuggcucuccuguagaucacgucccugucucucuaucucuccuauagaccacgccccaucucucuggcucuccuagagagcaugcccccaucucucuugcccagaucccuaauugccuccuuugggccuugcagacagagaaggaacuggacccagaagggcugaggaaggaguccgagcgggagcaggcaauauuggcucuaacauccacucuggacaaacucaucaagaggcugcaggagaaccagaguccagagcuugugcaaaaauacaaaaaaaggagaguugucccccaaaagccucccccaucaccacacccuacaggugagagcaguccccagagggagggcacagccucagagagugugccuuccucucccuccucugggagcacugugcagugucagcuccucccuccacuguccucucugcaggacaccucacagccagccuugggaaaacccauagcuggaagagcauuccugguuugcucuaugcccacugccugguggucugccuggcacacaggcaaagacuaaaugagcaugaguguagaagcugaaaagcucaucaugaagaaggggcucugugccugccuuccugugggagggaauuggagagucagagacaguuugggguuucccuagcagacauggugggcagguaucaggggcccucucugcagcugucagugugaauaggcaagccugcuggcaccggccaccagccagggcacacuucugugaccccuucuucaaucuccuuguguucauuucaugggauucugcuggaauggagagagaaggcauuccagcuucagaccuuaaagccacguuuuuugguaaacauugaaaggcuguuaagucuaggaaaaccgagccguggcuucccaaccugcuccuuaaagcaaaacaccuuuguggaugcagguggcccgaccuggcuuuuggaaaacagcuguuuuccuauagaaauuggaaggccggguggggguggggguggggugggggucugccuuuggggaagggcguguuuugaacccugaaucacaugcaugggaggcagaguuucuacccaaagcagccuauggcuuagcgagagagagagaccaccucacagcccuucaccccagagucacggcucugcuuugugucucccugugucuuccccucuaagaggaggaaccugagcacagaguccggguccgagucaccaagcuccguccuggaggccccaaucgggaccugacuguccuggagaugaaccgggaaaacccacagcugaaacagaucgaggggcuggugacagaagugcuggagagggaggggcucacggcggaaggugggcccugaagggcggugcuuagagcugucugucugucggaagggcuugccacaggaguggcagggcugggucaagguggacuggagaccucaccuugggaccuggagggcaggggacccucuaaagcucccagccuuccccuccucacuacccauauugcuccugccaggcaagauugagaucaagauugugcgacccggggcugaagguaaggaagaggacacacgcuggcugacugaugaggauacaagaaaccuuaaggagauuuucuucaauaucuuggugagacaucccacccacaucccgggcuccagcacacaccacugugcugcucaaaccaggguggguuaugccagccaucggcugccuacguuuauagagucccauccucauguccgaggugaggcuaagccucagcggcugcuugggagaauccguuaggaagcaauaucccuagucccugccucccuccuaggucucgggaccucccuaggucccagugcaggacuucccuuggcucagccccucuuuccucccagguacagggagccgaagaggccaauaaagagcgccagcgacagagugagcuggagagcaacuaccgccggguguggggcucucccgguggugaagacacgggggaccuggaugaauuugacuucugagaccacccugccagcccucuaaggauuccugcaucuuccugaccggccggcucugccuccuuacaccccauucuggggccuuggaggcaaaagggcagauuggagcccagcacuggacuugaggggcccagccccaagaguguaugaggguguguggggacccaugagggugaggagcuguugcagccaggccuaugggguccacuccccaaacacacccuccuuugccccuuuagcuuuuuccugucccccaacuucuuagcacuuaaccccacucuacccagagacuugaugagaccuugugaguggugguggcaggaacagcagggcugugcagguccccgaccccaccucucccuauccuaccuccauucccuguugcuguuugggagcuguugccccucccuuggaacgccuacuuccugucucugcugucucccgguaccugugcuucugagcccagacuaucucuugucacugaggggaugggagaccuuucauaucaccucacaaacaaucccagcaaaaaggguuggagauggagcacccccuuguucuucagcaaucagguuucuaaauaaaaaacuggaccgucaag

SEQ ID NO: 5782 - RNA, 3466 nt, Mus musculus
cacucaugcucauuuagucuuugccugugugccaggcagaccaccaggcagugggcauagagcaaaccaggaaugcucuuccagcuauggguuuucccaaggcuggcugugagguguccugcagagaggacaguggagggaggagcugacacugcacagugcucccagaggagggagaggaaggcacacucucugaggcugugcccucccucuggggacugcucucaccuguaggguguggugaugggggaggcuuuugggggacaacucuccuuuuuuuguauuuuugcacaagcucuggacucugguucuccugcagccucuugaugaguuuguccagaguggauguuagagccaauauugccugcucccgcucggacuccuuccucagcccuucuggguccaguuccuucucugucugcaaggcccaaaggaggcaauuagggaucugggcaagagagaugggggcaugcucucuaggagagccagagagauggggcguggucuauaggagagauagagagacagggacgugaucuacaggagagccaacugucguccuuucuuucaccuccccauuaauaacucucccgucgggugcucgcgcuccguggcagccgcaguggggguugcucaccuccuggaugauguucuccagcucccgcuccaugccagccuuaaccucagagcggaggcgcucgcgguuugagggcagcaacauccccuccagcuccuucucgaacucucccaggagcugcugcuccuccucguccucuuccuccuccuccuccuccucuucgucgucaccauccuccucuuccauaagacccgggggcucaccauccuuucccuucgccuucguucccucugcuucccucuggggggccuccgugguaucgucuccaggcugcucccgccuuacgcuuggcuuccccugggucgggaguuggguagaagaugcaguuugaaggaguccgccguaauauguggggggcaggacgugguagugggggccacaggacgggcaggaugggagccaggagcagggcugggcucuacuggcgccaguuuaucccaggcaaagcucucucuccaaaugcgccugcccagggccccgggacccguaccuuuucugcagcuuucagcuccucaaucagucgaaucaagucugcgggacuccggaugaguuucaccugcacguuauucugaaaaucugagaugggaaagagaggaggugugggcauuuggcauuuuaaauugucucuugaugccugaggagagacgugaggggugaagagcguggucugugccuugggaagcggcagaaggcaacaaaacccuugguccucccaagggaagggacagaaccauucccauuuccccuccccacagcacucuggcauggccuucagccacauucuacaggugggcaaacugacagaggagugcaggggagugcccuuugaccuccuuaagugguccugcugaucagaaagaagcuaacagugagcuagcuggggccaggcagguggagggcucagagggaaacaucaagugugcaagagucugcguucaguucuuggcaccaggagacacagggaggcggggaagaguggacuugcugccaggcucccgaccuccccugaguagcucagcucuaccccaccuaagagcuaagggagacacgggguugacugaccauugggagggcuuggagcuggaucugcugcggccucgugguucagguccuguuccugaugaggaggaagggcagacucaggagugagggcuugccucugcccuccaugcuccuuucaccccaagacagacagaagccaccucguagacccuacccaucccagggcccgaguccaggcucgucggggccagcggagaggccuggucucaccccugccugcgccuccucucuugcugcugccugcuccucuggccccugaagcuuccagagcucugauuccuucucuuccuuggcugggcugacaucugggguacggagaacagaggagaaugugggaaggggggagagaaggaggaagcaaagguggagggaacacacucccucuuauacugccacucacaacugucgaaucggacaggaagaugggguugggggugggagggaggugguagaggccagcaucaggcuggccaaggccgcaccccaccuucuuucuuugggggugcuccggcagccuugcucccacuccacacuuggcggucuguguccuggacuuccucugugguuuucucuucaugcugcuuugacucuaccagaaaaacagugagcacaggccagggcccaucaacgugugugcucgccugucucguccccaccucuccucgcuguccugaguacucaccagcuugccucuggagguaggccauguacucaucaggcugcagggcugggugacaaagaauggccuguggggcagcgcuggcugguggccggaggagaggaugcgggcagagccuugacgugcgaauggucaguacguaggagcaggagacggguucaucuacucggucaauguaguccccagauaugcccgcacccucgucacacaggaacuguggcagggcaagaagggaggcucacuuguaagauccaccaaaacaccuaugguucuuggauucuuacacaggacaccaggacacaccgugcuggacgcaggaccacggcuguacacaugacaugcuacacagauucaggguuucacaaagauccagcaaggaagacauuagcaccccagcucggucgcccaggacaaggaaacuuaucaagccaugcaguuuagacccucacucagguggccagcugauaaguggcaaaaacggaagauaaguuaggcaacuucauuguacgucagcaaucugccuuuccaucagucccuuguccuguguaaacaugguguguuggagcugcugagguggcucagaggguaaaggugcuugccaccaagccuaauggcuugugacaaccaaccaacggcuuggccuugacccccagugccccacaaaguggacggagggaacugacucucacuuguccucugacacucacaugugugcuguggcgugcgcucuacccagcagcacaaagacuagagagacacagauacuagcguggccccugagcaaggacaguaugcauucacaaagucuuccuuuuguguuuaagcacacugggggcaaaccuauacccacuucacucaggaggccaaugcuggacgacugcuguaaguucaagaccaaccugggcuaugguuugaaaaagcaaacgaauuaaacuagugagcuuaggcguaggagcgccaugugggcuguaacuauuaccuaacgcuagggaggcugacgggagaaucuggguucaaggcuagcuugugugacagggcaagauccugucacaaaaauaaacaaacaaacaaauaaaauuaaagaagga

SEQ ID NO: 5783 - RNA, 3466 nt, Mus musculus
uccuucuuuaauuuuauuuguuuguuuguuuauuuuugugacaggaucuugcccugucacacaagcuagccuugaacccagauucucccgucagccucccuagcguuagguaauaguuacagcccacauggcgcuccuacgccuaagcucacuaguuuaauucguuugcuuuuucaaaccauagcccagguuggucuugaacuuacagcagucguccagcauuggccuccugagugaaguggguauagguuugcccccagugugcuuaaacacaaaaggaagacuuugugaaugcauacuguccuugcucaggggccacgcuaguaucugugucucucuagucuuugugcugcuggguagagcgcacgccacagcacacaugugagugucagaggacaagugagagucaguucccuccguccacuuuguggggcacugggggucaaggccaagccguugguugguugucacaagccauuaggcuugguggcaagcaccuuuacccucugagccaccucagcagcuccaacacaccauguuuacacaggacaagggacugauggaaaggcagauugcugacguacaaugaaguugccuaacuuaucuuccguuuuugccacuuaucagcuggccaccugagugagggucuaaacugcauggcuugauaaguuuccuuguccugggcgaccgagcuggggugcuaaugucuuccuugcuggaucuuugugaaacccugaaucuguguagcaugucauguguacagccgugguccugcguccagcacgguguguccugguguccuguguaagaauccaagaaccauagguguuuugguggaucuuacaagugagccucccuucuugcccugccacaguuccugugugacgagggugcgggcauaucuggggacuacauugaccgaguagaugaacccgucuccugcuccuacguacugaccauucgcacgucaaggcucugcccgcauccucuccuccggccaccagccagcgcugccccacaggccauucuuugucacccagcccugcagccugaugaguacauggccuaccuccagaggcaagcuggugaguacucaggacagcgaggagagguggggacgagacaggcgagcacacacguugaugggcccuggccugugcucacuguuuuucugguagagucaaagcagcaugaagagaaaaccacagaggaaguccaggacacagaccgccaaguguggagugggagcaaggcugccggagcacccccaaagaaagaagguggggugcggccuuggccagccugaugcuggccucuaccaccucccucccacccccaaccccaucuuccuguccgauucgacaguugugaguggcaguauaagagggaguguguucccuccaccuuugcuuccuccuucucuccccccuucccacauucuccucuguucuccguaccccagaugucagcccagccaaggaagagaaggaaucagagcucuggaagcuucaggggccagaggagcaggcagcagcaagagaggaggcgcaggcaggggugagaccaggccucuccgcuggccccgacgagccuggacucgggcccugggauggguagggucuacgagguggcuucugucugucuuggggugaaaggagcauggagggcagaggcaagcccucacuccugagucugcccuuccuccucaucaggaacaggaccugaaccacgaggccgcagcagauccagcuccaagcccucccaauggucagucaaccccgugucucccuuagcucuuaggugggguagagcugagcuacucaggggaggucgggagccuggcagcaaguccacucuuccccgccucccugugucuccuggugccaagaacugaacgcagacucuugcacacuugauguuucccucugagcccuccaccugccuggccccagcuagcucacuguuagcuucuuucugaucagcaggaccacuuaaggaggucaaagggcacuccccugcacuccucugucaguuugcccaccuguagaauguggcugaaggccaugccagagugcuguggggaggggaaaugggaaugguucugucccuucccuugggaggaccaaggguuuuguugccuucugccgcuucccaaggcacagaccacgcucuucaccccucacgucucuccucaggcaucaagagacaauuuaaaaugccaaaugcccacaccuccucucuuucccaucucagauuuucagaauaacgugcaggugaaacucauccggagucccgcagacuugauucgacugauugaggagcugaaagcugcagaaaagguacgggucccggggcccugggcaggcgcauuuggagagagagcuuugccugggauaaacuggcgccaguagagcccagcccugcuccuggcucccauccugcccguccuguggcccccacuaccacguccugccccccacauauuacggcggacuccuucaaacugcaucuucuacccaacucccgacccaggggaagccaagcguaaggcgggagcagccuggagacgauaccacggaggccccccagagggaagcagagggaacgaaggcgaagggaaaggauggugagcccccgggucuuauggaagaggaggauggugacgacgaagaggaggaggaggaggaggaagaggacgaggaggagcagcagcuccugggagaguucgagaaggagcuggaggggauguugcugcccucaaaccgcgagcgccuccgcucugagguuaaggcuggcauggagcgggagcuggagaacaucauccaggaggugagcaacccccacugcggcugccacggagcgcgagcacccgacgggagaguuauuaauggggaggugaaagaaaggacgacaguuggcucuccuguagaucacgucccugucucucuaucucuccuauagaccacgccccaucucucuggcucuccuagagagcaugcccccaucucucuugcccagaucccuaauugccuccuuugggccuugcagacagagaaggaacuggacccagaagggcugaggaaggaguccgagcgggagcaggcaauauuggcucuaacauccacucuggacaaacucaucaagaggcugcaggagaaccagaguccagagcuugugcaaaaauacaaaaaaaggagaguugucccccaaaagccucccccaucaccacacccuacaggugagagcaguccccagagggagggcacagccucagagagugugccuuccucucccuccucugggagcacugugcagugucagcuccucccuccacuguccucucugcaggacaccucacagccagccuugggaaaacccauagcuggaagagcauuccugguuugcucuaugcccacugccugguggucugccuggcacacaggcaaagacuaaaugagcaugagug

SEQ ID NO: 5784 - RNA, 1732 nt, Mus musculus
cacugaccugucuaacguucuaaggccgcggcaggaucgcgguccgggcagugcccgguucuccgccccggccgggggguccucaugaggccggcgacggccugaugcgggagcugggcgggagggagcccgacagugucggggauccgacuccucccgccugcggacuccggggcuuuguagaccgcagcgcgggggugguucugaacguuuccugccggggugaacuggaucguaaauccgccgcgccccagccccagcgacaaagcggggaagcccuggcaccgcgucgcgcucccaggcagccgagggcucaggccuccgcccggcucucacaccgcagcgcagcgccgcucccgggcuggcugcggcacaggcucgggcucugagcggggauggcgagcuccgcggcgccgucuggcggacgcggagaagauugcuuaggcgaugagcccucccgggaagguccccccuuuucacaucccuucguccccaaaccgcggugucuaagaugccaguucccgguccccgccauuuccccacucguucacaguguagccccaggaagggcgauuggguucaguaugcggucuaaccucauuucaaggaacacuuggauggggaagaugaaauaaauaaaaccagccagcccuggaggugaacacugccucacgagcaacaaagacagcggccucucucugaccucuuggcuccgaauuccagccaucaaccgaggcaagccguuacucaauggccggccuacuuccccuaacugcuucuugguacagacuugaagaggaaccgcagaaaguggccagauggacagugaaguaggccauagguggcuugauucccgacacugaccagaaacaaaguccugugguucucagaaggaucaaaauugaauagaaaaauagguaaaacauaaugaaaaaugugucuggggguuggggcuguagauaagcaauauugaaugaacuguguguguguguuggggagaagagggaaaacccacccuuaaaccagaaguuucagaucaaaugcuaaaaguagaauuacaaaaccuuuaaaauaaaucaagggcuuuuuuuccuuuacagucggaagagauccccuaagcaagaggcgaagggaaauauuaguaaaccugucuauauaaaacacuuacuggagagauggcucagcaguuaagagcacuggcuggucuuccaaaggaccuggguucaauucccagcacccacauggcagcuuacaacaauaauuccaguucccgggcgucuggauaccccuucacagacccacauguagauagaauauuauuguaaauaggaauaaauuuauuuacaaaacacuugauagacaucggguguagaaugcaaaguuagguuuuuauuacugugcccaagaacuccgugaaucaaaaugaucuuuguaaccggucaacucccugcccgaggacagauacgccacgauucucuggaagcuguuacccguaucagauagcaagccacaugcguucacuuuucuaggggaucacagggaguugagagguagguaggaggaaguaugucaggauguaugcuugcuuccaucugaccaaggcauagccugugaguuagcccuuuauaaucaccuggccauuguagcugguggccauuuucuaggaacccuggaguggacuggccagaguccaucauccuggcuaguauuaaagcuugcuucaaauuuuguu

SEQ ID NO: 5785 - RNA, 7640 nt, Mus musculus
cagagcccgagccugugccgcagccagcccgggagcggcgcugcgcugcggugugagagccgggcggaggccugagcccucggcugccugggagcgcgacgcggugccagggcuuccccgcuuugucgcuggggcuggggcgcggcggauuuacgauccaguucaccccggcaggaaacguucagaaccacccccgcgcugcggucuacaaagccccggaguccgcaggcgggaggagucggauccccgacacugucgggcucccucccgcccagcucccgcaucaggccgucgccggccucaugaggaccccccggccggggcggagaaccgggcacugcccggaccgcgauccugccgcggccuuagaacguuagacaggucagugcgcuggcacgcccggcggccgaggugugggcaggagcggcguccuccuggccucgcgcaucgugcccguggcucaacgaggccacccgagggucaccgaggccgggcacccgcgagcgcgggcgcgacaccgugccuucccugacccgccaggugcaguacagccgccccuccgcagcacccuggcccggcugcugcccguggggugggggugggguccccgagggcugcgcacccaagauacugcaugucaccacggcaagccuuggguguaugcggaagcccagaggcgagagagaggcggaagaaaggaggccgggagaccuuuggcgugagcaugagggaaggggugcgcgccgugcggagcggagauggcuggccuuggguaccugcgcgagccucggaggcggcgggguccagagucccggcccucacguucucugagagccuggucaccucucacccucccccauaucaggaugcggcuagaccgccgggcccucuaugcgcuagucuugcugcucgccugcgccucgcugggucuccuguacuccagcacccgaaacgcgccaagucucccgaacccucuggcauuguggucgcccccacaaggucccccgagacucgaucugcuagaccuugccccugagccucgcuacgcacacaucccggucaggaucaaggagcaagugguggggugagugcggaccgcggcguggcggcggcgacagcgcagaacaugcuggaggggguggccggggagcuuuuguuuccuccagugcuagacucggacgcugcuuacugcugacugguugggugcaguuaucagggagguggagagggcuaccgaagcuugaacugggggggagacaggggcgcggcaaaucuauccuccucaaccuugucgccgccacuggagugugggaggauguacaggcaaaagagcacccggagacugccugcugucuugauuuagacuugagauuccagaaggguuccuggauggcggcuacguagacauccuaguaauuggcccuaguucgcaccucuguaacgcacagauuuaagggauaagcugucucucaccugugggcagaguugagggaucaaagugugcagcgcugugcguuuugugagauaaauggagcuuagguaccuaccuggacucugaagccgcuucuccucccuuuaggcugcuggcucagaacaacugcaguugugaauccaagggaggaagccuucccuugcccuuucugagacagguucgggcgguugaccucacuaaagccuuugacgcugaggagcugagggcuguuucugucgccagggagcaggaauaccaggccuuccuugcaagguaccagugagagaggaggauccagcucuucccagggaggccaguggugucguagugaccccguuggaagaaagagcuccucuccuacugacuccuuuaucaccucuacacuacaggagccggucccuggcugaccagcugcugauagcucccgccaacucccccuuacaguacccccugcaggguguggagguucagccccucaggagcauccuggugccagguaaagaaggaaggucucagggguuaagucaggucgugaggguggcggagcuacaggcuagcagguggagaucucugacaaagagauauggaggcagagggacucuaaggucgucagguauugcaggaauaccugggaggcuuaugaguaaauaucccuucuuugauagcuagcuagucaggacaagccacggaagaaaugccuuuuuuuuuuuuuugaugggaaggaguuaagaagcagucacuugaguucuguggguugugcacaguccugcugaggccuccacgggagagucagacauaaaguucuguauggcacgugguggcagggggagagaaaaugaggaagaauucaagacugucugugaaauucuggcuuccucauucuaccucccagggcuaagucugcaggaagcuucuguccaggagauauaccaggugagagaaaccgguaaagaggugggcuuggagaaugaagaauucuugauggguuacagagccccacuccacacccacacccacacccaggcaugcaggguugaaaaggcaagaggcgggucagggaccuaaggcugcugucucucacccucuuccaggugaaccugagugcuucucuaggcaccugggacguggcaggggaaguaacaggagugacucucacgggagaggggcaaccggaucucacccuugccagcccaguucuggauaaacucaaccggcagcugcaacuggugacuuacagcagccggagcuaccaggccaacacagcagacacaggugggaggcccgaggagggguagggacagacugagagaacagaaagaaccagaaaagcaaaugaccacgugugggaggcccucgggcaauggccagaacagccuagacacacaaugaauguugcaagugggccagcagggccaggagucagaggagccuuuguuuaucuagggccaaaacaggccagggagaaaccagagcuggagagcauucccacuucugucugucaucacggcuccaggaagugaccuguuccuggcuguuucuagcccaacacuuaccuugccaagcucccucacccuuccuccuuuuuuucuccaaaacuggcuuuucugaaccugcgccuaccuuagggccuuugcaucugccguuuucaggaauguuuuugccuaaguuuguuuguuugcuuucaagguuggcucccucuugauguuuacaucugggcucagacgucuccuguuugcuugaaacaaugucccuugccuccgcuuuuacacuagacguuucuuauuuacucagccuaagcuuugacguuguaaaauauggacaauuuacuuuucugugccuaagcuuaguuuccugcaauaguuuaucuaguaagauuaccaugaagauuaaauggcuucaucuauuuagaacacauuuucaauuuuuuuguuuuguuuuguuuuguuuugaaaaccaucucauuuauuuagcucugucuggcuucagacucacuauucagcagagccugauuccugcuccuugguguugcuaccucccaaaucccaggauuacagauguaugccaccacacccaauuuacagaaaaauuuaaaucugugcagcacagaggaaaguauagugauccaugccuguaauguucguacuugggaagccauaggaggaggagagaaauuucaaggguagccuaggcuacauagcaagagcgugcaugugugugugugugugugugugugugugugugugugugugaggcauguaguaaaugcucaguaaagauuaacuuguucuguuuuguuuuucgagacagggucucucuguguagcccuggcuguccuggaacucacucuguagaccaggcuggccucgaacucagaaauccaccugccucugccucccaagugcugggauuaaaggcgugcgccaccacugcccggcuguaaagauuaacuuuuuuaaaaaguuaucuuuuaucuauguguggugauguuuaucuauauaauccuagcacuuaggaaacugagacagguagaauugccuuaguguuggaacaagccuggguuauaugcaauaaguaccaaaccagccagggcuacaaagcaagacccagacucgagaaaccaaaguggggugggaggcgucgagaaucucauugucuuuguuccaccuccuaagcuguaagguuucugggcagaagcuguagcucaacggauaccaugcuauaccuagcaugcacaagaccagggguugaguucccagcacugcacagaugcuggcaccccuacaugaugucucuccuuaggagacaucuguagauaauaacaccugcaaucgcacucaauaggcacaggcaggagguuccaaaaauuuaaggucauccuccgcaaccauggugcugggaggagagcuggguguucccagcugggcgguagagugcuugccaagcacguguuagucucuaaguucaauuccuaauaccacaaaacaacaugcaagcuccacagaagucagaacgguaugaucuugcccaccaaggccugaaaaggcagaacacagauuaagaguuuaaauacuggccgcugaaaggagagugcucuucuagccuuaagggcccaauuccaccuccuuucuucccaguccgguucuccaccaagggacaugaaguugccuucaccauccucguaagacacccucccaacccccggcuguacccaccaucaucccuaccccaaggaggugaggcugaggcuccagggauuaggaaaguaaagaggggguuggcccuggggguggggguggggcugcuuucccacucuuucuccccccacccccgcccgcccccucacacuggccaauacaccuugcuuucagccgaguacaacaucagugcucugguuaccauugccaccaagacuuuucuucguuaugaucgacuacggacacucauugccagcauccgacgcuuuuacccuacggucaccauagucaucgcugacgacagugacaaaccggagcgcauuagcgacccacacguggagcacuacuucaugcccuucggcaaggugcgcugcccgcaaagcagagcgggggcgccagaggacucugggaagggggcgugccucagccaacagcuuccagggugcugauuaaggaccacuucccucaaacaaaugugugccuaucacaagggcuucggaaucaggaauccugccuaucuuauucguuccgcauucuugaaauggugcuuaauaccuauagcaauacaauggauguaugcacgaagcaaugaaauacaagacccuucccccaaagggcucaaaaugucuaggaaaaggguugggacccucugggaaguuuuaaaccuaguuuccggucaucggaaagcucuaagaagucuagagcaggacacaggcuguuuugagugcggggagagggaaaaagaugucaggcuuuuucuguucccaaccauauacaacucuucuaggguugguucgcaggucggaaccuggcggugucccaaguaaccaccaaauacgugcuguggguggacgacgacuuugucuucacggcgcgcacgcggcuggagaagcuuguggacgugcucgagaagacgccccuggaccugguaggggaggagagccggauguggggugggagacgggagagcgggacguccaaaggugaagcgagucugggggguagugugggcccuguguguuucgauagggcgaggguggggcaggggcgcggggaggaagcguucuacucucggggaccuggucuuagcuggagcauccucucgccuccugcagguagggggcgcggugcgggagaucucgggcuacgcuaccaccuaccggcagcugcugaguguggagccgggcgccccaggccuugggaacugcuuccggcaaaagcagggcuuccaccacgagcucguuggcuucccaaguuguguggucacagacggcguggucaacuucuuccuggcgcgcacagacaaagugcgccaagugggcuuugacccacgccucaaccggguggcacaucugggugagcggcgcccccuccuggcagugcguaggaaugggaaggaccaggcgcgguucugccacuugaacccucccaccacccucugcgcuuucccuagagcaguuuagagaggcugacaaaggucugcacuugaaaccuccacuuccuucugccggacaucccacuuaacaccucacacagcgcaggugccggucagccuugaacuuccucuccacugcaaagguuaccuuucugccagcugcuuccccaguucagacccuacucagagggagugaacugguauuuauugaaaugaaccccacacgagaguaaaucagagcaaaagaagcuagaguguccucagcaacauaguuuuuccuuagcugcccucugagcccuguauuucaguucagcguaaggauugccgucucuccccucaggagcuuuuaaccguugcucuccccacccucaccccagaauucuuccuggauggacuugguuuccuucguguuggcuccugcucugauguuguuguggaucaugcaucgaaggugaagcugccguggacagcaaaagacccaggagcugaaacuuaugcccguuaccgguacccgggaucacuggaccaaagucaaguggccaaacaucgccuacucuucuucaaacaccggcuacagugcaugaccgccgagugacgucugauuugggccuucacacugucaggcugggccugccuccuuguuccuuccaggauuauccaccaccaccuccaucccugugcaccccacugaugaacacccuggcuucccgauccucuccaccaaucugauuccuaacaggggcuuguccuggugacacccuuccuuucugugagcgaccagaggcccgauggagccauauccucuuccccccacagccagugccaaguccucccacaaccccauuccuauggggcaggaaauggggagguucacuuuccaagugccaaagagcccagaaggacucuaagacccucaaguggaaacacucucaccucccgaggugggcagggaaacucccaauuugcaaccccagggacaugcaccccaccccagcucuggauccagcaccguguguaccggcucccacauacccccacagaaagcacugugacuguaguucuguggggcuggugaacacacggugaaagccauuuuuacuugugucucugugguacuuuggguguggcggggcuuguggggggaugggagagcuccacguguagaugccgagacccacuccacgggcuucugguauucucggcuucauuuuauugguugcauugggguggggggagcucaaggaccguggccuuccucacacgcggacuguugggcccucucacacucuaagugcauggucagacccacaccgugcaaaucuuugggccaguagguuucuggagaagaaaaguggacaguuagggaauauuggguaccauauucccugagaccuaccaguaaucugguagcaugucaccccuuuggaaaccuuaguucaguucuccacccuugguaaagggugccccagacucuuuuuuuuuaauauuuauuuuuauuauuguauauuauuaauauaauauauaauauuauucuacugua

SEQ ID NO: 5786 - RNA, 7565 nt, Mus musculus
ggagccgggcaggggggcggauucggcaguagcaacuccccggacgcacgcaggccucagagccccccagcuuccguggccccucggcccugaaacuugaagcaggguagggguccagcaugaagcccccggaccgccccaccccuggccgcacugaccggauacugggggucauggguggcaugcugcgcgcaugcgccguacccgggcaggaggggguaaggaggagggaccgcggguggggucgggggggucuuuagaggacuuuaggagaauugcacuccacgacucaguuuccccgcaaacaaaaguuauauggagcagucgcaaggauccauaaauucaguuacgagggccauaugccaaguucugguugacgcuuucagaguaauguguauuuugacaggagggagagaagaagggggaggucguggcagccuaggaaaggguccuuacagugacucugucucggcagcccccggagagagaucccuuagggccugggaguaccaagacagagagugauuguaucgaggaggaucagacagggcagcgcgaaccugagguccucgccugggcuccgcagcccgguaagaagcugggcuuggguggggcacaauuugccauccugcgcaaaguggugacuucagauagauucuguucauauuagcauaaaggcuugcgccuaauuugcaugggaccauuaaaucgcagacaccacgcuucucuucuagcccgauguguguccucacuucggcgggucccgagcccccgaaggcggaguggaguguccccgcgccccaccccuggcccugggccagcccaggcgcccggacuucgccuuaauuggugauuaguuuuagcuggaguucuggggccuggaggaaagaugggucgggggagagggcggcaccugggcuguguucccuacaaaguguuccccaggcacacaagcccuacucggggcaugggggugagggguggcgggggagacagccagaaccucagaaccauucacacacaacaaggccccauccugcgaauucuucaucuuagaguccaaggggcgagcaaggcagacccaccuccagccuucacgcccacccaacccagagccccgcaguugcagcugggaugcuagagggagcccaggccugggaggaggggcggaggucuggggacccggacugcaagcguggaggugccugggggagggggcuggggaagcgcggaggggcggagccuggccgcagaggccccgccccacggcagcaccguggcccggccuguuauuccgcucgccgcucggcccggacccgcgcggcuccaguggcucugggaaucggcccccgcaccucccugcccgggccuagagccaccccuaagccgaggccggagacggagcuggagcggcugucgcaucccggccgggccucccccaucaccccuuccucuggcuggacaucuggacccugggccccgcaccgccgggguuccggaaacccuccccgcccaacuccgcggcccagccccgcacggcccucccuccagacuccccugccucgacuuccgucuacuccuggacccccgccucccauccuuuuucucccccccucuccaagccuggaccccggagggagggaggggggugugcgcccugcgcccgccccgccccgccccccgugauucccccugcauggccggcccggguggggggugcggggggccccgggcgccaugcgggggggucacaaagggggucgcugugccuguccccgugugauucgaaaagugcuggcaaaaugcggcugcugcuucucccgggggggacguggugagugcgaggucugagggggccagcauugagcuugagcugggguuagggcaucugcuuacucuagcccuagggcuuuagggcuggagcauguacggguguuuuccagaaaaaaaaugauuuaacagagaauaucuaagguccuuuuccacuucuagauuccugcugauucaaguugaggaaguugaggaagggucagaggacccauuucuuuccuuuagucagcuagccaggagggaaaauucucuggugaucgccugaugcccagaaccuugugucucagaucacacuggcugaauaucuuccgaaaagggagcagaggaauggugggcuggggguggggcgagggguaucuaccuaccuguaaaggguuuuauaagaacucacauugcagcucuucccaauugcuggccaaagauagccccgcugagcuguccucacugcccccuggguuggguaugugcaugcgcuggagaggggggcuguccaaaacaauauauauaguaauuacuggagugggaggagaggggcuggagguggcagacagccucguucuuuuguucucaccccucuccgggagaauggucuguaccuauugcaagggggaguguuguagggaagcagauggcuacccccaguuuccagugucugcccagauggcugcccccacccgcauaucugugcuaugcucaggauauggggaaccuucacauggaacuggaggagcacgggccugggagcuuacugucccuccuccccagagugccuuugcaaagauuucuauccuggccaacccaaaggaggguggcaaaugaggggacccugggagacgggcugaacaucauggagaggacaacauggggguuccccuaggacucccgagguggggggcagaguccauccacucaugucguuuuccucccaucagaauccuauucuauugccgucagugaggggagcaugucagcgucugcugucucggggcuggcugcccugucuggccccagcucuggccucagcucugauccguguucuccgauucccccuggaccaguaacuggccugaggagaugguuggaucauuccaaacauugucucaguguggaaacugaggcagagaguggucagaccggacaaugugaggugagcagggagucccacagaagaaggacccugggaaagagugcagguuggggucacuggcccuuggggaacccaucuacuguugaccaccucagucacuggcucugucugcccuugaucucucucuguccagaacuggacgcuggagccaacuuuaaccacaggacaagagcugcccgaacugaccuuacugacuacauugcuggaggguccuggagacaaggcacaggugaagaaauagaacugggcgugugacaggcaccuguuuaggccagccucagcuacagaucaagucccaugcucucuugugcuguaugaaaucacguuucaaaaucaaucagugagggaccagaggcauggcucaguggcuaaggauacugcccacucuuccagagggcccaaccucaguucuuagcauccaugucacaugauucacaacuaccaguaucuccagcucuaaaccaccagcacccucuucuggucucuguggguaucuacacauggccccccauaauguaaaaaugguaauaaucaucauaaucauaauaauaaauuucaaucccagcacuccagaggcagaggcaggaggaugucuguagguucaaggucagcaaguuccaggacagccagaacuacauagacucuaucuauguagaugauguaccuauguagacccuacaaacaaguccuuuuuuuuuuaauuuuuuauuuuguuucgagacaggguuucucuguguagcccuggcuguucuggaacucacucuguagaccaggcuggccucgaacucagaaauccaccugcucucugccucccaagugcugggauuaaaggccugccccaccacaacccggcuacaaacaggucuuaaaaccaucaaaagaauagaucugagaagguucuuagugaaagguauucaauccucuguuuguccacuuccuaccuuccagccagcugaagaggaaacuuugucccaagcucccaagaaugaggaagagcagaagaagauggcucuggaaaggaguauguaaguucacagggcacuucgguugaacuuccccaagaucccucacauuuuacugcccucugagagggcuguggugauguucuuuuagugcaagaagaacaggcuaaacuaaggauguagccacacucuaaagugaaggcaugcugugcucucuagguuuguccugggugagcugguggaaacagaaagaacauauguggacgacuugggacagaucguagagguaguucucgcuucuccucccgagccguggcccacugacccuuucccucugccuggggauauuuuucagauaggucgcucccucuggucacuuuacagauucccucuacuucuggacuuugugcagggccgaccugaggcugagcuuacguaaucauagucccaucucguccuucccacaggguuacauggcuaccauggcuacucaggggguaccugagagucuccgaggucgugacaggauuguguuugggaacauucagcagaucuaugaguggcaccgagagugagugauggagcccugagccaggcgcaggggaagagcgcucucugguagucuauccuagacuccguauuggaaccauggguccgaugugauucaaggagccacugggguuuuguagggagagcgacuagggcguguagcugaaagucugggacguuuggaggugagcgcucugaggagugugugaggugcuucucucccucucacaacucuuccagcuacuuccugcaggagcugcagcaguguuugaaagaucccgauugguuggcucagcuguucaucaaacaugugaggcugggccuuaacaggggaagaagggcuuggggugagucuggguucuguggagaugggcucucuuuugucaccacccacccccacuuucuucaacgugaucccugcuaggagcgccgacugcauauguaugugguguacugccagaauaaacccaagucagagcaugugcugucagaguuuggggacagcuacuuugaggucaguggcugaggugccuugggggaaagaagaacaggaucagcgugaauagacuuuucaggcuacaugacugcccugucccugucccugucccuguccccaggagcugaggcagcagcugggacaccgacugcagcucaaugaccuccucauuaaaccagugcagcgaaucaugaaauaccaguugcugcugaaggucaggaccaccuuagucccuggggacauggcuggggacaggaccacccuucuccaugggggcaaaacuacccuugucucuggggggcagagcugggaacaggaucacccuucucccuggggauacagcuggcuggggacgggcucuacagagcuuucuucuuuauguuauaggauuuucuaaaguauuacagaagagcugggaaggauacugaagagcuggaggugagguccccaggacacuguaucugccucauccucuucaucuuguggguaccacagucucagggugguucagggaugucugcuuucagggagaggcccccgggguggggauucuuggagaggcucucucaaaaggagcuucccugccaguaacgaaucuguccaaugacgccucucuucaccugugucccagcaagcuguggaggucauguguuucguaccuaagcgaugcaaugauaugaugucccuggggagacuucggggauuugagguacgggaauggggcggggcagagcagugaacugcgcuugagcucaggucuuaguagucuggauccuuaugaggaauuaccuccuugggcguguuggcgugggggaggggagagaagcugaugauucucuuuucaaacucuuguugcgccuucucagaggccauguccuucgguuccagggaaaacugacugcucaggggaagcucuugggccaggacacauucuugguuacagagccugaagcugggggucugcuuucuucccggggucgggagaggcgugucuuccuguucgagcaaaucaucaucuucagugaggcccugggaggaggaggccgagguggcgcgcagccuggcuacguguacaagaacagcaucaagguggggcggggcauauagagggagccgaccgagggggaagguggggcggggcaguauggagaaagcagccccgauggggcggggcauauggagggagcggaccggauggcgcgaggcucaggcuuuuggggcugguggaagggcuugcagaaucugagagcugucucugauugccaauccaggugagcugccuagggcuggaggggaaucuccaaggcaacccuugccgguuugcgcugaccucuagagggccagaaggugggauccagcgcuacguucugcaggcuucagacccugcugucagucaagccuggauaaagcaaguggcccagauccuggaaagccagcgugacuuucucaacggugaagcucccauccucucccuucagaggcucccaaagcuaucugaccuccugaaccccuuccccagccacgcagucuccaacccuugcuucuuugagccuaacuucucuccauccuacacccacccgaaacccucuaaaguuccaagcaccuuacauuggccaaaugaggaagaaggugaggcagggaaagugaucggucucuucuguaauacaucucuguuccuucccuuggcccagcauuacagucacccauugaauaccagagacgugagagccagaccaauagccuggggcgaccaggagggccuuggguagggagcccugggagaaugcggccuggagaccuggcccaggccagcaugcacacacccaucaauggcucucucccuucccugcuacuucugcccagaggggagguguccagagugcuguugccccuggauacacagguauggggaauaguuuccuacuagggcagaaaguggagggcguuugucuccacccccaccccauuuccuuauuccaccacuauccuuuugugugacuuuccaaauuuucauucuuacuuuccuuucuuuccuucuggggcaagaggaaucuuuagggucuuuaacuggagagaggaaugagggaaggcugguagcccuggcugacccucugacugguaacccuggcugacccucugacuugaaucuuccuucaggcucucagugauaccccccagacuccucaugacucuccagcccuucccacugugaacacuccucccugucaggccaggcucgccaagcuggaugaagaugagcuguaaccccaaaagugcagugcuauuggcgcaggcaugauuccucaaugaauuuggagggggaauccuggaaaugugccagaauccauccuccaugauguauagaggaugggagagacugggccugaaaggacucuuuucugcccaagggacacaggauccgucaguuccacucccugcaugcaccacgacccacucaaauggaggauauggaggagcuuggagggaggaugagggcagggaccagauagaaauuauuggccuggguugugauuuuguuuucgaguuuucuugugaauaaaaguuuugcuauaucacugag

SEQ ID NO: 5787 - RNA, 5353 nt, Mus musculus
auagaguugcauauuucacuuuauuuuuauuaaauuaaaagcuacagucuggcagcaauuccagauuuggggggggggggcggugaggaggcuccuuauaggggcagagaagagcgagagacagacugacaaagacagacacgggagagaaaggguccguuaagguaggacuacuguuaucuuaacacacagcuggcugggggaggcagcuaauaucaguccaaggugagacaguauucaggggcuggaguuccagagaccccauccuuccuacccagguccuuucucagcuuagucacuggagcacgguacauaccaggaaaagccaaggacacuggagaagcaggggcagagaaaauauguacacggagugaggggacgggagccuuggaaaacagccucugcuggagcacuuggccagugggggggcaggggaagggaccauguccucuuccccucugaguucccaccccagucagacauauccccucaaggauggugugggggcagagagaggcggggggagcagaggcuuccguuggauccuaguagaggacagcggggggccuuggcaaaggagcugucccucagucgucugugauacccuuggcucucaguuccucuugcacccuagucagguagguuggguccggauacccaaaccuggggcaaagagaaaugaggaucagaguuagucguuuggacuugaucguccuuacccacccucauuuugaguggcucaguuggggccaaauucagaccccucccacuucccaugaggagggaccuccaaaaccaagauaacccagccagaauaugcuuuuuggguggggaggggagguguuaagcugaacgcgucaggaccaggaugaaaacagacugagaggguggauggcucccccaaauuagaaauggugaaagggagacgccauggagagggagaugaggaggagucgcacagcuggggucccccugugcagcuggucuugugguggaugucguuccaagugaugacauugggucucccuguagucauggacgugccgauggugaaggugaggcgcuggucaaaugccuuucggaacagggucagcaccuuguugcccucggggcaguccgggagguaggccacccgugugguaccaggguaccgaacuccuggguugggguguucagccugagaggaagaggaggcagagagcagcuggcugucucaagggccuggacaccagcgaggggucugucagucugcccugccuuuuguccgugcauucccagcagacugacagagagacuuccagggaccggaugacuuuggagccugggcaggaagaggcuguuucuagacucaauccuuaucuuuaaucccucacaucucaagucagggacaaauggacguucagaagugauggcaguuacuuuccagauaagucagcacagcugcaacaacuaagaaagauuguaucuuuucccauucccuccuuuuccuaaaauacuacugccucugccucuugucuccaauuucuucuucuucaggguuucucuguuccugugaaucaacuggacaugacucuuuguccagccggaagacaucugccuucagcucuuauugucauauaguuugcaacagagcagcacucccagugguuagcgcagccagguucccuuccuguugugcugugccuuccuuccuucaccugggcuuugccuccacaaagagucugacacauccacucaagucaggguacuagugggcaacccuuucucucaugacugguuucagguuuuuuuuuuuguuguuuuuuuuuguuuuuugguuuuuuuuuuuuuuuuuuuuuuuuuuuuuuuuuuuuuuuuuuuuugguuuuuugagacaggguuucucuguguaucacuggcuguucuggaacucacucuguagaccaggcuggccucgaacucagaaauccaccugcuucuuccucucaagugcugggauuaaaggugugcaccaccaccacugccuggccacaccugaguuuuacaucugccugugggucaugccaauaaaacaguggggccucaaggagauggccccuccccaacagcuccagaacauaaguccuaaggcaugcugggagacagcaagagucuaacaugucuaacaacauacucucuacauugccuuuuuuucuuaagucaagagacagugaacuuggaggaagccaacggguaggaacugugaucucuuacccccuggacgccaggcgggaagacauauuggaugacaauggugccauacuucucguagcugggcagcaggaggguggcauccuuggagaccagcauccguccguucuggggcugguugcccacaagcugcccguagaaucggccgcacauggggcaggccuuuuucaccugcagggcccgugugaugcagcccucacagaaggagugccugcacuucuccagcgucuuggcauucuguaucucccccaggcaaauggggcaggugguuuccugcucuucagcguccucucugagacgaggagggaguggagggggcaggggaggaggaggaggggguagcccucuugccccugggggcaggaguggggcugcucggaggggaggagggccugggcggugcagcucgggguguuccccuccaccccccaaagccaggcagcccaugagcucccccugccucugggcuuucuuuagcucuuucucugccucuuucaguagccccuugagagccuuccuggccagguagagcccauugggaggggcugggggaggacccuguggggacagcuggagcacguagaugucagaagucucgccaucuaugaggauggacacccgaugcuccucccgaagccgggccagccgggcuggggucuccuugcucaggaagucccacacaggcuuggagacagucacuuuguucuugcaggagccuccacaggcugccauucuggacaggacgaacgacacugcccccagggugaaagggacucagaguggggaguccccauuugacagauaaaugugccucuuacuucaggcuccuucugaacccccuguguuaccucuguuucccucaaagccaacccccaacacugcccacaaaccgguugguuuucuaucuccacuucugucccauagcccagcacccucugggcacagguuuccauauuucaucguuaucuaagccaagcaccagcccugcuugcuucuuucauuucuccccugagcacaacaaccugccccuucuccccaagauggaaaaaaaaaaagguuccuccaagggaaggaggcuccccaccccuaccccaccccaucccaccuccguuugcuuugcucacuuugauccggaggagcuuagaauuggcaugcaggcucacucuccuuucccccugauaccuggagauccuguggccugguggaaugggaaagaaaagaaaguaagggggcuggagagauagcucggugguuaagagcacugacuacacuucuagagguccugaguucaaaucccagcaacuacaugguggcucacaaccaucuguaaugggaucugaugcccucuucuggugugucugaagacaacaaaaguguacuuauaauaaauaaauaaauaaauagauagauagauagauagauagauaaauaaaucuuuaaaaaaaaaaaaagcugggcagugguggcgcuugccuuuaaucccagcauugggaggcagaggcaggcggauuucugaguuugaggccagccuggucuaccaagugaguuccaggacagccagggcuacacagagaaacccugucucaaaaaaaaaaaaaaaaaagaaaagaaaagaaaagaaaaaaaacaggaggaggaggaggaggaggaggaggaggaggaaggaaaacuauuccccaaccccaaagccccaacucaggagcccuugaaauggccaggaaccugggguagggguacuggaaauggggauuucuuggaauacaggaggaacccgaaagcugagguucuccuggggcacggguaccugaaaagaccacagagacgaagguagcagaagucccuccaccuccaccuucagcuggccagagcuggagacgaggaagguaaagaguuaugauagcauuuccucagccagcccagacagaaaacgcucuucuaguuccucuccuccccugcagaauccucuccaaguugcucaaggaacuucaucaggcuaauuccucuuuuccccccagugcagagggagauccuagaugcagauaaagacaggaaggagaaaaaaaaaaagggccucacaggaugaaggucguacacgccaccucccucagauuacacugacagaaauaucuccuaaacuccucgcuuuacguucucgaauaguucaagucccuguuguugacagagaccuuuccuugagagccggaagucuguuagggaugccagcaaaguguuagcagucccgcaauaacaaaguucucauugucaccuuuaaacccagugcccgcagagcugcugucagcugcaaaucaagcaggagcuuggcuagagggacccgagguuuuccccugagcccugucacagcccagcuccagggccuuucccacaacacaaagugcagcucaauuaggaagaggggccauucaugugaccucaauuccuugugauccaaaaagaagccucuguccguuugugccuccaucauaggguccuugagaugaaaaccuaagcaucucaacccgcauggucugugcacggugaaaugcccccuccccaccagagagaacccaggaucuagguguccuagcuccaaguccugcuggcacggcacagggaggcggggccacaguuuagucugggucuagcauuccucuggggcaaaccaggccggacaccagaccagccucuuccuccagacagcggccgcuggcagggacggcgagaaagggcaaggguccccuggggagguguccacugaggcaccccccacccuucuccccgagacugcccccggauccauccaacccgaaaccaacucccgcaucccuacucgaggaagccccggagucccgccgcuuggugaggguguguguccacccgacugcggcccucagaacccccaaauggaggccagggcugaaggugcgggaaagaugaugggcccgggccccgagggcgcccucuucucccgcggcgcgcgcguggggguccaauggcggaggagggggcggagggaagcggggggcuugugagggugcggacccggccugggggggcacgcggugggugugggggcgccgggcucaccuaccucucgucagcgccgccauugccggucacaugacug

SEQ ID NO: 5788 - RNA, 887 nt, Mus musculus
uccuccccgagcugaaggaagcagucugggugacagggcgccuuguuaugagagggaaaguuuggaagccgucagugugcggcgggagcgauggugagguuggugagggguacuugcaggucuaagggccgucccuacaugucagggaaugcuucuuguuguuaauuggaagccagugggggauuaugaauccccuuuucgucggcuugagaggaccaggaguucucaggauccuggaggaagacagagcucuggcuccagccucuuuggagguccaaaugaauuagauccgagauuguuggauggagugggcauggggggauuucagcuggcacuacccugccaggcaguugggcaauugcuuggugaccuguggggcaaucuguacuuuuuauaugaucuuccugggggagggcacagcaguggccagacacugggaaacuuccuaguggccuggcauuaugggaauuugcccacacuccuagcugaagucuucugugccuagacaaagggaacuaggccuucauaugucaagaaauuagggaaugguuuugugguccuugggaguugaggugcugaacuccucuggucucuagggacugggcuuggaggggaccguuguggacauggccagcagauccugagguccuuacaggcgcuacgucauguuauuuaugguccuuuccuugagugcucugggcugugguguuucuugaguugguagacugagaggcccuucucuuuccuuguauugcaggugugggcuaagcugguggccccggcuuuagacuggaucccacaauguuugcagagauguucagguagccauggugguaugacagaacucucccucagguacccagcccgguguaagcguccucgugccc

SEQ ID NO: 5789 - RNA, 5697 nt, Mus musculus
caggaggggccggacagcauaaaggauacucgcucuccgcucuugaggucaguuaucuugagccuaacacgucgauuauaucauguugaagaugagcggguggcagcgacagagccagaauaacagccggaaccugaggagagaggcgaguacuggcuccgucuaacccuuaccuucccauccuggccagcauagcuauuuuauaaaguuggagacaacuguucuggaggauguagccccaccccuuccacuguaagcuuguagacugggaagggugaaggccgggaaucccugauucaggaauggugcuuacaggcccucucuugcauugggcgauugcauucccguucccuugucucgaguugguccccacucugcagagggacuccgguugccuucgggaacuugucucuguagugcgaacugcgggccagcuuaggccugggcaguucgcaggaaaggcggggcagcaggacacacccccaaagucggggacucuggcugucucagccuuuucuucaccagccucauuccccccaacucuuucaagcugaagcgccucagucaaggggccaacauggccacguuaguagcugacucucaaguucaagagaacgcgaagacugacagaucuuugcgagugggggugcuggugggaggagcauagauggguuuuucccuuuuccccagagguuucuagguuuccauacaagagagcagccuggaucucuuuaacuaugggaaauuauuugggaucucuccagggucuucugcuucucccagggcugauugaucucugcuucuuuccucagucccgucuccuaacuaaacuguguaaccauugcgucaggccagcccacuguuugucucugcacccucaggccuggggcuccucugcugaugaaagccaggucccacacacuggaagaccaagggaguuuucccuagaggacaacccugcagagaaacacucagggcaauauugcaucugcaguccccagagacagccagcuccgcucugccuuuaggcucagugggcuuaauucucuauaagggaacuugggggaggggcuuuuuccccauucauuccuaacaaaugccuaauaagcacccacuauguaccaaguaucuggggacccaggguauauuaggagcaaaagauaaaacuguucucaauaaaacuuacauuucaguauaaagcaaaagggaaaaaaaaaacaaaagcagggcagaauaguucagggcggugacuagagguugucaucagaagccaagccugugagccaagccccgguguuagagcuuuauagaagggagaggcugagcaacagaguuaagauaagcaugccaugccgguaucuuuaggaacaggacuagaguaagcaggagagggugaugaaaggaaacucaagcagccggucucauagagccuugcaagcacccucaugaugcuaaucuuuaacaaucaugaaacaggaagccauugggggaucugagcagaggaaugaucauagcacaugcauuuaauuccagcacucagagaggcagaucucugagcuccaggccagccagggcuacauuaugagacccugacucaaaauaaauacaaaaacaaaggguuagguauguagcucaauaguacacugcuugccugguauguagaggacccuaggucaacccacagccgugaaaauaaaguaaaagacaagaauagaaacaggaggucucagcugaacauaguggcacagccuuuaaucccagcacuugaaaggcaggcagaucuaaauucaaagccagagagucuacaaagcaaguuccaggacagcaaaagcuacauagugagacccugucuaaaagagaaagaaaggaaaggaaaggaagaaagaaaggagagauuucaaagaggcuuccaaaauaauccagggaaagaaauguaugguaaauuuauaucuggagccaggcagugguggugcacgccuuuaaucccagcauuugggagacagagacaggcggauuucugaauucgaggccagccuuguccacagugaguuccaggacagccaaggcuacacagagaaacccugucaagaaaaaccaaaaaaauaaauaaaugaaaaauaaaaaauugcaucuggaaauaauguaguaaugagaaauacuuagguuugggguacuuuuaaaguugucagugcuuuaggcugagcugugguaucugagaaaggggcaucaaggauaccaaaguuuuuggcuuucagcaccuagaguugccauuuaguaagaacuauacagccuugguaggaaaggccuuucauguaagcugaacgccugcucaacacugccaaggagcuggagaucccagagcaggucugcacugaggcugccaguggggggauggaaucugagcaagcacugcugaguuuacucuuccuucccucuaguucugucucccuuuggcggacuugaggucuaucugggauuuagagaaaacuuaguuggccaggacuuugcuauuauguaaucaagacggcaaaugucagcaacuaaaaauaaaguuaagccugccucuguccuuggaguuggcuucagggacacacacgcugcaagacacacgccuguguguguguguguauuacaagagaagaaauggcuucagggacacacccgcugcaagacacacacaccucuguauguguguguguguauuacaagagaagaacuggagccuggucugcagaguuguugaguuccagaauuccaggaugcccagggaugcacaaagaaaccaucucacaacccauuuuagaaaggaucuagaaaagggcuaggaggaguuagaaaggaucuagagaggggcuaggaggaguuagaaaggaucuagagaggggcuaggaggaguuagaaaggaucuagagaagggcuaggaggaggcuggagguaaaggacuguuuuuuccuuuucuccacaguguuccagaaggaagugcaucuucauacaccaccacaccugaaagcagguaaucuuggccacccucucagucagcugcgaaugcugcucauguugcuuugcugggggagaguuagacaaggccuucaucugaacaagcuuuugcugucagaccaugucuuucucugaccccauaauguuguuugagagcuggcuuucgaagucagccucaacaauggcaauugguuugucuucccaacucucaguccacaccaagauuagacccaaaggaccuuuugcccaagcuucccacacgagagaaaaaaagaguacaaauggccugguaauugccccuggaaauuaccaguaguguucccaagagaguugaauacuuuuacuguaauccuguaagaauauauauguauagccaagcccagugacuguuccucucucagaacuugagaggauccugaaguuaucuguaguaaauccuucucaauaaaggguauguucuaucagguguaguggugcauaccuuuagucccagcacuugggaggcagaggaagguaaaugucugagucaaagccagccuauuuugcagagugaguuccagggaagccagaacuauauauacagagaaacccuuucuugaaaauacaccccccacccuccaaguuuuguuuccaggagcuagagagaugacucagugguuaagagcacgugcucuucuuguagaggaucuagucuaacucccaguacccaaauggcaguucaaaaccaucuaugacucuaguucccagggaauccauucccucuuguggccuccaugucuaccaggaacacacacacagcacacauucaggcacucacuuauauaugcauagauaauaaaauaaauauaucuuugggaaaaaaaaaaagauauuuaagguuagguagccagccuggauuaagcuugguagugaccagcauauaaaugaaaacaaaacaaaaaguuggaaagcuguguggggguggugcauacuuuuaaucccagccuucaggaggcugaggcagguugaucucugaggccagugugaguucuaggacaggcagggcuacacagagagacccugucuugaacaaacaccaaaaagaauggcaaugagagcccggagaaagccuaucaguuccacacccaugcugccugugugccguaccugagucagguuuccagcagccacagaagguggcucacauggccuggaccuccagcuccaggagagccaaugaaugcugcuggcccccagacacugaauuacauccguuucaggguccuggccauggugugcaugugaucaucuggacaacuuuugagaguuggaucuggcagggucaaagucaaggcugcuaggcuugagaggcagccaucuccccaucccgacacaccaucauuagugugugugcaggucagagaacaacuugugcgaguugacucuucaccuccacccucugccaauguagccuucaaggagugacaacccaugcccuuaccuaucgugcaagaccaguaaauuuuaaauucuacguguuagaaaagggacaaggucagcucaccgacuguggugaauggaauguauguccuuuccagaaccugguccacgugcagucauggcagcugagucccugccuuucaccuuggagacgguguccagcugggagcuggaagccugguaugaggaucugcaggagguccuguccucagaugaaauugggggcaccuauaucucauccccaggaaacgaagaggugagugagaaugcugguccuaggaugggcgagcagagugauggugugggugccuauagccccagugcuugucaaguauaggcaagaggcucaguucauggccagccuaagcuagaguuugaauguagccuauacaagacccugucucaaaaaccaagcaaaaguaaaaccccaggaaacuggggguuuguaugccucuccugaacuaauuaauaucuaucuccccuucuucauuuccuuaaaggaagaaucaaaaaccuucacuacucuugacccugcgucccuagcuuggcugacagaggagccagggccaacagaggucacacgcacaucccaaagcccucgcucuccagauuccagucagaguucuauggcccaggaggaagaggaggaagagcaaggaagaacuaggaaacggaaacagaguggucagugcccagcccggccugggaagcaacgcaugaaggagaaggagcaggagaacgagcggaaaguggcacagcuagcugaagagaacgagcggcucaagcaggaaaucgagcgccugaccagggagguggagaccacacggcgggcucugaucgaccgcauggucagccugcaccaagcaugaacagugggcaucaccuccugucugucucuccggaaguguacccagcaccaucgcgccagcgccaagcaugugacccugcacugcacugcacaugcugaggaggggacugaggguagaccaggagagggcucggcuugcacauagacgguacauuguuuauuacuguccauguccaguaaagugacuuugugucaacagccucucacuuuuucuucuugccuuuaggaguuucaauggguuuccccucagccaaagccaacuguuucuuuagauccaagaguuuagccaccucugcagcaaccugguucuugucugccuucugugcuuucaguucccggacgacguugcccua

SEQ ID NO: 5790 - RNA, 5697 nt, Mus musculus
uagggcaacgucguccgggaacugaaagcacagaaggcagacaagaaccagguugcugcagagguggcuaaacucuuggaucuaaagaaacaguuggcuuuggcugaggggaaacccauugaaacuccuaaaggcaagaagaaaaagugagaggcuguugacacaaagucacuuuacuggacauggacaguaauaaacaauguaccgucuaugugcaagccgagcccucuccuggucuacccucaguccccuccucagcaugugcagugcagugcagggucacaugcuuggcgcuggcgcgauggugcuggguacacuuccggagagacagacaggaggugaugcccacuguucaugcuuggugcaggcugaccaugcggucgaucagagcccgccguguggucuccaccucccuggucaggcgcucgauuuccugcuugagccgcucguucucuucagcuagcugugccacuuuccgcucguucuccugcuccuucuccuucaugcguugcuucccaggccgggcugggcacugaccacucuguuuccguuuccuaguucuuccuugcucuuccuccucuuccuccugggccauagaacucugacuggaaucuggagagcgagggcuuugggaugugcgugugaccucuguuggcccuggcuccucugucagccaagcuagggacgcagggucaagaguagugaagguuuuugauucuuccuuuaaggaaaugaagaaggggagauagauauuaauuaguucaggagaggcauacaaacccccaguuuccugggguuuuacuuuugcuugguuuuugagacagggucuuguauaggcuacauucaaacucuagcuuaggcuggccaugaacugagccucuugccuauacuugacaagcacuggggcuauaggcacccacaccaucacucugcucgcccauccuaggaccagcauucucacucaccucuucguuuccuggggaugagauauaggugcccccaauuucaucugaggacaggaccuccugcagauccucauaccaggcuuccagcucccagcuggacaccgucuccaaggugaaaggcagggacucagcugccaugacugcacguggaccagguucuggaaaggacauacauuccauucaccacagucggugagcugaccuugucccuuuucuaacacguagaauuuaaaauuuacuggucuugcacgauagguaagggcauggguugucacuccuugaaggcuacauuggcagaggguggaggugaagagucaacucgcacaaguuguucucugaccugcacacacacuaaugauggugugucgggauggggagauggcugccucucaagccuagcagccuugacuuugacccugccagauccaacucucaaaaguuguccagaugaucacaugcacaccauggccaggacccugaaacggauguaauucagugucugggggccagcagcauucauuggcucuccuggagcuggagguccaggccaugugagccaccuucuguggcugcuggaaaccugacucagguacggcacacaggcagcauggguguggaacugauaggcuuucuccgggcucucauugccauucuuuuugguguuuguucaagacagggucucucuguguagcccugccuguccuagaacucacacuggccucagagaucaaccugccucagccuccugaaggcugggauuaaaaguaugcaccacccccacacagcuuuccaacuuuuuguuuuguuuucauuuauaugcuggucacuaccaagcuuaauccaggcuggcuaccuaaccuuaaauaucuuuuuuuuuuucccaaagauauauuuauuuuauuaucuaugcauauauaagugagugccugaaugugugcuguguguguguuccugguagacauggaggccacaagagggaauggauucccugggaacuagagucauagaugguuuugaacugccauuuggguacugggaguuagacuagauccucuacaagaagagcacgugcucuuaaccacugagucaucucucuagcuccuggaaacaaaacuuggagggugggggguguauuuucaagaaaggguuucucuguauauauaguucuggcuucccuggaacucacucugcaaaauaggcuggcuuugacucagacauuuaccuuccucugccucccaagugcugggacuaaagguaugcaccacuacaccugauagaacauacccuuuauugagaaggauuuacuacagauaacuucaggauccucucaaguucugagagaggaacagucacugggcuuggcuauacauauauauucuuacaggauuacaguaaaaguauucaacucucuugggaacacuacugguaauuuccaggggcaauuaccaggccauuuguacucuuuuuuucucucgugugggaagcuugggcaaaagguccuuugggucuaaucuugguguggacugagaguugggaagacaaaccaauugccauuguugaggcugacuucgaaagccagcucucaaacaacauuauggggucagagaaagacauggucugacagcaaaagcuuguucagaugaaggccuugucuaacucucccccagcaaagcaacaugagcagcauucgcagcugacugagaggguggccaagauuaccugcuuucagguguggugguguaugaagaugcacuuccuucuggaacacuguggagaaaaggaaaaaacaguccuuuaccuccagccuccuccuagcccuucucuagauccuuucuaacuccuccuagccccucucuagauccuuucuaacuccuccuagccccucucuagauccuuucuaacuccuccuagcccuuuucuagauccuuucuaaaauggguugugagaugguuucuuugugcaucccugggcauccuggaauucuggaacucaacaacucugcagaccaggcuccaguucuucucuuguaauacacacacacacauacagaggugugugugucuugcagcgggugugucccugaagccauuucuucucuuguaauacacacacacacacaggcgugugucuugcagcgugugugucccugaagccaacuccaaggacagaggcaggcuuaacuuuauuuuuaguugcugacauuugccgucuugauuacauaauagcaaaguccuggccaacuaaguuuucucuaaaucccagauagaccucaaguccgccaaagggagacagaacuagagggaaggaagaguaaacucagcagugcuugcucagauuccauccccccacuggcagccucagugcagaccugcucugggaucuccagcuccuuggcaguguugagcaggcguucagcuuacaugaaaggccuuuccuaccaaggcuguauaguucuuacuaaauggcaacucuaggugcugaaagccaaaaacuuugguauccuugaugccccuuucucagauaccacagcucagccuaaagcacugacaacuuuaaaaguaccccaaaccuaaguauuucucauuacuacauuauuuccagaugcaauuuuuuauuuuucauuuauuuauuuuuuugguuuuucuugacaggguuucucuguguagccuuggcuguccuggaacucacuguggacaaggcuggccucgaauucagaaauccgccugucucugucucccaaaugcugggauuaaaggcgugcaccaccacugccuggcuccagauauaaauuuaccauacauuucuuucccuggauuauuuuggaagccucuuugaaaucucuccuuucuuucuuccuuuccuuuccuuucuuucucuuuuagacagggucucacuauguagcuuuugcuguccuggaacuugcuuuguagacucucuggcuuugaauuuagaucugccugccuuucaagugcugggauuaaaggcugugccacuauguucagcugagaccuccuguuucuauucuugucuuuuacuuuauuuucacggcuguggguugaccuaggguccucuacauaccaggcaagcaguguacuauugagcuacauaccuaacccuuuguuuuuguauuuauuuugagucagggucucauaauguagcccuggcuggccuggagcucagagaucugccucucugagugcuggaauuaaaugcaugugcuaugaucauuccucugcucagaucccccaauggcuuccuguuucaugauuguuaaagauuagcaucaugagggugcuugcaaggcucuaugagaccggcugcuugaguuuccuuucaucacccucuccugcuuacucuaguccuguuccuaaagauaccggcauggcaugcuuaucuuaacucuguugcucagccucucccuucuauaaagcucuaacaccggggcuuggcucacaggcuuggcuucugaugacaaccucuagucaccgcccugaacuauucugcccugcuuuuguuuuuuuuuucccuuuugcuuuauacugaaauguaaguuuuauugagaacaguuuuaucuuuugcuccuaauauacccuggguccccagauacuugguacauagugggugcuuauuaggcauuuguuaggaaugaauggggaaaaagccccucccccaaguucccuuauagagaauuaagcccacugagccuaaaggcagagcggagcuggcugucucuggggacugcagaugcaauauugcccugaguguuucucugcaggguuguccucuagggaaaacucccuuggucuuccagugugugggaccuggcuuucaucagcagaggagccccaggccugagggugcagagacaaacagugggcuggccugacgcaaugguuacacaguuuaguuaggagacgggacugaggaaagaagcagagaucaaucagcccugggagaagcagaagacccuggagagaucccaaauaauuucccauaguuaaagagauccaggcugcucucuuguauggaaaccuagaaaccucuggggaaaagggaaaaacccaucuaugcuccucccaccagcacccccacucgcaaagaucugucagucuucgcguucucuugaacuugagagucagcuacuaacguggccauguuggccccuugacugaggcgcuucagcuugaaagaguuggggggaaugaggcuggugaagaaaaggcugagacagccagaguccccgacuuuggggguguguccugcugccccgccuuuccugcgaacugcccaggccuaagcuggcccgcaguucgcacuacagagacaaguucccgaaggcaaccggagucccucugcagaguggggaccaacucgagacaagggaacgggaaugcaaucgcccaaugcaagagagggccuguaagcaccauuccugaaucagggauucccggccuucacccuucccagucuacaagcuuacaguggaagggguggggcuacauccuccagaacaguugucuccaacuuuauaaaauagcuaugcuggccaggaugggaagguaaggguuagacggagccaguacucgccucucuccucagguuccggcuguuauucuggcucugucgcugccacccgcucaucuucaacaugauauaaucgacguguuaggcucaagauaacugaccucaagagcggagagcgaguauccuuuaugcuguccggccccuccug

SEQ ID NO: 5791 - RNA, 19305 nt, Mus musculus
uguuucguaauggugcgugaugggaugaguagucggcuuuccuggagccuaccgcgagcguccggccgacacagaacuccauuucccgacgugccuugcagcuuaacccaggagcgggaggccgguuccgauugcaucagcgugggcuccgaggcacgaugagacuguucgugagcgaggguuccccggggagccugcccgugcuggcugcggccgcgagggcccggggucgggcggagcugcucaucagcaccguaggccccgaagguacuggaguggcugccggugggcggcgggugagggguguucaucucacaguuguuugccaggcuccagugcccguuccccaaucgacucaacguuaacuuuagucacgccaaccuuuguuuccguaacccuucugaaguuaguucccuuaguuacccucacuguacucuucaaaccucguuuuaagucuccccucugguuaguuuuccaggacccaccuaucauggcaacucccucucagcccggucacucucgcgaucaccuccaaccucccgugucguuuuggggaagccccuuucuccuuccaggaccucaguacagacaugugcacacucaguccuugaaguuuauugcguauucccagacaacuuuuuugggugacuuucuaagaguugucuggucagauccucccugacagcuugacugcagcacuauucuauaccucucuguagacucuaccucuuguuugcaguuggcagucucaacugaacacuagcuggccccucuagcauauuccaccaccaccccuccccgguuaguguucuuaccuucgaaacuguagauugaaaacccaggccuccagcacacaaugugacgucaaaucauuucuuuuaagauuuacuuauuuauuuaauguauauaugaguacaccguagcuguacugaugguugugagccaucaugugguugcugggaauuugaauucaggacuucugcuggcuccugucaaccccgcuugcucuggucaaccccgcuugcucaggcugcgccccgccuuauaucuaaguacacugcagcuaucuucagauuuacuggaggagggugucagaucucauuacgggugguugugagccaccaugugguugcuggaaauugaacucaggaccuucggaagggcagucagugcucuuuaacagccgagccaucucuccagccuccucauuuauuuucuuaccccugauuuucacccauuuuccucugucucagagugugugguaccauuccuuacccggccuaaggucccugucuugcagcuggauaguggcaacuaccucuucucugcuagugcaaucugccggucaguauugguucuugguguggggaggugcccaaaucagggugaaucacuaaucuuucugugaccuuauuugcaaauacuguucuacuguggguucauccaugaacuagacagaugcuucaacuuacuuucucucccugggcagauauuuuuuucuguuauguggcugggaacaagaugaucucaccaaccaguggcuggaaugggaggcaacagaacugcaggugaauccguguaucagggaggugagggcagccuguccuuccucuguaugaacauccugacccauuuccccugcauuuuagccaguucugucugcugcccuacacugucuagugguucaaggcaagaaaggggaagauauacuuggcccacuucggagaguccugacucacauugaucacagcuugagucgucaaaacuguccuuuccuggcuggggugaguugacuugaaguggggucuggaaggcuuaugauacaggacuuuguggggaaaguguauucagaccccaacaacuaauuauuagcgugguaaccuugacacauuacuuaaacccacuaauucuucauuuuuguuaucguuuuuguuuuuauuuuuggguuuuucgagacaggguuucucuguguagcccuggcuguccuggaacucacucuguagaucaggcuggaccaaaacucaagaagcaugccagguguugggaucaaaggccugugccacaacuaguccuugauuuuauuuuauuuuauuuuauuuugugaaauggaagugauaguuccugccauaguuagagcuaucuuaaggauuauguuagaaagcacacauugacucacuuaguacuuggcacauagaaagcaaaaacucugcaugguggcacacauuuguaaucccgacuuuugggagguagaaacaaaaggaucagaaguucaaagccguccuuggaugcacaggggcucaggccagcuggacaggggcucaggccagcuggacaggggcucaggccagcuggacaggggcucaggccagcuagacaaggguucaggacagcuggacaggggaucaggccagcuggacaggggcucaggccagcuagacaggggcucaggacaguuggacaggggcucaggccagcuggacaggggcucaggacagcuggacaggggcucaggacagcuggacaggggcucaggacagcuggacaggggcucaggacaggacagcuggagcuaugugacaccuuauuuaaacaaacaaacagagguauaguaacauacgagcuuaaugaaaagguggguaugguggcacaugcauugaauccgaggauucuggaggcagaggcaggcagaucucugcaaguaaggucagacuggcaaggacagccggggcaguagcaaagguuagcuaucacuauugggacauagaugaaugcuucaccugugcacuucucucuucuccaacuaggacacagaaucucuagcugacauuguuuuguggggagcacuguauccuuuacugcaagacccagcuuaccucccuggugagaauuguacauaucauuucacccccaaaccugagcacuugguacagggcuguggaacaguaggguauugaguuuucacuugaaggugcaacaugacggggaaacuguagccgaauauggccagggucacugggaaagcauggagaagccuccagagggaggagguccaccucggccugcccagucuugauccuuaauguuuguacuuuguuguuaaacccacagaggaguugggugcccugcaaaguugguuccagacacugaguacccaggaaccgugucagcgagcugcagagacggugcuaaaacagcaggguguccuggcacuucgucuguaccuccagaaacagccacagccucagcccccgccuccugaggggagaacugucagcaacgagcuggagguuuggaacugggcagggcacccucacggagccuuagggccuuagguagaaggugucugggaggcggauguugauuguggccaccuucuuaguuguuugauacccugugggcccuccucauguugauucuugguaggaagaggaacuggcuaccuugucugaggaggacaucguuacagcuguugccgcgugggagaagggucuggaaagccugccuccgcuaaagcuccagcagcauccagugugaguagacaccgagagugagguuugguuuuguuacuggaaacaguugccagguaacaaagcaggcuccucugcuuugcucauggaauguugaugccaguaagguaaagagauguuuacaauauugacaguuguguauuuaugaauuuuuauuuaaguuuuguuuauuuuauguaugugaguacacugucacugucucagacacaccagaagagggcaucagaucccauuacagaugguugugagccaccaugugguugcugggaauugaacucaggaccugcggaagagcaaucauuguucuuaacugcugagccaucucaccagcccaguaaagcacuuuuugcauaaaccuaacaaucugaaugugacccccagaacccacauagaggugggaggagaaaauggacuauacccaguugucuucugaccuccauaugugugcugagccauucuugccccacuccaaaaaucaugggguuugcuuguuuuuauuucauguguccuacuguuuuuauugcacguauguaugugcacuacaugugugcaugguuccuauggaggacacauauguaguggagaagagggcaucuggaguuacagauggcugugagccucugcaagagcagcaccccucaccuaucucugcaggucuccccacuucuaccuuugagauggacuuuagccuuggcuggccuggaacucacuguauagaccaggcuccuuuagaacucacagagcucugucagucucugccucaaagacucugccuuuaaccugcuaggguugaagauaaugugccacuaugcccacuaagagauacacuguuucccauguguguacuggcuaaccugucaccaucaccaagagauauacuguuucacucgacugaccaagagauccacuguuuuauauguucauucuggcuaagguauuuaccuauaggccagcugccuuuggcuuagccugaaauuucagcuccuugggaggcugagacaggagaauuucaagcucaagauaucuugggcaacuuacuuagacccugucuuaaaacguaaacaaauguccuggaagccacuugugucauaagcagguuagucccaguaggcaggaggaccagcagguuaggccagccuuggcuauauagugauccauccugucauuaaaaaccauccacuaaucaagcaaaaagguccagggucagugguaggguuuuugcuuagcaugcauaaggaucuagacugaaucuuuaguacugcaaaaaucaagaccauaugcaaauuacauugucuucuuacucuguguggugugugugaaagagaaugcagaugcacacauaccacccuguguguagaggucagagacaguuuugcggaagucaguuuucccuguccacguugggcugcagcggugaaguugaggaugguagacuuguguuacaagcccuuggcugccugaggugucucagcagccccggccaggcugcuuuccccuucagaccucgguuguguuuugucccuugucaacauccagucagcagucacacgccagaucccaucucaaagcuuugcccaggucugagaauuuuaaaugaagaaacuccagaaauaaucuauucugaaguagcuagcccuggcuguccuggaacuugcucugcagagcagacaggccuugaacucugagauccaucugucucagccaccacugccaaggcauccguaaguuuuaaacagcuuuuauuauagcguguuguuuauuauagcaugcuguuguauuguugcuauuuauuaauguuguuuauaagcugugccuugacugcuacagugcuagguuauagacaggccacuguaccugccgggcguuuauguagagucuggggacuccagacuccuguguucacgcuuuuacagcaagcacuuuaugcacugagccgugugguuugggccaggccaggaggagaugcuuuaggaagagaagagccaggauaggaaaggauuugguucaguucauguguggcgaugacaagcuguaaugauuucagguugugacuacagaccuaucaacacugaacuggguaagaagaggucagagcugggaagugaaugacaggcagauacauucagggagcauugugauugggaguuugugccugagaaugcgcuaaggugcugacagugaaagagggagcuguugggaugggcugcguguagugcacaaagcugccccugaagcuugcuggcugagcagagcucucuccagcgaggccagggucauacucuggcucccugggaggaaagacugugaucugaggcaccuggauugaguccuccaguguucugugcacguguuaggacauuugcaucucugcuguggacuagucucucucuucuuugucaccagguugccugugccuggagagaggaauguucucaucaccagugcccuccccuaugucaacaaugucccccaccuuggaaacaucauuggcugugugcucagugcugaugucuuugcaagguggagccagcugcuggaggaauguccuccagaggguggagugggccccgagggaaauggaugccucagagguugggacuggaguaguccccccaugaccaccaucuccuuccagguauugucgccuucgccaguggaauacccucuaucugugugguacagaugaguaugguacugcgacagagaccaaggccauggaggagggccuaaccccacgggaaaucugugacaaguaccaugccauccaugcugacaucuaccgcugguucggcauaucguucgauacuuucgggcgcacuaccacuccucagcagaccaaguagguuccucagaaugaggcagaaauggacugaaggggaggcuagguguaaggaggaugccgcaaagacaggaacagagugucugaggagggacggucgccugagcuuugguuccgagcauccggguggaaggcagaacagggacuaggguggggccugaaggaggaccuuggacgggaaggaaaaagauuuccugcuuuccuuuccguguagugcuuccucccucugguugccuaggaaucuugguuuugagacagggucacacuguguagccuaagauggucucagauuuguggcaauccuccugccucagauuuccaaagguugggaagcacagguaugugcugccaugcccagcauggaaucuguuuuuguuuguuuguuuugguuuuucgagacaggguuucuuucucuguguagcccuggcuguccuggaacucgcucuguagaccaggauggccucgaacucagaaauccgccugccucugccucccgcguggcauggaaucuuuaaaacaacuccucccucccugcuuauguguguuuguaacgcggauucguucuuccucugccugaaaaguccuuagagaagcugugggcaggcagggcaguugaugucgcugugcaccuccgcccuaacgccgaauggcucaguguaaaaugaaugcagauguaaacuccgcugucagucaccccuacaaucccagcaucugggagguggaggcagaggguuaggaguugaagugguaguuaguguuggccucaugagaccuuucucaaaacccaugaaacaaaccaaaacaccauguaaauauagagucagcagaagugagcugugaagugggaagagucuguuugggcaguuggagucaggagagcaccguggugguauccaguggguccuagcuaggaacaggcuucacugugggaggccucccccggaaugaggucucgucucugguuagagcaacagaggaaggaguccacacuggucuggcuguucuuucucacccuuugcuugcuggccuugccagaaucacccaggacaucuuccagagguugcugacccggggguuugugcugcgagauacuguggagcagcuucggugugagcggugugcacguuuccuggcugaccgcuuuguggagggugugugucccuucuguggcuaugaagaggcccgaggugaccagugugacagguguggcaagcucaucaaugccauugagcucaagguaggaggaagaacucaaggaagcccaagggaaacauuuauuaauuacuuaucaauaaaaugauuuaucaaaaagauuaugagaaaagcaaggaaggagcagauucaggcuuguucugugggagcugugggcucuggugagcguacagcuguaacuuaaagacagacucuucaggguuagaguuguaggguuaggguuguagaccaggcuggacuagaacucacaagaggucuaccugccucugucucccaagcugagauucaaaguuugcgccacuuccaccuggccaggacuuuaauguucagugccuaaaaucuugugcugauuucugucugggcaguuaugcuguaguuagcuugggcugggacagagacagguuucuuuagcaaucggccaucugaucagugcuagguggcuguccuagaauugccuguaggcuggccucugccucccgagugcugggauuaaaggcgugugccgccacgcccggcagauuauucuuuuucuguuacuuacuuugucuugucuaaauuugcuccuuuguugcuuuacucauuacuuaaguaauuaagaaaugcuggauagucaagcaggaugcuuuuuuggcuugugcuggauguguagaucagugguagaauacuuggcuaacaggaguaacacacaguaggaagaugggcguggcuagugcugucugugaacauaggcaagauucagagcuggaugcaauggcaauguuugcuuugcuaaguauggagugccugcagacuuguaaagaacagucggaaacagauguggacuucagcugagcugugcgacacucaccgugucucaccuucacaccucggucgggguuggcaagguggcugugcagauacggcacuugcuggaaacccagaccgcauacggugggaggagaaaacagacuugaucuccacauggucacacucacacacaaaauacauauaucaagacagcacccuccuagccccacgcccagguaggucaagcaagcugaguaguaaggugcuguagccgaccagugcugagugcucccugcugcauggacugagugugugaaccugagucucaggagcaggugguucagcagugugcagugugcacauaagucucuguuacagcugugugcagugugcacacacggaggccacaaucggagggaggggugugcucguucugagcugggaggcugauuggccuggacaguuucccuccucugcagccggguccuacauacucccagcaagaucacacccucuguauggaauuucucuuuacagaaaccacagugcaaaaucugccgcuccugcccuguggugagguccucacagcaccuguuucuagacuugccuaaggugagucaggcagccccugccacagccacacacugguuuucuguauuuuuauuuguguguguauaggucugucugugagugagugugugugugugcgaguacaugaggacacaugcaugugaaccugugugcuaugugugugcagcuagaagaggacagaagaggcaucagaucuggagcuggaguuaugggcaauugcacgccauccagaaugggcgcuaggaccgggacuuggauccucugaagaguauuuuuauuuccaguaaucauuuaaauagcucaaaaacacagcuaugguaggccuaguuuguccaagucacuauauuuaauaacugguacugggcaaagcuuauaccuggcacaguuguggugaccgugugcuuucaaucccagcauucucagcacuaaagaggcugaagcaccagauaggagauucaugaacuuaaagccagcuugggcaaaauaaugcuaagacuuguauuuuaaaaaauagcaaacacauuguucugaugaaacagauuagagagcacagggugagucccaagcccacuucccaggccuuucuccuucaggguuugugggcugggcuggauucgcuguuuagcugaggguggucuugaacuccugaugcuccuccuucugccucccaaguacugcgguuacagacagauagggaacgaggccuagcuguuuccaccugccauucauaguccaaacuuuuaauuccaaaauuuuuuauuuuuuuuaaagauuuauuuauuuuauuuauaugaguacacuguagcugucuucagacacaucagaagagggcaucagaucccauuacagaugguugugagccaccaugugguugcugggaauugaacucaggaccucuggaagagcaguuggugcucuuauccgcugagcugucuuuccagccccauuauuuuuauuuuuuaagauuuuuauguuauguguauggguguuugccugcacguguuccugucaccacaugccuagagugcccucagagcagucguucccaaucugugggucacaaccccuuuuggaccccaugacccuuugacagggguccgguaucagauagccugcaaaucacauguuuacauuguggcuuauaacaguagcaaaguuacaguuaugaaguaacaaugaaauaauuuuguggugggggggucacagcuugaggaacuguaugaaagggucucaggauuagaaagguugcgaaccccugccuuagagggaacugaauuggaguucagaguuauagcugguugugagcugcagugugggugcugggaaccaaacccagguccucuguaagagcagccacuucuguuaaccacaaaccuuuuuucucuaauccccuaaucucauuuuuuaaaaaaauuugauggccuuguaauaguucauuauaugcauauacuucaaauaccauacuucaucaucuaaacugugagaauuuuuauuuuuuaauuuuuuugagucaggguuucuuuguguaacccuggcuguucuaaaacucacucugucgaccaugcuggcuucaaauccacagagaugagaugugucugccucugccucccaaaugcugggauuagaaagaggcgugcuccaccacugcucaguuguuuaaacuuuuuuuuuaaaaaguuaaaauguaauuauauuacuuccccuuuuccuccaacugcucccucucauggcuuuuucuacaauuguuuauauauacaaaaacauacccccacacacacaaacacacacaccccuccugauuauauacauaagugugugccaagcauucacaaguucuuaaacuuacuuuucucaccucugccucugaggagccagaauuauaaaccacagaccacuguacucaguuuaguuucaauguuuuugcuuuuacagacagcauuucuuuacauacacaucuuaaagacucgagggaauuuuuuuuaagacaggguuacuucacuuucccggaacuggcucuguagaccaggcucaccucugcuuccgagugcuggggugggaggcgugcuccaccauagccuggcuguggauguuucuguugaaugaguuuguuaacaauuguuuagaugucccugaagccaugaaucuuuaguuuuacauauguaguccugacuuagcugugcagcgccuuacucacugaccuuggugucauccugucuggguccucuguccuguuggucuuuucuucaucucaguuggaaaagcgucuggaggacugguuggggaagacagugccuggcagugacuggacacccaaugccagguucauuauacguuccuggcuucgagauggccucaagccacgaugcaucaccagagaccucaaauggggaacgccugugcccuuggaagguuuugaggacaagguaaauaccuuuagccuuuagucauggcuuaaaacauucagucucaggauucaguucaugggcuaacugauuaaaaaauuaugauauuuccucuuagccugaaauuuuggguugguuucuguuuguaucccugcagguauuuuacgucugguuugaugcuacuauuggcuacguguccaucacagccaacuacacagaccaaugggagaaaugguggaagaacccagaacaaguaagcugguuuuggugccugucuguaggacgagguaugagguaagaggcaggcucugggcugcuccgcagggaggagaguuucaggcaaucucccaauaucuucuccuagguggaccuuuaccaguucauggccaaagacaauguucccuuccauggcuuggucuuuccguguucaguccuaggagcugaggacaacuacacccuggucaagcacaucauugcuacagguaggccuggcagagcacggcugcggguggggcuggcagagcacggcugcagguggggcuggcagagcacggcugcggguaggccuggcagagcacggcugcaggugggccuggcagagcacggcugcagguggggcuggcagagcacggcugcagguggggcuggcagagcacuguggcaugguccuagggcgugaggcccaaggcagugcgugggagagccuggagacgugcggguucucgguuaggagcugagacggggaauaguucaaacugagaacgccauccacagggggaaacuggaaagaacuggaaagcaaaaucuaaagcuaaaccuaggaguauaagcaaagagacagaggccagaacagcagcacggacuccauggccuguguaagcuccucaaggagaguuguccuuggacagucagcacuugggaaagagcagggagggaagggcgugacccgaguccuucucuucuguccagaguaccugaacuaugaggaugggaaauucucuaagagccggggcauaggaguguuuggagacauggccaaggauacaggaaucccugcugacaucuggcgauucuaucugcuauacauucggccugagggccaggacagugccuucuccuggacagacuuguugauuaaaaacaauucugagcugcucaacaaccugggcaacuucaucaacagguaggaggaacuggggagagguccacccggcagggaggcaaggaggugggauugacugccgcgcagcgcacacuaagcugugcauucuugaggcaggucagcuguagccaggugguuugauggaauuggucacaaagcaaaucuucauguguuauauucuuauugaaggucuuucuagaacugggggugcaugcucucugcacaacaaaguuagacuucagaucacuaauguguuucagugaauagggguuguuugguauuagaacugagccauaggcucacucucugcaguugcuguguuucugcuccuguagccguucuccaaaggaacaacauaggcuggagcuggagacgcagcucagugacagugucucuguagacuuaggcuggggcuggagacgcagcucagugacaguguuucuguagacuuaggcuggggcuggagacgcagcucagugacaguguuucuguagacuuaggcuggggcuggagacgcagcucagugacaguguuucuguagacuuaggcuggggcuggagacgcagcucagugacaguguuucuguagacuuaggcuggggcuggagacacagcucaguguuuguguagcagauucagaguucugaguuucauccucagcacacacagacaugcgggugccuccugcacucaagacucuucugucagaguucuggacauuuaguucagcccuuaaccauguuuagcagcuucauuagaauauuuguuagcuuauaacauacuucaacuugauaauucuuaauacuucuaaaaauguauuguguaauuauuucucuauuugcagaauuacauuauugggagagaggauguagacuuuaaccuuacuuuuaguuugaagugccaggaauugucaggcuuaugcaggaaugccaugggaguuaagucuuccuguaugguugguuguuuuguuuuguuuuuuaacaguuauuuccuguuuguuguggggugcgauugauagugugccaugaacaucagcauauaaccugacucaguucuucccuccaccacggagaugccagccaggcauggaacucagucggcgagcuugguggcaucugagccaucuggcggcccaagcaugaagacuuauggaagugggaugaaguuucucuaaaaaccuggcaguaacucugucuucucuuuucucuucccucagagcuggcauguuuguuucuaaguuuuuuggcgguugugugccugagauggcgcuaaccccugaugacagacgccugguggcccaugucucuugggaacuccagcacuaucaccagcuguuggaaaagguucgguaagugacuuccagcucggucuagucagugauauguugguauggcuugcagcccuauacacucugccuccucccuucccaggauccgggaugccuugcgcaguauccucaccauaucucgccauggcaaccaauacauucaagugaaugagcccuggaaacggauuaaagguggugagauggacaggugugugcaggagcuagggcuggcuauaggaauuaaaugacaugcuacaucuuugugaccuugacaugucucucuuucucaggcagcgggcaggcacagugacaggcauggcagugaacauggcugccuugcugucugucaugcugcagccauacaugcccacagucagcucuaccauccagacccagcugcagcucccaccugcagccugccgcauccuugccacaagcuucauuuguaccuugccagcaggccaccgaauuggcacaguaggucucauuaauguugguggcacuuguuuuuacagugcugccuuuggggugugguuaguagagaccuaaacgucucugucguagguguggggcucuacggcuauucucagaagcccucccuaacucugcacuccggcuugugaguguggugcuaucuguauauacuuauugcuguucaugccagaagccagugagugcagagaauagaaauguuggguaagaaacaccaugaccugguggugcugacagcccucuucucugacacugacgguguccccuugugcccugugcuuccccacuggagagucccauucuuccacagugacugcugcccuugugaacuaugucacacuccuguuccuccuaaagcaucugggaucucugaaugcagaaagccggggcgggggucggggggugggggugggguggggggccgaggggugggggggugugcucuucugacguguucugccaugcuggagauuaucagggacugacucucauacuuguuuccauaggucaguccuuuguuccaaaaacuggaaaaugaccagauugaaaauuugaggcagcgcuuuggagggggucaggugagcaagcuggacugugcucucccccagcaaaagcccuggcagugccccccaaucuccccaaguauccugacucucucuuuccaccuuuagccuuacugcuuccucacuuacguuucuuuccugucuuagcuagaagaguccuuggaguuaaagguaaccauuucccugcgaugcuaugggaaacuggaggccagagggguuuauggcaacaaguaacgauugugcugcucuucuaggcuaaaggcucccccaagccagcagcuguggaggcaguuacagcagcaggcucgcagcacauacaaacgcugacggaugaggugaccaagcagguaugaagugggcggggacccugagcagaggaaguacugaaccuacacagguccuugucaugggacugcugccucccccucacccugcuccuuuucuuagggcaacgucguccgggaacugaaagcacagaaggcagacaagaaccagguugcugcagagguggcuaaacucuuggaucuaaagaaacaguuggcuuuggcugaggggaaacccauugaaacuccuaaaggcaagaagaaaaagugagaggcuguugacacaaagucacuuuacuggacauggacaguaauaaacaauguaccgucuaugugcaagccgagcccucuccuggucuacccucaguccccuccucagcaugugcagugcagugcagggucacaugcuuggcgcuggcgcgauggugcuggguacacuuccggagagacagacaggaggugaugcccacuguucaugcuuggugcaggcugaccaugcggucgaucagagcccgccguguggucuccaccucccuggucaggcgcucgauuuccugcuugagccgcucguucucuucagcuagcugugccacuuuccgcucguucuccugcuccuucuccuucaugcguugcuucccaggccgggcugggcacugaccacucuguuuccguuuccuaguucuuccuugcucuuccuccucuuccuccugggccauagaacucugacuggaaucuggagagcgagggcuuugggaugugcgugugaccucuguuggcccuggcuccucugucagccaagcuagggacgcagggucaagaguagugaagguuuuugauucuuccuuuaaggaaaugaagaaggggagauagauauuaauuaguucaggagaggcauacaaacccccaguuuccugggguuuuacuuuugcuugguuuuugagacagggucuuguauaggcuacauucaaacucuagcuuaggcuggccaugaacugagccucuugccuauacuugacaagcacuggggcuauaggcacccacaccaucacucugcucgcccauccuaggaccagcauucucacucaccucuucguuuccuggggaugagauauaggugcccccaauuucaucugaggacaggaccuccugcagauccucauaccaggcuuccagcucccagcuggacaccgucuccaaggugaaaggcagggacucagcugccaugacugcacguggaccagguucuggaaaggacauacauuccauucaccacagucggugagcugaccuugucccuuuucuaacacguagaauuuaaaauuuacuggucuugcacgauagguaagggcauggguugucacuccuugaaggcuacauuggcagaggguggaggugaagagucaacucgcacaaguuguucucugaccugcacacacacuaaugauggugugucgggauggggagauggcugccucucaagccuagcagccuugacuuugacccugccagauccaacucucaaaaguuguccagaugaucacaugcacaccauggccaggacccugaaacggauguaauucagugucugggggccagcagcauucauuggcucuccuggagcuggagguccaggccaugugagccaccuucuguggcugcuggaaaccugacucagguacggcacacaggcagcauggguguggaacugauaggcuuucuccgggcucucauugccauucuuuuugguguuuguucaagacagggucucucuguguagcccugccuguccuagaacucacacuggccucagagaucaaccugccucagccuccugaaggcugggauuaaaaguaugcaccacccccacacagcuuuccaacuuuuuguuuuguuuucauuuauaugcuggucacuaccaagcuuaauccaggcuggcuaccuaaccuuaaauaucuuuuuuuuuuucccaaagauauauuuauuuuauuaucuaugcauauauaagugagugccugaaugugugcuguguguguguuccugguagacauggaggccacaagagggaauggauucccugggaacuagagucauagaugguuuugaacugccauuuggguacugggaguuagacuagauccucuacaagaagagcacgugcucuuaaccacugagucaucucucuagcuccuggaaacaaaacuuggagggugggggguguauuuucaagaaaggguuucucuguauauauaguucuggcuucccuggaacucacucugcaaaauaggcuggcuuugacucagacauuuaccuuccucugccucccaagugcugggacuaaagguaugcaccacuacaccugauagaacauacccuuuauugagaaggauuuacuacagauaacuucaggauccucucaaguucugagagaggaacagucacugggcuuggcuauacauauauauucuuacaggauuacaguaaaaguauucaacucucuugggaacacuacugguaauuuccaggggcaauuaccaggccauuuguacucuuuuuuucucucgugugggaagcuugggcaaaagguccuuugggucuaaucuugguguggacugagaguugggaagacaaaccaauugccauuguugaggcugacuucgaaagccagcucucaaacaacauuauggggucagagaaagacauggucugacagcaaaagcuuguucagaugaaggccuugucuaacucucccccagcaaagcaacaugagcagcauucgcagcugacugagaggguggccaagauuaccugcuuucagguguggugguguaugaagaugcacuuccuucuggaacacuguggagaaaaggaaaaaacaguccuuuaccuccagccuccuccuagcccuucucuagauccuuucuaacuccuccuagccccucucuagauccuuucuaacuccuccuagccccucucuagauccuuucuaacuccuccuagcccuuuucuagauccuuucuaaaauggguugugagaugguuucuuugugcaucccugggcauccuggaauucuggaacucaacaacucugcagaccaggcuccaguucuucucuuguaauacacacacacacauacagaggugugugugucuugcagcgggugugucccugaagccauuucuucucuuguaauacacacacacacacaggcgugugucuugcagcgugugugucccugaagccaacuccaaggacagaggcaggcuuaacuuuauuuuuaguugcugacauuugccgucuugauuacauaauagcaaaguccuggccaacuaaguuuucucuaaaucccagauagaccucaaguccgccaaagggagacagaacuagagggaaggaagaguaaacucagcagugcuugcucagauuccauccccccacuggcagccucagugcagaccugcucugggaucuccagcuccuuggcaguguugagcaggcguucagcuuacaugaaaggccuuuccuaccaaggcuguauaguucuuacuaaauggcaacucuaggugcugaaagccaaaaacuuugguauccuugaugccccuuucucagauaccacagcucagccuaaagcacugacaacuuuaaaaguaccccaaaccuaaguauuucucauuacuacauuauuuccagaugcaauuuuuuauuuuucauuuauuuauuuuuuugguuuuucuugacaggguuucucuguguagccuuggcuguccuggaacucacuguggacaaggcuggccucgaauucagaaauccgccugucucugucucccaaaugcugggauuaaaggcgugcaccaccacugccuggcuccagauauaaauuuaccauacauuucuuucccuggauuauuuuggaagccucuuugaaaucucuccuuucuuucuuccuuuccuuuccuuucuuucucuuuuagacagggucucacuauguagcuuuugcuguccuggaacuugcuuuguagacucucuggcuuugaauuuagaucugccugccuuucaagugcugggauuaaaggcugugccacuau

SEQ ID NO: 5792 - RNA, 1082 nt, Mus musculus
cggugcgggcuagcguggcacucugggucggccggcuccgagaggguccuuugaacuguugaagucggccgcuguaaagcgauccgauggagacgacgcgauggguggcauuuucugauuccuuacuggucguugaagugguaucgcacgcgccgauucaaguuguuaaggaucggaguuuuuaauugguuugugugcggguaguccgagagcguggcgaugcauuuagcuacaagauuaaaaaucaguuggggaacugugagcaaacuuuagugucaacguggaaauuaauguggcuguccaucagccacaaaggauguggcucgcgaaccuuuauuacuuaggaauugggaauguaguuuaguuaguaagcguuugcuuagcaugugcaaaccgcuggguucacccccgguacacaacacuguguggugguguguccacuccuguaaucccagcguugaagagguggugauaaaauuaucauaaauucgacguuauccucuauugcaagccagccuaagcuacuagggaucugucaguaaaucagugaggaagccuggaaagauggcucagcggagaacacaggccaggcuguccuuuuccuggacucuccuuugacccauuugcaugguugacaguugucuguaacuugaguccuaggggaaucaugcgcccucuucuggucuucaugauuacugcaugcauguggugcagagaccucccugcacucgaaaccccuuacaaauaaaagaaaaaggaguuggguguggugggacacucccuuaauuccaggacucagaaggcgaaggcaguuggaucucuuugaguucaaagcuauccuggucuuuauaaaccuagucucaaaaaaaaaaagugugugguuuuuguuuuguuuuauuuuguucuuaauuaaaaauaagggguuuagagauaacucugguucgggagcacuugaugcucauccaagcacacacaugacaggcagaucacaaccuucuguaacacuagugccucuucuggccuccauagaccugcccaaaaauaguacacucaacuugcaggcaagaccuugauacacauua

SEQ ID NO: 5793 - RNA, 7135 nt, Mus musculus
cucucagcuguccacuguccuccagcccugucacuucagcucugccaccacggugagaggcuccaaggccuaccuacuaauacugucuggguagcugguguggguccagaagguaccagaaagggggcuuaccucccugaaggaagagggcuagcccuccccagcagcaccaucaaggucucagagaccccuuuccacagugaacugacuuagggagucuggaaaguaagucgucucuucauuauccuuucauuucuucuaaccugagucuguugggcuucuucgucucucuccucaccugugaguaguuugggguuuugaagugaaauuguccuaguucaggaugagugaggauuggagaaggggguaggguguggugggguccagggaauggagggguaagggaagggaaggcucacauuacucugaaaaccuaaaauagcugaggccugaggcaggccagggaagaacuaggcacaaggcccccaaggcucaggagagagguaggggaggacagaucucuggacacaccuucagacacgcagacggguuaaccguguuaaccauguuaaaccuccugaagccacuagaagauguguaucaucgaucagaacuaccuguaggacagcuguucucaaccugugggucgcauagcagacguccugcaugucagauauuuauauuucaauucauaacgguagcaaaaguauaguugugaaggagcagugagauaauuuuaugggucaccaccacacaagguaccacagcguuagggccacagcauuaggaagguugagaacugcuguagaagaaccuagaagacaagccuugaguagcauguuggauuuguagacucugggcuugcuccuugauguggaaaguauccguguaagcaacugacuggggagucuuuccucuguuggacauuucucgggggaccuccauagaaucucuucauaagcucugccaaagcugucuaaccaaguuucucccaaaggcuccccuucgagggccacccuacugugugcagcaggacugcuggaauagaagaacagcagacagagauuagaacucauagcggggcccaaucucuuguaagaugacagaaaaggaagugguggaguccccucagccccccuuuccaggagagacuccgcaaaguggggugagucuggaccuauguccgcuuuuggggggagcgggguccaaagggcugggaagccaucacacagccucugaagaaaacuacucggauugaaaccgcuugugugcgucucauuuauuauugggauagccaacaccugcaacacccagcccccuaauaccagggacguugcuuucccaugauuggaaaaugagaccaugacugucauuuaaugauggguuuccuucaccccucccucagcuacagcgacugaagcaguuauucaagaagggcucuccagagacagcugagauggagccucccccagagccccaagccaauggagaggcggugggggcugggggugggcccaucuacuauaucuaugaggaagaagaggaggaggaggaagaggaggaaccacccccagaaccuccuaagcucgucaacgacaagccccacaaguucaaagaucacuucuucaagaagcccaaguucugcgaugucugugcccggaugauugugcgugagucuuggggaagcagaggcaguaggauggaagucucacggggagggacaggaccaaggagaggugugucuguauagacagacuggcaagauucacccuaugaaagcgcugagguugacaguagaaggcaggcaggccagagcugaaguagccacggggugaaggaaggggggcauccagaaccucacucaaacguucucccccuugaagucaauaacaaguuuggacuccgcugcaagaacugcaaaaccaacauccaugagcauugucaguccuacguggagaugcagagaugcuucggcaagaucgugaguagugaggcuccggggagcaggaagggaaggcacgggcaaucagguccuccuuucuggccccuaaagccacuccauacaucuccugcuuuaccuuacucugagaggggcugagcacucacucguggggggugggauccuggacccugccuugccgcuucuaauguucuccccaucccgccuccagccaccugguuuccgucgggccuauagcuccccacucuacagcgaccaacaguacgcugucuguaaguacccguacaggauccgagggaggggugcaggccuccaagguggugucauacuacccguuuaggaaaagaaauucugaaacagggucauucuaucuccauagcucuaccgcagucuagacuuuuuacagccauuucuggauacaaugguuagucccuugguuuauagccaagagaugugaaugagcaggccagcaguacagcuccuuuuaaaccauuucuaagcaagaacaaggauuaagucuguuuuuacccuguugcagagugauuccacguccagaggccagcucaagagcuauggauaucccaccccaccccccagaaaaagguccuaaucuggcaugccuucaaaguguauuccuugagguugaauugaugguacaggccuugaauccacacucacaaggcagaggcaggcaggucucucugagccagggcaacacagcaaggcugacucaaaaaaggaaacacaguggcaggccuguguucaaaguucauguuucuuuugguggucacaguguucagggugggugaggggcugaaaacuggcucagauguauuuggcagagaagcuggauucugcgaagaguguagguacaaacgaaccugccagcgguagcgccucagcuugcacacaugccacuuaaccaaagagaagcaggguaguaauuaucccagccaugucccaacucccgagaaacuuaccaacacagucuaguacucugucuggucccaucuccaggcauucccaguggugguuuagagcccuuaaccucuagguguuacacagccggccuuucccucuccccuccuucuccagucccccaacaaacccugugagcacuggcugaauccagauagcccucugagaggucucuccuccaaccccuccucggccuucccagugaugucucucuuucuuccucccauccuaccagcugcugccaaucgcaaugaccccguguuugaaacccugcgcgucggggugaucauggcaaacaaggaacggaagaaggggcaggcagauaagaaaaaugugagcgcuguaggcccgcacagaggcucguuccagaagcuccgugggucaggucauuucccccguaggaaaaccgacagaaacuauggguccucugcccccagauguugcggcauagccagacagaaacauugcugugugaaauuuuagauuugugugugugugugugugugugugugugugugugugcacgcuuauucaucucacugugggccucugcaugggcccacauccugccauagugcugagaguauaggucagugguggacuacuugccucgugugcacacuugcguaaagcguccugguuuaauacccaguccugaaaaacaaacuggcuccugacauacagcaugccuccuuggcucccuucuaaaacugagagauugccacuggaggcuggguccaguccuuggcauuacugcguagcaggcaagaguuuacauuuggagaagagaauuugccaccaugugguugcugggaauugaacucaggaugucuggaggaucagucagugcccuuaaccucugagccaucucucaagcccuaugaaagacuuucaagcuugauaaugcuggaaauguguuugccuggacaagcaauuaauuucuccccagacaaccuuaugaacuaauaugaaugguguuaguuaagucaauuccaguucuggggucuaugugggcaccaggcaugcacaugguguacagacaccaugcagggagagcacacguacacauaaaacgaagauaaaaccuuagggggagagcagcagcccucagcaccaccuucugccaagccccuccccuuuuugaauggagaccagucuccucauaaguggccaugaucuugaauguccucugguccucucgccuucacuucccagguaacacaugucaccacacccgcuuugugugacuacagggaucaaagccagggcaucaugcauccugggcaagcaucuagcaagugaacuacaccucuaacacacacuccgucccaucugcucugagggccuugcuauacagcacucacuuuauaggcauagccuuggauucaugaucuuccugucucagccucccggggucagaauugggcuugcaccaccuugccaagcuuuaaugacuuggaaccucauaagagacaauuuacuuuccuuggauggaaaaaaaaaucuuauccagcugggcagugguggugccaucccagcauuugggaggcagagacagucagggcaguucacggccagccuggucuacagagugaguuccaggacagccagggcuacacagagaaacccuaaaacaaagcuaaagaucugaucucaaaauggucgauauacagcuuagcugcagauaacaaacuucagucaguuaguuaccuaugaaugaaugacacugcuguuucguagauucuguucucaucagggaaacgugaaaaguuguugccuuaggucaggugaggugugccuguuguccccgcacggggagcugcaggccaggggaucagaaacccaaggucagcucuggccagguaaggagaggacagcugagcugaugagacaaccaagagaagaggagaaggagaaaccugugcggccacauacacaccuuuucuuacacacugggauauaauuuuaaaaagauguauuuauuuauuucauguaugugaguacacugucucucuucagacacaccagaagagggcauccgaucccauuacagaugguugugagcuaccauguguuugcugggaacugaacucaggaccucuggaagagcagccaauguucuuaacuacugagccaucucuccagccccacacuggaguauuuuuaagcagacaguauaaugaagggccugaaaucugaaucauagggguaauuugaaaggacuaaagauuaccggggaagagaagccagaaagcauaucugcuguccuuggauauuuaaagggacuguguuugcuccacauuuaaagcuccagacaguaagucaagacagauagauacagauauucuuuaaaucacaugggcuguauuguaagguagugaacuccccgucaucagcuaucuucaggcacaauacggguggccuaccugcccgcaugcuucagaagaaauccccgaguaucuucuggugguuggaguagauacuuucuccaaguacacuccagagcuugaguugcucugcuacucccuggccugccuggagaggcagcuaaaacacaggaucccaagacagccugucucuaacucuagugucccccucucuagccucuggcagccaugauggaggaggagccagagucagccaggccagaggagggcaagucacaggauggugagugucacucaucugcauccacugggaugggaugggaugggaugggauggaggguuuagcugcuguauagcagcagguggagagcaaaaggcugaaccuagggugagggaagugauggaugcccuccuggaggcagaagcaauuugucuauuuuucccauccaaggaaacaaugcagaaaaggacaagaaggccgagaagaaaacuccugaugacaaaguaaguccuuccucccuguagaacccugguccucgucccagccaacgucugacaucacucacagcucuucccaucaccccugacccacccuccacacugagacagacacacaaaccgaugcagcccucucaucccgggagagguaaaucggagucugguaacucaucgcucucuugcaccuccagaacaagcagccuggcuuccagcagucucauuacuuuguggcucucuaucgguucaaagcccuggagaaggacgaccuggauuucccgugaggagccuucaagggaggcgggaguguggggagcaucgaggaguaagagaugagcucucugugggaauggaggagggcagaagggcggguaccccgcagcacagccaggcacgggcaugugacuguaaaucacagagagggucuccuuucuaucccaggccaggggagaagaucacagucauugaugacuccaaugaggagugguggcggguaagacguugccaccgcuaaggugggagaugggcagucuagaaccugagaucuccagcguagccacugccuuccuucucuaggggaaaaucggagagaaagucggauucuucccuccaaacuucaucauucgggugcgggcuggagaacgugugcaccgcgugaccagaucguuuguggggaaccgcgagauuggacagaucacucucaagaaggaccagguaucucgggaaccuuaacccaaugccaggccuggucguaccucuccauccaugcaccucagagggaggcccuaacccaucaguauguacgacccuccccaacgucccugcgcuccucuucuaauuuuuuuuuccuguuccucaauccuuuaaaccccuagaucguagugcagaaaggagaugaagcuggugguuacgucaaggucuacaccggccgcaagguggggcuguuucccaccgacuuccuggaggagauuuaagaguacuggugccugcuggcgggagacacccacuccucguucugggcggggcccagugcgagcuggggagggaaggggcaaggggagggaguacuggaugaggagggucggaaaggcccaccagagcauaaugacguuucuggggagggucugguucccaccucucuccccugccuagggcuccggauaccuggugcgcugagcagccugcaccgauuaggcccacacuucagguucauccaacuuucaagagcuugggggugggggugggggagcaucuccauaaggaggggcagaacugucaaauguuucgaauuuauuaaaguuuuaacaaaaguuag

SEQ ID NO: 5794 - RNA, 2218 nt, Mus musculus
aggaauagaagagauccaccuagaagaccagacacugggacaagauggcaggaacuagucuagggacccgcuucuaccggcagauaaaaagacacccuggggugaguucaguccucagaucuaauuccccucuugucacccugccucucaagcccuccccacccccacuccccccauccugcuuccuguccgguuuccuuaguguucccaaguuuucccagggacauucuauguccucucucugcaauguacucaaugucccugcaaccugccuuggacaggaucacuguaaggguaagggacagcaugcugaggauguggcuguagguuucaggccccacucccaaagggaagguggcaucagaccuugaguaaagauaaagggacaggaagaaaacuaggacagagugagugggaacugagcagaguucggacccugagagugccugguuuuucugcagcucaucccaaugauuggcuucaucugcuugggcaugggcagugccggacucuacuugcugcgacuugcccugcgcaguccugaugucugguaacaacaggucuugggaggcaagagggcagggguccuggguggaauaaaauggucuaaggugggaccuuagaccuagaaggacccucggucuguguccguccucauuuccacugccacccagcauuucccaggguuggaguggccccugaccugagagacccucaccucccaucuggaccaccugguggcucacugucaguggcuagccacguggggcagcuggaaucccagcagcucaccacaggguugccauggcgacacaucucuacuggccaugucugguggcuuuuagguaccucuaugccugaccggaagugcuggaugucuggcagugugggacuccugagggucuuugguuguacugggacuuuguguccugccagaagcaucaggggggucaguccuuugacaagcagaaggccaaagcaccacccacucugauccuggagucugaggugcacccacugaaaguacuguccuucaggauuucugccugacucccaggacucugcccugagcgguugggugagggaggcuaacccugggcagucuauaggcuagguugucauuuggucaucagcugccauacuucuugccagcaccucccagggauggcgaugacaacgacacucacucccccuucucugucagucucuaggaaauguucuccccuccucaggguagggcgccagggguggugauacugaggccauguuuaaugccaaaguccugguucccagaaaagaaacuuuaaccuuccuguccuguucacagcugggacagaaagaacaacccagagcccuggaaccgccugagucccaaugaccaguacaagguaacuguagaaccaguguuuccccucuccccucccguccuagucccuaagucaguaccacacacaagacagaggagguaagagccgcucuuucaacucucuuuucccucuccacaguuccuugccguuucaaccgacuacaagaagcugaagaaggaccggccagacuucuaagucagagaucuccacguaaaucacucuuucugcucccugccccagacccuugggcgucugucuagcagcaucaguccagcuucugcuuaaaggcccgauucccacgcaaaggggaggccgccccgcccccacccgccucccuugcucccaggagaggaaaaagccucugacccucagcuugagucccacgugggggaggggacucgacugcagacgacaguugggguugacccaaaaacccaagccagucccccucucccccugccgcucccugcuccuccugacuggguguggcgcaggcuacguguugagcguguccgacgugugccagcagcaagcaggggcccgagugccagggacguggcaggccccacguuuguuuugacagaguuuugagcaggguucagggcggugucugcccaggcucgacugggcucguccuggguucccagccugacucggaugggguaucucugccaugcagugggcuucuucccugcccaagccggcagccuccggucaaggacagcccucccgccuugcaccugggcagucuugugccuuucccccaccccucccuucccuugcuucucugucccuggggaucaaacagaagcagccgugggcaaaauacaauuucauuuaacaaauugaau

SEQ ID NO: 5795 - RNA, 2218 nt, Mus musculus
auucaauuuguuaaaugaaauuguauuuugcccacggcugcuucuguuugauccccagggacagagaagcaagggaagggaggggugggggaaaggcacaagacugcccaggugcaaggcgggagggcuguccuugaccggaggcugccggcuugggcagggaagaagcccacugcauggcagagauaccccauccgagucaggcugggaacccaggacgagcccagucgagccugggcagacaccgcccugaacccugcucaaaacucugucaaaacaaacguggggccugccacgucccuggcacucgggccccugcuugcugcuggcacacgucggacacgcucaacacguagccugcgccacacccagucaggaggagcagggagcggcagggggagagggggacuggcuuggguuuuugggucaaccccaacugucgucugcagucgaguccccucccccacgugggacucaagcugagggucagaggcuuuuuccucuccugggagcaagggaggcgggugggggcggggcggccuccccuuugcgugggaaucgggccuuuaagcagaagcuggacugaugcugcuagacagacgcccaagggucuggggcagggagcagaaagagugauuuacguggagaucucugacuuagaagucuggccgguccuucuucagcuucuuguagucgguugaaacggcaaggaacuguggagagggaaaagagaguugaaagagcggcucuuaccuccucugucuugugugugguacugacuuagggacuaggacgggaggggagaggggaaacacugguucuacaguuaccuuguacuggucauugggacucaggcgguuccagggcucuggguuguucuuucugucccagcugugaacaggacaggaagguuaaaguuucuuuucugggaaccaggacuuuggcauuaaacauggccucaguaucaccaccccuggcgcccuacccugaggaggggagaacauuuccuagagacugacagagaagggggagugagugucguugucaucgccaucccugggaggugcuggcaagaaguauggcagcugaugaccaaaugacaaccuagccuauagacugcccaggguuagccucccucacccaaccgcucagggcagaguccugggagucaggcagaaauccugaaggacaguacuuucagugggugcaccucagacuccaggaucagaguggguggugcuuuggccuucugcuugucaaaggacugaccccccugaugcuucuggcaggacacaaagucccaguacaaccaaagacccucaggagucccacacugccagacauccagcacuuccggucaggcauagagguaccuaaaagccaccagacauggccaguagagaugugucgccauggcaacccuguggugagcugcugggauuccagcugccccacguggcuagccacugacagugagccaccaggugguccagaugggaggugagggucucucaggucaggggccacuccaacccugggaaaugcuggguggcaguggaaaugaggacggacacagaccgaggguccuucuaggucuaaggucccaccuuagaccauuuuauuccacccaggaccccugcccucuugccucccaagaccuguuguuaccagacaucaggacugcgcagggcaagucgcagcaaguagaguccggcacugcccaugcccaagcagaugaagccaaucauugggaugagcugcagaaaaaccaggcacucucaggguccgaacucugcucaguucccacucacucuguccuaguuuucuuccugucccuuuaucuuuacucaaggucugaugccaccuucccuuugggaguggggccugaaaccuacagccacauccucagcaugcugucccuuacccuuacagugauccuguccaaggcagguugcagggacauugaguacauugcagagagaggacauagaaugucccugggaaaacuugggaacacuaaggaaaccggacaggaagcaggauggggggaguggggguggggagggcuugagaggcagggugacaagaggggaauuagaucugaggacugaacucaccccagggugucuuuuuaucugccgguagaagcgggucccuagacuaguuccugccaucuugucccagugucuggucuucuagguggaucucuucuauuccu

SEQ ID NO: 5796 - RNA, 5998 nt, Mus musculus
ccgacuacaagaagcugaagaaggaccggccagacuucuaagucagagaucuccacguaaaucacucuuucugcucccugccccagacccuugggcgucugucuagcagcaucaguccagcuucugcuuaaaggcccgauucccacgcaaaggggaggccgccccgcccccacccgccucccuugcucccaggagaggaaaaagccucugacccucagcuugagucccacgugggggaggggacucgacugcagacgacaguugggguugacccaaaaacccaagccagucccccucucccccugccgcucccugcuccuccugacuggguguggcgcaggcuacguguugagcguguccgacgugugccagcagcaagcaggggcccgagugccagggacguggcaggccccacguuuguuuugacagaguuuugagcaggguucagggcggugucugcccaggcucgacugggcucguccuggguucccagccugacucggaugggguaucucugccaugcagugggcuucuucccugcccaagccggcagccuccggucaaggacagcccucccgccuugcaccugggcagucuugugccuuucccccaccccucccuucccuugcuucucugucccuggggaucaaacagaagcagccgugggcaaaauacaauuucauuuaacaaauugaauuugcugcgccugcuaaucacgucuggugucggcucugaucagagaggaggcuacagccccggggguccuggugguggugggagggaaggagagauacacguugagggaguagaaucgcuggcuggcccaggggaccccucccacaguaauaggaacccugggcagguuagcauuuuauuagauaaaaacaggaaggagggcgcuuacccacccccucuuccccaagaaagagcgggaggggagucuguaacacuugagauguagugggagggucgggguggaaagcugagggcgaagucgggugucauggugcaaaccuauaaccccagcacuugggaaaugaagguggaagggucaguucaaggccacucacagcuaagugagacccccgucucaaaaacaagucggaugucaacugggugcuucguguagacacgguuaaagaucagaaaucucagcuacaaauucuggaagggaguuuaugccuggcucuugcccuaaauggaaggccucccucccuccacuaaaacccagagaggagugacaucucuucuaugguccagggaggcgggaagaaagguaacuuccgggucugugggcuucugaccgaccgccagguguccucaacuguccucaacguucaucaaauccaggcauggggaagccccuggcaaacuguuccaccuguugccggagguuggccaaacgcuggcuugucucugggucuuugagcaggaaggauuugaaauccuggagcuuggcugagaucggugggagaaguugaucagagggcugcugggcggggccaggagcuagggugcggggaggcgggugaaacugguugaccaaggaccucugaagcuacucaccagucuugcgcuucaccuccaagccaauguugacucccucaucgauaaaaucgacgacucuacggaagucguccucacggaacuggcgagaggucaacgcgggggccccugggagagagagcaggagacaauuagcauagccaagauacagacaaccccagugugggggacccuucccuccgcagaccccagauucucaccaagccucaagccccccggaguaauggcgcuccggucuccaggacagguguucuuguuggcugugauggagacgaguuccaacacgcguucggcucgggcuccauccaggcccuugggccgcagguccaccagcaccaggugggugucagugccaccugaggggggacagugacaggggacugcgguguccuggcccucugcuugaggccacaaaggccuaggccuucacccacccccuggcuuaccagacaccagcgaguauccucgcuugagcagggcaucagccauggccugggcguuccucagcacuuguaaggaguacucgcggaacauaggggugcaggccuacagaggagagaugguagcuccugcuguuugucgccgcagagcugaguacaggcccugucuuguacugaacaaggaggacuccaugaccccggcuuugcugacucccaguuuaagcuguuucccuuccacgagccucggcuuuagguacaaggaaguaaggaagcaaaaccucuggcccagugcaccccgacacaaggggagagcguucccccccccaccugcuugagagccacggcuacugcagcaauggcgugguugugggggccacccuguagggaugggaacacagcgaaguugauucgguccucaaagguauaagggaucucuuugccagucuuggggucuacgguucguacucccuuccgguagaagaugagcccugaccuguguggaagaugcauagucaggcucuaaaaggaagggcaagugacagggagagaggaagacggaugacuggcauaggugcucagaggauccacggguccccucaauuggguuugcgggggggggggggagggaagaagguuuaaccccagggaauucugaccuggccccucgcagugucuugugagugguggugguaacaacauccgcguacuugaaaggggaggggaucaccuuggcagccaccaggccacugaugugggccaugucugccagcaggugugcccugaccucaucacagaccugggcagguagagaaacaggucacagccuggggaagaccgggauggguauacacaaggcagguguccuugccucgccccgccccccccccccauagaggaaagcuugauuggcagucccucaccaaccucucucaugcgugcauagucaaugaggcgggcauaggcacucgugccagcuaugaugagccgcggucggaaaagccgagcggucagcgccagcuggucguagucgaugaggccaguuuggggcuggacacagacagauagccagcuaaggcccggagcuagaggcagcucaagccccucccacuggccgaggagagcggaccaucggggccaagugcccagccccuggaacacuacuuacauugagcuuauagggcauagacucgaagaaaauggauguggcggagauccgcuugacaucagacauguagccaugggugagacuagacagaagggagaucucagagugauguagccugacuuaaccagccacccagcagaccugucccagaacacugguucuagcucgccucaccgcccccccccccccccccgcguuccccucuggccaccccaugcuaggugcucaguguaacaugggacaguguggcccaucuucaccggaccugacagguacucauucacucacuaacuccugucuucgcugccggcaaacccaucguuccgcccacucauacucacuggcccccaucgggcagguccaaccccaugauucgaucaugaggcugcagaagggccguauaggcagccagauuggcuggggacccugaguauggcugcacauugacuccccacugugccggauccaggucaaaggcuuccaaggcccggcgcuggcagagcagcucgaucucguccaccacuuccgcuccuccguaguaucugccguggaagacggaccguacguaagggcgcagagagagcacccuugaccagcagcaaaggacugggcagccgcuguucaguaaaacuaacggggcucagggagguuccgccacugggguugccaucccugcugcugcccuccagcccucuggucuagccucaccucuugccaggguaacccuccgaguacuuguuguugagacaggaccccagggccuccagcgcagcucggcugcagaaguucugggguggugggggggcagugucagaaggcaauggggucucccuuccccuggauucccacggccccgccccugccagagcccacaggcugcaggggugagacgggauacgccaaaggcucuguguuccucgccagacauggggcgggaccagaagcaacauucucagaaacucggcugccaugacggguggccccaguagggccgccuguccacucaacccgugcuuccagguuccucuuucuucugacgagagaaggagguuaaggaagagaugaggacgcuacauggcucuagaagcuucccaaugcucaagccccauaaacugguccugccuuaugcuucagaggacaguauagagaagagggaaaaggcccaggaaaaagcucuuuugaaucugacagggaggcguggagaagucacuaccgugaccgcaggugacgugguguucccugcgcgcaccguagcucgcgcucuuugacccauauccucacguccuaccucugaggcgaugagcuccaggccgcgacacugucuguccuucucccucugcagaagcucccacaucucagggucacugucugauaaacucuccuggcccguccaaccuccagcugcuuccccagccugcgucugggccaccuugcugugcugggcccgggcagccaugcagaccagcugaccacaucucugcagaggcucagggcagaaaggccaggguuaauuaaaaauuguccagaucucuucucccagcugcccucagucauggguacagaucgagcccucuggcuaaguacgcagccugguccggccagcagucagugcucucuacccccacuuucaucuugaauagcaaguucuagagucaaagguucagaucauuauccaaagggcaguuuuggucaacucuaacacaacgcaucccuaaucacccugagugacucugcaaagucacagagcaaagcuugugccccagaagcccaugucccuccaauucaggugagagacacugcgauuccagagucuccccacacacaggaacaaaaugaccauccuaagguccuggcugcucuugugggggacagcgguucaucuuccagcacccacaaaacagcuaacaaccaucuguaacuccaguuccaagagaucugaugcccuccucugaccucuguggguacccaggcaugcacgcagugcacacacagugcaguuaaaauauucauaaacauaagagguggacuuccugcagggccuccggacaugaauaccuccaugagagaagauaccaagcuaacagggcuuaacaccagaggcuuuuaaagggugguuuccagagcaaccuuuaaaaaguaggaggauagacuuuuaagcaguucuuggaaagaguuguguacuggcgggaguugggguaggcugaagguguuugcccaaaaucuuaauuuuaucucacacucacagacacacacacacagcaccucgcuaccuccuuccugcccacacagcagcaggacccuugcgugaugaaaguacugaggcucgguugcaucaucuccauagcucagagcuggcgggaaaaauucaacuagcgcaucgaagccgggaaccccacuuguuugcuaggauauuguuaacacagcgucugcggaccuuuaccuuaagagucgugucaacugggugacuacaagacccuaccuaggucgucugaucgccagaacuaggggcccagccaccgcacaugugcugucucagggauuuccugguuaagcaucuguuccccgaggccccagaacacgugcagcaaggagccaggagaaccccacuuugggugggccuuuccacugaucauccaguaaacagaacccuguucuuacccgagugguccgaagcaaagagaaggauaccaucgcuacaggaggcacaggaggacuagccacuaacucuguaucgguguaguaccggggucgaaaaccagcugcucuuagaacgcgugcgcgagaaaauugcccccgugaaguucgagugaaagaggcguucccugcg

SEQ ID NO: 5797 - RNA, 5998 nt, Mus musculus
cgcagggaacgccucuuucacucgaacuucacgggggcaauuuucucgcgcacgcguucuaagagcagcugguuuucgaccccgguacuacaccgauacagaguuaguggcuaguccuccugugccuccuguagcgaugguauccuucucuuugcuucggaccacucggguaagaacaggguucuguuuacuggaugaucaguggaaaggcccacccaaagugggguucuccuggcuccuugcugcacguguucuggggccucggggaacagaugcuuaaccaggaaaucccugagacagcacaugugcgguggcugggccccuaguucuggcgaucagacgaccuagguagggucuuguagucacccaguugacacgacucuuaagguaaagguccgcagacgcuguguuaacaauauccuagcaaacaagugggguucccggcuucgaugcgcuaguugaauuuuucccgccagcucugagcuauggagaugaugcaaccgagccucaguacuuucaucacgcaaggguccugcugcugugugggcaggaaggagguagcgaggugcugugugugugugucugugagugugagauaaaauuaagauuuugggcaaacaccuucagccuaccccaacucccgccaguacacaacucuuuccaagaacugcuuaaaagucuauccuccuacuuuuuaaagguugcucuggaaaccacccuuuaaaagccucugguguuaagcccuguuagcuugguaucuucucucauggagguauucauguccggaggcccugcaggaaguccaccucuuauguuuaugaauauuuuaacugcacugugugugcacugcgugcaugccuggguacccacagaggucagaggagggcaucagaucucuuggaacuggaguuacagaugguuguuagcuguuuugugggugcuggaagaugaaccgcugucccccacaagagcagccaggaccuuaggauggucauuuuguuccuguguguggggagacucuggaaucgcagugucucucaccugaauuggagggacaugggcuucuggggcacaagcuuugcucugugacuuugcagagucacucagggugauuagggaugcguuguguuagaguugaccaaaacugcccuuuggauaaugaucugaaccuuugacucuagaacuugcuauucaagaugaaaguggggguagagagcacugacugcuggccggaccaggcugcguacuuagccagagggcucgaucuguacccaugacugagggcagcugggagaagagaucuggacaauuuuuaauuaacccuggccuuucugcccugagccucugcagagauguggucagcuggucugcauggcugcccgggcccagcacagcaagguggcccagacgcaggcuggggaagcagcuggagguuggacgggccaggagaguuuaucagacagugacccugagaugugggagcuucugcagagggagaaggacagacagugucgcggccuggagcucaucgccucagagguaggacgugaggauaugggucaaagagcgcgagcuacggugcgcgcagggaacaccacgucaccugcggucacgguagugacuucuccacgccucccugucagauucaaaagagcuuuuuccugggccuuuucccucuucucuauacuguccucugaagcauaaggcaggaccaguuuauggggcuugagcauugggaagcuucuagagccauguagcguccucaucucuuccuuaaccuccuucucucgucagaagaaagaggaaccuggaagcacggguugaguggacaggcggcccuacuggggccacccgucauggcagccgaguuucugagaauguugcuucuggucccgccccaugucuggcgaggaacacagagccuuuggcguaucccgucucaccccugcagccugugggcucuggcaggggcggggccgugggaauccaggggaagggagaccccauugccuucugacacugcccccccaccaccccagaacuucugcagccgagcugcgcuggaggcccugggguccugucucaacaacaaguacucggaggguuacccuggcaagaggugaggcuagaccagagggcuggagggcagcagcagggauggcaaccccaguggcggaaccucccugagccccguuaguuuuacugaacagcggcugcccaguccuuugcugcuggucaagggugcucucucugcgcccuuacguacgguccgucuuccacggcagauacuacggaggagcggaagugguggacgagaucgagcugcucugccagcgccgggccuuggaagccuuugaccuggauccggcacaguggggagucaaugugcagccauacucaggguccccagccaaucuggcugccuauacggcccuucugcagccucaugaucgaaucaugggguuggaccugcccgaugggggccagugaguaugagugggcggaacgauggguuugccggcagcgaagacaggaguuagugagugaaugaguaccugucagguccggugaagaugggccacacugucccauguuacacugagcaccuagcaugggguggccagaggggaacgcgggggggggggggggggcggugaggcgagcuagaaccaguguucugggacaggucugcuggguggcugguuaagucaggcuacaucacucugagaucucccuucugucuagucucacccauggcuacaugucugaugucaagcggaucuccgccacauccauuuucuucgagucuaugcccuauaagcucaauguaaguaguguuccaggggcugggcacuuggccccgaugguccgcucuccucggccagugggaggggcuugagcugccucuagcuccgggccuuagcuggcuaucugucuguguccagccccaaacuggccucaucgacuacgaccagcuggcgcugaccgcucggcuuuuccgaccgcggcucaucauagcuggcacgagugccuaugcccgccucauugacuaugcacgcaugagagagguuggugagggacugccaaucaagcuuuccucuauggggggggggggcggggcgaggcaaggacaccugccuuguguauacccaucccggucuuccccaggcugugaccuguuucucuaccugcccaggucugugaugaggucagggcacaccugcuggcagacauggcccacaucaguggccugguggcugccaaggugauccccuccccuuucaaguacgcggauguuguuaccaccaccacucacaagacacugcgaggggccaggucagaauucccugggguuaaaccuucuucccucccccccccccccgcaaacccaauugaggggacccguggauccucugagcaccuaugccagucauccgucuuccucucucccugucacuugcccuuccuuuuagagccugacuaugcaucuuccacacaggucagggcucaucuucuaccggaagggaguacgaaccguagaccccaagacuggcaaagagaucccuuauaccuuugaggaccgaaucaacuucgcuguguucccaucccuacaggguggcccccacaaccacgccauugcugcaguagccguggcucucaagcaggugggggggggaacgcucuccccuugugucggggugcacugggccagagguuuugcuuccuuacuuccuuguaccuaaagccgaggcucguggaagggaaacagcuuaaacugggagucagcaaagccggggucauggaguccuccuuguucaguacaagacagggccuguacucagcucugcggcgacaaacagcaggagcuaccaucucuccucuguaggccugcaccccuauguuccgcgaguacuccuuacaagugcugaggaacgcccaggccauggcugaugcccugcucaagcgaggauacucgcuggugucugguaagccagggggugggugaaggccuaggccuuuguggccucaagcagagggccaggacaccgcaguccccugucacuguccccccucagguggcacugacacccaccuggugcugguggaccugcggcccaagggccuggauggagcccgagccgaacgcguguuggaacucgucuccaucacagccaacaagaacaccuguccuggagaccggagcgccauuacuccggggggcuugaggcuuggugagaaucuggggucugcggagggaagggucccccacacugggguugucuguaucuuggcuaugcuaauugucuccugcucucucucccaggggcccccgcguugaccucucgccaguuccgugaggacgacuuccguagagucgucgauuuuaucgaugagggagucaacauuggcuuggaggugaagcgcaagacuggugaguagcuucagagguccuuggucaaccaguuucacccgccuccccgcacccuagcuccuggccccgcccagcagcccucugaucaacuucucccaccgaucucagccaagcuccaggauuucaaauccuuccugcucaaagacccagagacaagccagcguuuggccaaccuccggcaacagguggaacaguuugccaggggcuuccccaugccuggauuugaugaacguugaggacaguugaggacaccuggcggucggucagaagcccacagacccggaaguuaccuuucuucccgccucccuggaccauagaagagaugucacuccucucuggguuuuaguggagggagggaggccuuccauuuagggcaagagccaggcauaaacucccuuccagaauuuguagcugagauuucugaucuuuaaccgugucuacacgaagcacccaguugacauccgacuuguuuuugagacgggggucucacuuagcugugaguggccuugaacugacccuuccaccuucauuucccaagugcugggguuauagguuugcaccaugacacccgacuucgcccucagcuuuccaccccgacccucccacuacaucucaaguguuacagacuccccucccgcucuuucuuggggaagaggggguggguaagcgcccuccuuccuguuuuuaucuaauaaaaugcuaaccugcccaggguuccuauuacugugggagggguccccugggccagccagcgauucuacucccucaacguguaucucuccuucccucccaccaccaccaggacccccggggcuguagccuccucucugaucagagccgacaccagacgugauuagcaggcgcagcaaauucaauuuguuaaaugaaauuguauuuugcccacggcugcuucuguuugauccccagggacagagaagcaagggaagggaggggugggggaaaggcacaagacugcccaggugcaaggcgggagggcuguccuugaccggaggcugccggcuugggcagggaagaagcccacugcauggcagagauaccccauccgagucaggcugggaacccaggacgagcccagucgagccugggcagacaccgcccugaacccugcucaaaacucugucaaaacaaacguggggccugccacgucccuggcacucgggccccugcuugcugcuggcacacgucggacacgcucaacacguagccugcgccacacccagucaggaggagcagggagcggcagggggagagggggacuggcuuggguuuuugggucaaccccaacugucgucugcagucgaguccccucccccacgugggacucaagcugagggucagaggcuuuuuccucuccugggagcaagggaggcgggugggggcggggcggccuccccuuugcgugggaaucgggccuuuaagcagaagcuggacugaugcugcuagacagacgcccaagggucuggggcagggagcagaaagagugauuuacguggagaucucugacuuagaagucuggccgguccuucuucagcuucuuguagucgg

SEQ ID NO: 5798 - RNA, 3716 nt, Mus musculus
ggcagguuagcauuuuauuagauaaaaacaggaaggagggcgcuuacccacccccucuuccccaagaaagagcgggaggggagucuguaacacuugagauguagugggagggucgggguggaaagcugagggcgaagucgggugucauggugcaaaccuauaaccccagcacuugggaaaugaagguggaagggucaguucaaggccacucacagcuaagugagacccccgucucaaaaacaagucggaugucaacugggugcuucguguagacacgguuaaagaucagaaaucucagcuacaaauucuggaagggaguuuaugccuggcucuugcccuaaauggaaggccucccucccuccacuaaaacccagagaggagugacaucucuucuaugguccagggaggcgggaagaaagguaacuuccgggucugugggcuucugaccgaccgccagguguccucaacuguccucaacguucaucaaauccaggcauggggaagccccuggcaaacuguuccaccuguugccggagguuggccaaacgcuggcuugucucugggucuuugagcaggaaggauuugaaauccuggagcuuggcugagaucggugggagaaguugaucagagggcugcugggcggggccaggagcuagggugcggggaggcgggugaaacugguugaccaaggaccucugaagcuacucaccagucuugcgcuucaccuccaagccaauguugacucccucaucgauaaaaucgacgacucuacggaagucguccucacggaacuggcgagaggucaacgcgggggccccugggagagagagcaggagacaauuagcauagccaagauacagacaaccccagugugggggacccuucccuccgcagaccccagauucucaccaagccucaagccccccggaguaauggcgcuccggucuccaggacagguguucuuguuggcugugauggagacgaguuccaacacgcguucggcucgggcuccauccaggcccuugggccgcagguccaccagcaccaggugggugucagugccaccugaggggggacagugacaggggacugcgguguccuggcccucugcuugaggccacaaaggccuaggccuucacccacccccuggcuuaccagacaccagcgaguauccucgcuugagcagggcaucagccauggccugggcguuccucagcacuuguaaggaguacucgcggaacauaggggugcaggccuacagaggagagaugguagcuccugcuguuugucgccgcagagcugaguacaggcccugucuuguacugaacaaggaggacuccaugaccccggcuuugcugacucccaguuuaagcuguuucccuuccacgagccucggcuuuagguacaaggaaguaaggaagcaaaaccucuggcccagugcaccccgacacaaggggagagcguucccccccccaccugcuugagagccacggcuacugcagcaauggcgugguugugggggccacccuguagggaugggaacacagcgaaguugauucgguccucaaagguauaagggaucucuuugccagucuuggggucuacgguucguacucccuuccgguagaagaugagcccugaccuguguggaagaugcauagucaggcucuaaaaggaagggcaagugacagggagagaggaagacggaugacuggcauaggugcucagaggauccacggguccccucaauuggguuugcgggggggggggggagggaagaagguuuaaccccagggaauucugaccuggccccucgcagugucuugugagugguggugguaacaacauccgcguacuugaaaggggaggggaucaccuuggcagccaccaggccacugaugugggccaugucugccagcaggugugcccugaccucaucacagaccugggcagguagagaaacaggucacagccuggggaagaccgggauggguauacacaaggcagguguccuugccucgccccgccccccccccccauagaggaaagcuugauuggcagucccucaccaaccucucucaugcgugcauagucaaugaggcgggcauaggcacucgugccagcuaugaugagccgcggucggaaaagccgagcggucagcgccagcuggucguagucgaugaggccaguuuggggcuggacacagacagauagccagcuaaggcccggagcuagaggcagcucaagccccucccacuggccgaggagagcggaccaucggggccaagugcccagccccuggaacacuacuuacauugagcuuauagggcauagacucgaagaaaauggauguggcggagauccgcuugacaucagacauguagccaugggugagacuagacagaagggagaucucagagugauguagccugacuuaaccagccacccagcagaccugucccagaacacugguucuagcucgccucaccgcccccccccccccccccgcguuccccucuggccaccccaugcuaggugcucaguguaacaugggacaguguggcccaucuucaccggaccugacagguacucauucacucacuaacuccugucuucgcugccggcaaacccaucguuccgcccacucauacucacuggcccccaucgggcagguccaaccccaugauucgaucaugaggcugcagaagggccguauaggcagccagauuggcuggggacccugaguauggcugcacauugacuccccacugugccggauccaggucaaaggcuuccaaggcccggcgcuggcagagcagcucgaucucguccaccacuuccgcuccuccguaguaucugccguggaagacggaccguacguaagggcgcagagagagcacccuugaccagcagcaaaggacugggcagccgcuguucaguaaaacuaacggggcucagggagguuccgccacugggguugccaucccugcugcugcccuccagcccucuggucuagccucaccucuugccaggguaacccuccgaguacuuguuguugagacaggaccccagggccuccagcgcagcucggcugcagaaguucugggguggugggggggcagugucagaaggcaauggggucucccuuccccuggauucccacggccccgccccugccagagcccacaggcugcaggggugagacgggauacgccaaaggcucuguguuccucgccagacauggggcgggaccagaagcaacauucucagaaacucggcugccaugacggguggccccaguagggccgccuguccacucaacccgugcuuccagguuccucuuucuucugacgagagaaggagguuaaggaagagaugaggacgcuacauggcucuagaagcuucccaaugcucaagccccauaaacugguccugccuuaugcuucagaggacaguauagagaagagggaaaaggcccaggaaaaagcucuuuugaaucugacagggaggcguggagaagucacuaccgugaccgcaggugacgugguguucccugcgcgcaccguagcucgcgcucuuugacccauauccucacguccuaccucugaggcgaugagcuccaggccgcgacacugucuguccuucucccucugcagaagcucccacaucucagggucacugucugauaaacucuccuggcccguccaaccuccagc

SEQ ID NO: 5799 - RNA, 3716 nt, Mus musculus
gcuggagguuggacgggccaggagaguuuaucagacagugacccugagaugugggagcuucugcagagggagaaggacagacagugucgcggccuggagcucaucgccucagagguaggacgugaggauaugggucaaagagcgcgagcuacggugcgcgcagggaacaccacgucaccugcggucacgguagugacuucuccacgccucccugucagauucaaaagagcuuuuuccugggccuuuucccucuucucuauacuguccucugaagcauaaggcaggaccaguuuauggggcuugagcauugggaagcuucuagagccauguagcguccucaucucuuccuuaaccuccuucucucgucagaagaaagaggaaccuggaagcacggguugaguggacaggcggcccuacuggggccacccgucauggcagccgaguuucugagaauguugcuucuggucccgccccaugucuggcgaggaacacagagccuuuggcguaucccgucucaccccugcagccugugggcucuggcaggggcggggccgugggaauccaggggaagggagaccccauugccuucugacacugcccccccaccaccccagaacuucugcagccgagcugcgcuggaggcccugggguccugucucaacaacaaguacucggaggguuacccuggcaagaggugaggcuagaccagagggcuggagggcagcagcagggauggcaaccccaguggcggaaccucccugagccccguuaguuuuacugaacagcggcugcccaguccuuugcugcuggucaagggugcucucucugcgcccuuacguacgguccgucuuccacggcagauacuacggaggagcggaagugguggacgagaucgagcugcucugccagcgccgggccuuggaagccuuugaccuggauccggcacaguggggagucaaugugcagccauacucaggguccccagccaaucuggcugccuauacggcccuucugcagccucaugaucgaaucaugggguuggaccugcccgaugggggccagugaguaugagugggcggaacgauggguuugccggcagcgaagacaggaguuagugagugaaugaguaccugucagguccggugaagaugggccacacugucccauguuacacugagcaccuagcaugggguggccagaggggaacgcgggggggggggggggggcggugaggcgagcuagaaccaguguucugggacaggucugcuggguggcugguuaagucaggcuacaucacucugagaucucccuucugucuagucucacccauggcuacaugucugaugucaagcggaucuccgccacauccauuuucuucgagucuaugcccuauaagcucaauguaaguaguguuccaggggcugggcacuuggccccgaugguccgcucuccucggccagugggaggggcuugagcugccucuagcuccgggccuuagcuggcuaucugucuguguccagccccaaacuggccucaucgacuacgaccagcuggcgcugaccgcucggcuuuuccgaccgcggcucaucauagcuggcacgagugccuaugcccgccucauugacuaugcacgcaugagagagguuggugagggacugccaaucaagcuuuccucuauggggggggggggcggggcgaggcaaggacaccugccuuguguauacccaucccggucuuccccaggcugugaccuguuucucuaccugcccaggucugugaugaggucagggcacaccugcuggcagacauggcccacaucaguggccugguggcugccaaggugauccccuccccuuucaaguacgcggauguuguuaccaccaccacucacaagacacugcgaggggccaggucagaauucccugggguuaaaccuucuucccucccccccccccccgcaaacccaauugaggggacccguggauccucugagcaccuaugccagucauccgucuuccucucucccugucacuugcccuuccuuuuagagccugacuaugcaucuuccacacaggucagggcucaucuucuaccggaagggaguacgaaccguagaccccaagacuggcaaagagaucccuuauaccuuugaggaccgaaucaacuucgcuguguucccaucccuacaggguggcccccacaaccacgccauugcugcaguagccguggcucucaagcaggugggggggggaacgcucuccccuugugucggggugcacugggccagagguuuugcuuccuuacuuccuuguaccuaaagccgaggcucguggaagggaaacagcuuaaacugggagucagcaaagccggggucauggaguccuccuuguucaguacaagacagggccuguacucagcucugcggcgacaaacagcaggagcuaccaucucuccucuguaggccugcaccccuauguuccgcgaguacuccuuacaagugcugaggaacgcccaggccauggcugaugcccugcucaagcgaggauacucgcuggugucugguaagccagggggugggugaaggccuaggccuuuguggccucaagcagagggccaggacaccgcaguccccugucacuguccccccucagguggcacugacacccaccuggugcugguggaccugcggcccaagggccuggauggagcccgagccgaacgcguguuggaacucgucuccaucacagccaacaagaacaccuguccuggagaccggagcgccauuacuccggggggcuugaggcuuggugagaaucuggggucugcggagggaagggucccccacacugggguugucuguaucuuggcuaugcuaauugucuccugcucucucucccaggggcccccgcguugaccucucgccaguuccgugaggacgacuuccguagagucgucgauuuuaucgaugagggagucaacauuggcuuggaggugaagcgcaagacuggugaguagcuucagagguccuuggucaaccaguuucacccgccuccccgcacccuagcuccuggccccgcccagcagcccucugaucaacuucucccaccgaucucagccaagcuccaggauuucaaauccuuccugcucaaagacccagagacaagccagcguuuggccaaccuccggcaacagguggaacaguuugccaggggcuuccccaugccuggauuugaugaacguugaggacaguugaggacaccuggcggucggucagaagcccacagacccggaaguuaccuuucuucccgccucccuggaccauagaagagaugucacuccucucuggguuuuaguggagggagggaggccuuccauuuagggcaagagccaggcauaaacucccuuccagaauuuguagcugagauuucugaucuuuaaccgugucuacacgaagcacccaguugacauccgacuuguuuuugagacgggggucucacuuagcugugaguggccuugaacugacccuuccaccuucauuucccaagugcugggguuauagguuugcaccaugacacccgacuucgcccucagcuuuccaccccgacccucccacuacaucucaaguguuacagacuccccucccgcucuuucuuggggaagaggggguggguaagcgcccuccuuccuguuuuuaucuaauaaaaugcuaaccugcc

SEQ ID NO: 5800 - RNA, 34147 nt, Mus musculus
ccuacacccuaaaccuuaccuuauacccacauaccagguguagccuaucauccccucccccagccugcacauagacauacauaccuacaccuggcccucucuugugugugugugugugugugugugugugugugcaguguccacaugccaccccaugcgagguucuccccgcuguugugaacccccauggcugcuggggucgugcagagcucuggaauguuaggugggcaauuugggaguguacagggccagggaacccucuucagcuuucgguccccccacucccaccccugcucaggugaacucucccccugccguaucaacaauggaggcugccaggaucugugucugcucacccaccaaggccacgucaacuguuccugucgagggggccggauccuccaggaggacuucaccugccggggugaggaagcaaguuggagcugggacaggggcugcuguggggugucagcacaagagacccuuauuccagacuccagcccaggcuacaaggcuggacucaggcuaggucgcaacucaugacaccuucucccuccgcagcugugaacuccucuugucgggcacaagaugaguuugagugugccaauggggaauguaucagcuucagccucaccugugauggcgucucccacugcaaggacaaguccgaugagaagcccuccuacugcaguaagggcccugcuccagccccucccccaguccccugugccaugugacccagcuccauagccucagcucaugaagagcagagcuuggaccuuaggaagggacggucauugguggggaggggggaaagaagccccuuccuaugccugcugugaccacgcacacccuccccucacagacucacgccgcugcaagaagacuuuccgccaguguaacaauggucgcuguguauccaacaugcuguggugcaaugggguggaugacuguggggauggcucugaugagauuccuugcaacagugaguacaucccagccucacccccaguacccugccacaccccugccuuaccccuaccucaccacagccaucugccucacccuagccuccugccucaccacagccaucugccucaucacugccuccugccucaccccugccucaucccagcuucauccuagccuccugccuuaccccugcuucaccccugcccucaccccugguuuuuagucucagacuguaccccguccucacuccggcugagcauuuguccccaggcacucugaggacaggcgagaacucuguccugggccuuucuggcccugcagagggacacuggccugaugguacuggugggcccuguucuagagacugccuguggugugggugaguuccgcugccgggauggguccugcaucgggaacuccagucgcugcaaccaguuuguggauugugaggaugccucggaugagaugaauugcagugaguaacagccugcucaugacugacagcuggcccaugacugauggccuacucaugacugacagucugcucaugacugacaguuggcccaugacugacagccugcccaugauugacaguuggcacaugacugacagccugcccaugacugacagcuggcccaugacugacagccugcuccugccuacuuuccugucccuccugccucaggcuguucugccuuauuuccucucagccccccuggccccaaauaguagccucuauccucucugaccuugcuuuuucucccuccauagagguagugagucagugggcagcaggcaccaaaucugaaaccauaagucuaacauggggccagcaauugcucccauagugugucuuagaaggagcuaggugugaccccucacccacccucaccaccccuucuauuccaucuuccacauuggccccuagguggcgcccugcccuuccucuucucucgugaccccacugacccacccucccuccaccagguaccacagacugcagcagcuauuuccgccugggcgugaaagguguccucuuccagccgugcgagcggacaucccugugcuacgcaccuagcugggugugugauggcgccaacgacuguggagacuacagcgaugaacgugacuguccagguuggccagcggaagcucgccgggugaacgggagacccggggcuggcagugucuucauggcuggcagagucuucacaucucccuucuacccccaggugugaagcgcccuaggugcccgcucaauuacuuugccugccccagcgggcgcuguauccccaugagcuggacgugugacaaggaggaugacugugagaacggcgaggacgagacccacugcagugagugcccugggacccuacccagcucccaccucacaguccuuauggaaagcgcccuacacggggagacaccuggguuccacugugucucauccucucagacuccagaauagagucacuucuucaguuugugaugagucgcucaccugcccugccuuuccuugucuucuuauuacuuucuccucuauuccagacaaguucugcucagaggcacaguucgagugccagaaccaccgguguaucuccaagcaguggcugugugacgguagcgaugauugcggggauggcuccgaugaggcagcucacugugguaagcaguggccugaauccgguucagggcggucaguguccuacccccuaaagaaggguccauauaccagugggccauguuaucacggcugccugcucugcccuguccccuccugagucucucugugucuccuugccccucaugcagaaggcaagacauguggccccuccuccuucuccugucccggcacccacgugugugucccugagcgcuggcucugugauggcgacaaggacuguaccgauggcgcggaugagagugucacugcuggcugccgugagugggagaggccgugaggaaugggugggcaucaagccucgcagccuugcuuugcaaacacuggcaaaugaggucaaggguaggaagaacuucagugggagccgugcguuuaaggagaucacagauccagaccccucccauucugcccauugcuaccacucauguugcaggaaacuuaggauugggggugggggagugacuaucaacagcuaguaaguagggcagggcaggaguagggcaggccugaggagggacucugccuccauccccaguguacaacagcaccugugaugaccgugaguucaugugccagaaccgcuuguguauucccaagcauuucgugugcgaccaugaccgugacugugcugauggcucugaugaauccccugaguguggugagucccgugacuggaggaguagcccugccuagccgugcuggagguccagccucaucauccccucccccaccacagaguacccaaccugcggccccaaugaauuccgcugugccaaugggcguugucugagcucccgucagugggaaugugauggggagaaugacugucacgaccacagcgaugaggcucccaagaacccacacugcaccagcccaggucagccucuagguggagcccuuucuccuuccugugaccccacugaccuguucccaccacccuccauguuggccucuagauggcucccugccccuuccuccuccucuucugugaucccacugaccaguucccgccacccuccacagagcacaaaugcaaugccucaucacaguuccugugcagcagcgggcgcugcguggcugaggcguugcucugcaacggccaggacgacuguggggacgguucagacgaacgcgggugccaugucaacgagugucucagccgcaagcucaguggcugcagucaggacugcgaggaccucaagauaggcuuuaagguacucaggggauccgaccagagcccuuuguuccucccccucaucccuccaucgaguacuuauugagaacccacucugccagcaguauacuaggcucugaggacauagcagggcagacagaagucccucuucaguuagagccucagagccagugggcuguguucacgggugagaagagaguggguugucaaguagauauguugcucuggagcucaagcuaaaggccaggccuggaggaagaauuaucaccccagagaggcuauuuaaacccccgaggaagugaauagagaugauaaaaggccuuagccagcacuaagcuacaucgagggacuaggaggcuagggaagccaccaagacagaaugacagccacaugaggaaaacucggagggacagggugcacagauugcagucugugugucacuugccucccccagcccuccugagggccucuaggcgucguugguucccagaagcauagacuccagccgcuuccucagcugcacaucccuuaccccccacagugccgcugucgcccgggcuuccggcuaaaggacgauggcaggaccugugccgaccuggaugagugcagcaccaccuuccccugcagccagcucugcaucaacacccacggaaguuacaagugucuguguguggagggcuaugcaccccguggcggugacccccacagcugcaaagcugugaccggugagacgggcacuuggagggugagauguauuucaggcagcugugggauugggcagcagguggcagguagggagagggcuugauacaauguagcuggagauagccugggguaccagggcugcuggagauagccugggggacuagaggugcuggagauagccugggggaccagaggugcuggagauagccugggggaccagggcugcuggagauagccugggguaccagagcugccagaauauaccuaagcuuggagcugagccgagacccuccuccuacagaugaggagccauuucucaucuuugccaaccgguacuaccugcggaagcucaaccuggacggcuccaacuacacacugcuuaagcaggugccaaaaccaagccuucuuuacacccguuguugacugcccgggcccaguauggccuccccaguucuucccaccgccaggccaugguugucuccuucucccucucccuccagccacauccugacuccagacauccuuccccagauacacaugugccccugcggcagcugacuucccuguccccaucccaaacccagggccugaacaaugcggucgccuuggacuuugacuaccgagagcagaugaucuacuggacggacgugaccacccagggcagcaugauucgcaggaugcaccucaacggcagcaacgugcaggugaaaacagaaggcugccccgugucggcugacaggcacaccagggccccgcugacgagccucacacccuccccauaguccuuugcuguaaaagagucuccccuucucucacaccugucaacacugcuucgcccugcuccucccugagccacagaaacguucugcucgcuucaccuuccccuccucucaacucaaaaguaugcaagcacaggagacuccuccugccuucccuugaguucugugugcucuaggcguguguggguggccccagagacccccugcuuggagcuccuggugauagccacuuacggucaggagaguggagaagccaugccccggagacugagggugccaccagcuccuccuucccuguguuccuuacagguucugcaccggacgggccuuaguaacccagaugggcuggcuguggacuggguggguggcaaccuguacuggugugacaagggcagagauaccauugagguguccaagcuuaacggggccuaucggacagugcuggucagcucuggccuccgggagcccagagcucugguaguggauguacagaaugggugaguggugggcagagggguugggggagcccuagaaaacacccaagcccggacaaccugcaggcuccuggugggaacagucucuagacucuuaggauucacugcuccccaccugccagguaccuguacuggacagacuggggugaccacucacugaucggccggauuggcauggauggaucuggccgcagcaucaucguggacacuaagaucacauggcccaauggccugaccguggacuacgucacggaacgcaucuacugggcugacgcccgugaggacuacaucgaguucgccagccuggauggcuccaaccgucacguugguccguaugcuagagaggcugcccaaggccagcagaccuggggggcagggaucuaaaggguuuaggguggcaagaaggcaaagugugcagaaaccacaacccagaggucuugggguuucaauacccuggcacuucucugggaugggcccagacuccaggccucaauccagcuccuuagaggaacaagggcuauccccugugcagcucaggauaauggccugaggggugggcacaugaggacuuccugaagaacaccugugcuucacacuuccugagagaagcugugaccuacuccagagcagugguauggcugcuggacagcuaucgcuguugagccuuaggaagucguagaagcaucaggaccugggauucauucccaucucaggguugugaugggguuuaaggaagacaaguaggcacagaaccuagccuguacucggugcccacuacugcugugucucccauagugcugagccaagacaucccacacaucuuugcgcugacccuauuugaagacuacgucuacuggacagacugggaaacgaaguccaucaaccgggcccacaagaccacgggugccaacaaaacacuccucaucagcacccugcaccggcccauggacuuacauguauuccacgcccugcgccagccagaugguaaucgagcagaaaaaggggggaguggcaagccuaguccaagcaugaaaggccuguucucagccagggucagguucccuccccggcacugacugagcguuccugcugggucccgaacuuacagaggcuauagguccccuagcagcuucagucugcccugggcucaauguggggucucugacagccaggcccuaaaguaguagagagcccagagauuagugaguguggaccaagagcaucagaggaaacccugaaagcagacauauucaggguaggauagagauguaccaaggaggccagacauccuuuagaaggcuggaaaccauucccggcaggacccacccucacagucagagaagccagugggcagccaugacccuucaaccucuuucuccuggcagugcccaaucaccccugcaaagucaacaaugguggcugcagcaaccugugccugcuguccccuggggguggucauaaaugcgccugccccaccaacuucuaucuggguggcgauggccguaccuguguguccaacugcacagcaagccaggugaaguuccuccuaagaugcccaugcugcaacaccccaauccccugaccccacacuccuguuucccggcacccacuaaugccugcaccucuggcaugccgacacccgcacacuuccugccuaccucuuguguccucacggcaauccuuguacacugccaccuuauaaacaccucuaauacugaucucaggaggaccuagaguccucgccuucccaugcucucccuguacagacacccccuugucuggcuuuccuagguccauuguagcccugcuuucuguccagcucugccaccccacaaacucccacuaugucccugaaacguuuccaccccgugaaagaaagccuucugaguuccucauacccuuuccaaccccucuugcccaccuguccuccaguuugugugcaaaaaugacaagugcauccccuucugguggaagugugacacggaggacgacuguggggaucacucagacgagccuccagacugucgugaguguccucgacgcccccaagggauggagaccucaguggccuauuugcucccugcucuuucuuuuuuagugugugcgugcaugcauguguguauaucuaugugugugugugucugugugcaugugugugccugcauuugugugugugccuaugugucugugugucuguguacauguguguaccugcaugugugugugcauguaugugcuuuuguggaugugccuacgugugcaugugugugugcacguaugucugugugaaugugugucuguguguauguguauaucugugugugcauguguaugugugugccgugugugcccaugugagugcgugucugugugugccugcauguauguguaugugugugugugugugugugugugugugugugccugagugccugcaugugugcagugugcauuugccagugcaggcaugcacaugcuguggugaaauguaugacaguccggggaaaacucucagaaauuggcuuucucuuuccucacuggguucugaggaucaggcuuagguggcaacacccaccaggccaucuugcugaacccaucuccuacuccuaacacugagucuccuuucucggcagccgaguucaagugccgcccaggccaguuccagugcuccaccggcaucugcaccaacccugccuucaucugugauggggacaaugacugccaagacaauagugaugaggccaauugcgguaaggagcugccuagauaccaaccauuccuuccgcagcacuuggggguucagagagugaggaugugccagccugcagcagcuuucucucuaggcuacauuucugggcuuaggaccgcaguccacccauccucuacaagggacagggaggcaccugccugcccgcccugaguucccuccuucucccucucccucucccucuccuucucccucucccagacauucacgucugcuugcccagccaauucaagugcaccaacaccaaccgcugcauuccuggcaucuuccguugcaaugggcaggacaacugcggggacggcgaggaugagcgggauugccguaugugccagguucugggaagugggugggggacguagcuggcacacaccguuguugcccacugcuucccauagaggcgcugaguuagcucuauuagcgggggacaucagucacauuggacauuuccugguuugcucguaaaaacacugugcucgguauggacagucugcagauccaggcuggggauaaucuauuccuuccugacugagaccagggccaggcuuucuggggagcgcgugggggaccaaagcugugaggagauaaaggguaagguccucguucucuguuccaucuugcagcugaggugaccugcgcccccaaccaguuccagugcuccaucaccaagcgcugcaucccucgcgucugggucugugacagggauaaugacuguguggacggcagugaugagccugccaacuguagugaguuguccgucgccccugggccauccuuccucacggccucuguggcuccauuacccaggcagacagaccccucccucggcugccguacccuugcccaguggcucucugguggggacgacuccuccucacccaugccgaugccuugcagcccaaaugaccuguggaguggaugaguuccgcugcaaggauucuggccgcugcauccccgcgcgcuggaagugugacggagaagaugacuguggggaugguucagaugagcccaaggaagagugugguaagcccagccaucuugagaggauggguguuugggguucuggguagaaagaaguucagugguugaccucucugggcggagccucgacgugacccagcguggggcucuuguggaccccauagagcugacacgggaaggaagcuuccccugcagugcccaccaccucugaauccugcuccucucccucucugccccucagaagagaacugugcagaaucucuacccuccuguucaccugucccacccccccaaaucagcugccuuccccaaacacuuugcuggccuuccccagaaccuccuguagauaccacacggcaauuaucacugccugagccccagagcaaucucuuucggggggcaauaaccaccuucucucugccgccggucucacuugucuacccuagacucuaacaucugccgcccacuccaccccugaccgccccaauaucugccuccacaucuugccucccccagaugagcgcaccugugagccauaccaguuccgcugcaaaaacaaccgcugugucccaggccguuggcaaugugacuacgacaacgacugcggagauaacucggacgaggagagcugcaguauguccuacgccuuacccugccccaucauuuccuuucccaggccuuggcaucucccuccucagcaccucaccccuucuaacccccaccccgcgcaagaggguggccuccaagggcaaggggucaggcaccccucagccgcgcucuacccuacucuauguccuuguacuugagcuugugacauuucaucucaucucauguuucucuccauuuucacacuguccucuugggguugcagagguaggugucucugguguaccccuguuccugccagcucugccucugccuggagccccgcccaucccugugcugugcuuuucugcccaccguccuuaacuggccucuuccccagaccuggcgcuugucucgguggucuuguucuccccucccuccccuaagugaucuguccuaaggacaggaccagggacccgugcccucucccaugugucuguaccuaauaggauaagugugaguacccuccugacccagccagucucgugaggacagccaguuaaacacuguccgccauugguugagugucucaaucauuacaccagucggcuguggccucuucacagacggacguagggaugagccuugugcuugggaguuaguauuucugagggcuggagaugcccugugcccacccugcugggaccugucucuccucagcaccucggcccugcucugagagugaguuuuccugugccaauggccgcugcaucgcugggcgcuggaagugugauggggaccaugacugugccgacggcucagacgaggugaggagagcucgaggaaagggguggucucggaagaauuagggcaggaccccaagggucugauugggcugcugguccccaugcccacagaaagacugcaccccccgcugugauauggaccaguuccagugcaagaguggccacugcaucccccugcgcuggcgcugugacgcggaugcugacuguauggacggcagugacgaggaagccuguggcacugggggugagugagccccuucauccuggugccuccacccucccugccuuccccagcccacuguguggcccaguuuaaucuuuuaauucagccauuuguugguacugcaacaaacccuuauuaagcauauacugcaagccaggcauagaccuaguguuggagcaguagacaagacucaggcucacuccgugugcauuuuaugcagguuuuacccuguuguacuaauucuuuucaucucacuggggguuucuacccuccuuuaaucacucaguucccagauaaaagacaaaacuuauauuuauagcaagccaauaauauaccagagcuaggcagauauccacccucuaagcuauuuagaaucuacuuccccaucaauaacccugagauacaacuugccauguuccaucugagcagcucuuaacuccaauuggugagcccucuuggacauguuuucaugacucaccuaccccauggcaucuucucccucuccugguggucccugccucagacccccagccugggaauugaaaccccaccuauuucucuuuuguccagcuauaggcuguaggcaucuuuauucaccaaucagggauaacuugagggacaagguuacauuagcaucacuugggucccugugaaaaucuccugcucccugggggcaaccaggaccaguauuuagcaauaugauacauagugauacaauacaauacaauacaaagugauacaguacaguacaauguaacagauuuaacaucagcggugcucuaaccuugcuaaggaggcuagcuagguagagaucaugcagacgccuguaguccagguccacccaugccuuuuccaccucccacccaguugccuguguuaagaggccaguuccuacucaucuuccuucccuggggcaggcggugagucaggggcugcucuagccaaacaugccugggcucagccacuggaggggucaguggacaccugucagaagagaagcaggggucucaccugcaaggcagccuucugguucugccccaugggcugaugguagcaaccaaagcuaagucuccaaacugccgcacaucugugccugccacagacuauacuagacucgggugucccaccucaccuacucaaggagaacauccuaaaccccugucaacacugccccaaguagccucuccucccccuaaauaccagaggaagcacauugccccucugcccacugggcagaaaaugaagacgacugaguuugauucagugacaguuucugugaugacccccgggccucagucccacccacggugcaagugacagacagcauccugcagccgcaguugcauucauucuuaccccucuguucacccugcacccagugaggaccugcccauuggaugaguuucaauguaacaacaccuugugcaagccgcuggccuggaagugugauggagaggacgacuguggggacaacucagaugagaaccccgaggaaugcggugagauguagggaggcggggggcuggagagauggcuuggagguuggagguuaagcgcacuggccgcucuuccaaagauccugaguucaauucccagcaacugcaugguggcucaugacaaucuggaaugggaucuggugcccucuucugguguaucugaagacagcaacaguguacucauacaaauaaauuagauuuaagauuaggggucauccacagcaaggaugcuggagaccuggcuucuauacuccccaguggccagcucuucccuaccacuugcccccaacacugauuguggcucugucuccuggcuucuacagcccgguucaucugcccucccaaccggccuuuccgcugcaagaaugaccgagucugccuguggauugggcgccagugugauggcguggacaacuguggagaugggacugacgaggaggacuguggugagcugagggcaaugagccggggcugaggggaccugcaucuggggagcagacugcuauaaggcuuucaaucuggcaagaguggagcccuugggaaagguauggguggccuccuggagcccugagucugcaaggucagcacacacacccucagcuuggcgagcagccaggacacaccuguguucaugaagucucuguggauguacggguagugugcucuguauccagagccuaaagccucuccccuccccagagccccccacggcccagaacccccacugcaaagacaagaaggaguuccugugccgaaaccagcgcugucuaucauccucccugcgcuguaacauguucgaugacugcggcgauggcuccgaugaagaagauugcagcaucgguaggaccagaccugagagcagagggugggugggcaccaggggguguggcucaggggaaaaccagagggcagggcucaggggaaaaccagggggccgggcucaggggaaggacuccaccaucuguccuccacagaccccaagcugaccagcugugccaccaaugccagcauguguggggacgaagcucguugugugcgcacugagaaagcugccuacugugccugccgcucgggcuuccauacugugccgggccagcccggaugccaggguaggagagccggaugggagauggggcaggaaccccagcuccuagacucccccaugacgcccaguguaacccccagacaucaacgagugccugcgcuuugguaccugcucucagcucugcaacaacaccaagggaggccaccucugcagcugugcccgcaacuucaugaagacacacaacaccugcaaagcugaaggugcuagaggccggaagggccagaagggccugaaggggcagggccagaaggaaggguggaagggccugaaggggcagggccagaaggaagggugggcagggucgggccacaccagcuauaaaauggagcuggccuggaguggaacauucccaauggcacuucguugcucagacuuggaugcccagacucaagguacaccgggaugccaucccgagcaaagcaaagcacaggaaagguagaagguaccgccuggcuuucuggggaaguucuaugagagcaacacuccuguguggcacacaguguccccuccccucuccuagauugagaguauaguccgacucacagucacaugcacccaccugcauguucccuccaugcccugacacagcacugcaccuuucauauguccucacaccguacauguacaugguaugcauauacacacucccauguauacauacauuucucaugccuugcacauauccuccacaucucuguaccgcuucagcacuuaucagagucuguagcagaccuacaugcuaaccagagaccacaagauagaauucuuggaacuaucaggaagcagguaagagaagaacagauuucugaagggucuggucagucuggaucagcuuggggcacagguuagagcccuuggaucugccauuggcuccacccacaccggaaacauccccuucugucuaaaacaaauggucugguuagaucggaggcuacuguagugugacagggucuuggucaaaugugucccagggauggaacucgggcccuggguucucaccucuaccuuucaagcccaucugauagguggucucucucacuccggcaggcuccgaguaccaggugcuauacaucgcggaugacaacgagauccgcagcuuguucccgggccacccccacucagccuacgagcagacauuccagggcgaugagaguguccgcauagaugccauggauguccaugucaaggccggccgugucuacuggacuaacuggcacacgggcacaaucuccuacaggagccugcccccugccgccccuccuaccacuuccaaccgccaccggaggcagaucgaccggggugucacccaccucaauguaagcauccagccugucagagaugggguggaagagcuccgcaggacagaguguaggggcugagagggcagaaaacuagaagacaggaguggucaggucagccugcuaggcacagcuaacagccagagcaauaaguaguauuuggggcuggagagauugcucagugguuaggaacaauaacugcucuuccaaagguccugaguucaauuuccagcaaccacgugguggcucacaaccaucugcaaugggauacgaugcccucuggcacucagcagcauagccuacucugauaccucugagucaguacuggccaacuugcuuaaugcgugggcuuuacuuuauugacaaaaugaauaauagcucuccugggcuuaaguagaguucagagguggaaugugugaaacccuaggcuugauccucagcaacaaugaagauauaauaauaccuagucuucuaagcuucuuuauagaucuggcugcuuggguuuuuuuguuuuguuuuuuuuguuguuguuguuguuuuguuuuguuuugugcuaaauuugaacuaaagacuucauggaugcuagccaacugcuuuagcaaugaacuacacucccagcuucagacugcuuuuuuuuuguuuuuuuuuuuaauacauugagugugugugugugugugugugugugugugugugugugugugugugugaaucacauguacauaccacggcacacauguagaagucagaggacaacuugaaguuuguucuuuguuccuaccaggagucccagggauuggaacuuagguccucaagcuuggcagcaagcaccuuuacccacugagccacuucacugcccccaccacuuuuuaaaagugagaauuaacuagaaaaccaugaaaaugugccuggcaugguggcgcaugccuguaacuccagcuguauucauagcagaggaaggaagagcaagagaaaagggucagucuaggcuacacagugaguuccagaucagccugggcuaugagagagaccuauucaaaagcaaaagaaccuagaaacuguggucacgucaguguggggugacagacaagaacaggugggcagaccaaggagaaugggggugacaaucagggagacagaagauggcagucgcugaacauaugaccccacuuagauuucagggcugaagaugccgagggguaucgcuaucgacuggguggccgggaauguguacuggaccgauuccggccgagacgugauugagguggcgcaaaugaagggcgagaaccgcaagacgcucaucucgggcaugauugaugagccccaugccaucgugguggacccucugagggggugggcacggguccugggggggagguaucugggcuggugucccucaagacaggugguaggcucgacauccacaggcagggggcagagaccucaggcugcuaggcuucuccaguccuggcccuccuaaagccucugucggggacucccaguugaauagcuuuacuggcagccaagaucugggacccccugcaggcauagcccugcccauucagaugcuauuggcuuagcacauuguaguuagagcagaugaugcuagcaugggucggcagcugucuccuggggcucauugaaggggacaggguguuuccucacaauacccaggagcguccacaccaggccaggugcccucucuuccaucucacucugucuccuuggcccugggauccaacccacucucauuucucccuucccagcaccauguacuggucagacugggggaaccaccccaagauugaaacagcagcgauggauggcacccuucgggagacucucgugcaagacaacauucaguggccuacaggucccuggggcagggguaggguguggaaggggcagacucugaucauggcugcuucagaagucaccccugcgugcaguggggcgggcaaucuccagcagaucaggccgagggccaugggagugcuucccggaugggcggcugggagagauccuaugagccggguaggauacaugccguggauaccagacagagucagcucuguucucugcgcccagccuggcgugacagaagcugaucucugacagacagcauucucucaccccagggcuggcuguggacuaucacaaugaacggcucuacugggcagaugccaagcuuucggucaucggcagcauccggcucaacggcacugaccccauuguggcugcugacagcaaacgaggugagggugcuggcaggcuugguucccaucaugguccccaacaucaucaucaggcuucucacugagcucaaggaugucucuucagaagccuggcacccagccagcccgugagccugcgccuaccugaccauuuuauucacucuaccaacaaguaucaaguuguguggggucagcaggguaaaugaagggagagagagcuaaagucccccauggccccagaaaucuugggggugaugagacaauuugccaguggcagggauaguucuagauauguuaggucugagacgccuacacugacaggugucuuaaagacuggguccagggcccaggcgccuguagugacuuaaccuggcugucccugcaccccaggccuaagucaccccuucagcaucgauguguuugaagacuacaucuacggagucacuuacaucaauaaucgugucuucaagauccacaaguuuggacacagccccuugaucaaccuaacugggggccugagccaugccucugauguaguccuuuaccaucaacacaagcagccugaaggugcaucagagggaaaacccgggguguggcagggugggucagugauaaggagggugccgggcagugguggcgcaugccuuuaaucccagcacuuggaaggcagaggcaggcagauuucugaguuugaggccagccuggucuacagagugaguuccaaggcagacagggcuacacagagaaaccaugucucuggaaaaaaaaaaaaaaaaaggaaaauguucuaaguccacacugcucaacaucgaccccuuccaacacccacagugaccaaccccugugaccgcaagaaaugugaauggcugugucugcugagccccagcgggccugucugcaccugucccaauggaaagaggcuggauaauggcaccugugugccugugcccucuccaacacccccuccagaugguaugcaugcccuuuuccuggguaccugaggaucccuuaccuauagccucuggcuccccuuacccuugacccccuuccccuucccaugcucugaugagcucuuacugcagccccuaggccuggaaccugcacucugcagugcuucaauggugguaguuguuuccucaaugcucggaggcagcccaagugccguugccagccccguuacacaggcgauaagugugagcuggaucagugcugggaauacugucacaacggaggcaccugugcggcuuccccaucugguaugcccccaaccagggaugguccucucccaucauccucaccuggccccuucuaucgccuccagcauccacuucaaccccaucuguucgucaaggugccuaggaucccugcuauaggcccaggugguccccagugccauggucccacucacagauccucucccaccaggcaugcccacgugccgcugucccacuggcuucacgggccccaaaugcaccgcacaggugugugcaggcuacugcucuaacaacagcaccugcaccgucaaccagggcaaccagccccagugccgaugucuaccuggcuuccugggcgaccguugccaguaccgugaguauucaccucaaccccagggaaggaagaggggagccagaaagaacccaaaggagcagguugagaggauggaagacguacgcagaugagccaagcccaggcugugggugcugccucucauguuggcgcaucugccuaagccuccaggcauucaacacaaggaaugcuuagggucauccuaguguucuggggucugugacagggcauuaggaggcucaggagugggugggaguuauucauaaguccuggacccugcauaagguacuuccucuccacucccaaccacagggcagugcucuggcuucugugagaacuuuggcaccugucagauggcugcugauggcucccgacaaugucgcugcaccgucuacuuugagggaccaaggugugaggugaacaaguguagucgcugucuccaaggcgccuguguggucaauaagcagaccggagaugucacaugcaagugaguggggggucuugccuccacauucugcucugucuucuggccccgccccauccugccccuccugggcccgcccccucuccgggcccuuccggccccgccccuaucuugccccuccuggcccgguuccuguucuagcaucccagauacccuucugcaagccccagcuccagauuuugauuccuuuccacagcugcacugauggccggguagcccccaguugucugaccugcaucgaucacuguagcaaugguggcuccugcaccaugaacagcaagaugaugccugagugccagugaguuggccccgccccaucaaaucugagcaaaggaacaauaugaccuaugaccuccuaguuccugcagcuaaaauggucguggaggugaugcccacccacugaguuuugcuuucuugccugcaggugcccgccccauaugacaggaccccggugcgaggagcagguuguuagucagcaacagccugggcguaagugguggggagggcagggcugccacgacauagagcaagaagagccuuacaccucccaucucccuaggcuucagacucaguuucccgacuucucucuccagauauggccuccauccugaucccucugcugcugcuucuccugcugcuucugguggcuggcgugguguucugguauaagcggcgaguccgagggugagccacugggagucugagaaauucuggcuguuauuuuacaauccgauaaccuuaccaacaucacgguucccugacuccugccucuccccagggcuaagggcuuccagcaccagcggaugaccaauggggccaugaauguggaaauuggaaacccuaccuacaagauguaugaagguggagagcccgaugaugucgggggccuacuggaugcugauuuugcccuugacccugacaagguaugccagaggccaucgaaggggcuucuggaacaggaucaaaggccggaggggugggguuggggugaucaaggcaaccagagguguuacacagaagugggagcugggguauucuaaucauaugaaccuuuuuuuuucccagccuaccaacuucaccaacccaguguaugccacgcucuacauggggggccacggcagccgccauucccuggccagcacggacgagaagcgagaacugcugggccggggaccugaagacgagauaggagaucccuuggcauagggcccugccccgacggauguccccagaaagcccccugccacaugagucuuucaaugaacccccuccccagccggcccuucuccggcccugccggguguacaaauguaaaaaugaaggaauuacuuuuuauaugugagcgagcaagcgagcaagcacaguauuaucucuuugcauuuccuuccugccugcuccucaguaucccccccaugcugccuugagggggcggggagggcuuuguggcucaaagguaugaaggaguccacauguucccuaccgagcauaccccuggaagcuggcggcacggccuccccaccacgccugugcaagacacucaacggggcuccgugucccagcuuuccuuuccuuggcucucugggguuaguucaggggagguggaguccucugcugacccugucuggaagauuuggcucuagcugaggaaggagucuuuuaguugagggaagucaccccaaaccccagcucccacuuucaggggcaccucucagauggccaugcucaguaucccuuccagacaggcccuccccucucuagcgcccccucuguggcuccuagggcugaacacauucuuugguaacugucccccaagccucccaucccccugagggccaggaagagucggggcacaccaaggaagggcaagcgggcagccccauuuuggggacgugaacguuuuaauaauuuuugcugaauuccuuuacaacuaaauaacacagauauuguuauaaauaaaauuguaaaaaaggaaaaaaaaaagaaaagaaaagaaaagaaacccacugugucugcaugcuaaugugagaauuugggagcuggggcugugcuugccuguuccagccaccagagggagcauugcugcaugcuggaggcuggccugagaauccuaagguccacgucuccagccccacuccauccuccugucuugcuauggcagggaagagcuguuuugcucaguguaugaccuugagccuuaugaugugacugguaggaucuggugucacccggccccagugcauugacucagacaugugcuucacuguucuccugcccuacacuggccccacagugagaugccacccuagaaaaaagcacacuggguaaugaaggccuuuaggaaggucugcuccaugcuccuuuugaaauguugacaucucacucuaugaccuaugaguaaaacccuggcuguugggccagcagaauggcugggugggcaaaacacuugacuuugcaagccugguagccugcguuugcucuuggaacccauguaagagugggcaagaccaccgggcagugguggcgaacgccuuuaaucccugcacuuaggaggcagaggcaggcggauuucugaguuccaggacagccagagcuacacagagaaacccugucucgaaaaacaacaacaacaacagcaaaaaaaaaaaaaaaaaaaaaaaaaaaaaaugggcaggaccagcuccguaaaauuauucucugaccuccauauguacgcuuuggcaaacacagaauuuuuuuuuuuaauuaaauaccugcauuaggggaugagauagaggggaggagagccagcaaggcucaguuugcccaucagcuuccgacauaugccucucucucaacaaacauugcagacauuccaggaguugaccaggaaaggacuuacacuaucuuaguuguuccagaucuccuugaaccucuuucaaaggggaaugaaccccuugcggaagacuaugcagcuuuacacuguccaggacugggggaggguuagaacccugcucuucuaacagcagcaaacaaugccucccaaaggagcuguccagcuuuucaucucugacccucccaggguauuucuccuuugaauccuccccucggggaagcuuauggguagaugaacauccaaagacaagacccuccuuuucuaucaucaauuuuaucuccaaccucaucccugaagcccggcuaugagaucuuccuugcuccuccagacuccuuaugacucugggaugagcgauccugcugggaauaaaauggggguggggguggggguugggggggggucauuguugauccuuaaauguugacuuguggcucuuucuggccaccagguggcgucuacacugcuguaacacugcuuauccuaaagcuccccacacuaauuaugcaccugcugccgaggacccuagcccagccucucacuuccuucccuggggcuauuuugcgcugacccuucuacccucugucagccaucuuccuucccucccccagagucugcucauuccccaccaccaguaaucccacccucuccaccccuuccuucugccagccugcaucuguagccccccccccccccggagccacugauucucugccugucaccucaagaucucggguagaacaagacaggcccccaacugcugcuuuagaaagccuaccccuucguuagcacccucccucucuggccaggaccagaagggugcacuaucuucaaccaagccaaaugcaagggagucucaaaaaccaaaaaggacacugacugauucagaucagauugaaaagcagauauucuuagauggaaagagucagggacagaggcaaagacccagagauaaguacugugcacauguguguaugugugcaugcacuuguaaucucugagagaauuggacggccugagauuagcuaaaacgauggugauggggagggucaggucuccuacagauagauacuuuggccgugggcuucuaggcacccaggaugugugaccacccuuugccuucacccagaacuaaagcagcuccuuugcuuagggucagcccuggccagccauuuggccuugucccugacacuuugucucauccugccuuuauucguucagcccugacugcaccccaaaucgcugcucccugguuuuugucuccuugagugucaccaaguacaccccuguccuuucccugacccucuuuucagugucugucacuuccugugugucuguuauuuucauaucccuaggcuugucuuucagauugccugugugugugugugugugugugugugugugugugugugugugucccuguggguauuugccucugucaaggcaagagguacuuuggguaccuagcuguuucuguauaucacuguaugcuacuguguguauaaaucauguguguccgucucugugugcuuaugugccucuguguaugcuggucuguaugugaaguggccucacugcuacaguguagcaggguacuauuacagugggguaagacuggagacacaccuugggaugugugucugucucuucaucucuuugcaugguccuaucucuugcugucuagguguuggucauacuaccuacucagccucagacacagcgcauagcaacagcugacagcugaagacucccuggguaggggagagagagaaagaccagugggaggaggaaacacgaagaaacagcccugaggaugagaacagagaccgugcuggagcuggggacagagagagacaaggacagagauagacagggaaggggacgggaugagaagagcugagaguggaagaugggauugugggagagaaagcacagggcucguaccaagaggggcagaaggcacugaggacuuccugccuagcaccaaacaagggugcucuggaucaggccagggucaacagugcggaucaggggcuaacuuaaaagagccgguuuagccaagggguccgggggccgcagaggugccgcggggcggggacagggcggcgggcgccguuugucagcccuauugacagacgugaugggguuuccguccgugaucaaugauucucaucuccaggccgaaugagccgcggggcgcccauccauccccgucagcgccgcgcucagugcuagucgcccgaggccccgcccgcccucaccucggucccuguccggaucacugcccuagaccuaccucugccaggauuauagaaacaccccccacccauccaccucgggcaucacaggacaggguccugcugcguucccuagccuguguaugggaacucaugcuccgcgacgaccccuucccgcucacaguucagggccuagagucccacgcccuauuguagcccucaucugccccaagaccuggcgucuuuggggugcugcuccccaaaccccuugccccucuccagcuucacaccugagccagggguguguccagggugugucacggugaaagucaccuuccuugcccccagcugggcgggagggggcgcgcggggcgcggccgggauuggagcaccgcggagccccgcccccccaccccgcccgcccgacucagacccaacuuucucccccgcccgcgccccgcccccagcgccuugcuccgcuccgcgcucaguccgcgggccgagccgcccgcucccgcugcucgcgccgccgcccucugcccggcgucccucacccugagcccaguccugccggacucgggacccgcccugcccgacccgcucgaccgcucgggaagaugcggcugcucccggaauggcuccucuugcucuuugguccuuggcuccuuaggaagguaaggguggcagagccaaggugcgggguccgggacacgaagaacacugcaugccagggggcuccgcgcguccgccccgcccccaggacuaagcgucccaacuuugugcgucgugggggacguggacagacagacugcccgcuuuaggacuggcaugcacccagcaaguuggcugaggguuagaagaaggugcaggguggaggcccggcuccagucggauucaggcgcgacggggggaggggacgaagcgcgacccgcgagugcgccagacagagaaggagugcgagacagacagacaagccagcggguguuagccuagccuucuuuccgcaccuaccucgcuugccucccucugucugucugucuguccuuccaccucucacccuccaccuucccauuccucuucuccuugucacaaugccagguaagcucugcgauccgagcauacauuauccaggcacacgcgcuuacacggacccacaccagcagggcugaacuuggcuacaaucuuccaucccauuucccgcggagacaccaucuccccugcauaaccucacagacacaccccccucucacgccuggugguuguugucugggaggggagucucuccuuacaucuccuuccugcccccacccuucucacugucucuuuuccugggguuucugggugaagacccaaaggcuaaaagggcccagagcucauccugcccgacucuugccuugagaucuucagcccauaugggcucacagugcggacauggaguguauggguuaaaaccagcccuuguaugcauguguccagggaauccaggcacugggacccaaggugaaugucuauguuggcaugccaugguggagacauugucuuugcaugguugauugugccugcuucaaagcacugccaucuauuugugcccugaagugugacccacaaggguaguuuagacucugcccccaacuuccuuucucaacuaugaccuacccaguuuaagggcaaccaguuggcuccacaagcccucacucuuggaccucaauccccagucuuuaagagaaaccaguaauucuccuccaaaacgcuuggaccccaggccuggugugguguccucauaacuacaauaggguagacacugccccagugagccaguuaguagagcccuuggauucucccaagccuaucugccuagugaccuugagagaacggaaacugggcaauaaauaaauaaauaaauaaauaagaaagaaugaacgaauggauggauggauggauggauggauggaaaaaaagaaagaaaagaaaauagcccccuagugugaaaaaugcugccuuuggcaagagcuuucuuugaaccugaggccugguuuguacccagggagacugcaggagaagguccagccccaaacaaaccacaguaugugaaggccuggggucacagaggaaggaaggauacauugcccugauccuucccuccacccccaccagccuucuccacucucuucgcaucaaauuaacuccccuguggacagaucugguuuaauuuccuuugcccccugaagaggaaggaaacaucugguagagccuugagggagaguaagcaugaggaugauaggagagaugggaaucugucuuccugugagaaggcugcagcugugggguggcuaugucggaaucagcagggaagugccuaucuggcauuugguccagccuguggacaugugagggucuauguuuauguuugguuucugaauaccuguuacuuugcauagggucauguaaggaaaucuguucuccaauggacuuaggagaaaaacaguggggcgugugcacaugcacagaacccccaccccccggggucucugauguauuugcaugcuggaacacaucuguuuuuuugccugugaaucugggucugggagugugcucauagcuucaagugccagcaaucacggauugugagccucagaagggcucaccugauugugaacgcauacgugcacuccugagugugccugcguccagggauaucuugaugccagaauugggagugagcaugagauaaagcugacacuggguugagcuuuugaugggcacagcucuugagauggcucuuggggaaaucuugaccaucgaugcugcccgcccugccuucccgaggacuucucugcuucuuccucuacuuuccagcuccugagacuccucacacguucugguuccccugguuuccauugcaucuagggcucugacuucuggacuggacuggcugcucaggaucuuuccaauacaaucuucaaccuccuuucccuccguaucucugucuuccuugccccuugccaaagcagcugccuacugggaaaaacagcaggcgaucaauagucacuaaucacuaaucacuaauuacuaauuagcugggggagggcaggggcggggguccugugggacuuuucagcucuauccugccucagggaaggauuacagcuacaccucucucucucucucucucucucucucucucucucucucucucucucucucucucucuuggucuagaccagccacaacccuugugccaaccaccaccuccuaccuccuuacccuccucaagcccccuaacuaaucucuggcugggccacuuaggcacgcacagccugggcuuggucccagcgcugcuggcugggauuuggggguaaucaggggcggcagcugggccagggauacuggaggauggagucuaaagugacagcccccuugggccagagcuugcagcuaaaccucacauccugaaugggaggggcgccacuggaaaggagaauuuccagggggucaugguugggcugggugaggagcuagauagagcucuagaaggaggcgauggugaagauguuugauaagaaagcagacagcagguaaagaggagucacuggggucagggacccauggucagagaguggcaagauaaaccuugauaagccagcagguaggugaagggacccuuggaggggucacuaaggauuaauuggcaaggcgcuagggaacuucgaauagggagaacccuguaaccaaggauaggcgugggcaaggggacaagguuaacagagaaagggucagguugugaugagagguuuucugguucaagcucaaaggggcucccaagauguacaguagaaaaagcgaaccgggauagggagcugggagugcggccuugagcacuggaaauuggcgagucuccccuucuccccugcccgccccuccuccaccucuaccccgcccacucccccuacggcucaggcuucgggaaauuacauccccgcuccgcggcuccccccccccccaccgcgcccuggagccggcgccuuuauaggcacauuuauugcaauaauaaagugaggcgcggggcggggggcggggggcagccauucccggggggaccgcgccggcucuaggaagcaaggaaauaaaauaaaauaaaauaaaaucaaaauucagauaacggugagccuugcgcagcaggccgcgggcaggcgagaggguggggcugcggaggagagggcgauuggcccaaggacagagcccaccucaccagcaggcccucaccccugcucuguagaagaggucuuugccuccacuugccugacccccucccaaacuugauguugaagcuggccuucugccuuuuccugucuccuccaaauaccuguccucaagcuccugucuguuuccauacugccugucacuuuccugguucccgagauuucccaugccagcccccccccccccaguggcucccccuacccuaucuccugggucucuauccaucagcauccuguuuucuucuuaaaagccaucuuccuuccucccuuucugcuuuauuccauccugcccccaugacugucuccccaaaccaucuucaaugccagccagucuccagaguccauuugucauugaccaugacugccccacuucagcuccuagccuccaucuucugguccccugaccagaggccuucuaggucucugccuaauaccuggucaucauuuccaaucucuccacucuuguccccaggucuauccuugugggagccucauccucauauccuaugcuccuacccaacccuagccccagaccaucugugcccuaaugcucaccucagcccguccugucuuguccacccacacccugacauacagcuuuauucccagcucccagccagacgucaccccacccugaccugacugcagagaugacucucaacuugcagggacucuguauucuauugcuugcuuccccaaccagggccuaaacuauugucuuccucugaugaauuguaaguucuuucugacccaaagggaaaaagagaagcaacggauuagucuggaggccccuggggagugcacccugcaaugcggcuaagggggccugacagcacgauccucucucucucucucuauccccaaagagccuucauggaguuuguuuagcaucaggagguggccucaacucccccucaggugcgugggccugcugccuuggggcaaaguguuccuggcugaguuccuuccgaauaggccugaaggagucugcuggaagccccccuaaccaccaccacacaccuccaccuccuaccccagcugacagccagcaugcuagccucuccccucugcaaaugucacugcgcccaauuaguuuaauuaaacuagcuuucaagugggggggggucccccuuggucaacacccagcucaggcccucagucauugcggggugggcucuggcaaaaaggagcucccacaccaccuugaguuuccugugcccucccccauauccauuacuggaaacugacaaccagaaagacagacagaaagagagaaagggggugcuccccagaacuggaaaucagagacagagugggggaagaaacugagacagagagauugagaaaagauuggggaaaagagagagugagagagagagaaugagagagaaagagagagaaugagagagagagagagagagagagagagagagagaaagagggagagagggagagcuagagagggagagugagcgugagcgaucaaggaagccagagggaggauuuuauuuuauuuuauuccguguucccauuucucggcucguuuccuuccagacucucaccccucccgguccgagcuucccacccccaaggucgcuucagcugccucucuccccaacucuucccuuuuaucuuagcucacuccagcagugggugggggcuguggguaccaaagcccagggauuugccaggaucacagaagcagagacagcaauuugucugggaucagagguggggggacauccuggcaccucucucugcccugucaaaccucacucccuacccccaccccacccccaaucucuuccucugaagagacugagccuaccagcccugagcaggucccucccgggauugggugcagggcagaaaguacuaggauguccuaggaaguaguagcuuggagacauuugauguccuagcauugagcgcuugggggcagggggugggggguggaccagcuggaaauaggacuuuacugggguuugguccagagugggagggggagagacccacccuuuggcuuucccugaagccucacccaauccuaccucuaacaccccccaggggguucaguuccaccuccccagcuucuucccugcccccaucuccauccuaagccucugucccuggcccuacucagguacacccucugggcguaagaugccagcucaagcuugucugcgugagucaaucacucucugccaccuccaccgcccucaccuggggugggaggagggcuggauaggagaagaaaugaggggggcaauaaauauguaugacgagcggauggcggcagcauuaauaacccgggauagcagcaucgcggggacggagaccagccaguagagauucuagcccagcucggccauuccuguccucuguggacacaguguauauauagacuugggugugugcaaacggaggggucaccuguacuucagaauccuuuacccgucuauccucagccugcaagucgcugguaggaaaauacaugccguguguguguguguguguguguguguguguguguauguguguguguguuacacacacucaugugguaugaacacaggcuacucucauugugcacacacacacacacacccuuagaaagacccugcuacagcgcuucucacaagaaaagugacaccucuggacaaccacacaaccacccugcauauauggguauacagauaccauagccacacacauaccacuaccacacaaugacacacagcuucacacaucacaacagacagauaaccaccacccaccccacccccagguaauccaggcacaaauauacaauggacaggcagccacugagagcagaugggacccacacagccuccucaggcugacacacagacacauacacacagagaaucaacacagccacacacagccuuuacagacugaauauguacaagccaccucagacagaacacauggacacauauacacaaccguuucgggauaacaaccaccccaggcacacauggaacugccucucccaagggacuggcaggcagcugucagggccacacugccgguggugucuagugcgggcugacugacacacucugacgcgcucuguuccucucccucccacucccugugccagagcggcaucuccauauuucuuccucucacucucccgucgcucgcucucugcuccuucacucucggccacccccucuacacacaccccaagauaauugauggcccggcccgggcccagccgcucccgccucucgauccaucuuguaucagcaucagugcugucucccagauccccggccaccugagacaggccagcaccaugggcgggcagggugacuccuccagcccuuccaagccaaaggguuggggacagggggagugcccuuuauucugcaagcuucaacccauggucugggauugucuguucaguugguucuuagaggccccuccgggaaagauaaaguauagagcucuuccuaucucuuuaccaccgaugccggguguuagggauuuacaagggucucaguugguugucaggcccaccacugagaccauuacaggccggacuauccagaaagggacucuaccuuuccccacccacaccaaagcuagcuuugucuuggcgcccacccugaagcucugugacaacccuggguccaucaggucacuucccagguacagaagcuacggucuggauacacgaagugacuugaccaagaucacagagcuugaaagggcuucagugucugaccccagaacacauuccugagccaccgcuguggguugcccagccagcgucucucuucuuucuuccuacacaggcugucuguggccagaucguggaguccgggaggccccaguaccuagacuugcgucccgccauggccggagggggcgcccgcggccagcagcucccagcgcccgcaucuuccgagggccugggcauggcgcgcuccuggagcugggcuuggccggcuaaccacaccggggcgcuggccaagccagggacagccgguggcccguccgugccgcgcaccaagaggaagccauccauuaaagcggcccgagccaagaagauuuucggcuggggggacuuuuacuuucgugugcauacccucaaguucucgcuguuggugaccggcaagaucguggaccaugugaacgguaccuucaguguguacuuccgucacaauucguccagccuggguaaccuaagcgucaguaucgugccgcccuccaagcguguggaguucgggggcgucugguugccugggccugccucccacccucuacaguccacgcuggcacuugaaggggugcuuccuggauuggggcccccucuggggauggcggggcaggggcuggggagcaaccuugggggcgcacuugccggcccacucggaagcgcgcuaggaguuccuggggccaaagagucgcgcgcuuuuaauugccacguggaauaugagaagacaaaccgcgcucgcaagcaccgcccgugccuguacgacccgucgcaggugugcuucaccgagcacacgcagagccaggccgccuggcucugcgccaagcccuucaaagucaucuguaucuucgucuccuuccucaguuuugacuacaaacuggugcagaaggugugcccagacuauaacuuccagagugagcaccccuacuuuggauaacgccccuguccugggccccgagcuucccaccagaucgcagucucacuaggugggaccccucccuguauaccccgugcuccugugacugcccccacuucuuccacuaugguggagaaaaacagccuuccccgggacuaucagccaguguggcccucuauuuccuugugguaccgagugucccugaggcugggguggucuuuuucaaacgguaaauugcaggggcaagagcauagccccacgauagguggggcuugaggucuucuuaggguucccuacgaaugcguauugcccacgccgcaguauuaauggcuccuggccuggcacucuuuccccaagcccugguccuccccuccccuaagacuguaaaugucuaaaagcgcccagcccauccaauccucucccguucugcgugccccaugucaguccugccuucuuccuaaccuugcuaaagcaaaaguccugaucagggggcucugccuggcccuugugcucugcccaccccuucccucccccgcccucaguccggcuacaccugcccucucuggcugcuuccucucgguguuuuuuguuuuuuguuuuguuuuuuuuucaacgccaaaacagacggggagggaacaaaauaaagcgaaauccaauacucgccuguguuaagaccuuuguaggaaagcggggcgggcagguguggauuuuugucuggcagaagcuagccuggacaccucaccuugccgccca

SEQ ID NO: 5801 - RNA, 82997 nt, Mus musculus
guuucuuuucuuuucuuuucuuuuuuuuuuccuuuuuuacaauuuuauuuauaacaauaucuguguuauuuaguuguaaaggaauucagcaaaaauuauuaaaacguucacguccccaaaauggggcugcccgcuugcccuuccuuggugugccccgacucuuccuggcccucagggggaugggaggcuugggggacaguuaccaaagaauguguucagcccuaggagccacagagggggcgcuagagaggggagggccugucuggaagggauacugagcauggccaucugagaggugccccugaaagugggagcugggguuuggggugacuucccucaacuaaaagacuccuuccucagcuagagccaaaucuuccagacagggucagcagaggacuccaccuccccugaacuaaccccagagagccaaggaaaggaaagcugggacacggagccccguugagugucuugcacaggcgugguggggaggccgugccgccagcuuccagggguaugcucgguagggaacauguggacuccuucauaccuuugagccacaaagcccuccccgcccccucaaggcagcaugggggggauacugaggagcaggcaggaaggaaaugcaaagagauaauacugugcuugcucgcuugcucgcucacauauaaaaaguaauuccuucauuuuuacauuuguacacccggcagggccggagaagggccggcuggggaggggguucauugaaagacucauguggcagggggcuuucuggggacauccgucggggcagggcccuaugccaagggaucuccuaucucgucuucagguccccggcccagcaguucucgcuucucguccgugcuggccagggaauggcggcugccguggccccccauguagagcguggcauacacuggguuggugaaguugguaggcugggaaaaaaaaagguucauaugauuagaauaccccagcucccacuucuguguaacaccucugguugccuugaucaccccaaccccaccccuccggccuuugauccuguuccagaagccccuucgauggccucuggcauaccuugucagggucaagggcaaaaucagcauccaguaggcccccgacaucaucgggcucuccaccuucauacaucuuguagguaggguuuccaauuuccacauucauggccccauuggucauccgcuggugcuggaagcccuuagcccuggggagaggcaggagucagggaaccgugauguugguaagguuaucggauuguaaaauaacagccagaauuucucagacucccaguggcucacccucggacucgccgcuuauaccagaacaccacgccagccaccagaagcagcaggagaagcagcagcagagggaucaggauggaggccauaucuggagagagaagucgggaaacugagucugaagccuagggagaugggagguguaaggcucuucuugcucuaugucguggcagcccugcccuccccaccacuuacgcccaggcuguugcugacuaacaaccugcuccucgcaccgggguccugucauauggggcgggcaccugcaggcaagaaagcaaaacucagugggugggcaucaccuccacgaccauuuuagcugcaggaacuaggaggucauaggucauauuguuccuuugcucagauuugauggggcggggccaacucacuggcacucaggcaucaucuugcuguucauggugcaggagccaccauugcuacagugaucgaugcaggucagacaacugggggcuacccggccaucagugcagcuguggaaaggaaucaaaaucuggagcuggggcuugcagaaggguaucugggaugcuagaacaggaaccgggccaggaggggcaagauaggggcggggccggaagggcccggagagggggcgggcccaggaggggcaggauggggcggggccagaagacagagcagaauguggaggcaagaccccccacucacuugcaugugacaucuccggucugcuuauugaccacacaggcgccuuggagacagcgacuacacuuguucaccucacaccuuggucccucaaaguagacggugcagcgacauugucgggagccaucagcagccaucugacaggugccaaaguucucacagaagccagagcacugcccugugguugggaguggagaggaaguaccuuaugcaggguccaggacuuaugaauaacucccacccacuccugagccuccuaaugcccugucacagaccccagaacacuaggaugacccuaagcauuccuuguguugaaugccuggaggcuuaggcagaugcgccaacaugagaggcagcacccacagccugggcuuggcucaucugcguacgucuuccauccucucaaccugcuccuuuggguucuuucuggcuccccucuuccuucccugggguugaggugaauacucacgguacuggcaacggucgcccaggaagccagguagacaucggcacuggggcugguugcccugguugacggugcaggugcuguuguuagagcaguagccugcacacaccugugcggugcauuuggggcccgugaagccagugggacagcggcacgugggcaugccuggugggagaggaucugugagugggaccauggcacuggggaccaccugggccuauagcagggauccuaggcaccuugacgaacagaugggguugaaguggaugcuggaggcgauagaaggggccaggugaggaugaugggagaggaccaucccugguugggggcauaccagauggggaagccgcacaggugccuccguugugacaguauucccagcacugauccagcucacacuuaucgccuguguaacggggcuggcaacggcacuugggcugccuccgagcauugaggaaacaacuaccaccauugaagcacugcagagugcagguuccaggccuaggggcugcaguaagagcucaucagagcaugggaaggggaagggggucaaggguaaggggagccagaggcuauagguaagggauccucagguacccaggaaaagggcaugcauaccaucuggaggggguguuggagagggcacaggcacacaggugccauuauccagccucuuuccauugggacaggugcagacaggcccgcuggggcucagcagacacagccauucacauuucuugcggucacagggguuggucacuguggguguuggaaggggucgauguugagcaguguggacuuagaacauuuuccuuuuuuuuuuuuuuuuuccagagacaugguuucucuguguagcccugucugccuuggaacucacucuguagaccaggcuggccucaaacucagaaaucugccugccucugccuuccaagugcugggauuaaaggcaugcgccaccacugcccggcacccuccuuaucacugacccacccugccacaccccggguuuucccucugaugcaccuucaggcugcuuguguugaugguaaaggacuacaucagaggcauggcucaggcccccaguuagguugaucaaggggcuguguccaaacuuguggaucuugaagacacgauuauugauguaagugacuccguagauguagucuucaaacacaucgaugcugaaggggugacuuaggccuggggugcagggacagccagguuaagucacuacaggcgccugggcccuggacccagucuuuaagacaccugucaguguaggcgucucagaccuaacauaucuagaacuaucccugccacuggcaaauugucucaucacccccaagauuucuggggccaugggggacuuuagcucucucucccuucauuuacccugcugaccccacacaacuugauacuuguugguagagugaauaaaauggucagguaggcgcaggcucacgggcuggcugggugccaggcuucugaagagacauccuugagcucagugagaagccugaugaugauguuggggaccaugaugggaaccaagccugccagcacccucaccucguuugcugucagcagccacaauggggucagugccguugagccggaugcugccgaugaccgaaagcuuggcaucugcccaguagagccguucauugugauaguccacagccagcccuggggugagagaaugcugucugucagagaucagcuucugucacgccaggcugggcgcagagaacagagcugacucugucugguauccacggcauguauccuacccggcucauaggaucucucccagccgcccauccgggaagcacucccauggcccucggccugaucugcuggagauugcccgccccacugcacgcaggggugacuucugaagcagccaugaucagagucugccccuuccacacccuaccccugccccagggaccuguaggccacugaauguugucuugcacgagagucucccgaagggugccauccaucgcugcuguuucaaucuuggggugguucccccagucugaccaguacauggugcugggaagggagaaaugagaguggguuggaucccagggccaaggagacagagugagauggaagagagggcaccuggccugguguggacgcuccuggguauugugaggaaacacccuguccccuucaaugagccccaggagacagcugccgacccaugcuagcaucaucugcucuaacuacaaugugcuaagccaauagcaucugaaugggcagggcuaugccugcagggggucccagaucuuggcugccaguaaagcuauucaacugggaguccccgacagaggcuuuaggagggccaggacuggagaagccuagcagccugaggucucugcccccugccuguggaugucgagccuaccaccugucuugagggacaccagcccagauaccucccccccaggacccgugcccacccccucagaggguccaccacgauggcauggggcucaucaaucaugcccgagaugagcgucuugcgguucucgcccuucauuugcgccaccucaaucacgucucggccggaaucgguccaguacacauucccggccacccagucgauagcgauaccccucggcaucuucagcccugaaaucuaaguggggucauauguucagcgacugccaucuucugucucccugauugucacccccauucuccuuggucugcccaccuguucuugucugucaccccacacugacgugaccacaguuucuagguucuuuugcuuuugaauaggucucucucauagcccaggcugaucuggaacucacuguguagccuagacugacccuuuucucuugcucuuccuuccucugcuaugaauacagcuggaguuacaggcaugcgccaccaugccaggcacauuuucaugguuuucuaguuaauucucacuuuuaaaaaguggugggggcagugaaguggcucaguggguaaaggugcuugcugccaagcuugaggaccuaaguuccaaucccugggacuccugguaggaacaaagaacaaacuucaaguuguccucugacuucuacaugugugccgugguauguacaugugauucacacacacacacacacacacacacacacacacacacacacacacacucaauguauuaaaaaaaaaaacaaaaaaaaagcagucugaagcugggaguguaguucauugcuaaagcaguuggcuagcauccaugaagucuuuaguucaaauuuagcacaaaacaaaacaaaacaacaacaacaacaaaaaaaacaaaacaaaaaaacccaagcagccagaucuauaaagaagcuuagaagacuagguauuauuauaucuucauuguugcugaggaucaagccuaggguuucacacauuccaccucugaacucuacuuaagcccaggagagcuauuauucauuuugucaauaaaguaaagcccacgcauuaagcaaguuggccaguacugacucagagguaucagaguaggcuaugcugcugagugccagagggcaucguaucccauugcagaugguugugagccaccacgugguugcuggaaauugaacucaggaccuuuggaagagcaguuauuguuccuaaccacugagcaaucucuccagccccaaauacuacuuauugcucuggcuguuagcugugccuagcaggcugaccugaccacuccugucuucuaguuuucugcccucucagccccuacacucuguccugcggagcucuuccaccccaucucugacaggcuggaugcuuacauugaggugggugacaccccggucgaucugccuccgguggcgguuggaagugguaggaggggcggcagggggcaggcuccuguaggagauugugcccgugugccaguuaguccaguagacacggccggccuugacauggacauccauggcaucuaugcggacacucucaucgcccuggaaugucugcucguaggcugaguggggguggcccgggaacaagcugcggaucucguugucauccgcgauguauagcaccugguacucggagccugccggagugagagagaccaccuaucagaugggcuugaaagguagaggugagaacccagggcccgaguuccaucccugggacacauuugaccaagacccugucacacuacaguagccuccgaucuaaccagaccauuuguuuuagacagaaggggauguuuccgguguggguggagccaauggcagauccaagggcucuaaccugugccccaagcugauccagacugaccagacccuucagaaaucuguucuucucuuaccugcuuccugauaguuccaagaauucuaucuuguggucucugguuagcauguaggucugcuacagacucugauaagugcugaagcgguacagagauguggaggauaugugcaaggcaugagaaauguauguauacaugggaguguguauaugcauaccauguacauguacggugugaggacauaugaaaggugcagugcugugucagggcauggagggaacaugcaggugggugcaugugacugugagucggacuauacucucaaucuaggagaggggaggggacacugugugccacacaggaguguugcucucauagaacuuccccagaaagccaggcgguaccuucuaccuuuccugugcuuugcuuugcucgggauggcaucccgguguaccuugagucugggcauccaagucugagcaacgaagugccauugggaauguuccacuccaggccagcuccauuuuauagcugguguggcccgacccugcccacccuuccuucuggcccugccccuucaggcccuuccacccuuccuucuggcccugccccuucaggcccuucuggcccuuccggccucuagcaccuucagcuuugcagguguugugugucuucaugaaguugcgggcacagcugcagagguggccucccuugguguuguugcagagcugagagcagguaccaaagcgcaggcacucguugaugucuggggguuacacugggcgucaugggggagucuaggagcugggguuccugccccaucucccauccggcucuccuacccuggcauccgggcuggcccggcacaguauggaagcccgagcggcaggcacaguaggcagcuuucucagugcgcacacaacgagcuucguccccacacaugcuggcauugguggcacagcuggucagcuuggggucuguggaggacagaugguggaguccuuccccugagcccggcccccugguuuuccccugagcccugcccucugguuuuccccugagccacacccccuggugcccacccacccucugcucucaggucugguccuaccgaugcugcaaucuucuucaucggagccaucgccgcagucaucgaacauguuacagcgcagggaggaugauagacagcgcugguuucggcacaggaacuccuucuugucuuugcaguggggguucugggccguggggggcucuggggaggggagaggcuuuaggcucuggauacagagcacacuacccguacauccacagagacuucaugaacacagguguguccuggcugcucgccaagcugagggugugugugcugaccuugcagacucagggcuccaggaggccacccauaccuuucccaagggcuccacucuugccagauugaaagccuuauagcagucugcuccccagaugcagguccccucagccccggcucauugcccucagcucaccacaguccuccucgucagucccaucuccacaguuguccacgccaucacacuggcgcccaauccacaggcagacucggucauucuugcagcggaaaggccgguugggagggcagaugaaccgggcuguagaagccaggagacagagccacaaucaguguugggggcaagugguagggaagagcuggccacuggggaguauagaagccaggucuccagcauccuugcuguggaugaccccuaaucuuaaaucuaauuuauuuguaugaguacacuguugcugucuucagauacaccagaagagggcaccagaucccauuccagauugucaugagccaccaugcaguugcugggaauugaacucaggaucuuuggaagagcggccagugcgcuuaaccuccaaccuccaagccaucucuccagccccccgccucccuacaucucaccgcauuccucgggguucucaucugaguuguccccacagucguccucuccaucacacuuccaggccagcggcuugcacaagguguuguuacauugaaacucauccaaugggcagguccucacugggugcagggugaacagagggguaagaaugaaugcaacugcggcugcaggaugcugucugucacuugcaccgugggugggacugaggcccgggggucaucacagaaacugucacugaaucaaacucagucgucuucauuuucugcccagugggcagaggggcaaugugcuuccucugguauuuagggggaggagaggcuacuuggggcaguguugacagggguuuaggauguucuccuugaguaggugaggugggacacccgagucuaguauagucuguggcaggcacagaugugcggcaguuuggagacuuagcuuugguugcuaccaucagcccauggggcagaaccagaaggcugccuugcaggugagaccccugcuucucuucugacagguguccacugaccccuccaguggcugagcccaggcauguuuggcuagagcagccccugacucaccgccugccccagggaaggaagaugaguaggaacuggccucuuaacacaggcaacugggugggagguggaaaaggcauggguggaccuggacuacaggcgucugcaugaucucuaccuagcuagccuccuuagcaagguuagagcaccgcugauguuaaaucuguuacauuguacuguacuguaucacuuuguauuguauuguauuguaucacuauguaucauauugcuaaauacugguccugguugcccccagggagcaggagauuuucacagggacccaagugaugcuaauguaaccuugucccucaaguuaucccugauuggugaauaaagaugccuacagccuauagcuggacaaaagagaaauaggugggguuucaauucccaggcugggggucugaggcagggaccaccaggagagggagaagaugccaugggguaggugagucaugaaaacauguccaagagggcucaccaauuggaguuaagagcugcucagauggaacauggcaaguuguaucucaggguuauugauggggaaguagauucuaaauagcuuagaggguggauaucugccuagcucugguauauuauuggcuugcuauaaauauaaguuuugucuuuuaucugggaacugagugauuaaaggaggguagaaacccccagugagaugaaaagaauuaguacaacaggguaaaaccugcauaaaaugcacacggagugagccugagucuugucuacugcuccaacacuaggucuaugccuggcuugcaguauaugcuuaauaaggguuuguugcaguaccaacaaauggcugaauuaaaagauuaaacugggccacacagugggcuggggaaggcagggaggguggaggcaccaggaugaaggggcucacucacccccagugccacaggcuuccucgucacugccguccauacagucagcauccgcgucacagcgccagcgcagggggaugcaguggccacucuugcacuggaacugguccauaucacagcggggggugcagucuuucugugggcauggggaccagcagcccaaucagacccuugggguccugcccuaauucuuccgagaccaccccuuuccucgagcucuccucaccucgucugagccgucggcacagucaugguccccaucacacuuccagcgcccagcgaugcagcggccauuggcacaggaaaacucacucucagagcagggccgaggugcugaggagagacaggucccagcagggugggcacagggcaucuccagcccucagaaauacuaacucccaagcacaaggcucaucccuacguccgucugugaagaggccacagccgacugguguaaugauugagacacucaaccaauggcggacaguguuuaacuggcuguccucacgagacuggcugggucaggaggguacucacacuuauccuauuagguacagacacaugggagagggcacgggucccugguccuguccuuaggacagaucacuuaggggagggaggggagaacaagaccaccgagacaagcgccaggucuggggaagaggccaguuaaggacggugggcagaaaagcacagcacagggaugggcggggcuccaggcagaggcagagcuggcaggaacagggguacaccagagacaccuaccucugcaaccccaagaggacagugugaaaauggagagaaacaugagaugagaugaaaugucacaagcucaaguacaaggacauagaguaggguagagcgcggcugaggggugccugaccccuugcccuuggaggccacccucuugcgcgggguggggguuagaaggggugaggugcugaggagggagaugccaaggccugggaaaggaaaugauggggcaggguaaggcguaggacauacugcagcucuccucguccgaguuaucuccgcagucguugucguagucacauugccaacggccugggacacagcgguuguuuuugcagcggaacugguauggcucacaggugcgcucaucugggggaggcaagauguggaggcagauauuggggcggucagggguggagugggcggcagauguuagagucuaggguagacaagugagaccggcggcagagagaaggugguuauugccccccgaaagagauugcucuggggcucaggcagugauaauugccgugugguaucuacaggagguucuggggaaggccagcaaaguguuuggggaaggcagcugauuugggggggugggacaggugaacaggaggguagagauucugcacaguucucuucugaggggcagagagggagaggagcaggauucagagguggugggcacugcaggggaagcuuccuucccgugucagcucuaugggguccacaagagccccacgcugggucacgucgaggcuccgcccagagaggucaaccacugaacuucuuucuacccagaaccccaaacacccauccucucaagauggcugggcuuaccacacucuuccuugggcucaucugaaccauccccacagucaucuucuccgucacacuuccagcgcgcggggaugcagcggccagaauccuugcagcggaacucauccacuccacaggucauuugggcugcaaggcaucggcaugggugaggaggagucguccccaccagagagccacugggcaaggguacggcagccgagggaggggucugucugccuggguaauggagccacagaggccgugaggaaggauggcccaggggcgacggacaacucacuacaguuggcaggcucaucacugccguccacacagucauuaucccugucacagacccagacgcgagggaugcagcgcuuggugauggagcacuggaacugguugggggcgcaggucaccucagcugcaagauggaacagagaacgaggaccuuacccuuuaucuccucacagcuuuggucccccacgcgcuccccagaaagccuggcccuggucucagucaggaaggaauagauuauccccagccuggaucugcagacuguccauaccgagcacaguguuuuuacgagcaaaccaggaaauguccaaugugacugaugucccccgcuaauagagcuaacucagcgccucuaugggaagcagugggcaacaacggugugugccagcuacgucccccacccacuucccagaaccuggcacauacggcaaucccgcucauccucgccguccccgcaguuguccugcccauugcaacggaagaugccaggaaugcagcgguugguguuggugcacuugaauuggcugggcaagcagacgugaaugucugggagagggagaaggagagggagagggagagggagaaggagggaacucagggcgggcaggcaggugccucccugucccuuguagaggauggguggacugcgguccuaagcccagaaauguagccuagagagaaagcugcugcaggcuggcacauccucacucucugaacccccaagugcugcggaaggaaugguugguaucuaggcagcuccuuaccgcaauuggccucaucacuauugucuuggcagucauuguccccaucacagaugaaggcaggguuggugcagaugccgguggagcacuggaacuggccugggcggcacuugaacucggcugccgagaaaggagacucaguguuaggaguaggagauggguucagcaagauggccugguggguguugccaccuaagccugauccucagaacccagugaggaaagagaaagccaauuucugagaguuuuccccggacugucauacauuucaccacagcaugugcaugccugcacuggcaaaugcacacugcacacaugcaggcacucaggcacacacacacacacacacacacacacacacauacacauacaugcaggcacacacagacacgcacucacaugggcacacacggcacacacauacacaugcacacacagauauacacauacacacagacacacauucacacagacauacgugcacacacacaugcacacguaggcacauccacaaaagcacauacaugcacacacacaugcagguacacacauguacacagacacacagacacauaggcacacacacaaaugcaggcacacacaugcacacagacacacacacacauagauauacacacaugcaugcacgcacacacuaaaaaagaaagagcagggagcaaauaggccacugaggucuccaucccuugggggcgucgaggacacucacgacagucuggaggcucgucugagugauccccacagucguccuccgugucacacuuccaccagaaggggaugcacuugucauuuuugcacacaaacuggaggacaggugggcaagagggguuggaaaggguaugaggaacucagaaggcuuucuuucacgggguggaaacguuucagggacauagugggaguuugugggguggcagagcuggacagaaagcagggcuacaauggaccuaggaaagccagacaagggggugucuguacagggagagcaugggaaggcgaggacucuagguccuccugagaucaguauuagagguguuuauaagguggcaguguacaaggauugccgugaggacacaagagguaggcaggaagugugcgggugucggcaugccagaggugcaggcauuagugggugccgggaaacaggaguguggggucaggggauugggguguugcagcaugggcaucuuaggaggaacuucaccuggcuugcugugcaguuggacacacagguacggccaucgccacccagauagaaguugguggggcaggcgcauuuaugaccacccccaggggacagcaggcacagguugcugcagccaccauuguugacuuugcaggggugauugggcacugccaggagaaagagguugaagggucauggcugcccacuggcuucucugacugugaggguggguccugccgggaaugguuuccagccuucuaaaggaugucuggccuccuugguacaucucuauccuacccugaauaugucugcuuucaggguuuccucugaugcucuugguccacacucacuaaucucugggcucucuacuacuuuagggccuggcugucagagaccccacauugagcccagggcagacugaagcugcuaggggaccuauagccucuguaaguucgggacccagcaggaacgcucagucagugccggggagggaaccugacccuggcugagaacaggccuuucaugcuuggacuaggcuugccacuccccccuuuuucugcucgauuaccaucuggcuggcgcagggcguggaauacauguaaguccaugggccggugcagggugcugaugaggaguguuuuguuggcacccguggucuugugggcccgguugauggacuucguuucccagucuguccaguagacguagucuucaaauagggucagcgcaaagaugugugggaugucuuggcucagcacuaugggagacacagcaguagugggcaccgaguacaggcuagguucugugccuacuugucuuccuuaaaccccaucacaacccugagaugggaaugaaucccagguccugaugcuucuacgacuuccuaaggcucaacagcgauagcuguccagcagccauaccacugcucuggaguaggucacagcuucucucaggaagugugaagcacagguguucuucaggaaguccucaugugcccaccccucaggccauuauccugagcugcacaggggauagcccuuguuccucuaaggagcuggauugaggccuggagucugggcccaucccagagaagugccaggguauugaaaccccaagaccucuggguugugguuucugcacacuuugccuucuugccacccuaaacccuuuagaucccugccccccaggucugcuggccuugggcagccucucuagcauacggaccaacgugacgguuggagccauccaggcuggcgaacucgauguaguccucacgggcgucagcccaguagaugcguuccgugacguaguccacggucaggccauugggccaugugaucuuaguguccacgaugaugcugcggccagauccauccaugccaauccggccgaucagugaguggucaccccagucuguccaguacagguaccuggcagguggggagcagugaauccuaagagucuagagacuguucccaccaggagccugcagguuguccgggcuuggguguuuucuagggcucccccaaccccucugcccaccacucacccauucuguacauccacuaccagagcucugggcucccggaggccagagcugaccagcacuguccgauaggccccguuaagcuuggacaccucaaugguaucucugcccuugucacaccaguacagguugccacccacccaguccacagccagcccaucuggguuacuaaggcccguccggugcagaaccuguaaggaacacagggaaggaggagcugguggcacccucagucuccggggcauggcuucuccacucuccugaccguaaguggcuaucaccaggagcuccaagcagggggucucuggggccacccacacacgccuagagcacacagaacucaagggaaggcaggaggagucuccugugcuugcauacuuuugaguugagaggaggggaaggugaagcgagcagaacguuucuguggcucagggaggagcagggcgaagcaguguugacaggugugagagaaggggagacucuuuuacagcaaaggacuauggggagggugugaggcucgucagcggggcccuggugugccugucagccgacacggggcagccuucuguuuucaccugcacguugcugccguugaggugcauccugcgaaucaugcugcccuggguggucacguccguccaguagaucaucugcucucgguagucaaaguccaaggcgaccgcauuguucaggcccuggguuugggauggggacagggaagucagcugccgcaggggcacauguguaucuggggaaggaugucuggagucaggauguggcuggagggagagggagaaggagacaaccauggccuggcggugggaagaacuggggaggccauacugggcccgggcagucaacaacggguguaaagaaggcuugguuuuggcaccugcuuaagcaguguguaguuggagccguccagguugagcuuccgcagguaguaccgguuggcaaagaugagaaauggcuccucaucuguaggaggagggucucggcucagcuccaagcuuagguauauucuggcagcucugguaccccaggcuaucuccagcagcccuggucccccaggcuaucuccagcaccucuggucccccaggcuaucuccagcaccucuagucccccaggcuaucuccagcagcccugguaccccaggcuaucuccagcuacauuguaucaagcccucucccuaccugccaccugcugcccaaucccacagcugccugaaauacaucucacccuccaagugcccgucucaccggucacagcuuugcagcugugggggucaccgccacggggugcauagcccuccacacacagacacuuguaacuuccguggguguugaugcagagcuggcugcaggggaagguggugcugcacucauccaggucggcacagguccugccaucguccuuuagccggaagcccgggcgacagcggcacugugggggguaagggaugugcagcugaggaagcggcuggagucuaugcuucugggaaccaacgacgccuagaggcccucaggagggcugggggaggcaagugacacacagacugcaaucugugcacccugucccuccgaguuuuccucauguggcugucauucugucuugguggcuucccuagccuccuagucccucgauguagcuuagugcuggcuaaggccuuuuaucaucucuauucacuuccucggggguuuaaauagccucucuggggugauaauucuuccuccaggccuggccuuuagcuugagcuccagagcaacauaucuacuugacaacccacucucuucucacccgugaacacagcccacuggcucugaggcucuaacugaagagggacuucugucugcccugcuauguccucagagccuaguauacugcuggcagaguggguucucaauaaguacucgauggagggaugagggggaggaacaaagggcucuggucggauccccugaguaccuuaaagccuaucuugagguccucgcaguccugacugcagccacugagcuugcggcugagacacucguugacauggcacccgcguucgucugaaccguccccacagucguccuggccguugcagagcaacgccucagccacgcagcgcccgcugcugcacaggaacugugaugaggcauugcauuugugcucuguggaggguggcgggaacuggucagugggaucacagaagaggaggaggaaggggcagggagccaucuagaggccaacauggaggguggugggaacaggucaguggggucacaggaaggagaaagggcuccaccuagaggcugaccugggcuggugcaguguggguucuugggagccucaucgcuguggucgugacagucauucuccccaucacauucccacugacgggagcucagacaacgcccauuggcacagcggaauucauuggggccgcagguuggguacucuguggugggggaggggaugaugaggcuggaccuccagcacggcuaggcagggcuacuccuccagucacgggacucaccacacucaggggauucaucagagccaucagcacagucacggucauggucgcacacgaaaugcuugggaauacacaagcgguucuggcacaugaacucacggucaucacaggugcuguuguacacuggggauggaggcagagucccuccucaggccugcccuacuccugcccugcccuacuuacuagcuguugauagucacucccccacccccaauccuaaguuuccugcaacaugagugguagcaaugggcagaaugggaggggucuggaucugugaucuccuuaaacgcacggcucccacugaaguucuuccuacccuugaccucauuugccaguguuugcaaagcaaggcugcgaggcuugaugcccacccauuccucacggccucucccacucacggcagccagcagugacacucucauccgcgccaucgguacaguccuugucgccaucacagagccagcgcucagggacacacacgugggugccgggacaggagaaggaggaggggccacaugucuugccuucugcaugaggggcaaggagacacagagagacucaggaggggacagggcagagcaggcagccgugauaacauggcccacugguauauggacccuucuuuaggggguaggacacugaccgcccugaaccggauucaggccacugcuuaccacagugagcugccucaucggagccauccccgcaaucaucgcuaccgucacacagccacugcuuggagauacaccggugguucuggcacucgaacugugccucugagcagaacuugucuggaauagaggagaaaguaauaagaagacaaggaaaggcagggcaggugagcgacucaucacaaacugaagaagugacucuauucuggagucugagaggaugagacacaguggaacccaggugucuccccguguagggcgcuuuccauaaggacugugaggugggagcuggguagggucccagggcacucacugcagugggucucguccucgccguucucacagucauccuccuugucacacguccagcucauggggauacagcgcccgcuggggcaggcaaaguaauugagcgggcaccuagggcgcuucacaccuggggguagaagggagaugugaagacucugccagccaugaagacacugccagccccgggucucccguucacccggcgagcuuccgcuggccaaccuggacagucacguucaucgcuguagucuccacagucguuggcgccaucacacacccagcuaggugcguagcacagggauguccgcucgcacggcuggaagaggacaccuuucacgcccaggcggaaauagcugcugcagucugugguaccugguggagggagggugggucaguggggucacgagagaagaggaagggcagggcgccaccuaggggccaauguggaagauggaauagaagggguggugagggugggugaggggucacaccuagcuccuucuaagacacacuaugggagcaauugcuggccccauguuagacuuaugguuucagauuuggugccugcugcccacugacucacuaccucuauggagggagaaaaagcaaggucagagaggauagaggcuacuauuuggggccaggggggcugagaggaaauaaggcagaacagccugaggcaggagggacaggaaaguaggcaggagcaggcugucagucaugggccagcugucagucaugggcaggcugucagucaugugccaacugucaaucaugggcaggcugucagucaugggccaacugucagucaugagcagacugucagucaugaguaggccaucagucaugggccagcugucagucaugagcaggcuguuacucacugcaauucaucucauccgaggcauccucacaauccacaaacugguugcagcgacuggaguucccgaugcaggacccaucccggcagcggaacucacccacaccacaggcagucucuagaacagggcccaccaguaccaucaggccagugucccucugcagggccagaaaggcccaggacagaguucucgccuguccucagagugccuggggacaaaugcucagccggagugaggacgggguacagucugagacuaaaaaccaggggugagggcaggggugaagcagggguaaggcaggaggcuaggaugaagcugggaugaggcaggggugaggcaggaggcagugaugaggcagauggcuguggugaggcaggaggcuagggugaggcagauggcuguggugagguagggguaaggcagggguguggcaggguacugggggugaggcugggauguacucacuguugcaaggaaucucaucagagccauccccacagucauccaccccauugcaccacagcauguuggauacacagcgaccauuguuacacuggcggaaagucuucuugcagcggcgugagucugugaggggagggugugcguggucacagcaggcauaggaaggggcuucuuuccccccuccccaccaaugaccgucccuuccuaagguccaagcucugcucuucaugagcugaggcuauggagcugggucacauggcacaggggacugggggaggggcuggagcagggcccuuacugcaguaggagggcuucucaucggacuuguccuugcagugggagacgccaucacaggugaggcugaagcugauacauuccccauuggcacacucaaacucaucuugugcccgacaagaggaguucacagcugcggagggagaaggugucaugaguugcgaccuagccugaguccagccuuguagccugggcuggagucuggaauaagggucucuugugcugacaccccacagcagccccugucccagcuccaacuugcuuccucaccccggcaggugaaguccuccuggaggauccggcccccucgacaggaacaguugacguggccuuggugggugagcagacacagauccuggcagccuccauuguugauacggcagggggagaguucaccugagcaggggugggaguggggggaccgaaagcugaagaggguucccuggcccuguacacucccaaauugcccaccuaacauuccagagcucugcacgaccccagcagccauggggguucacaacagcggggagaaccucgcaugggguggcauguggacacugcacacacacacacacacacacacacacacacaagagagggccagguguagguauguaugucuaugugcaggcugggggaggggaugauaggcuacaccugguauguggguauaagguaagguuuaggguguagguggcucuggguagauggaauuauuaggcugagugauaggaucuccugggauggggacgagccuagggucaugaacaguacgaaugcaugugcaugugugcaugugugugugcgugugcgugagcgcaugcaguuuugcaugagauggaccugaguauaucaaguccauguauguacacaggugucuugagggaguuggguuugagaaauguuggggccuuaggaguuucugggugccaaagguauguaaagguauuugucuguacagaagaaauccugggagagacaagacuaucauauauguauuaugcagucacagagaucaggagagacaagacugucaugugcacaugugugcagucacagggaacaggagagacaagacugucgugugcacaugugugcaggcagagaucaggagagcacugcgggugguagccccacucacagcuguuggugucguuggccacggcgaugaugcccauggguugcuggggaauguccacccgaagcagcuucaugucgcugcccacauacuuguuggcucgcugcacagcccgccgcacccagucaguccagaaaaugugcucuccguacaccgccaacccaaagggguggacgggcuccgacuuuaggaucaccugaugagacagaagcaccagcgucucugcauucgagccccucaucggucuuaacagcacagugaggggaggcaagagggccgugggaagucacagaccgucugggaaggaucuggcuucgucuucucucuuuucuaaguguugucagaaccacgcagggcaaaggcuacccacaguuaaggacucgaaugggaccucucaccguguccugggucucccugucuggugcucugcccugacuugguucccuccacauccccacccacccacccacccacccaccccuacacucacauagcggugggagccgucguacucgcagcgcucgaucuuguccaagguggcauccgagaaguacagcuucuccgcccgguggucgauggccaacccauugggcgugcggauguccuucucaaugagggucaggacguuggcuccggauagggcugcccgcaugaugcuuggauggagcucguuccaauugguccagaacaucaggcugaugggaaacgggcaaagggaucaggaaccuaaggagucaacuagaacccaggaugagccucacaacccgagagccacgaaagccaacauagccucggugccugagacuagcccagccaaggcacugaguuacugcacuauguggcuagaucugacugugugugcccacagucacguacugcaguaugggaagggaccaucugcauuugcugagacuggaggcuguguggccaagcgagucagcucccagccccaaguccuggcuccaccacuuuccagccagguaggcugggggggggggggggggggaguaguagguugccuacuuuaggcaacuugcccgaccacucugacugaccuauuuuucuauuauuuagugggggauaauauugcugcagagguuguaaaaacuaaguacuguguauucaucucaaugagaguuuuccauguauuuacugcuaacugcuuucucuguaucaaagcuggcucuuuaacaaacuacccaggaaacucuugcuaaguauugacuauuuccuugggcacauauggauuguacccucaaaaauaguuuucuggggcugaagagaugacucagagguuaagagcauuggcugcucuuccaagggcccugaguucaauucccagcaaccacauggugucucauagccaucuacaaugagaucuggugcccucuucuggccugcaugcauacaugcaggcagaacacuguauacauaauaaaucaaucuuaaaaaaaaaaaacaaaaaaaguuuucuucacaacauaaggacaugugaacuuaaggccaagccaugccccacuguuuguggaguggugcuaagggccugggugugggguggggaggaucaagcacagcacagcggcagcagggucgcccuuggacagcuugauucauucacuugaccugggguggugaacccuuugcacauguuccuuugagaugcagcaaagaaaacagaaacaguuucagaauagaccuggccaccgugccucagccccucccuucucugaccucacugaugaacuuguaacuugucuguuugaacuugaacuuguaacuugucuguuuacccccuucguucucuucucucucuaggaucaccagccugggcuugagguucuuuaccuccugauccuccugccuccacuuuccaagugcuaggauuacgggaacaugcugccauacgugugccaggcuaaccgucugccagaugagcuacauuccagcucaaccacagcguaacgcuugccucccucuuugaggcccuggagacccauuccucagggacaggaucggccuguuguuguuuaugagaccgaguuuccuguagcucugacugucuuggcacugucucaguagaccaggcuaccccugaacucaagagaucugccugcucugcuuccccaaugcaucacaccacacacaggacucuuuauggauggagguggcgacccauucagccuguccuggggcagcagcuguagcaugcuuucucucucucucucucccuucuucagauagggccuguuguaucccaggcuacccuucaacuaguuacauagcuuaaugaccucaacucccaccguuccuacauccaccuccccagugcugagauuauagucauggaccaccuugccuggcccgagugcuguuuccuggcuugugcagccuggcuuuacagugauuuccacacucucaaguccagccuagaccacacucacagcggagcaccaaauugacuuacaugggauguacccugaguuaagaguuuggcaaagcugcuuugugggaugguggggugggggaggggaggcuuccuuggggcagagggucagcaacuagaaauacaguggacguucuaccuguccaacuaucugauuuccaaggacacuaaugcuucagugaggaucaggaggaguauggcuggcuggcugaaccacuauccugacauacuggcuccuuccagcucucuccccuaaccuaagacaaucucagcccucuagucaccccugagcugccucccugaugacauucucccagacuuccacagggcaggucuuuggcagucaugaaauccuccacccucugccaaccaguccauucucuguguacuuggguuuuuuugaagccacuggcucuggggcucuagagagagagagagaaagagagagcacuuuccugggcucagccaggagggacuugguugaaaccgaggaugccucuuuuagaauggcagaaaaauaucaugacagccccuccccagaggcucuaggcccaggaaggacaggccccaggaccagcccagacaggugaggucaccaaggcuguggcauugcuuuaguuuccuagugaggcugauagaaagcauucugauuccagcugaacuggggagggcaggucgcucagacgugagccaggacugcuaugcagagggugugacucacuaguaaccugcacaucaaaaugaagaaagacaggguaggcaggacagguagaccagacucccugccugcucaggcuagccuugcccaaauggugggcagucccguugcuguccuguuugaccuuuucuugcuuuucucacuuuggggccuugugcucacaacugccuucacaaugccucuuggucacuguaauaagaccucugcucagcaagggguuugaacaggcccagcccauauccucaaggucagugagccuucgcugaagcuuugagucccacgguacugugugaugaaugccagucacaaagccagaggcaucucccacggcccucaaccucccuucauuucugacacuuguauuaagcagcgcccugagaggugaugcaucucacugaggccagaaauggugggcccugccuguccccuuucuguucccguaugacauagcucccaccccccaggcccagcagcucacuucuggcacucauccagcacaaaggcucucggguggucgucuccggacauggugaugacugucucccucucgaaggccccugggcgagucugguccacgguguggcgggugaugguggaugugguguagcuuguccaguacagugugucccagccacggugauaggccaggccuuccacagagcccacaucugugaagagacaggaacagcuguggguugagaagggccaaccagcagaagcagaggggcagccugguaggugcuaagggcaugacuggcuccccuggaauugugggaaccgggaguuccuccgagggcucuuuggucagacuugccagggccccagggccccucacagagccacgucacaccaccugcgucaugauccguggcaccuuccuuccucuucucuugcccaccccccacucccggccuauguguggucacacucuucagaaguggaguucuguuuauucauguaugggggagauuccggcuaacugaauucuacuauuccucuggggccagacuggaaagcuuccugcuugcagaggccuugaacuggaauuuuuuggggggagggggagcaugggguggucgagacaggguuucucuguguggcccuggcuguccugaacucacucuguagaccaggcuggccucaaacuuagaaauacaccugccucugccucccaagugcugggauugaaggcgugcgccaucacgcugggcugagcuggaauguuuuauaaagcagauguaacuaaaaagacagagcugaacagugcugugagcagcagccagcggaggcuccggggcucccuggggcgugucuaugugacugccagaggcggagcacacuguaggacggacaacagagagcgugauaggaggggcuggcucccagucucuccugauggagcugagauugagaguauccaguuuaggugcuggggcugggcccaacguccugcacaugcugagcacgagcuccaccagcccucagacgcuccauuuuuagacacagacaggaugucguagagaaagugugccaggagacagaaggacagagggacaggucuauucuuuucuaugcaguaccuagucagcaccuggcuggucugaauggaccuccuggaugaagagaggaacaaaggaggaaugggaauagaccuuggguaacacagugcucaccuaccuagcaugcacaaagcucuggguucaaguccuaccacaacauaaaaaaaaaggguaugguaguggcgcacaccuauaaucccagaugaccccagugcugugcaggcaggaggaucagaaguucaaaucaagguuauguguggcuacaaaauguuucuuaaaaaaguaaaggaguggggcuggagagauggcucagagguuaagauaacugacugcuauucugaagguccugaguucaauucccagcaacuacaugguggcucacaaccauccguaaugagaucugacacccucuucuggagugucugaagacagcuacaguguacuuauguauaauaaauaaauaaaucuuaaaaaaaaaaaaagaaguaaagaaguaaagaagaaggggguggggaugagauggcucagcgguuaagagcacugacugcucauccagagguccugaguucaauccccagaaaucacaugguggcucauagccauccagaaugagaccugaugcccucuuuuggugugucugaagagagugacauuguacucauauacauaaaauaaauaaaucuuaagccuuccgcuccgggaagaaguggggcuggagagaggaggaggaggaggaggaagaggaagaugaggaggaggagaagaaaaacaagagggagaaaggaggaggaggagaagaagaacaaggaggagaaggagaagaaagaggagaagaagaagaggaggaggaaggaaggagggaggaggaggaagaaggaaggagggaggagguggaggaggaggaggagaaggaggaagaggagaagaaaaacaagagggagaaaggaggaggaggagaagaagaacaaggaggagaaggagaagaaagaggagaagaagaagaggaggaggaaggaaggagggaggaggaggaagaaggaaggagggaggagguggaggaggaggaggagaaggaggaagaggaggaggaaggaaggagggaggaggaggaggaggaggaggaggaggaagcggcagcagcggcagcagcaacagcagcagcaaagggaaaaccugaagugguaaaaggcagugcugagugcugagacucuuucuggugacagcucuguggcuuucacagcucuggcagggccacuggcugccaggcucagcuuucaugugcacaccccugagacccugacuccugaguucaggguaagaagcucgcuggaucugcugacucccacucagggagaguugcaccugggcccgugucugcugccugugcuugcauaucuugguguggaaugaaaucagugcaaggaaggaagaggccuccuucuggcuccauguaaaggacaaugugcagguuaccacaauggcaguggauccugccagccccguaggucagugguccucaaccuuccuggugccucaauccucuaauacaguuaguuccucgcgcuguggugacccuaacuguacauuuuucccguugcuacuuccuaacuguaauuuugcugcuguuguuaugaauuauaauguauuucugauaugggaaacccugccuuggggcccacccagcauguggguuugguuggugccuguguguccacacacugacagucccccaucgccccacuguuuauugggaggacucgggcuuggcuuacuuuccacgauggugguccugcccgagccaucgucauugaucugcuggauguucccaaaguggaugucacugaagaagaugcgguuagggguccccggggaggugccugcucgguagucaaaggccagggcgaugacauuuuucaugugcucggggucuucaaagggcugcaccggugcguugagguuacgcucauccgacagguggaugcucuugaggaugguccgcucugaguagagcagguagccagcguacucucggcaugaggccccgucuucugccagcaucccgugggcacaggcacaggcucgcuguccgccaccccgauacaagcagagcugcuggcacccgccguuggcuaccgcgcacacauugguaccugggggcagagagcaucggaggguagaacaucggaagguagagcaucagaagguaguaugguguauagcauaaagagaggcucuuuggucucucuguccucggaucaguuggaaauuucagcugaucccugcuuagcuaugguaucuaauaucuugaucuaucccgcucaguccuaacucccugcccccagcucuugugaaucacuggaaagugcccuggaggcucugacugauuuccugccuugucccucuuccuccaagguucagcuguccuuguucaccuuucuggccuggcccagagcccagccuuacccuucugccugucccuguugaagaccuugaugucuuuaagcugaacaccaaugccuguccucagaggcacggagucuguagcauugucuuugcagccgcgcuugauggagccauuggcgugaguucuggagaagggaaagccguguguaggguaugucacuaaaaagccagaaaggagaaacccaugggagaagcaggacccagccccccucaccugucacuccaguagaugaaguccucaaacacggacacggagaacauauccauguuauugcuggacaggaccaccucccgguucucgcccguuuccaggucgaugcgcucgaucuuguccauccgagcaucacaccaguagagcuugccgcccuguggacagauguacccagcucaccuuggggcuaacuccugcuuuccaguagggaucggcuccauguguaaccacacuuacuguguggaccacacacccucacucuauacuuuuuaauuuauuuauuguuacugcccucauuugcagcauuagagacuagucccaggaccaagcauguuaggcaaauaucauguuagcuucuuaucuauguaucuauguauaucuauguaucucuauguaucuauguauauaucuauuuaccuacaccuauguuuauuaucuaaaaucuaucuaucuaucuaucuaucuaucuaucuaucuaucuaucaucuaugcaucuauauauguaucuauuuaucuaucaccuaucuauuugucaucuaucaaucuaucaucuaccuauuuauacaucuaccauauaucuauuauguaucuaucauguaucuaucuaucuaucuaucuaucuaucuaucuaucuaucuaucuaucuaucaaucuauguaucuauguaucuaucuaucuauguauuuaucuuaaauuuuugagguaagaucuuacugaauaguccaagauggccucaaacuugaaguaauccuccugucucagccucuugaguguuaagcauaugcuaccacacccagcuuucucauacucuacuucagcaugaccacccuccaucgucuuagggcagauuacuauucucggugacaaauggguuaaaggcugccaccacccucccugguccacgucuaacccugaugguuaccacagggaaacugauagggaaaggcucagaacuaggguuaucgccuucaucagcuccaggguguauccguaccugauagucuacugagaugccauugggccagcugaugcugacauuaaccaacaccacucucucugugccaucaaggcgagaccgcucaauacguggguaaugaccccacucgguccagaacaaguaccuguggguagggauggaagugggggugagaguccaucccacuuagaagcugggccuugucagacuauacuguggucaagagaucuaagccagcuugccuagcuccuuaccccuucucuggguggacagugauggcccgaggcuuguccagacccugggaaaugaccacauaacgaaaagagccauugagccgggcaaccucgaugacaucgaagcccugguccguccaguauauguugccugaggagggagucagucggugggguucagggagauugguagggagccuuguaccugguccccuuccauccaaaucuucccuguagcucccauuggcuucugcccauaccuucagacuuuacguccccauggccugugccuuucccccaaagccuauuuuccuucuaccauucauuucaccugcgauccaguccaccgcgaugcccuccacacggccaauaccguuggucaccacauccucucgccaugucuggucacgcuuggcccugcugauggugcuuaggcccauauccacccaauaaauagugucauuuucuggaagcagaggggcagacaugagaaugccccucaaugcagaggcaaggcaaagggucaaaucacgaggagggucaggauagcaccgaaugggggcugugggugccgggugcuuucuuggaaguggggaggcagcaggaaggagugaggcagcugcuacagucaguacaggcagcccuucuaggacuuuaaugugucacucccauaaacuacuggggcaugcugacuaauccccgggacaauagcucaccggcauggaagucgauuccgacagccagugaaguuccggacacugggaccagggcauccgacuugucauugggaucuaguggaaucccccgaauucccucauguacagaguacaggagaaaagagcccacaccugcaacacaaaaacacuuuaagcaugagccuugcugacaaagcuagguuccugucacccucaaacugcuuuucucagcuuccccuuuggcaguuucuucuacccaucuccugaaccucuaaacgcucacaccaugugugaggcccggaccuuggacaggagauggcaaccuaacuggcuucugagagccccagcucugggagaccaccugcagaaccacuauucaccacaagagggcagaaagagacuuacauuucuuucucagcacccugccccagucuuccuuccaagggccucaggggaggucgcagcagacaaccagagcagcaagacuccaaaaucuagauucccaguuuggcacuuggucugaccuuaacuuucucauugcccugccucugcucaguuccaaauccuuucccaacauaaaguucucaacauccugcuugccccugggucagucuucuuuccaguuuuccuguuuuugagaaggcacugcucucuaugcaucccagaauccucccugacucccaucccuugaauacaaugugugccccagugaaucccuccauuaagccuugguugcuuaaacucugugaaagaagaggaggaagaggaggaggaagaagaggaaaaagaggaagaggaggaggggggaggaggagaagaagaaggagaaggagaaaggagaaggagaaggagaaggagaaaaagaagaagaagaagaagaagaagaagaagaagaagaagaagaagaagaagaagaagaagaagaagaagaagaagagacgaccaccaccaccaccaccaccacgugcagacacuaaaagucucccaaaauaugcucaguguacucaggguucugaggagccaaacaguaaaaacacaauguuuacauguugcucggcccaggguuccuuucuguaacacccacccacaucaaagcaggagguuucuggcagagcacuuuggggaaaagugcuguccaagggcaagcuuguaaaccagcaggcucuugugaagugccuccaugucucaucccuuccuugcaagccaguugaguagccaggccucgggccugccuccucacgcacacacuccuaauacucuccuaacuggucugacugccuugguuccucccuccuccauucugcaagccuucugccccuggguuaaucuccaaacaccacuuucuaggcacuccuggcugagaacccgcagguccccacccuagcucaaagccuuaucacagucuucccacgcugcccucgacagggcucagcggcccuggaacuugacuucucagcuauauuucuugccucuuuuuuuuuuuuuuuuuuuuuuuuuugauuuauuuauuuauuauauguaaguacacugcagcugucuucagacacuccagaagagugcgucagaucuuguuacagaugguugugagccaccaugugguugcugggauuugaacuccggaccuucggaagagcagucgggugcucuuaccuacugagccaucucaccagcccuauuucuugccucuuauguagcaugagugucugucuccaaggcgugcacacauagcugggauuuaagucagggcucagggcauguuaagcacacccuauuguaccaccaacuucucucuucaagguaccaagcaucagauucuacccacucuauaaacccagggcacagcacagggcacgccucuucugccaagcuggccugccucugucagccgccggugucuaucucaccaaaaccuacugcagguccugaacagucacuagcgcuuugugguccggcuucucacuaugcuggccccacuuucuggcuccagcuuuuguccgcaguacccagaaaggggcacuggauaagcauuuagcccagaagccuccugguaacacacgaugaacaccaucuuucucaaacgcauaauguagcaauaggguagaaggggucaaggcuggacagagaggaaaugccgggaacugacccucacaggccugcuguccgcuccggaggcuguaaccggcuguacacauacaggagcgagucgucucugauguuggcaggcagagcugggaacagucuccguuguugacacugcagggguuggugcccucaugcucugcgggaggacacaggagugaaaagaaagggugagccuuggugggggacaggcuugggcugcucagagaggacaacagucacuggauucacccuggaccugucagggucacacccaacccaauucuuaggucucaugucuucuuagaucccuggaccuucuggccagacugagucuacauuucacacgaguggggguaagguaaaaagcccucccucuaugcccucaccaccccccccccccguucuggaggcugcucauggucacagcccugcagucucucugccaccccucaucccucccgccgcagacccccuccacacaccacauugugcgcccacugcauaccuagcuggaugcucucgucauacaccuucaugugcauaaccaacgugguacuguuccgcagcaccacggacccagagccaucggcuuuguugcacgugcccaucuucucugacaccugaucugcccaccacagcuuguccccuggggcaacaggagggaauaagacucuugggaaggcucuuuccuaguccucuuuuucuuuuaaauauagauuuuuuuuuuaaauuaagauuuauuuauuauauguaaguacacuguugcugucuucagacacuccagaagaggucaucggaucuaauugcagaugguugugagccaccaugugguugcugggaauugaacucaggaccucuggaagagcagucagugcucucaaccacugagccaucucucuagcccccccagcucucuugcagaagucauuaggcuugcaggggguggaaaguggccuucaggaucucccccaucaccuguucagcugugccuagccugcucuccuuccaucccuccuuccacccgagcccucacccaugauggccagggcaguggccuugcccagcuggcuccgcauggugucgaugaccuccagcucgcucccauccagauugcaacgguugauugugugguucccagagcugauccaguagaguuugcucucagggaagucaauggccaacccuggaagaagagugggugucagagccauggagcccucccugaaccuuguggcucugggacaagguauagugagaguaggcaccaagcuggaagcuggaagaggccuaaggcaccagagagacacuaggagcaucuccuaauggagcuagaugccugcaggagcaagaagggcaagugcauacccacagggcccuucuggccacugaagagcagagugugguugcucccauccauguuggccaugcugauguuguccccaucaguccaguagagcuugcugggaaaggaaccaagaauuggguaaggguccuccccuccccuccucacacaggugcuccccaacccugggcugcagacugacccacgaagcggguggacgaccaggccguggggcugcuccaggcccugcaccaccgcauucuugaaggagccguccagccgggccacguuaaucugcuucuuguuggugucguaacuuguccaaaacagauuucgggagacccaguccacagccagcccgugggcguugggcaagucugggggcacaaauagggaguccgugguugguauuugcaggguauaggcugaggagagugugcuaccuggggagugagggucaagaaguaggcuagagauaagauuuggagaaggaguaucaggaccacaggggaugugacugguaugagccuugggguggagggcagggccagaaccugcagagacaacggucuccacgccagugccguugauaaaugcccuuuugauggcuugaguccgcacaucagaccaguaaacucgcugcucucgggcaucauaguccagcaccgugacauugucgauaucaggcaccgugaaggagaugauauaauuguaguacggggcauccagguccacgccccggaucuccaucugacgugcguacagcaggaacuucuuaaacucugugggacgcaggaaagucauugaaggcagucccucgccuucaaguuucucaccuaccuagguuaggugucuccccugaaucccccugcgugcuguuggccuuuugcuacgaugaugguccucagccuuccuaacgcugugacccuuccucaugcuguagccuccagccauaaaauuauuuucauugcuacuucauaacuguaguuuugcuauacuuaugaauaguaagauaucugguaugugaccccugugaaagggucacuugauacccccaaaggggucgagacccacagguugagaacugugaagagacugugucagaucuuggcaguuguggcucuuuccuccagcgcuagcaaguuuucagagccccuccuuccagucauuccuuugcuuaacagcagggaccucuccuucagccucaguuuacccguaacuguuagaggaggagauggcuuccuaccauagcaggugguguuguccuugugcagcuucaugagguggggacaggcgcaggagacgguccgguuguaguugaugaggcacagaugggaacaggggccccggccgccauuggccucacauggguuuggagcuggcccagagagaggaagcaagagcauccugggauguguugaucccucccuggcccuucucacccaggucucauccccuccucacaccccauuaucccagcaccucccccacgcccauccaagggcugguggcuccucuucagucgccugaaggccccuuacccaugggcugccgggaagggugauacaccugcaggucgaagggcuggguguugguccucuguaccacggugacguuguggccaguccacuuguuggccuuagccaguguauuuguucgccagucgguccaguacaccuccccaccguacagugucacggcaaaugggugugacaggaacucguguccccgaagcaccuccauguggccggagccgucauaccgggcugaauagauggcaucugaccugaggguguaauggaggggucagugggggucucagcaaggugcccugccaggugcccaccuucccucauccucacaacucaacacaccagggaacuccccuucccaaguccugccugggacugaagagagaaagcaagguugcauggguugggauccuagccuuaugcccuccccaagggaaucuucuagauuuccuucccagggcuacaguuggcguuuggagcuccagggugaguuaggaaaaggcaccuucucuuugcccugggcaggcagagcccucagcagaggacacgggguaugagaagagcggaggguagauggaugacugcagguuacaacccugcuccuucucaucugucaguuccccuccccccauccuccucuuggcuucaucuuucuucaugcugguccugucccuccccugcccggaugcugcugaccuagcaucaauccagaggaugcgcuucuccagguaauccacggugagcccguugggccagcccccagagccugucucccgguggaugguucggcggccagccccacucauggacgcagccucgauucguggcaggcuggcaucccagucuguccaaaacagaauccuagggagggagggaggaagggaggagggccaaagaugggguggucacacaacagauaagcugggggagucaacaguaccaagaagacaggugucccuggccaggcugaacacagagcuacggagcggggguggguaggggguggggguggggcagaguccuuacccaucccgaggguccagagcgauggcccucgggugcucaaugucacccgccagcagagugguucggaggguuccguccagcuuggccacuucgaucugguccagguugcucuccacccaguagauguugccugcaauccaaucuacagccaggcccucugguguggccaagccauacugaaucaccaccucaaagcuggucagggcuaggaagagaagguugcaggugguuagagacuccugggccggggcuuggcgaaggcauggaucucagggucccucaaugauccaccuucacccugacaccucugcccagagagcugaagggccuggcucccacucuccucucccaggccucuuuccuccugggagguaggugggaaagggggcucuuggaggagggggugaggucagccacuuugaguauguacuguucugaggugggguaaccugggcaaggaggucagggcugauggaagcuucugggaacauguuuggacauacuauaaggaugauggaacgugcuagaaacuacccauugaauguccugaagacacucuacacuaauguguccgugugucuuauuauuuuagaaacugucaugugacgacagcucaguuuacguaacuauucuccugaggacggacauuugagauguuuccaaguuucuuuuauaauaaacaacacaaacuccucuauuaaaacaugucucuugcuugccucugcucagggacccucccugacacacaacuuaaaacuaucugucuugaucacugcuguauccagcgcaauagaugcuuaauacugagccuguguagcucaggcuaccccgagacagaggugguccaucccuacauggcauuuuccuucuaagcccaaaauuccaagacuggggaaccaggcuucaggccguuccaaagaaagggugaucauuuuguuaauuaucaggcagcagcaaugcuuacgauaauuacggggcaucaggcucugagacccacagcaaaauccaacccaauuaacugggggagggggggcacacgggggaugggcagccgaagccucagcuccggggccaccugaaucugggcccgugacccugaguacccaagugccaucuguguacaauccuggcaacucucccaggcccaaagagucaccuccguuguccaggaguuucccacgguagaucuuguccucuaccacgucgguccaguagagggcacucuggcugagguggaaguccagggcaauaguguugcgcaggccaggcacuaggacgcuguagucccccuugugaaggucaaugcgccugaucucguggcgguuggagaagaugaugaacgguuugaagggaucuggagggaggcaaguguucaggucagcgaagggcuuagagccacucacugugccacccuguccugggauauacauacagcgucccugcuagcccuggccuucagcccacuguagcucaggcgcgugaccaggccugcuuggcuggcucaccuugaccccacugcgucuuacccagacugcggcagcuuuccccgucaggcuccaagacccagcccucguagcaggagcacuucacacugaacuuguucuggucacacuucuggcugcauuugaggugcuuggcacaguagcucuggaucuggcaggugugguugucagagcccagcuccaugcccagagggcaagagcacacgaugccuucaccaggggccacugagcaguugugacuacagccaccauuauucagagaacacuggucugggggacaggaaagagauagggucaagaucugggaggaagcaggacauggcccugccaggccuucacauuuuuuuuuauccuguucugagccccggagcccuaaccacagcucagcccugcugagccucugucuccuucccagucucucuuaggaucaggauugggacacuagaaccugacacccaggaccaucauccuuuuuccuuaccccugugugcucucgaugcccucacgucgauggcugggaccugggcauuuugccuccucuuugggaggauacucaggucaaggcccuuucuuugaucccucccgauucacgugugacacagggcagggugcagaggggaaugcccugaccuucccaacacgccccacgguggcaauuucugggccagccucagauggcuguacccuucacuccucuuucccagaagucagaugacuuguuuguucugggacggugugguuugcucagaucuccucgacccuccucacucauucugcacacguugcccauuuccgggaacccaguuaaauucccuccuccagaagucagcucaaaucaugccucaacccugugccucacccccagccuggccucccuuuucaguggucugacugagggugucugacccaggucaggagucuuaacggcucccucccugcccugccuucagagugggauggcccuggauuaguuuauuuaagggcucugugcuucuucuuccucaguugguggcagacaguggcugucuaccugggccacuuuguaaaguaauuguuacaggaguugucaccucaggcagggccaaggcaaguccuaggucagugccuccucugccccagaucauuuccuauaguccuacccuggacaagaccuccccucuccccacugcugggcaaccccaggcccugcaugggcgccucaccacagagcucgcccucauccgagccgucuccacagucauccuugccgucgcacagcuugucaggaggcaggcagacagagguguuguuggcgcagggaugggaggguggccugcaggccagggccucacaguucuccucgucggaguuaucuucacagucgcugucgccaucacacacccacgccuugcugaugcaccgggcugagggaccaggauggggacagaaugaggaaccaggccuggagaguggaacucacugugcccugcccagacccagcuaagaaugucuucacugaagugcuuaggagcccacuguaaaccuugaaaccuuuucugucaaacccacacagcuaacgaagaaggugcagaaccugcagaaggugccggugcucgauucuggccaggguuuggguucccggggucuuucauacagacucuggcucuuucuugcccuuuccucuacauaacaccaagccacuguuacauccucaagauggccuccuccuacucaugaagcuccccgcccugcucugcccccucucaccggaguccuugcagccaaacuugacauucgggucacaaacaugggucacgcccucacagcucuucucaucgcuggaauccaugcagucgguguccccgucgcagcgccaccucagggggaugcacaggccaucuaggcggcacuggaacucauccgaguggcagccaccaggaggucuuguagcuggaggacaagggcgggggguggggugugcaucaggagggagaggcacccuggacagaucucugccacuaccucugcuuagccuagaugcugagccaaguaaggaugcccugggugucccaugagccugccgauagccagaaagcucuaacucaucgagagacucagauguuguaucuucaaggacccgggugacccucuuaucuaacgccccuccucuaagcuuaugagaguaacuagcuacauauuccaucugucagggcagaacucaaauacaucaaccuaaccguguuucccucacucccugcacacucucuguauacaccgucccucccacgugccucaaagaccaaauccuuucuucaacauagcuuagagucuaguggagggggguggaccuaggcuaugauugcaggcaauggcaggaguuuaacagugccagccugaugaaaugacacgucaggcaagacggccucagcaggccccugagcagaaaccuccucagcgggaauaugaauugaagagugagccacuaagauacgugcagcugcacagccaacagaggagcauccugugggaagauuccagaugggacagcagaggcaaaguugggagggaaggggcagaaggcagaacauggaucagagaugggugaagggcccagaggucucagcaccuuuuucacgugugcagagagcuugugaagccugagggcagugucggggcacaagaucacugacccauugggaucuuccuguaucucaccuaauccuguaggccaguggcauaguggaaaugccaccccccccagugugagcauugaugaucggguaacugggguggcaggguguguccaugucucaacucucagcagcugccuauaaccugacuuccuucccugggggggggggccugaaguucagcguaagguaauuuccuucugggguuguuuuccaaauguaccacccaucuuccaaagugccucccaggucaagccucugcccaacugucauuaugcuauuggaagcagcugcuuucggaguagccccauuuccuugucccugcacgaggcaucugccaucuaaccagccucccacuacccccauaggaagccuuacacuuuccuauacagguacugaaaucaccugcaagcccacuuccuccucaagguacugggucaugccagcucagaaccacagguuaacuaucacugccaaucacuguccacaagccaggucccaccccucccaucuccaccuaauacucagaugcagaggaagcccagaugcagaggaagccagaucuacuuggcuuguugggcaaggccugcauugcuucacccaucuaggaaggaauccuuucuuaaacccccuaguccuuuucagagaugguccugaagacugagcuuccugugacccucuugucacugccucucagcugaaugcguagaguggcccauggcacucaggacgaugcuaauucugacgcggggacuccuagcuggaggcucaugggccauguacggcuugcagaaauauuuugacccauaaguaaacuaucaguugucaugaacugaagugcgauuccuaaaaagaugcucaacuccgcaugccaccuuguuuggcaaauaugucucuguacauuaaaaucacuaauuaauaguauuaauguuccuauaaaaaauguagggggcuggcgagauggcucaacagguaagacacugacugcucugcugaagauccugaguucaaaucccagcaaccauaugguggcucacaaccgccagaaaugagaugugaugcccucuucuggugcaucugaagagagcuacaguguacuuaugaaaaauaauaaauaaaucuuugggccggagcaagcaggaacugagcgaguggaguugacuggagugagcagagguucuaaaaauucaauucccaacaaccacaugaaggcucacaaccaucuguacagcuacaguguucucauauacauaaaacaaauaaauaaaucuuaaaaaaaagaaaaagaaaaagaaaaaaguggacccagggacagacacauuuagggaagaagccacaugaagaugaaggcaggggcaggguaguguguccagaacaaaggaagaccagaggucucagaagacacaaggauguguuuuccuucacaggcuggggaggagccagccuugaauucaggacaguuugcuuuucuaccucacaugcuguguggagcacgguucugucaucuacgucccucgcuuguggcacuaugcuacagaaacguuagcaaacugauaugccagugucagaauacaguacauuucacagggggaaaaaaaaaggcauuucugucuuuucuuaaagccagaccaaacuuauacugauccucuuuuuuucucggcagugacgaggcagagcuaagacaccagcgcccucagagaggaccugugcccucugggaaacucagccucucccaagaggccccaugggcacuggguacuguccgugguacucuuucuucuuucuuucugagacagggccuucuacccuaggccaggcugaccuacuaucugucagugaucgauccuccugccucagccucucgguggugggauuauuggugugagccgccaugccugacucccugucaauccacagcucccagaaacauccuguguccugauaaccacuaccaugucagugcuaauugcugagaaaacucaagaggcccacagagaugagguaacuuguccgaggccacucagauaacaagcugcagagcugaagcugaaaucuaaggccacccaacagccaggccuucaaucguaacagugcgugccaaugauucgccagcaaccuuccucuccugggggacuggagccuccucaaggacaaggggcaagcaucagagaucucagggugguaacaaagccaucucgggguucuuggauggcgacaacagugggguggguggcuggacaggcuggaugcuaguccagagugcucacccugguugguacaguuggcgugugucucgucgcuguaguccccacaaucauuguccccaucacacguccagugcucggggaugcaucugccacuguugcacuugaacuggguacuggagcaggagugacugcagccggcuucgucgcuguuguccccacagucauugucugggcgagggaagagggggagagccaaggauggguucagcagaacagccuuucuguaaccccagcuuggccugcuuagcccccucacucccaccagcagcccgccccaccccccacugagaaaauaacagacagaaaagacaaacagaaacugcauagacugcagcaugcaccauggcccacagggugggggaggcagugggugggcuccaagaggcccuucccugagucucagagaguuggggguggggacauccuuugcagcaggauauggggacaggauugccuacuuuggggggcuagggagagguuccugaugguuugaaagaugaggggugugggguguaggcgagacugcuggcuggaaagaucuuuacccagccacacacugagcuugggcauugcaagacacuggugcagggugcaggcucccagaggcuagaggacuauucuucugaaguagguaucuggguggacauccuggcuccuaagcccuaggguaacuucccucugcacauacugacaggacucucaaagacagagcacucucaaagugcucucugaguguaguguguuccugcccacuuuuaacuggcuuugacuuucuucccccaggucucagccuccucggggccaccucugucaccucucuccucugaacacccuccaaguucucuccugccucugccucuuuugucugugugugucuggcagcucugggccagggaaccuagggugcugggaaggcugaggccaucuggggcucuggggugauggugcaugugccucuaugcacugaccggcaggcucaggacaggucuuuucgucagagccguccccacaauccuucucugaaacacagaaaccgccagggcaaccauuggcacucgagacacggcacggaggagggagacaugguacagacccaacccauccucacaugugaagcagggcuggagauccuggggcagcacauugcaacacaacacagcagcacaccagacaggacagaguccgaaacggcacacacaaccaccacuugcaugugugcuuacacacaccguggucccuguggcucagggcugacaucaccugguccguggcugaccuccaggugugcuuccaagccugagacccagagccuggggcaugcaguaaagaccccaagaggcagagggcauagggagaagaggcuaggcccugggcuuugucgcucugcccucacuuaacuuuccugccagagggugggcagcucugcucugcuaaggcaggggugauacaaccgcagggaccuucuguccaccuuggugccccaugguauuucugucuccuuccuguuucuccuagcuaguaaaucucucaggguuucaguguaccacagagaaccccggcucgagucuaagaucuugccugccuucucugaggccugccuggcuucuggcuuuccuaggaauuacaguaagaggagggagguacgcucuuagcucuuaccguugucacaccgccaguugauguuaauacaucugccauuguugcagguaaauugagucagggggaagcaggugggguaggcugucagagagaaagagaaaggacagucgaguggggcccucaaagucacacguucucacauugagaagcagguggugaaggggacacuuccacaagcaggagccucuagcagagucagauggggcagaggggcucgcuggaaauagcucauuuaccccugcuaggcaucaucacaaaccccgagcgccccccccccccaaugugaugguggugcuauuauccccugcugcagacagaacuuaucaaggccacagugacaacuuacucaagccuaccagguacacaccuccagccccaacccgugaucugccccuccccucugccagcuggccagacuuucuugccugccgugccccucaccgcaugaggcugacucaucggaccgguccccacagucaucauccagaucacagguccaugagauaggaaugcaucggccacuggcacaggagaacugguuggguggacaggugcgggcuaggggggaggggcaggugcagaaguucaucaucuagccccucuccucucccaucguccucugcaccaccccccaccccccauucuguuugagauguuauucucuagugucccgaaucacacuggugccgccugaccccauaucccaagggaucuuugggguuuuugggaaaaggcuccauccgugguuuuuccucaucuccaucuaaaguuaaucuguuccccuguacacccaguccuguuggucuguccauccuggcagggaauggaagacccccaucuccugcccagggucccuuucccuuugcucuggguucaugggcucuucugucuucccaggccuggcuccuggacuaccgugcccgaguccacaccugagcacguggcauuggauucguccucgcuguugccacaaucauuauccccaucacagagccagcgguuggggauacaccgguuguucucacacuugaaucgguccgagggacagguguguugaucugggguuugggggagaggucaggggucagugagaaccgacucucuguucucacggacacauaugcagagucccacugcccugugcaggcgcacauccagugucccacuacugggcaguggcacacauccagggucccacugcccggccacccaggaugggaacagugacucacggcacagugcuggggccucaucgcuguuguccagacagucguugucuccgucacacuuccagcgcuccuggaugcagcgguuguuggcacaggcaaacucgcccggcuggcacuggggugggggcacguaggauggguucgcugugggcaccacaggagugugagggguaaggucagacccaggccacgggacaggcgcuaaaaccccuguacuucucuucugauuuacuguuuucuccgugagcagauuauucgguucaauacgguaagggggacuacacccugcccuggcaaugucuguaucucccuguggucugagaguaaaauaguucuacaggucacagagaugugcuugguccacugcugacucugaacggccccuaggugucaucucaggagcccccaagauccuguccuggacuuggucuuucacaaagccauugacuccaccugguaaguaaacacagauccccagaucucugcaugcuccacucuucccauccccagcugcagugguaccucuccaucacugucugccuuagcaucuaagcagaccuuugguguagucaccugagcuuugcauucgcuuuucucacccaguuucuaaaaccucugcagggucccaugggucaccaacgcucucuccucuacuccguggaccacagggccuugaaggugguaugugugcuccuuguuccgcacagccgcuucuuagcuguuuuucccuuccuuucuagaaaccagugcugaccugcucaggcugcuucaucaagacuaaggaugcucugcuccugguccacugccaccuucucuacaaccaguccuggcucuguuuguuuguuaauuuuuuuuuuuuuuuuuuguauuuugagacaggguuucucuguauagcccuggcuguccuggaacucacuuuguagaccaggcuggccuugaacucagaaauucaccugccucugccucccaagugcuggaauuaaaggcgugugccgccacacccagcuguuuauuuuuauguauaugaauauacauagcugucuucagacacaccagaagagggcaucagaucccauuaaggaugguuaugagccaccaugugguugcugggaauugaacucaggaucacugggagagcagucagugcucuuaucuaccgagccaucucuccagccccuugccucuauucuuaaugaugucaguguucacaaagacaguuccagugcccuggccuuucacacccucugcuucucccagcccucugucuuguucucaacaggacauugaucucuacugagccuuuuuuuuuuuuuucuuuuuucucccuuuuguauuucuguuuugagagcagauuucauuauauagcccugacuggcuuggaacucucuguguagaccagguuggccuggaacucacaaagauccacgcaccucuuccuauugaaugcugagauuaaagguguaggccaccacauccagcuacugauacaguucacucccagaacugugauaaaaaaguuuauuccagcuaugagaaaguguaaguaugugaucaauacaaaaggguuaauaaauaaauggggucagacuuucauaucgggaugccuguguuaacuuggaccucaguuucaacccuuguaaauaaaaaaaugcuguccccacagagacguguuagaggacaaguaagcuacuacaugggaaauucuuaaaaccacacauaauguaugcuuagugaauguuggcugugguuauaaaaaaaaaaacccaaaaaccaacacacaucagcagagaaauggcugagucaacaauggaacauuuacuaaacgguacaguuuggccacuaaaaucgcugcuuagcaacggaagcaggggccagaagaacaugcaugcagcaaugcccuuuuauguagacauaaaugcacacagacauauuggggaggaguccccccuaaaauggcaucagggccugguaggauguuuuucugcacagcacauuuauucauuguuacaaugaauuguuacauuguuacaaugaguaccuacuuuuuuuuuuuuuuuuuuuuuuuuuugauuuuucaagacaggguuuuucuguguagcccuggcuguccuggaacucacucuguagaccaggcugcccucgaacucagaaauccgccugccucugccucccgagugcugggauuaaaggcgugugccaccacgcccggcgaguaccuacuuuuauuuuaaccuuaauuguguguauggugcugggaauuugaccuaaggccuuaccugaaggccagcaucccuagaacccuucuuauguuuaggagaucaaggcuauuuaaaucaugaucuuagggccuggagagauggagaggcaguuaggcacacuggcugcauuuccagaggacccagauuccauccccagaacccacaugguggcucaccacccucuguaacuuuaguuccauggaaucuggcacccccuuuugcccacccacuaugggcacugcauacacauggaacacagacauacccgcaggcaaaauacccaccaaaaaguaaaaacuaaucaauaaaaucaugaauguaaggaacugaagguguagcacguugguggagugauuaucuaguguauaugaggcacuggguugauccucaguacaauaaauaaauaguaaggauaaaacagagaauacuguggcggguaagagccgaaagaggcaggagauucauguacacacuggaugagggcuguguauaaaacagaacuacccaccuagggaagaaaguaccucgugugacuuaccacaucauauucauguucacugguuggaucaggguuuuuauuucuccuuauuuccuuuuuaaauuuuugguuuugagcuagaauauccaugcuggacuggaacuuauaaucccccugcuucagccuccacagugcagggacucuaggcauguauaccuuacccggcuaauuuacagaauuuuuccaguuuuacuuuugauuuuuuuuuuuuuuuuuuuuuugacagggucuuauucugcagcucggguugaccuggaauucuccaggcagaccauucuggccuuacguucacugacauccaccugccucugccuccugagugcugcuguuaaggaguaguuccagccuauaguguucugaaauacuguuauuuuacuguaaugauagccaaagcuaaaaugaguuaagaauaguuccuuucuuacucgcugucucguuccucauucacuugccccaucuucgugcccucagaacuaccccacccccaauccuccuuuagccccagagccuucucugaacccuaucccuugcuuccugucagcaucucagggcccccucuuugcuuccuuaaucucuacuggaaacacagagaacuccccugcccucugccauucuucugcuggagcuaccuucccacccuugugcaagccaggccccucauacccaagcaggugacaccaucuguguccaacaccugguccucggcacaggcacacuggcggcucccggggguggcgaggcacaggcugcugcagccuccguuauuuacccggcauuuguugguacccacugcaggagagggcaggaaaaggauggggaggcagggucaggaaaggaaaaauacacaaagugaggagaccaaagaggaagucgggaaaggaagguugcguugaaagagagggaauggaagugaauggggaacagaggcuucugggaagucuuugacauuaaagccaggggucccacccuacccacccgccauccccagcccauaaaggagcaccuugcugcugcugcgcgucguacauucggaucucaaagauaggcggucucucgcugcgcagaagggucacagugggcggugcgccugccacgccccguuccaagcgguagacgcugccgcuccgguacucgguccaaaagagguaguugccauggugacacaggccgaaggcaugauucaguucaggacccucauauacaaucuaggaauggaggugauguuucugaggagaggagggcaaauagagauucccaagggacaacuaggggcccugguggugcuggcuccaucaggugacucagaaaggacacuguccauacggaccucucauaaggcuguucaauaugucauuuauguguuucucucucucucucucucucucucucucucucacacacacacacacacacacacacauguaugaacacacaugugcacuugcgcacacacauacaccaacauucagccauuuauuucucuaccuaagcaacauuuauugggauuuauuaugggcugagcugugauggguacuaagagcaccauuguccuauggagggcauauguagguaaucugugggaagagggaccuggacacaaucuucaagagaaagagagccaagaagaacuagggggacucccaggaagccaaggcuuagggagcagaggccuaugauguucuggaauaacaagcugucuagugcagcuuguucauagaguguugaguuguggggaguaggagacacaagaugguagaggugcccagagcuuuauugugaagggccugacacaccaagacaguuuggcccauauaccuaaaggcaaacacaacucaugaaccaacggagugaacaaauaugcauauaugcuaccccuuagcaccuuacauguugcugcgugacuacccugaaguguguuauauguauguaugugcacacgcacagaagugcacacacaggugugcuugugggcagccauaugcagauagacauccucaaagaagacaauauacacaacaugaaaacauacauucauagaguagccauguguagaccuguaagaagcacgaagcccuacacacacagacauguacauccucauggaguuuccauagaaacaggguuaaacaaugcacacaugccugcccaccuuccggucugugccauugagcaguauggucucaauucggucauagaaggcauccacccaguagaggcguccggcugggauauccaggcuuagcccauugggccaaagcacugucuuggaggugacaaagauaucucggugugagccguccauccaagcccucucgagccgcccucgccgacuguccuugggguccuccucccagucuguccaguacauccaccugugggcagugacuggucagcaccacauggucacccuugucacaacagcuucuguugugauucuaggcacuaggugguaucuaggugguauccagaguuccucccaggggucucucugagcuauuucucucuaaaccccacaucacagcaacucaggccaccaugaauggcuacucuaauuggagcauggcucuggcaucccaggaugcagcaaaaccaagguuccccaucucuuaggagcgaacaucccaggagaaacaaguuguucaagaaagucgugucggagugauaaaaucaggaggaaaauuaaaugugaguggcggagagaaucuaggcagcaaguuugggugaacagggaugggguggggggcuucucugagacccaacgcugacaagaaaccaaaugugagguauccgggaguuccagacagcaaaggaugggacaggaaguggugggugagggaaggaaggcaggugcagauguuggcaagcaagaacugugcagacccaaaggcuagggcggcuuggagccaaggggaaccaggagagagcucuguaguggagcggcagaagcagacuuccgguugcguaccaggguuuuguuuucccuccucaagacagacggacaaacacacgcucucuuuucaggcuccuuuuucaggcucccguuccugccucugcagccugccugccucagccacgccccuggcuuugccgcuucccuccccaguccucugagauguacaugcauccaccccacgcccagggacagacucacccauugaguggauccacuacaauggcccuggggugugucaucuugcccucaauuagagucuuccgggucugagcggcuuucuccagccuggccacacuaauggucuucuuggggccaucaucaguccaguaaagauugucucccauccaguccacggcuacgcccuccacauuguggaugccugugaggguguagagagcgcaugggggugacccuugaaggacacaugacacagagagagaugguggccaggcagggggagcaggaggcauguggugcccugaauggugggcagaugggggagggaggguggggcagagguggggguggggauggagacgacccuuucagaugccacaucuacacugcaucuacgaugccacaucuacauuuugaaaaacagcaugaggcagccaggaaacuacgugacuaaggggagcucucagaugagggcaugucugggccugugcuuagguggacagccggggcgauaugcacuggcucuuugcuccaguaugacgccaccauccugggccuaaaaaaccuguacucacaaaaaugaguaaauuaggaagugaauuuucccuuagccaaaggcuuuaucuagugucccuuaaauagcaguuccccuguacagggguccccagugucuuccugacaggagucauucuugauuuccacacagucuuaugauugcugacugcugagguucucugagcugcacagaggguggggagcaagccagauugacugguuaaggaaccagaucuuggggcccccaaaaacagaucugagguauaaaacacacacagcucagaagcccucaaggggaacggcuccacugcacaguggcccugccaaaguaggucagagggagagacagacacagaguucucaggccacagagagguagagauauccguggccaugagauccagcugcauacauucugagcauuuacacuuguggaugagcccugucugacauggcaggcccggcugugauucagggccuauggccucuccuggcuguaugcuguacacagcuccagggcucugagccaauggcggcgagacccugaauuuucccaagggcuggccaaggcagcccucacugccuaacacauccauccauccuccgacucuuuuuggcucagccaagaagggggucacacaggggucaaccugucuauccccucaucuccaugccaaccagcccagccagcuugucagcaaggacucuucauacugugagggagcaaucuaagccucugaugucuuccugucucaggcgccucaucccccaggagcucuucccacacaccgcccaccucugacgcccucaccauccuucaggauagucucucucuccgugccaucaauuuucuggcggccaaugagguagcugguggugucagcaaaguagaugaagccggucucggcguggaaguccagagcgcguggauucauaagguucucgauggggaucaugugcucaucugggaccuuggcccccauguccaugccucuaaugaugccuggucggcccuugccauacacgaggaacagcucauguucagguucuagggcaaguacaaagggcacaaaguuacacagacacacaugaacuugcgcacacacacacacacaugcauacacacacagacauacaugcauauacacacagacacacaugcacucgcucacauacacacaugcacacacacauacacacaugaacucgcacacgugcgcgcgcacacacacacaugcagacacacagacacacaugcacuugcucucacauacacacagagauacacaugcacucgcuuacacacacacacacacacacacacagauacacaugcauauacacacagacacacaugcacucacacacacacacauggauacagacacacacgcauacacacaaugcacacacauguaugcgcacauucacacgcacacauggucaccacccaaauugaaaucugggucugaggugcuauagugcguuggcugggcugggucaggagaucuggagcagacagggcuaugagucacucccagaagacacaagauaacaugcuccacucuaguccuagagccgcugugucauggggauuugacucaagcaacuuuucauggaaaucggagugcuuucagagcacguugguaucuggucauucuaccagucugucaccaucuuaaccuaaaccaugucacucugacccacaccauggaaauagccaccuggcuucuucccuccugcccagcacaguauaagcguacacaggacgcacccaaucacucaucuucuuuccacaguggucauaagcuccucaucccagugagaaauucccuucauuucccuuuacucacaccacgacaccuuacccagcgucucggcagaccacacccuacacuggccucagggccuuugaaccguaaguucacuccuccauaaaugaucucucagcagucacacgguuggccgccucacuucaucagcagagagcuuggcuuagauaucacauccuccgacuguccugacaacuccucuguccccccacacccuucacugcccgaacggugucaaacacccaguguguguuugcugaacacucgcagaaugagugaucgugugcuagauauaucgcugcucuugggugugggccccuuaugucucugcccuucguuucucugcaucuaggcagaggcagcggguuacaggggaaugucuguggacccaccccuacccccagcaggcccaacucucccugauacucacucuuacaagacuucccaucacuucccaggcugaagccagaccugcaccugcagguccuugccuugugacuguuggccaggaggcagaugucggagcagccaccuggcuucccguacuggucauucucacaggcgugacuccgcacugggggcagaggagagagcugucagcacccuucagggggcucugcucgggucagauggggggugcucuuugcucuugucccauuuuaggacuuugaagcccagaacuaguauucaccgccuugccacaacccaggcauaagggauuccggucguggagaggcgaggagaaguagcuuggggaaggugccuagaaacacucucaauuugaaagagauaugcagaagagcagacagugcuguuggggugaagccgacuguggaggugcccuguugaccgcuuaccucggggcuggcgucgcuggugguagauaugcagggcaccacccuuguccacacgggugacgaccugguacucaguacuguugaaccgguucacucggaucacgcucgucuucugcugcguguuggcauuguccgaguugguggcguagagauaguucucaaacacggucaggccguacaggugcucgaucugagacggcaggcagcgucggucaacaagaugaaaaggcugcucccuucaucccccaucggccuccgccugccacccagacucccaucaccuacguccgaacuuuccccgcuaguuuuguuuaaccugaugcuaaacuuguguguucuggaaauuucuguuuguccaucuccuauucguccuucacaaaguaaagaacuggaguuuucaaagagaugcuauuccuuucuauacucugccucuguggugacacugcuaucuaacacaccagaugugcugaucacuggaccauccuaccaccgaggacaagaaaaaacaaugucccucgcagaauuaagcuccuugcagacccuuugagaauuugcagaugaguuaaacucgggcccuaaccucccuccccagagaaugcucaacuugacugcagcuuuucuggagacugaggguucucucgugucccaaggaagccuacaggggccagcuguuuccauuugcccaagauaaggagucugcugugagauuuuucaagguuaggacuggaagaguuccacucaaagccccgggcauggcugcacacgcaagcuacuccggaguggacggucugcacugagcagcaggaccuccuggcuggguucgagcguuguucccaguuguguaaccucuggcaaauuaccaaacaucuuugaaccccgcuuuugucaacugccugcucaucucccagggguuauuuuaagccucaaauaagaaaaagggaaguaaaaggggugucuuuaaaugacugcucccaucagaaugggaagccauagccuuccucucugacacauuccugcuggccccuccagaagacaugggcugguuaacucugcucuuuccacacucacugggagcccuagagaucaagucccccaaaggacuccccgucagcaggaggcucuggugguuggucuccucagaauaaccucagacaaagcagcccccucaccaggaugccuuggaugauggucugccgacccuucccuucguagucuaccaccucgauguagucuagguaggcguccgcccaguagacgaggcggcugaccagguccagggugaugccguguggaaacacgaucuugcuauccaccagcuuggugcgguucuguccauccaugucacagcgcuccaccuuugggaucugcccguagucagugaagaacaccuuccugugggugcacacaugauaaauggggcgcagggaccaggaucccccacacacuucccacuacagcuucugccuccucuuucgagagugagaaugccagcccgacacucuuaccccauggcgggguccaaggcgaugccuuugggguuguagaguuccagguccagcagagugacacagguguccccguuucgguuacagacaaagauccugucgucaaugucgucgacaaaguagaaguuucccgucagccagucgauugccaucugcuccacgucuggaaaaggaaggagagagcuaugugggacaggcccacccacaggcauccguuccucuggugagcuugccuucucugcgaccuaacccuccucagccacagccagcugcagccaccuuccccggagcucuuguggguguucgcagcggauacagucacacuuugacauucuuuauguuuccaaguaucuggucucuccaaauagaagucuccaaauagacucaacccccugccccagcccccauccuaggcucaggauugucauaagcaggagggacuagguaaauauuggcuggcugacugacugacugacugacugacugacugacaggaucuuccgauucuaauccaguuuucaucaggaaagugcuaucuuguagugccaagaggcaggaggucaggccuaccaacucacccugauauuuucucuuuaaccugcuuucucuugagaaaaggguguccuaacuaaccaaaacggcacauuaucuuugguuugggccugauuuauauucgcucuacaugguaagucuaauuauuucauacuaacaagaaguaccggcuggaagcugugcauguugcauaaauuuaaagaaaaaaaauuacugggaaguagaauguucauaaaugaacucagcuugggagaaaaguauuucaaaauaugaaguucauacagcaugacccaagacugguggccccgaggcuggggaaucagucacaugagccaaacuccuucuucuugccuucacguccccguuucuuccauguuaguacuuaauucccucacaccccgaggaagcacagaaggaaugagaacugaaguacagagaguccaagaggaggcgaaaauaggacccuggagauaaaccaggagacagagaaagaggaacuucugaugguacauggcagcuaccacagucauucuaagccaugaagggccacaggaggaggguaagccaaggacuguuggaagucuggggauaaggacaacuguuggcagccuucccaacacagcccaggcuuccaugcaccccccgcuggccccuuucaaauacacucucagaagaaaugccacuugcagaccugaacguuccuaaggcagagacuuuuaucugcacuguuucaacagcagguagccagccgucuuuuuacugccugccucuggcugaagcucggcccacacuaucaggacucagcccuguagggaugacucugccacacagcuacagguauaaugaugaacucugcucaaccccucccuaaccccccuuccuccccacagggauccaggagcuguuucuuaauagugggagggggugcagggaauaggaacaugucauccagggaaguuggcuggcugggacgacugacucagagucacaggacugaggacagaggagcgagcgggggaaguagucacugaaggcucacauaaauggcuuccucuucagguccccucugguaaaccccacccugagacaacuggagaaagaggucauagggaugagguauuaccccuacaagugcugacacauucccaaacccagcuacucuguccucuggguucccaagacuguuccauuuuggggggcaggcagggaagcaugaagaggacaagggucauagaggcagaaagcucaaugcaagugcucucucucucucucucucucucucacacacacacacacacacacacacacacacacacacacacacacacgagucaccauagagaaaccagauuaaaaugaaacccacugggccaccuccaaaggaaacugaagucccaaaguagggaccuuccuguggccccgggcagcuagcagggcagccgaaaucaacagggcucugugcccuuuacuuggugggcgcugcgggggucuggggggccacuggcaugugugcaaaaaucauccgucaaaucuguuuuccuuagcaccagcuggcacaaauggcuuucucuccaacuuccucaggcuucccugagucacugcccagcccuaggacuggcaacacccuggcccugcucacccauccacccuuggcaagagggaaagaggaagaagccugcagagagcuggugcccugcuuccagaugcugcuccauucucaggccaagccucaagauggggggaaccugagugggagccucucuccuggcuugcguucccucccacuucugggaaagcagggcagugacagucccuguucucaugugucugcccuuggcugggcuccccucaccuccccaaagaccaggcagggucccauucagcagaccugacuguaaggaauuggcaagaaaugacgucccuagccagccuggccuccccuuugguauuuuugcagcuggagauuauuagucucaagcaaaacuccuuuguuauccaagcccacuccaccacauuauuuuccucucuccuaaaguucagcuuccucuguuccuccccacaccccauccccaaccacaggccacuacucuauaaagcuguguugagagacuuggacauacugagaagggauaucguucaccauugccuaucagucucugagauacgggccuuggucuuauagccugggguucagguggagcccugggcuuuugccuacaggaacugcauauuccugcuccacaaaccuagacuggcuaugggcauaacuggcaugacuggaaagcugggccugaugacaagauuuauauguaacgccagcacuuaagaggugggggaagagggucaggaguuuaaggccaaccuugacuacacacagugaguuucaaggccagcuggggugacuugaauuuuugucucgaggcuggagagauggcucaguaguuaagaacaccugcugcucuuccaggggaccuggguguagcucuuggcaccuacaucagguggcucacaauugcauguaccuccagcuccauggcaucugcacacacacgaugcacauaaacucacacaggugcguguauaggcacaugauuuuaaaaugaacaaacauaucuaaaucaaacaaacaacaaacaaaauacauccgcccaaccaaacuaaaccuaaauaaaacaauacagcaaaaccccugaaggguagagguucccuccgugcccccgcacucccagggcugacuugcccuccagaggagcucuggucaaagguucuaagcccuaaaacaggagcagcucugauaagcccaaggaggaggaauguggugguggucuggugguagaguggcggggccucuagcagagcgggggaggggucugagaaggauaaaugagucaaaagguuaagaccacagcccgauggcguccucaaaaaggacuuucaguucuaggcccuagaauagaccuggcgaguguuuacaagugcugagcucugcuugcagccccagucucaucaugcugcgcacacauccaucuccgguccuucucaccuucuccaucauccacauugcucaagagaaauuucuuaaguagugggcugcuuucccagaaacacaagcagacucccaagauccuagguucaguuacaugguuccggucacuuucuguaaacucaggagaucugggugcaggaagggagucucuauaucuuuuuuuguuuuguuuuguuuuguuuuguuuguuuuguuuuuuguuuuguuuuguuuuguuuuugagacaggguuucucuguguagcccuggcuguccuggaacucgcuguguagaccaggcuggccccuugaacucagaaaucugcccagcacugggauuaaaggcgugcgccaugacgaccggcaagucucuagauacaucaacacacccaaagauuguagaacacgcaccacgucccuugaagacgaaagaacuccauuucuacauuagcuacauccccagggaacacacuugguucugguccuuauuucuuccaugcuacuuccaaugcugugcucugcccuggguccagcuggguucugagcacugguaaaccaucaguaaaugggaugguacauuuggggcauguagcccaugaccacuccauacgugucaccucuucccgaaccccagucuuuccuaccuucccuuucgaccugugaccucccgaguuacgguggccaacggggugggcgugggcacugaaacugguguucuuauuucacacugacucuguugagagacucuccccacagaacggagcuucccucaauggaaggaguucccccuacauggaggaacuucccccuauggaaaggagcuuugccugcacaaaggagcucucugugcuggaacuugaccgacugaaaggggccucuccguguuacaggcuccagugaccccaggagcuccuggcguuaugaauuccaccugacugcagaugccgcaggucaggcauuaucuuuacauuuccuccccggugccagacgcacacuacgcacacguauugauuggcuuaacaaauauuuacugaauaccgaauccucccucuguuguccuggagccagggcauccuucccccuucucuucccuggccuuggaaugccgaggacauuggcagaggacaguuugcagucccacugagggaucuggcuagugaggcgagccuggcagguuugacuaaauaacacggccucguguuccuguuugcuaccaaauccugacuucagcucuugcucauucuaccagcaaguccagaaguuaucauaacuucuucccugacuacccuuccugccccugcuuauacacccagccagaauucccauggaugaaauccugguuucugcucugccugacuuacggucucugcaugauugagaaauucucacugggcucugaaaugucugucuugcuuaaguuacuuccucuggauugaaaacagggaggacagagcugggguaggcuggcuugggaggcaacuucaaggagacagcgggggaggagaggacaaggcuggaucugggcccggagacacagagcuggugcgggccaggaggggagaagcaagaaagugguguuagugacuaggaaaccgaaaggggaugagaagccaaagagcuagggugcagggguccugggccagcggauagaacggccaguccuccacaguaucaggacaccccgugggagucagaaaggcgaaaggagggaggugccuuucgugugugaacucuggaacaguuccguuuggguguuuuguguaguuuucuuguucggauagaguaccgccguguaacucaggcuggccuggaguggacuaacagucuugcuaccucugccucccauguuggggcugcagggaugagccacgaagcucggcuucugaaguguucuauacacagcaugaggcagagaaaggggaaaggacacacacacccccacaccccuuucaguugaucgcagacacagagggucuucuauuugccugcccucuagaaaaagcaccacccuauuuccuguugagauuuuuaaaacacaucuacucacuccaccucccaaaaagguggagaggagggaagagaagcaaaguuggucaacugggcuuggauggagacuuguuuugcaacccuggugccugcaacagacaguccuuuuucuaggucuuccuagcccaggcaggacgucccaagaaggaaaccccugacaccuguaaaccccuccagacucccccgucucauacagcacaacgcaaaacaacuucguuaaguggcauuuccuuccaggccucuguuugcagugucaccuucccaaagccucauccuccuuagaauggccacauccucaggcaaggaauggggacacgccagagcccuucagcugaggaaaggaaggguggggugagcagacugaaccaucuguccugcucggagcacuuaagggguuaaaugggagggccauuucugggcucugggaauaucaggccuguugacccucuugggauuuaguuucagaacuuuagucuugugugaaucacuuucaaaauauuuaugucuauguguacacaguuuaugguaucauuuauuuacaauuuuauauaccacagaugaaaagcuggucaugguggcuuacaccuacgaucuugacaccuggaaggcugcugauggaagaggacuacugugagcuugaggcuagccugggcuauagaguuuuaaaaaaauuaacuaauuagggauggagaggcgguucagucagcaaaguguuagggcaucggugccagaggacccguguucuauucccaucauccacuuuaaaaagcgagucguugcuagacacgguggcggcacacgccuuuuuaagcagaggcaggcagaucucugugaguuccaggccaaccaaggccauacagcaaaacuuugucucuaaaauauauuuaaaaggugaacccaguagugcauucuuguaauuccaguaccagagaggcagaaacaggaggauacugggguacugcuggucaaccagucuaccucaguuggcaagcuccagguuuagugagaccuuaucucaaaaacuaaggcaagagggcaggggcgaaagaagggaucagugauucagacacuugcuaauuugcaguaacuacacccagagggugguucacagcuaucuaacuccacuucugagggaucugcuacccuuuucuggccuccuugggcacuaggcaugcauagauacauacaugcaggcaaaacauucauacauauguaauaacaauuuaaaaauaaggcagaaggguauggaggaagacaccugauauugacuccuggauuuugcacgaauguguacacacacgccaucuacacacaaguacacacacauaacgugcaccaagaaaacuaauaaugcaaucauaguauaggaaauuucuaaugagacuaucagguaagaacauaaccgcaaagcugaacuuuacaacuggggacucaaggcaggagggagcagaaguugaaggccagccuuggcuguguaacaaguuagaggucaacuugggccgcacaggauccugccuuaaaaauacaaaacaaauccuguuaagagggcuggugaguuggcucaguggggaaacugcuaagccugauucccugaauuaaacccccaggacccaagcagugaagggcucucauauguugucuucugguuuccacaugcgcaccaugauucaugugugcacgaauacacacacacacacaaacacacagagaguaaagaaguuaauaaaauauaaaaaaauuaauaaccuuuagcaacacuuuuuuuaaacuuguacaugcugaaaugaacacuacgucucuggagaagggaugacgcuuaaaaagagagaaaguacuuauuuccuuauuauuuuucuugaguaaggaucuugguguacuuugaugugggcucuagugacuucucuguccucaccuucaaccccaugagucucuuuucccuuuucaguccuggagauggaacacagccugccaugagccacucucccagcucacuccccuuucuuuucuggccucacccguucaggucucccaguucauuaggcagaagagaaggugggucugggcuguagcugaggugggagaagaagacaggcacaccaaucuaggccaguguggccacgcauggggcuauggaauuagcagacugugcugucugagggaggagguaaugggccuuguguggguguguggguggcuggggagcucacagggcucucaggaugccgagcagaccgguccccaugcuucaggacccaugugaacagggcccccuucccagcuuccuuccuucuuuacauuuauuucuguuugcagaggucucucugaggcaggcuucccccaucuccccgcaccagucggauguccucacuggcuccccucuucucagucauaagauacacaccccaaccuucugacaaccuccugacccccuccccacccucuucccuaccgacuuagguauguucccaggggucucacagaggucccagucauggggaagguugggaggaucuggcugcaggauggaaggcagaaggcaguggauuuuuccuucauucuccagagaacuaacuauagaacagcagccccugugcagguauguaaccggggccccuggagcucccugaccccagggaaggccuccuccugaggaaggggauguaccaggggugggggaggguguuacagagacacuuccgacauccucaagccagggcccauaauuaguuugugggaugugagcaaaccaccauccucagggugacagccagacacucuggcgucaggaguggggguggggacgagguagggagggacgggagcuggggcaaauggaacccaaucauuccuccugaaaggauuuucuccaagcaccuuggucgcuuccagauagaguuccuggacucugccccagaggcccagugaaguccugaagccugguaggcaaggcaaaucuguuugccaagggaggggugucgcuacccaagguuacuuccugcuucuuuggggaagaauagccaggccagggcagaaguugagaagguucccagggggcacaucauagccaccuacccgguauacccaugucuggccccgaggcaaggcugccauugcuaacccucuuugcccaagcacgccuguugagugggauggugaacuagaaacacaggcaggguaguugucuccagucucagcacacagggcuccuugagcuaccuaucccaaaggugucuggcaguucucugcugugcgcuccagaaggacagacacccaaucacaggugaaccuuggacacugauaacugcagagcuagagguugaugucugagcaguauccugaggccacagagaggaagauuugcucuguuuuccaccaucgcccucucucccaccccugaaaggacccucaaucaaacugaauccuuuauaaccucaugggaccuuggcuuucuucgagggagccucacaggccuagaagaagagcuuacagaccuacuacaggagcggggaucuagccagccguaggaugccugcuuagcaucugucagcgagcaccaccaaaccaaaccaaaccaaaccaaaccaaaccaaacuaagaaccaaaggcuauaggauccacaguucauugcccucagccucauuagcaaggcaaucuuuaccaccaguuugcacuuuaucagaucuggacagaguaacaacagcccauuacgcaguuuagggaacuaaguugugguggggagcucugguuuacucaaggucagagaucuaugucugagggcuggggacagaucaaccacaggccagaccccucccggcagcccuguguggcuuuucggggaaugugacucggccagcuguugacucugaagcaauuacuguuuguuuguguaacagcacgagaggggaucugcacccagccaugcgugaguccagccugugacacccuuccucacgcuuagacagcaaaguugccucggaagagaagagaagccugcaugggaauggccagcacauccuaaaugcuccaguggcccgugguucgucccuucgucucauugacugccacagacaggaaguaggcucagggacuuggcaccuacccaacagcaggacguccuuucuggccauacuccugaggguaacaaaaucacauggaagcccaaagcaagccaggcucaggcuccucugcccucugcuacuuaacaauguccguccuuccccagccccccugcagaugcuucuguaugggaaagccccucugcaucuaaugacacucugcuuucaaagacgggacagucccuggucucuggagagugaccauucguggccuucucaguugacacuucuccgcugaggcaucccuuagcccugaaccagaaaugaaagagccggcucagagugaaaaggaagaauagccaucaaucugcuccugugugcaaggagcacagaccuggucucagacucugcccgucucccccgcuucccugcccucugagugacucacggugcaggcugagggagauguugaugguaugcucauccacaaagcccuucaggccaggcauccgggcacacuugagcugugucugggcagcacuguccccaacgugcacccagcauacggucucauuggcauaacugaaguccauggccgugguuugucgggugcuggugggugugaugguagacacuugggccccacucagguacguagcuaggauguucugagaguuggcaaucaguagcacuggcggccgaucuacuggcucuggggaugggacagagaaagggcaguugggacuuguaaccguugaggcgacuauucacuggggagccgcauugcagguccccggcucuguggucacuggcagacccacucaccauucuuggccuugcaggagcgguuguccgguugcagcagguagccuucaacacagccacaugugaaggagccaucuguguuggugcaaagcuggcugcaggugccauacacggaacacucgucaaaaucugcccagagagaaaaggaagaggagauguucauucuaguguagcacaggugccccgagacaccagcagacaacuggcggaaucgauuacaguucagaaggugcaaacccacugcccggcaaacaguuuugggauuuucugggucaugcgcacugacagugauuuggaaaacauuucuuggauaacagauggggcagguagagaauacaaugaugaauuugaaaacagagcugcauuacugucuucaugaaacuugcauucuggugauaaacggaagguugguguuaugaugaagggaaagcuuaaguuagaggagaugggauaacagaaaugaaagacugugguacauacaguagcagcagggugcucgccugacacaugcaaggcccuggguuugaucccuagaucugcauuaaaaauaaacgucacgggggcugaugagaugggucagcgguuaagagcaccgacugcucuuccaaagguccugaguucaaauccuagcaaccacaugguggcucacaaccaucuguaacaaaaucugaugcucucuucuagagugucugaagacagcuacaguguacuuacauauaauaaauaaauaaauaaauaaauauuaaaauaaaagucacaggggcugcagagauggcucagugguuaagaacacuuacagcucuuucagaggauuuagguucuguucccggcacccacguggugacucacaaccauguggaauacuaguuucaggagacccaauacccucuucugaccucuuuagccaccaagucuccaugugguaccacacauacauguaggcaaaacacucauauauacaaaaauaaauaaaucuuaaaaaaauacagaagagaccucuagacguauggcucaaugguuuaagaacaccggugcccuugucaaagacccagguucuauucccagugcccacaugguagcucacaaccaucccauaaugcuaguuccaggggauccaacacccuccauggacauuagguauacuuaugguacacaaacauauauauagguaaaacacucguacacgugagagagagagagagagagagagagagacagaccaagacacacauacggagagacagacaagacagagacacacagagagagagacagagagacagagagacagagacagagagagaaaggcagagaaaggcaggucacaagaguaugauuuagagaggucagaguagcugcaucaagaagguagauuugugcagacuuggggccauuuaaaacagaaaaguucgcauugggaacaucuuacucaucaacagggaaauggccaaguaagcuguggucauagauucacgucacagugguuuuuuuuuaaugaaugagauaaaucucuacauacuaccagggauggggggcggggaaaucccuggaacacgcuaaagagaaacacuguaagugauacccacaguguggcaucacuuacggaaagagaacacacacacaagcaauacuuccaauuagauuuuggugggggcggggggggggcgggagaggaggcuugcaguagggcagcacacacaugacuaggaggucugcccuccaggaagaggggaacagcauuggaauugaagaaacuuugcgaaggagcuuuguguuuuuaucuguaaagcgugcgugaucuacuuuuuggagaaaggguuccuucugcagcccagguuggccuggaacucacaggaauccacacaccucagcuuuccaaauaugguaguuacaggugcaagccaugccgucgggcuaauguuucaccguugacagcaaaauucacgugcuagcuacaacuuuuggaggcauguauauuaaggguaggcugaaagcaaugcugagggcuuguagccacacuauguguugacugccucuuggaccacgccauccccuguuguuguccccccccccccccgccccggcccggcccugcuccagcccaccuugcagccagccuccucaugcacacacccuacccacacagucauguuuacgcaccuuugcacgucuugccaucugccugcagcuggaagcugcuguuacaguagcacgugggcccacuggguguagguacacaaugguguugacaacccauucgagaacaguuggcucggagcucugcacgggacaagagagacacucaggccacccugagacagcaacuaccccagacacacagccaccccaggacagcaaccacccuagacucacagccaccccaggacagcagccaccccagacccacagccacuccaggacagcagccaccccaggacagcaaccaccccagacacacagccaccccaggacagcaaccaccucagacucacagccaccccaggacagcaaccaccccagacccacagccacuccaggacagcagccaccccaggacagcaaccaccccagacacacagccacuccaggacagcaaccacuccagacacacagccaccccagacacacagccaccccaggacagcaaccaucccaggacagcaaccaccccagacacacaguuaucccaagacagcaaacccccuccauuuccagucacccuucacaaacugcauugaaguaaaggccauuguaucugagagcgagggggcugaggaagcaagugcaguauaguauuuuugcaaagcccagaaggggccaacacggcagguacagggucacagccaacuguggcuugucacccgccucuuccugccccaacacucaguauaucugugucuacccuaggauggguucugggauccacaggaagggacagugaaucuugucccuuuugugugccuuguguuuguacccaaagggaguuacuacaucagcuccagcugagggugaagaauggacagacacaugguugcuuuugucuucuggccuaaaaguacucuucuaagucagcuuugaguucugggggccucggagggaagacccagaguccagauggaggaugaagagggggaguaaaauggauucuuccuucugccaugacccacuuccacaggggagacagaagggguaagacgggggcagggcagggagagguacgagaacagcccccccaagaccagcgacccaauuaagggcuuguugggucugggcaacuaagccacaaagaccccuuuguccaagugccccauuccuccacacagaagagaacagcucagaagcuaagguguuuaaggcgcuaagccuggcaggaggagcugggguggggaggugggccucgguuacuccuucugcccuucucugaccagaaagcccaaauguaccgccuucgcugucuuuugccaaggaagaaaacauugccugcuguggaaaaucuagaaaagauugguuuggggcuggguggcggggguugggggacuucucuaauauugggggagguucaaagucaaguuuuuguuuguuuguuucuguaacuaaaaagguauuccagaaggaauugaaccugggcacacacuguuggcuaagcuuggucacggggcugaaguuaucccuaaacuuaauuucuguaucucuuuccaggaucuccagaugaaaucagccaaaaagaaaggaggggaaaaaucccccacaaauucccuugcuccacaguccaugccggagugaaaggauccagaugugccgccucccacaggcagauguuuucugacauguguaugacauacgacacuggccgcaccccgacucccaugacugucuuccucaaggucugucagacguugcuugcuccaggcccagagcccagggcagaagaaaagaggcuacuauuucucuaagagcuaggccugaagcuuugucacuacccacaccauggguuccucucaagcugcuacacagcuaagagguaugacuuaucacuaguguucccuccucagacuaaacugccucccccagccaccagcucugagaauguaugggcugccgggaaaggaaggagcagaguggcuuccgggccccucccagauuugcaguucuggagggucacaaacucucccucugugccuauccccagcucugagcacagcaccuccaauccucugucaggagucagauaggaaagcuuuugaaggaguccacaauuaaaaacaaacaguauaaaaaugcugaauaguugagaacggacuugaaaagaggcagugacuuaucuaagcacacacagccagaggaaaguggucagucaggcccacggcugaagcccuuagggcucuuugaucaaucuccaagcccaaagggccgggcaagccugggcaugagaguagaacaaggucucauacacacuaaagcucaaagaugguccucgaucacaaacuggucaucccaccagacacggagccaagagaucuuguauuguuggcacaggagaguauggggagcccuuaccucggcagugagcacccucgucugagccauccaugcaguccuggaucccguugcagagacgagacauggggacacauagcucaguccccagacaacugugcucauuuggcgggcaucucugggcuuuacucuguggaccugggagcaaacagaagugacggcaugaccaggcugccugggguggcugucuagucgucucuguacuggguagauagauuuaauaagccaagauuggcauuucagauagccauacauucuagaucucaagagguuuagggacuggacggacccuucuacauauagcugcucacaagaguagccacgcaucuggggacggcugugcagaggggagagcuagggccuacucccaaaccacgcuuagggaaccuccagccucaacauccuguaaucgggagacaggcagaaggcagaagugaaagauuuugaugagcguuaaggaaacauagucccuggcagaaaggagcucaaaugauaaacaaacacaaaccaccuuuguaugguucucagagagcagagcugggucuacaagugagucaacucauguacacagcaccggccauaugugguucucaaaugcugugagugugcauuaaguuaaaacuacuuauagggguugaagagauggcucagcgguuaagagcacuggcugcucuuccugagguccugaguuugauucccagcaaccacaugguggcucacaaccaucuguaaugggaucugaugcccucuucuggugugucugaagacagcuacaguauacucauauaaauaaaauuaaguaaaucuuuaaaauugcuuauaaaauauauacuaguuuuugauauaucaaaggagggcaaacgaucucuaauaauuucauacagauagcauuaguauauugaaacaauauuuuaggugucuuugguaaaagcacucaaauuaauuuuuuuaguguggcuacuuggaaauuuuagaaccguguaugugacuuauacuauauuucaauucaacaguauuauucuagacuugcaacccagagcaaagaucuacaaaaggaucuggagagguccaaaguuguggccuacugaccacaucccucuuaauuaccaugguaaccagguggagggacgagaggguaagacaauggucccaacaggcaagguaggagagggugugucuguguggguggagcccuacuggcacugcuugugcagggaguggcuugugggcaagggaguuuccauuuugugacccugccuggguuuguguguaccccuguguccacgugucugggcgucugucagaguguuucuuuggccacucuugggagcauccacaugggcuauauaaaccugucagaaccucugucgggucagugggccagauggggcuaugugauucuguuauuugggaauuaucuaagaugagauuuguaggaaacagaaagaagaaugaacaagagugugacccagcccuucuccuugguuuucuguccuuccaucacacaggcagggggucaaccguguggagaggaaguaguuuagccaggaggaggcuacaggucuaauaccccggcuccuacucacccagggcaggacacugggguagggaagaaaacaggagccuucauucccacccuacauguuacccuugauaaccaugguuggagguaugggaaaagggcacagauaggaccagagccagaugaagcccugagcaugcuaagaccuuggccaggauuggccaugugggggagacacuggguggagaccccaggacucuagggucuuggcagcaagucuucuacccuaugaaccauuccccauccuggccacuggaugggugaaggcuggguggggaccuuucucccaguuuaaacagcugccucugauuacaccacuuauugggggcaggggaggggagggugucgggaagggcacagggguggggcuucugguacagggcaguggccuuuggccugggacuaagggcagcaggguaccuggcaagaccuggaggcugcucagugagcaccagccagaggaaaugcucgaaggaaaggguggcgcgguuaucuccccgagacagagaugcagccccagaggauacuguccccaauagucuugggcacguagcagccaaaggagaaaucccaggugcugcugcuacacacaccaggcacccugcaggcacuccggagaagcggcuacacuuuuagcugugucacgggcaaauacaagcacagagcaagguccaugcuaggcuagagauggcugcucuuaucuggagagagcaagcccgggaagguacucacagaucucaggggcuucaucagagccgucggggcaaucucuuucaccgucacaccgccagcccuuugagauacaggugauuuggucucugcaggcaaacugcuuagggcugcaaguuuuaggggcuggaggcaaggaaagaaaggguagaugucaaggaaggacagaagucaacucuuggacccugggguuuccuaaggcucguucuucuccagcauccauccucucuauacaguaggucuggaacacuggaggagccaagaggaucuuaucaccccuucccaaguuuucuagguugucuguacagcaugucccucuaccuccuugcuguuugucaccacaccagacaccagcaccccucacccugccagggaugauggcggggcagggcagagcccucugcugugccuuuccuccauguuccucuuguucccacugacagccagcagcuggccuuuccuaaccucugcuucugaccucaggacacuacuggccucuugaccuauaucacccagcuccuacuccuuaccacuggacccccagaugagaacuggggagcugcccuuggcacacagcguggccuggagauguuaucugcagagggcagcugggcagaaacuucagcuuucgggggaguucucuggauaagaaggauccaucagaggcagggugcuggcuggcuugaucucuaggaacuaacugggaugccccucaccuauggagugauuauauccauagggaccaccugguucuaaucccuuucaucccccagugaggagcuacaccaaagacagcuggcaguccugggagccucagacagugauaaacuagcucuuucugugugccgucuuauuuagucuuccccacaaguugauaugagggaaggcuagcccacaguuucugggccagaccugcccaggauuauaaagugacaaaccaggacuuacucaacccaguucagccaaaucugcauuuguuguuuuguuuuuccuuucuuucuuuuuaaguuuuacguguauggguguuuugccugcacugcugucuggguagcacgcuugccuggugccugaggagagcacagaggcaccggauccccuggaaguggaguuagaaacaggugcgagcugccuuugcauggcgggauuugaacucaggaccucuggaaaagcaagcggugcucuuaaccacugagucaucucuuuagcaccagggcucuagguucuuaaagagugcagcccucaccggggaggcagcccaucuguuccagucaccauguccugcaugggguggggguggggucuuucaauccacaccagagcaggaaucuccucucccagcuucuaucaccuuuucucccgcuggguaaagcccgguucuguuucccugacacagaacuggaggccgguuuugugccaggcacugaacuaggcacugagauggauccaaaggccauggaccccuccagaccuacaguuccuggggagacgacacaguacuaacucaggcugagacaggagaguaagaaaagugugucagggcuccgaaggagggagucugauggccacacugaaaugucccucucucccucauccccagcucuggcagaggggacuguacccaggccccuggccagcaucagagcugaguucaggaaacacaucaaggaaggccuggccaggcccccuuggagucccccucccucccucccacccugauccgggaauaaaggccccuugaggagguggauaaugcugaguucauugccccacugggccagcugugaggucuucccggggaaacagcccugccaaccuaguuagcaugcuggagaccaucgcuuccucuggccagccaggcggccugaggugggagagagggaccacagugggauucagagacagauggggguguuuggaguucagagcggacccccuccccaagauacccaggccaaugacacgucuucccucucccaccuggggcugagcccaugcccugacacucccaguguggcagaacucacagccagggccugaggucaccggcuggucgcucugaccuccucugucuuccgagucccagccauggauccccuccuuuggcccucacaugguucccccacuguccccccccacccccauuuuuggccugaauuugacagaggaaacagcagcuggcaaacuccaaaagcugaaaugagagauucgcaaaccagaugugcucuuguggagggccgugggggaugggcucccucccucccucccagaaaggaagaggagggcucagacccuauccugcaccaucuccuuaggcccaggggcagaggguggacggggguggugguggagggggagguugugggucucucaggagagccaggauagcagaaggaguggagauaagugaaaggacuuccugucggccaugguggagaaagcccuaggaauuuugagugagaaggcugaagccugucuuugauuuccuucagggggagaaggaaaacacauaacauaaccuacuuuggggcagucuccacagccaagugacgcuuccuccaggcugggagggagcugggagggagugggauggaggaggaaauguauaaucucuuuaaaggccaagccaaccuagauguccuuaguggagucuugugcaucugaacuccacacucagaaaaccugucuuugugggucaggaauuggugaccaaccucuggucccugcccauccccucaccgucccccacaccagauggcaaugaacauucuuuaaaagugaccacuaagugccauacacagaucugaagcccugggguccaacugucaggcuacgagaugcuugccaguggcuauccuacagagaacccugagaaagaagagguaggaacaucggucccugucagagggagggcaacagacauuguucagacuggguagccucuggggaggagggcauggaggagugggguaagaaugggacagaggagggcuggggccuaagggagaagcuggagagagggaggagggagagagagcugaaggagcacggggacacaggggcgucuguucucagcuuugccuagagaugugaccgccaugcuaacuuagccaacacccugccccuccccaaccaggcacccagcccagccaaggcccccagggccaccaagcuggagccaggcaggccaggaggugugggguuggguguguauccagacacaacacagaccccacugccuggcucaagccuuggcuaucucuucugucccacucugggaccuugggguagggugguggcaggagccagaaugcuuggcuagggaagggggagaaaguauagucucagacagagacuuuccaaagaagcagugccugcccuucaacaaccccugggagccccaggcauucuuccugaaggacaggagacagaaggcuggaacagcaagaaagugacccugggccacuuggagagugacaggguagagagagggcuaggaacccucuaauaggucuggggacauucuguaagagaaaccgcauggcuaagcuaagagaacaagcagagcuggggacagacugcaggaaucugagcuuucaaauacuugaggagagccaggcagggaaggccuccugcccaacacagagcuuuccccaaauuuuauguauuuuggguguuaccaguggcuccuuccugcucagugagguucagacacauuuuugucauuccugagucugaaacccugcucugcggccugggacagauggacagacaggguggcuuggaccgccaggggaagagaagggucuacccuucaauccugagucaauauugacucagcaggacaucagccugacccacgacccugucucuuccuuucccccacaaauaaaauccagauccacuggaaugccugcggaggucaaccucuuucucccaaggcugaguccguuauuggcccucccccaugcccacauggccugcgcucaccgcucacuggugguaaggaccuaagcuccugaccuguucucuaggucuuuuccauuaggaggaaguucuacuagaagucucaccuccuuuuuuucuuucugaaauaccuccaguccucccuuuuagcccacaacaacaacaucaaaaaaaaaaaaucaauuuuuuuuucauuuuguuguuguuguuccagaaauaugugcccuaaugacacuucccaaaaucagugaggaggguuaggagagaggaaguuggaggggaccaucuggguccaggaagguaagggacaggcaggaaagcccaggagaaauaccacuaccaguagcuuucaagauccaggggacugcacagaagucagacuuagacaaaagaaauuaagacagugacugagaacaaucaaagcugaaaggcugcaaaggguaggaaccaagagggccagagacacagagcagacacacagcaaagcagacagccaaaaaagacaggaagugggcucagggcagagguugcccagagggugacacagcucuccuggggugaacccagaaaaugacccccucucccugugacagaguggagggcaguacauauccuggcuuugggagacaaagucccagcaucagaaacauuuugacuaaugggaguccagguuagaggcugcugucucuaacagagugggagggugucucccccaauccccacacaacacacauggaagucaaacucuucagccagggaagucagggcaugggauugucaucucaugggagugugaugaagaaucccuucucucugccccucagcaccuucugggaggcucugcgcuggugccaugaggucgcagcacgggaaacacuccagagccaacugcuuccuucuccaaacaaugcaggauccugcuaaccaggcugaaaucugggacagaacacaggaggcgggaccagguucccuggcacaagucaccaccaacucugggacccuugcauggucccacucaacagcccagguuccccaaggacaagcaagcucuccugcucagaccuggaucacaggcaggguaaagaauccaaggggcagggaagacccccagaagagaauucagggugugugugagagaauacauuuuugguuugcaauuaagaguaaaauggggauaaggaaggucuuugcaauaguaagcgauggcugguugauuuggguuuuguugguacaggggacagaauccagggccuuaagcaugcuaugugugcccugccaccccgucccccaccgagcugugcccaaccccaggaagggguuugaagaggguaugaguuuggaaaggaucugacuuagggcugggccuggggugacaagguuggaaggcccaguaaaggcaggugauagagaauaauaaaacaaauaaaagcacagagaacaagaaaaagaaaaaagucuugugaaguagcccccaacaucaaaauaauagccccaaugaauuuccuacacgugccuggcuuugaagaagggauguuuaggauuuggaucugaacagggggaauagagaacuggaacguucuccaggaagacaggaggcugacacuucaaccucauaacucacaucaacuguccaccuuuccuagcaacuacuaacaugccggcucacgcuggagaggagagagcuggggaaagaagucagcugucuucccugagcuggcugccugucaaguuccuccaccacgaagugucccaucucagcagggcugucaaugauccuucucugccuuuuccauccuccuuggcuacaaauguauccaaaugugucuaccaggaggaagugaagccucucaccccauaaggcaaaggacucccggaugaguuucagacacagagggaagagaguauggggcggucccuagaguuauuccugagcaacaggaagggcaauuagaacuguuagguaggucgaggcagaaggguccuucucuagaaagccaagacgaauguucagugucuagagggcuuggcuaagagcuccagaaugcacggggucuacuuuucuacagguucucucuuccuccccaggagguaguccuuucucucggacuguauuucuugccagagauggaacagggggcaucccgugcacuaggacaaauacccuaccacugaccuuuaucccagcccugagaaacugugugcagagcugaaaugaacuggagacuuagagguacgcggcuagagacaguuaaggggaacgugucagaguuccucauucaaugaccaccuaucaacuuagcccagcauuuagggucuuggggguucugcuucccaggacccagcacugaaugagccacacaucuccacgggcaucuuucccuucuaccugauuccauccacccuccuccacagggcuucuggcagguccauuucuugcuuaauacauuuucuucccaaagcucuuugccucaguuucccuucuucucccaucccagcucugagaccaagaagaaagcacgggaugacguuagaugugaaggacagaggguggcugcacaggcuugccugacagggcaaagucucuuuccucaucgcaggcagaaaauuagggguggcagcuagacaagacaguccccgacaugacaugacugaaggccacugaguaaacuguuuuccugggcacagcugccuccugacccucuuguccuccucccacaacugaaacaaguuagagacaggggugggggaggauacauaaucuaguuucagagaaaaacuuucccaaucccggccuggcaagcucuugaaggcagaggagggcuguaagaugcuacgaagcuguuguccucagugagaggcaaaccugacaggaagucacaaaaucucaccccuucucaaguuagggacccagcccaauucaaccccaugaccccagcgugaagccugggcaagucuugaacuggggacucauggaagaggaaaaacagcugacagaaauagggacgaggggcaugcaauucccccaaaacaacacagcagcccaaaccuaacuaauauacaaaguguauguaugaagugagacagggcugggcuuuacacauuuacuaaaugagcaggauugggggcauggucauaacccccaucccaaccuccaacucuccuuccaacccaaacugugaucaagccugaaaucggggagacagagcuuccucugaaccccuccccagcguuccagaccauucuccagucucuuccagaaugaugacaucugacguuuuuccucucaucuuaaagcucccaggaauuaagaagggaaagccagccauaagcgucaccagaccccuccaucccucaaccgggcuccugacugaggcccucagcggggagcugcucacuucggaacccaggcaggcagcccaggauucuggacccgggccuccaugccugggaugcagggcucauuccacacccaaacagggggcccugccuauccccacccacagcuuucucggccugccugcccuuuggccagcagggcaccccuagccggcuuugccuuccagccuucagaguccacugcaaaaggcccuccgcccccuuuugcagcgguacacagcaaauccggauuccuucacaauucagaugggggugggggggcgggaggguggaggauguaggggaggcagaggcccucccguaccagagauaggaagagaaggccucuuaaucccaagaucagaaaaagggggagcccucuuuuccuacccaggccucuggucuuugucugagcuggggggcccuggaagcaucauuugucccaggcucccaucccccaaaucagaccccauccccgcccccagucaggccucugcugugucagcuggacugggauaacaaaaggcacccccucccgcgucucccuuccccauccagacgcaggaguggggguuggggagggggagcccccagggguccaugggggccgccggaaucucacucaccauccauaguggccccggagaccagagcugaaagcagcggcagcagcagcagcaacggcggggucagcauggugugggccgaugcaaacagcagcccccacccucugguccuguuacuucuuguccucgccccccccaauuggggggucccccuuuaucuuccucuccccgacucuucuauucuuauccuuuccuuaagcaaagcgaaccaggggcauaggugaaaugguacaguuccgagcccccugggaagggccugcugacgcgggugcgcccccugcccccaaauucgaacccuucaccccugcuuuacuccucgcuccucucccccucccagggcgaagcucacagccccaucucggagccgccucuggcugcaaaaaugcacaauugggaggaggcggggugggggguggggggcguggacccgaugggggugccuugguaggggccugauggagcacuaggggcucccccguuuccgccuccucagugcacuggccuggagcucgcaccgcugcuccccugacugaag

SEQ ID NO: 5802 - RNA, 82997 nt, Mus musculus
cuucagucaggggagcagcggugcgagcuccaggccagugcacugaggaggcggaaacgggggagccccuagugcuccaucaggccccuaccaaggcacccccaucggguccacgccccccaccccccaccccgccuccucccaauugugcauuuuugcagccagaggcggcuccgagauggggcugugagcuucgcccugggagggggagaggagcgaggaguaaagcaggggugaaggguucgaauuugggggcagggggcgcacccgcgucagcaggcccuucccagggggcucggaacuguaccauuucaccuaugccccugguucgcuuugcuuaaggaaaggauaagaauagaagagucggggagaggaagauaaagggggaccccccaauuggggggggcgaggacaagaaguaacaggaccagagggugggggcugcuguuugcaucggcccacaccaugcugaccccgccguugcugcugcugcugccgcugcuuucagcucuggucuccggggccacuauggauggugagugagauuccggcggcccccauggaccccugggggcucccccuccccaacccccacuccugcgucuggauggggaagggagacgcgggagggggugccuuuuguuaucccaguccagcugacacagcagaggccugacugggggcggggauggggucugauuugggggaugggagccugggacaaaugaugcuuccagggccccccagcucagacaaagaccagaggccuggguaggaaaagagggcucccccuuuuucugaucuugggauuaagaggccuucucuuccuaucucugguacgggagggccucugccuccccuacauccuccacccucccgcccccccacccccaucugaauugugaaggaauccggauuugcuguguaccgcugcaaaagggggcggagggccuuuugcaguggacucugaaggcuggaaggcaaagccggcuaggggugcccugcuggccaaagggcaggcaggccgagaaagcuguggguggggauaggcagggcccccuguuuggguguggaaugagcccugcaucccaggcauggaggcccggguccagaauccugggcugccugccuggguuccgaagugagcagcuccccgcugagggccucagucaggagcccgguugagggauggaggggucuggugacgcuuauggcuggcuuucccuucuuaauuccugggagcuuuaagaugagaggaaaaacgucagaugucaucauucuggaagagacuggagaauggucuggaacgcuggggagggguucagaggaagcucugucuccccgauuucaggcuugaucacaguuuggguuggaaggagaguuggagguugggauggggguuaugaccaugcccccaauccugcucauuuaguaaauguguaaagcccagcccugucucacuucauacauacacuuuguauauuaguuagguuugggcugcuguguuguuuugggggaauugcaugccccucgucccuauuucugucagcuguuuuuccucuuccaugaguccccaguucaagacuugcccaggcuucacgcuggggucaugggguugaauugggcugggucccuaacuugagaaggggugagauuuugugacuuccugucagguuugccucucacugaggacaacagcuucguagcaucuuacagcccuccucugccuucaagagcuugccaggccgggauugggaaaguuuuucucugaaacuagauuauguauccucccccaccccugucucuaacuuguuucaguugugggaggaggacaagagggucaggaggcagcugugcccaggaaaacaguuuacucaguggccuucagucaugucaugucggggacugucuugucuagcugccaccccuaauuuucugccugcgaugaggaaagagacuuugcccugucaggcaagccugugcagccacccucuguccuucacaucuaacgucaucccgugcuuucuucuuggucucagagcugggaugggagaagaagggaaacugaggcaaagagcuuugggaagaaaauguauuaagcaagaaauggaccugccagaagcccuguggaggaggguggauggaaucagguagaagggaaagaugcccguggagauguguggcucauucagugcuggguccugggaagcagaacccccaagacccuaaaugcugggcuaaguugauagguggucauugaaugaggaacucugacacguuccccuuaacugucucuagccgcguaccucuaagucuccaguucauuucagcucugcacacaguuucucagggcugggauaaaggucagugguaggguauuuguccuagugcacgggaugcccccuguuccaucucuggcaagaaauacaguccgagagaaaggacuaccuccuggggaggaagagagaaccuguagaaaaguagaccccgugcauucuggagcucuuagccaagcccucuagacacugaacauucgucuuggcuuucuagagaaggacccuucugccucgaccuaccuaacaguucuaauugcccuuccuguugcucaggaauaacucuagggaccgccccauacucucuucccucugugucugaaacucauccgggaguccuuugccuuauggggugagaggcuucacuuccuccugguagacacauuuggauacauuuguagccaaggaggauggaaaaggcagagaaggaucauugacagcccugcugagaugggacacuucgugguggaggaacuugacaggcagccagcucagggaagacagcugacuucuuuccccagcucucuccucuccagcgugagccggcauguuaguaguugcuaggaaagguggacaguugaugugaguuaugagguugaagugucagccuccugucuuccuggagaacguuccaguucucuauucccccuguucagauccaaauccuaaacaucccuucuucaaagccaggcacguguaggaaauucauuggggcuauuauuuugauguugggggcuacuucacaagacuuuuuucuuuuucuuguucucugugcuuuuauuuguuuuauuauucucuaucaccugccuuuacugggccuuccaaccuugucaccccaggcccagcccuaagucagauccuuuccaaacucauacccucuucaaaccccuuccugggguugggcacagcucggugggggacgggguggcagggcacacauagcaugcuuaaggcccuggauucuguccccuguaccaacaaaacccaaaucaaccagccaucgcuuacuauugcaaagaccuuccuuauccccauuuuacucuuaauugcaaaccaaaaauguauucucucacacacacccugaauucucuucugggggucuucccugccccuuggauucuuuacccugccugugauccaggucugagcaggagagcuugcuuguccuuggggaaccugggcuguugagugggaccaugcaagggucccagaguugguggugacuugugccagggaaccuggucccgccuccuguguucugucccagauuucagccugguuagcaggauccugcauuguuuggagaaggaagcaguuggcucuggaguguuucccgugcugcgaccucauggcaccagcgcagagccucccagaaggugcugaggggcagagagaagggauucuucaucacacucccaugagaugacaaucccaugcccugacuucccuggcugaagaguuugacuuccauguguguuguguggggauugggggagacacccucccacucuguuagagacagcagccucuaaccuggacucccauuagucaaaauguuucugaugcugggacuuugucucccaaagccaggauauguacugcccuccacucugucacagggagagggggucauuuucuggguucaccccaggagagcugugucacccucugggcaaccucugcccugagcccacuuccugucuuuuuuggcugucugcuuugcugugugucugcucugugucucuggcccucuugguuccuacccuuugcagccuuucagcuuugauuguucucagucacugucuuaauuucuuuugucuaagucugacuucugugcaguccccuggaucuugaaagcuacugguagugguauuucuccugggcuuuccugccugucccuuaccuuccuggacccagaugguccccuccaacuuccucucuccuaacccuccucacugauuuugggaagugucauuagggcacauauuucuggaacaacaacaacaaaaugaaaaaaaaauugauuuuuuuuuuuugauguuguuguugugggcuaaaagggaggacuggagguauuucagaaagaaaaaaaggaggugagacuucuaguagaacuuccuccuaauggaaaagaccuagagaacaggucaggagcuuagguccuuaccaccagugagcggugagcgcaggccaugugggcaugggggagggccaauaacggacucagccuugggagaaagagguugaccuccgcaggcauuccaguggaucuggauuuuauuugugggggaaaggaagagacagggucgugggucaggcugauguccugcugagucaauauugacucaggauugaaggguagacccuucucuuccccuggcgguccaagccacccugucuguccaucugucccaggccgcagagcaggguuucagacucaggaaugacaaaaaugugucugaaccucacugagcaggaaggagccacugguaacacccaaaauacauaaaauuuggggaaagcucuguguugggcaggaggccuucccugccuggcucuccucaaguauuugaaagcucagauuccugcagucuguccccagcucugcuuguucucuuagcuuagccaugcgguuucucuuacagaauguccccagaccuauuagaggguuccuagcccucucucuacccugucacucuccaaguggcccagggucacuuucuugcuguuccagccuucugucuccuguccuucaggaagaaugccuggggcucccagggguuguugaagggcaggcacugcuucuuuggaaagucucugucugagacuauacuuucucccccuucccuagccaagcauucuggcuccugccaccacccuaccccaaggucccagagugggacagaagagauagccaaggcuugagccaggcaguggggucuguguugugucuggauacacacccaaccccacaccuccuggccugccuggcuccagcuugguggcccugggggccuuggcugggcugggugccugguuggggaggggcaggguguuggcuaaguuagcauggcggucacaucucuaggcaaagcugagaacagacgccccuguguccccgugcuccuucagcucucucucccuccucccucucuccagcuucucccuuaggccccagcccuccucugucccauucuuaccccacuccuccaugcccuccuccccagaggcuacccagucugaacaaugucuguugcccucccucugacagggaccgauguuccuaccucuucuuucucaggguucucuguaggauagccacuggcaagcaucucguagccugacaguuggaccccagggcuucagaucuguguauggcacuuaguggucacuuuuaaagaauguucauugccaucuggugugggggacggugaggggaugggcagggaccagagguuggucaccaauuccugacccacaaagacagguuuucugaguguggaguucagaugcacaagacuccacuaaggacaucuagguuggcuuggccuuuaaagagauuauacauuuccuccuccaucccacucccucccagcucccucccagccuggaggaagcgucacuuggcuguggagacugccccaaaguagguuauguuauguguuuuccuucucccccugaaggaaaucaaagacaggcuucagccuucucacucaaaauuccuagggcuuucuccaccauggccgacaggaaguccuuucacuuaucuccacuccuucugcuauccuggcucuccugagagacccacaaccucccccuccaccaccacccccguccacccucugccccugggccuaaggagauggugcaggauagggucugagcccuccucuuccuuucugggagggagggagggagcccaucccccacggcccuccacaagagcacaucugguuugcgaaucucucauuucagcuuuuggaguuugccagcugcuguuuccucugucaaauucaggccaaaaauggggguggggggggacagugggggaaccaugugagggccaaaggaggggauccauggcugggacucggaagacagaggaggucagagcgaccagccggugaccucaggcccuggcugugaguucugccacacugggagugucagggcaugggcucagccccaggugggagagggaagacgugucauuggccuggguaucuuggggaggggguccgcucugaacuccaaacacccccaucugucucugaaucccacuguggucccucucucccaccucaggccgccuggcuggccagaggaagcgauggucuccagcaugcuaacuagguuggcagggcuguuuccccgggaagaccucacagcuggcccaguggggcaaugaacucagcauuauccaccuccucaaggggccuuuauucccggaucagggugggagggagggagggggacuccaagggggccuggccaggccuuccuugauguguuuccugaacucagcucugaugcuggccaggggccuggguacaguccccucugccagagcuggggaugagggagagagggacauuucaguguggccaucagacucccuccuucggagcccugacacacuuuucuuacucuccugucucagccugaguuaguacugugucgucuccccaggaacuguaggucuggagggguccauggccuuuggauccaucucagugccuaguucagugccuggcacaaaaccggccuccaguucugugucagggaaacagaaccgggcuuuacccagcgggagaaaaggugauagaagcugggagaggagauuccugcucugguguggauugaaagaccccacccccaccccaugcaggacauggugacuggaacagaugggcugccuccccggugagggcugcacucuuuaagaaccuagagcccuggugcuaaagagaugacucagugguuaagagcaccgcuugcuuuuccagagguccugaguucaaaucccgccaugcaaaggcagcucgcaccuguuucuaacuccacuuccaggggauccggugccucugugcucuccucaggcaccaggcaagcgugcuacccagacagcagugcaggcaaaacacccauacacguaaaacuuaaaaagaaagaaaggaaaaacaaaacaacaaaugcagauuuggcugaacuggguugaguaaguccugguuugucacuuuauaauccugggcaggucuggcccagaaacugugggcuagccuucccucauaucaacuuguggggaagacuaaauaagacggcacacagaaagagcuaguuuaucacugucugaggcucccaggacugccagcugucuuugguguagcuccucacugggggaugaaagggauuagaaccagguggucccuauggauauaaucacuccauaggugaggggcaucccaguuaguuccuagagaucaagccagccagcacccugccucugauggauccuucuuauccagagaacucccccgaaagcugaaguuucugcccagcugcccucugcagauaacaucuccaggccacgcugugugccaagggcagcuccccaguucucaucuggggguccagugguaaggaguaggagcugggugauauaggucaagaggccaguaguguccugaggucagaagcagagguuaggaaaggccagcugcuggcugucagugggaacaagaggaacauggaggaaaggcacagcagagggcucugcccugccccgccaucaucccuggcagggugaggggugcuggugucugguguggugacaaacagcaaggagguagagggacaugcuguacagacaaccuagaaaacuugggaaggggugauaagauccucuuggcuccuccaguguuccagaccuacuguauagagaggauggaugcuggagaagaacgagccuuaggaaaccccaggguccaagaguugacuucuguccuuccuugacaucuacccuuucuuuccuugccuccagccccuaaaacuugcagcccuaagcaguuugccugcagagaccaaaucaccuguaucucaaagggcuggcggugugacggugaaagagauugccccgacggcucugaugaagccccugagaucugugaguaccuucccgggcuugcucucuccagauaagagcagccaucucuagccuagcauggaccuugcucugugcuuguauuugcccgugacacagcuaaaaguguagccgcuucuccggagugccugcagggugccugguguguguagcagcagcaccugggauuucuccuuuggcugcuacgugcccaagacuauuggggacaguauccucuggggcugcaucucugucucggggagauaaccgcgccacccuuuccuucgagcauuuccucuggcuggugcucacugagcagccuccaggucuugccagguacccugcugcccuuagucccaggccaaaggccacugcccuguaccagaagccccaccccugugcccuucccgacacccuccccuccccugcccccaauaagugguguaaucagaggcagcuguuuaaacugggagaaagguccccacccagccuucacccauccaguggccaggauggggaaugguucauaggguagaagacuugcugccaagacccuagaguccuggggucuccacccagugucucccccacauggccaauccuggccaaggucuuagcaugcucagggcuucaucuggcucugguccuaucugugcccuuuucccauaccuccaaccaugguuaucaaggguaacauguagggugggaaugaaggcuccuguuuucuucccuaccccaguguccugcccugggugaguaggagccgggguauuagaccuguagccuccuccuggcuaaacuacuuccucuccacacgguugacccccugccugugugauggaaggacagaaaaccaaggagaagggcugggucacacucuuguucauucuucuuucuguuuccuacaaaucucaucuuagauaauucccaaauaacagaaucacauagccccaucuggcccacugacccgacagagguucugacagguuuauauagcccauguggaugcucccaagaguggccaaagaaacacucugacagacgcccagacacguggacacagggguacacacaaacccaggcagggucacaaaauggaaacucccuugcccacaagccacucccugcacaagcagugccaguagggcuccacccacacagacacacccucuccuaccuugccuguugggaccauugucuuacccucucgucccuccaccugguuaccaugguaauuaagagggauguggucaguaggccacaacuuuggaccucuccagauccuuuuguagaucuuugcucuggguugcaagucuagaauaauacuguugaauugaaauauaguauaagucacauacacgguucuaaaauuuccaaguagccacacuaaaaaaauuaauuugagugcuuuuaccaaagacaccuaaaauauuguuucaauauacuaaugcuaucuguaugaaauuauuagagaucguuugcccuccuuugauauaucaaaaacuaguauauauuuuauaagcaauuuuaaagauuuacuuaauuuuauuuauaugaguauacuguagcugucuucagacacaccagaagagggcaucagaucccauuacagaugguugugagccaccaugugguugcugggaaucaaacucaggaccucaggaagagcagccagugcucuuaaccgcugagccaucucuucaaccccuauaaguaguuuuaacuuaaugcacacucacagcauuugagaaccacauauggccggugcuguguacaugaguugacucacuuguagacccagcucugcucucugagaaccauacaaaggugguuuguguuuguuuaucauuugagcuccuuucugccagggacuauguuuccuuaacgcucaucaaaaucuuucacuucugccuucugccugucucccgauuacaggauguugaggcuggagguucccuaagcgugguuugggaguaggcccuagcucuccccucugcacagccguccccagaugcguggcuacucuugugagcagcuauauguagaaggguccguccagucccuaaaccucuugagaucuagaauguauggcuaucugaaaugccaaucuuggcuuauuaaaucuaucuacccaguacagagacgacuagacagccaccccaggcagccuggucaugccgucacuucuguuugcucccagguccacagaguaaagcccagagaugcccgccaaaugagcacaguugucuggggacugagcuauguguccccaugucucgucucugcaacgggauccaggacugcauggauggcucagacgagggugcucacugccgagguaagggcuccccauacucuccugugccaacaauacaagaucucuuggcuccgugucuggugggaugaccaguuugugaucgaggaccaucuuugagcuuuaguguguaugagaccuuguucuacucucaugcccaggcuugcccggcccuuugggcuuggagauugaucaaagagcccuaagggcuucagccgugggccugacugaccacuuuccucuggcugugugugcuuagauaagucacugccucuuuucaaguccguucucaacuauucagcauuuuuauacuguuuguuuuuaauuguggacuccuucaaaagcuuuccuaucugacuccugacagaggauuggaggugcugugcucagagcuggggauaggcacagagggagaguuugugacccuccagaacugcaaaucugggaggggcccggaagccacucugcuccuuccuuucccggcagcccauacauucucagagcugguggcugggggaggcaguuuagucugaggagggaacacuagugauaagucauaccucuuagcuguguagcagcuugagaggaacccaugguguggguagugacaaagcuucaggccuagcucuuagagaaauaguagccucuuuucuucugcccugggcucugggccuggagcaagcaacgucugacagaccuugaggaagacagucaugggagucggggugcggccagugucguaugucauacacaugucagaaaacaucugccugugggaggcggcacaucuggauccuuucacuccggcauggacuguggagcaagggaauuugugggggauuuuuccccuccuuucuuuuuggcugauuucaucuggagauccuggaaagagauacagaaauuaaguuuagggauaacuucagccccgugaccaagcuuagccaacagugugugcccagguucaauuccuucuggaauaccuuuuuaguuacagaaacaaacaaacaaaaacuugacuuugaaccucccccaauauuagagaagucccccaacccccgccacccagccccaaaccaaucuuuucuagauuuuccacagcaggcaauguuuucuuccuuggcaaaagacagcgaaggcgguacauuugggcuuucuggucagagaagggcagaaggaguaaccgaggcccaccuccccaccccagcuccuccugccaggcuuagcgccuuaaacaccuuagcuucugagcuguucucuucuguguggaggaauggggcacuuggacaaaggggucuuuguggcuuaguugcccagacccaacaagcccuuaauugggucgcuggucuugggggggcuguucucguaccucucccugcccugcccccgucuuaccccuucugucuccccuguggaagugggucauggcagaaggaagaauccauuuuacucccccucuucauccuccaucuggacucugggucuucccuccgaggcccccagaacucaaagcugacuuagaagaguacuuuuaggccagaagacaaaagcaaccaugugucuguccauucuucacccucagcuggagcugauguaguaacucccuuuggguacaaacacaaggcacacaaaagggacaagauucacugucccuuccuguggaucccagaacccauccuaggguagacacagauauacugaguguuggggcaggaagaggcgggugacaagccacaguuggcugugacccuguaccugccguguuggccccuucugggcuuugcaaaaauacuauacugcacuugcuuccucagcccccucgcucucagauacaauggccuuuacuucaaugcaguuugugaagggugacuggaaauggaggggguuugcugucuugggauaacugugugucuggggugguugcuguccugggaugguugcuguccugggguggcugugugucugggguggcugugugucuggagugguugcuguccuggaguggcugugugucuggggugguugcuguccugggguggcugcuguccuggaguggcugugggucuggggugguugcuguccugggguggcugugagucugaggugguugcuguccugggguggcugugugucuggggugguugcuguccugggguggcugcuguccuggaguggcugugggucugggguggcugcuguccugggguggcugugagucuagggugguugcuguccugggguggcugugugucugggguaguugcugucucaggguggccugagugucucucuugucccgugcagagcuccgagccaacuguucucgaauggguugucaacaccauuguguaccuacacccagugggcccacgugcuacuguaacagcagcuuccagcugcaggcagauggcaagacgugcaaaggugcguaaacaugacuguguggguagggugugugcaugaggaggcuggcugcaaggugggcuggagcagggccgggccggggcggggggggggggggacaacaacaggggauggcgugguccaagaggcagucaacacauaguguggcuacaagcccucagcauugcuuucagccuacccuuaauauacaugccuccaaaaguuguagcuagcacgugaauuuugcugucaacggugaaacauuagcccgacggcauggcuugcaccuguaacuaccauauuuggaaagcugagguguguggauuccugugaguuccaggccaaccugggcugcagaaggaacccuuucuccaaaaaguagaucacgcacgcuuuacagauaaaaacacaaagcuccuucgcaaaguuucuucaauuccaaugcuguuccccucuuccuggagggcagaccuccuagucaugugugugcugcccuacugcaagccuccucucccgccccccccccgcccccaccaaaaucuaauuggaaguauugcuuguguguguguucucuuuccguaagugaugccacacuguggguaucacuuacaguguuucucuuuagcguguuccagggauuuccccgccccccaucccugguaguauguagagauuuaucucauucauuaaaaaaaaaccacugugacgugaaucuaugaccacagcuuacuuggccauuucccuguugaugaguaagauguucccaaugcgaacuuuucuguuuuaaauggccccaagucugcacaaaucuaccuucuugaugcagcuacucugaccucucuaaaucauacucuugugaccugccuuucucugccuuucucucucugucucugucucucugucucucugucucucucucugugugucucugucuugucugucucuccguaugugugucuuggucugucucucucucucucucucucucucucucacguguacgaguguuuuaccuauauauauguuuguguaccauaaguauaccuaauguccauggaggguguuggauccccuggaacuagcauuaugggaugguugugagcuaccaugugggcacugggaauagaaccugggucuuugacaagggcaccgguguucuuaaaccauugagccauacgucuagaggucucuucuguauuuuuuuaagauuuauuuauuuuuguauauaugaguguuuugccuacauguaugugugguaccacauggagacuugguggcuaaagaggucagaagaggguauugggucuccugaaacuaguauuccacaugguugugagucaccacgugggugccgggaacagaaccuaaauccucugaaagagcuguaaguguucuuaaccacugagccaucucugcagccccugugacuuuuauuuuaauauuuauuuauuuauuuauuuauuauauguaaguacacuguagcugucuucagacacucuagaagagagcaucagauuuuguuacagaugguugugagccaccaugugguugcuaggauuugaacucaggaccuuuggaagagcagucggugcucuuaaccgcugacccaucucaucagcccccgugacguuuauuuuuaaugcagaucuagggaucaaacccagggccuugcaugugucaggcgagcacccugcugcuacuguauguaccacagucuuucauuucuguuaucccaucuccucuaacuuaagcuuucccuucaucauaacaccaaccuuccguuuaucaccagaaugcaaguuucaugaagacaguaaugcagcucuguuuucaaauucaucauuguauucucuaccugccccaucuguuauccaagaaauguuuuccaaaucacugucagugcgcaugacccagaaaaucccaaaacuguuugccgggcaguggguuugcaccuucugaacuguaaucgauuccgccaguugucugcuggugucucggggcaccugugcuacacuagaaugaacaucuccucuuccuuuucucucugggcagauuuugacgaguguuccguguauggcaccugcagccagcuuugcaccaacacagauggcuccuucacauguggcuguguugaaggcuaccugcugcaaccggacaaccgcuccugcaaggccaagaauggugagugggucugccagugaccacagagccggggaccugcaaugcggcuccccagugaauagucgccucaacgguuacaagucccaacugcccuuucucugucccauccccagagccaguagaucggccgccagugcuacugauugccaacucucagaacauccuagcuacguaccugaguggggcccaagugucuaccaucacacccaccagcacccgacaaaccacggccauggacuucaguuaugccaaugagaccguaugcugggugcacguuggggacagugcugcccagacacagcucaagugugcccggaugccuggccugaagggcuuuguggaugagcauaccaucaacaucucccucagccugcaccgugagucacucagagggcagggaagcgggggagacgggcagagucugagaccaggucugugcuccuugcacacaggagcagauugauggcuauucuuccuuuucacucugagccggcucuuucauuucugguucagggcuaagggaugccucagcggagaagugucaacugagaaggccacgaauggucacucuccagagaccagggacugucccgucuuugaaagcagagugucauuagaugcagaggggcuuucccauacagaagcaucugcaggggggcuggggaaggacggacauuguuaaguagcagagggcagaggagccugagccuggcuugcuuugggcuuccaugugauuuuguuacccucaggaguauggccagaaaggacguccugcuguuggguaggugccaagucccugagccuacuuccugucuguggcagucaaugagacgaagggacgaaccacgggccacuggagcauuuaggaugugcuggccauucccaugcaggcuucucuucucuuccgaggcaacuuugcugucuaagcgugaggaagggugucacaggcuggacucacgcauggcugggugcagauccccucucgugcuguuacacaaacaaacaguaauugcuucagagucaacagcuggccgagucacauuccccgaaaagccacacagggcugccgggaggggucuggccugugguugaucuguccccagcccucagacauagaucucugaccuugaguaaaccagagcuccccaccacaacuuaguucccuaaacugcguaaugggcuguuguuacucuguccagaucugauaaagugcaaacuggugguaaagauugccuugcuaaugaggcugagggcaaugaacuguggauccuauagccuuugguucuuaguuugguuugguuugguuugguuugguuugguuugguggugcucgcugacagaugcuaagcaggcauccuacggcuggcuagauccccgcuccuguaguaggucuguaagcucuucuucuaggccugugaggcucccucgaagaaagccaaggucccaugagguuauaaaggauucaguuugauugaggguccuuucaggggugggagagagggcgaugguggaaaacagagcaaaucuuccucucuguggccucaggauacugcucagacaucaaccucuagcucugcaguuaucaguguccaagguucaccugugauugggugucuguccuucuggagcgcacagcagagaacugccagacaccuuugggauagguagcucaaggagcccugugugcugagacuggagacaacuacccugccuguguuucuaguucaccaucccacucaacaggcgugcuugggcaaagaggguuagcaauggcagccuugccucggggccagacauggguauaccggguagguggcuaugaugugcccccugggaaccuucucaacuucugcccuggccuggcuauucuuccccaaagaagcaggaaguaaccuuggguagcgacaccccucccuuggcaaacagauuugccuugccuaccaggcuucaggacuucacugggccucuggggcagaguccaggaacucuaucuggaagcgaccaaggugcuuggagaaaauccuuucaggaggaaugauuggguuccauuugccccagcucccgucccucccuaccucguccccacccccacuccugacgccagagugucuggcugucacccugaggauggugguuugcucacaucccacaaacuaauuaugggcccuggcuugaggaugucggaagugucucuguaacacccucccccaccccugguacauccccuuccucaggaggaggccuucccuggggucagggagcuccaggggccccgguuacauaccugcacaggggcugcuguucuauaguuaguucucuggagaaugaaggaaaaauccacugccuucugccuuccauccugcagccagauccucccaaccuuccccaugacugggaccucugugagaccccugggaacauaccuaagucgguagggaagaggguggggagggggucaggagguugucagaagguugggguguguaucuuaugacugagaagaggggagccagugaggacauccgacuggugcggggagaugggggaagccugccucagagagaccucugcaaacagaaauaaauguaaagaaggaaggaagcugggaagggggcccuguucacauggguccugaagcauggggaccggucugcucggcauccugagagcccugugagcuccccagccacccacacacccacacaaggcccauuaccuccucccucagacagcacagucugcuaauuccauagccccaugcguggccacacuggccuagauuggugugccugucuucuucucccaccucagcuacagcccagacccaccuucucuucugccuaaugaacugggagaccugaacgggugaggccagaaaagaaaggggagugagcugggagaguggcucauggcaggcuguguuccaucuccaggacugaaaagggaaaagagacucaugggguugaaggugaggacagagaagucacuagagcccacaucaaaguacaccaagauccuuacucaagaaaaauaauaaggaaauaaguacuuucucucuuuuuaagcgucaucccuucuccagagacguaguguucauuucagcauguacaaguuuaaaaaaaguguugcuaaagguuauuaauuuuuuuauauuuuauuaacuucuuuacucucuguguguuuguguguguguguguauucgugcacacaugaaucauggugcgcauguggaaaccagaagacaacauaugagagcccuucacugcuuggguccuggggguuuaauucagggaaucaggcuuagcaguuuccccacugagccaacucaccagcccucuuaacaggauuuguuuuguauuuuuaaggcaggauccugugcggcccaaguugaccucuaacuuguuacacagccaaggcuggccuucaacuucugcucccuccugccuugaguccccaguuguaaaguucagcuuugcgguuauguucuuaccugauagucucauuagaaauuuccuauacuaugauugcauuauuaguuuucuuggugcacguuauguguguguacuuguguguagauggcguguguguacacauucgugcaaaauccaggagucaauaucaggugucuuccuccauacccuucugccuuauuuuuaaauuguuauuacauauguaugaauguuuugccugcauguauguaucuaugcaugccuagugcccaaggaggccagaaaaggguagcagaucccucagaaguggaguuagauagcugugaaccacccucuggguguaguuacugcaaauuagcaagugucugaaucacugaucccuucuuucgccccugcccucuugccuuaguuuuugagauaaggucucacuaaaccuggagcuugccaacugagguagacugguugaccagcaguaccccaguauccuccuguuucugccucucugguacuggaauuacaagaaugcacuacuggguucaccuuuuaaauauauuuuagagacaaaguuuugcuguauggccuugguuggccuggaacucacagagaucugccugccucugcuuaaaaaggcgugugccgccaccgugucuagcaacgacucgcuuuuuaaaguggaugaugggaauagaacacggguccucuggcaccgaugcccuaacacuuugcugacugaaccgccucuccaucccuaauuaguuaauuuuuuuaaaacucuauagcccaggcuagccucaagcucacaguaguccucuuccaucagcagccuuccaggugucaagaucguagguguaagccaccaugaccagcuuuucaucugugguauauaaaauuguaaauaaaugauaccauaaacuguguacacauagacauaaauauuuugaaagugauucacacaagacuaaaguucugaaacuaaaucccaagagggucaacaggccugauauucccagagcccagaaauggcccucccauuuaaccccuuaagugcuccgagcaggacagaugguucagucugcucaccccacccuuccuuuccucagcugaagggcucuggcguguccccauuccuugccugaggauguggccauucuaaggaggaugaggcuuugggaaggugacacugcaaacagaggccuggaaggaaaugccacuuaacgaaguuguuuugcguugugcuguaugagacgggggagucuggagggguuuacaggugucagggguuuccuucuugggacguccugccugggcuaggaagaccuagaaaaaggacugucuguugcaggcaccaggguugcaaaacaagucuccauccaagcccaguugaccaacuuugcuucucuucccuccucuccaccuuuuugggagguggagugaguagauguguuuuaaaaaucucaacaggaaauaggguggugcuuuuucuagagggcaggcaaauagaagacccucugugucugcgaucaacugaaagggguguggggguguguguguccuuuccccuuucucugccucaugcuguguauagaacacuucagaagccgagcuucguggcucaucccugcagccccaacaugggaggcagagguagcaagacuguuaguccacuccaggccagccugaguuacacggcgguacucuauccgaacaagaaaacuacacaaaacacccaaacggaacuguuccagaguucacacacgaaaggcaccucccuccuuucgccuuucugacucccacgggguguccugauacuguggaggacuggccguucuauccgcuggcccaggaccccugcacccuagcucuuuggcuucucauccccuuucgguuuccuagucacuaacaccacuuucuugcuucuccccuccuggcccgcaccagcucugugucuccgggcccagauccagccuuguccucuccucccccgcugucuccuugaaguugccucccaagccagccuaccccagcucuguccucccuguuuucaauccagaggaaguaacuuaagcaagacagacauuucagagcccagugagaauuucucaaucaugcagagaccguaagucaggcagagcagaaaccaggauuucauccaugggaauucuggcuggguguauaagcaggggcaggaaggguagucagggaagaaguuaugauaacuucuggacuugcugguagaaugagcaagagcugaagucaggauuugguagcaaacaggaacacgaggccguguuauuuagucaaaccugccaggcucgccucacuagccagaucccucagugggacugcaaacuguccucugccaauguccucggcauuccaaggccagggaagagaagggggaaggaugcccuggcuccaggacaacagagggaggauucgguauucaguaaauauuuguuaagccaaucaauacgugugcguagugugcgucuggcaccggggaggaaauguaaagauaaugccugaccugcggcaucugcagucagguggaauucauaacgccaggagcuccuggggucacuggagccuguaacacggagaggccccuuucagucggucaaguuccagcacagagagcuccuuugugcaggcaaagcuccuuuccauagggggaaguuccuccauguagggggaacuccuuccauugagggaagcuccguucuguggggagagucucucaacagagucagugugaaauaagaacaccaguuucagugcccacgcccaccccguuggccaccguaacucgggaggucacaggucgaaagggaagguaggaaagacugggguucgggaagaggugacacguauggaguggucaugggcuacaugccccaaauguaccaucccauuuacugaugguuuaccagugcucagaacccagcuggacccagggcagagcacagcauuggaaguagcauggaagaaauaaggaccagaaccaaguguguucccuggggauguagcuaauguagaaauggaguucuuucgucuucaagggacguggugcguguucuacaaucuuuggguguguugauguaucuagagacuugccggucgucauggcgcacgccuuuaaucccagugcugggcagauuucugaguucaaggggccagccuggucuacacagcgaguuccaggacagccagggcuacacagagaaacccugucucaaaaacaaaacaaaacaaaacaaaaaacaaaacaaacaaaacaaaacaaaacaaaacaaaaaaagauauagagacucccuuccugcacccagaucuccugaguuuacagaaagugaccggaaccauguaacugaaccuaggaucuugggagucugcuuguguuucugggaaagcagcccacuacuuaagaaauuucucuugagcaauguggaugauggagaaggugagaaggaccggagauggaugugugcgcagcaugaugagacuggggcugcaagcagagcucagcacuuguaaacacucgccaggucuauucuagggccuagaacugaaaguccuuuuugaggacgccaucgggcuguggucuuaaccuuuugacucauuuauccuucucagaccccucccccgcucugcuagaggccccgccacucuaccaccagaccaccaccacauuccuccuccuugggcuuaucagagcugcuccuguuuuagggcuuagaaccuuugaccagagcuccucuggagggcaagucagcccugggagugcgggggcacggagggaaccucuacccuucagggguuuugcuguauuguuuuauuuagguuuaguuugguugggcggauguauuuuguuuguuguuuguuugauuuagauauguuuguucauuuuaaaaucaugugccuauacacgcaccugugugaguuuaugugcaucgugugugugcagaugccauggagcuggagguacaugcaauugugagccaccugauguaggugccaagagcuacacccagguccccuggaagagcagcagguguucuuaacuacugagccaucucuccagccucgagacaaaaauucaagucaccccagcuggccuugaaacucacuguguguagucaagguuggccuuaaacuccugacccucuucccccaccucuuaagugcuggcguuacauauaaaucuugucaucaggcccagcuuuccagucaugccaguuaugcccauagccagucuagguuuguggagcaggaauaugcaguuccuguaggcaaaagcccagggcuccaccugaaccccaggcuauaagaccaaggcccguaucucagagacugauaggcaauggugaacgauaucccuucucaguauguccaagucucucaacacagcuuuauagaguaguggccugugguuggggaugggguguggggaggaacagaggaagcugaacuuuaggagagaggaaaauaaugugguggagugggcuuggauaacaaaggaguuuugcuugagacuaauaaucuccagcugcaaaaauaccaaaggggaggccaggcuggcuagggacgucauuucuugccaauuccuuacagucaggucugcugaaugggacccugccuggucuuuggggaggugaggggagcccagccaagggcagacacaugagaacagggacugucacugcccugcuuucccagaagugggagggaacgcaagccaggagagaggcucccacucagguuccccccaucuugaggcuuggccugagaauggagcagcaucuggaagcagggcaccagcucucugcaggcuucuuccucuuucccucuugccaaggguggaugggugagcagggccaggguguugccaguccuagggcugggcagugacucagggaagccugaggaaguuggagagaaagccauuugugccagcuggugcuaaggaaaacagauuugacggaugauuuuugcacacaugccaguggccccccagacccccgcagcgcccaccaaguaaagggcacagagcccuguugauuucggcugcccugcuagcugcccggggccacaggaaggucccuacuuugggacuucaguuuccuuuggagguggcccaguggguuucauuuuaaucugguuucucuauggugacucgugugugugugugugugugugugugugugugugugugugugugugugagagagagagagagagagagagagcacuugcauugagcuuucugccucuaugacccuuguccucuucaugcuucccugccugccccccaaaauggaacagucuugggaacccagaggacagaguagcuggguuugggaaugugucagcacuuguagggguaauaccucaucccuaugaccucuuucuccaguugucucagggugggguuuaccagaggggaccugaagaggaagccauuuaugugagccuucagugacuacuucccccgcucgcuccucuguccucaguccugugacucugagucagucgucccagccagccaacuucccuggaugacauguuccuauucccugcacccccucccacuauuaagaaacagcuccuggaucccuguggggaggaagggggguuagggagggguugagcagaguucaucauuauaccuguagcuguguggcagagucaucccuacagggcugaguccugauagugugggccgagcuucagccagaggcaggcaguaaaaagacggcuggcuaccugcuguugaaacagugcagauaaaagucucugccuuaggaacguucaggucugcaaguggcauuucuucugagaguguauuugaaaggggccagcggggggugcauggaagccugggcuguguugggaaggcugccaacaguuguccuuauccccagacuuccaacaguccuuggcuuacccuccuccuguggcccuucauggcuuagaaugacugugguagcugccauguaccaucagaaguuccucuuucucugucuccugguuuaucuccaggguccuauuuucgccuccucuuggacucucuguacuucaguucucauuccuucugugcuuccucggggugugagggaauuaaguacuaacauggaagaaacggggacgugaaggcaagaagaaggaguuuggcucaugugacugauuccccagccucggggccaccagucuugggucaugcuguaugaacuucauauuuugaaauacuuuucucccaagcugaguucauuuaugaacauucuacuucccaguaauuuuuuuucuuuaaauuuaugcaacaugcacagcuuccagccgguacuucuuguuaguaugaaauaauuagacuuaccauguagagcgaauauaaaucaggcccaaaccaaagauaaugugccguuuugguuaguuaggacacccuuuucucaagagaaagcagguuaaagagaaaauaucagggugaguugguaggccugaccuccugccucuuggcacuacaagauagcacuuuccugaugaaaacuggauuagaaucggaagauccugucagucagucagucagucagucagucagucagccagccaauauuuaccuagucccuccugcuuaugacaauccugagccuaggaugggggcuggggcaggggguugagucuauuuggagacuucuauuuggagagaccagauacuuggaaacauaaagaaugucaaagugugacuguauccgcugcgaacacccacaagagcuccggggaagguggcugcagcuggcuguggcugaggaggguuaggucgcagagaaggcaagcucaccagaggaacggaugccugugggugggccugucccacauagcucucuccuuccuuuuccagacguggagcagauggcaaucgacuggcugacgggaaacuucuacuuugucgacgacauugacgacaggaucuuugucuguaaccgaaacggggacaccugugucacucugcuggaccuggaacucuacaaccccaaaggcaucgccuuggaccccgccaugggguaagagugucgggcuggcauucucacucucgaaagaggaggcagaagcuguagugggaagugugugggggauccuggucccugcgccccauuuaucaugugugcacccacaggaagguguucuucacugacuacgggcagaucccaaagguggagcgcugugacauggauggacagaaccgcaccaagcugguggauagcaagaucguguuuccacacggcaucacccuggaccuggucagccgccucgucuacugggcggacgccuaccuagacuacaucgaggugguagacuacgaagggaagggucggcagaccaucauccaaggcauccuggugagggggcugcuuugucugagguuauucugaggagaccaaccaccagagccuccugcugacggggaguccuuugggggacuugaucucuagggcucccagugaguguggaaagagcagaguuaaccagcccaugucuucuggaggggccagcaggaaugugucagagaggaaggcuauggcuucccauucugaugggagcagucauuuaaagacaccccuuuuacuucccuuuuucuuauuugaggcuuaaaauaaccccugggagaugagcaggcaguugacaaaagcgggguucaaagauguuugguaauuugccagagguuacacaacugggaacaacgcucgaacccagccaggagguccugcugcucagugcagaccguccacuccggaguagcuugcgugugcagccaugcccggggcuuugaguggaacucuuccaguccuaaccuugaaaaaucucacagcagacuccuuaucuugggcaaauggaaacagcuggccccuguaggcuuccuugggacacgagagaacccucagucuccagaaaagcugcagucaaguugagcauucucuggggagggagguuagggcccgaguuuaacucaucugcaaauucucaaagggucugcaaggagcuuaauucugcgagggacauuguuuuuucuuguccucggugguaggaugguccagugaucagcacaucugguguguuagauagcagugucaccacagaggcagaguauagaaaggaauagcaucucuuugaaaacuccaguucuuuacuuugugaaggacgaauaggagauggacaaacagaaauuuccagaacacacaaguuuagcaucagguuaaacaaaacuagcggggaaaguucggacguaggugaugggagucuggguggcaggcggaggccgaugggggaugaagggagcagccuuuucaucuuguugaccgacgcugccugccgucucagaucgagcaccuguacggccugaccguguuugagaacuaucucuacgccaccaacucggacaaugccaacacgcagcagaagacgagcgugauccgagugaaccgguucaacaguacugaguaccaggucgucacccguguggacaaggguggugcccugcauaucuaccaccagcgacgccagccccgagguaagcggucaacagggcaccuccacagucggcuucaccccaacagcacugucugcucuucugcauaucucuuucaaauugagaguguuucuaggcaccuuccccaagcuacuucuccucgccucuccacgaccggaaucccuuaugccuggguuguggcaaggcggugaauacuaguucugggcuucaaaguccuaaaaugggacaagagcaaagagcaccccccaucugacccgagcagagcccccugaagggugcugacagcucucuccucugcccccagugcggagucacgccugugagaaugaccaguacgggaagccagguggcugcuccgacaucugccuccuggccaacagucacaaggcaaggaccugcaggugcaggucuggcuucagccugggaagugaugggaagucuuguaagagugaguaucagggagaguugggccugcuggggguagggguggguccacagacauuccccuguaacccgcugccucugccuagaugcagagaaacgaagggcagagacauaaggggcccacacccaagagcagcgauauaucuagcacacgaucacucauucugcgaguguucagcaaacacacacuggguguuugacaccguucgggcagugaaggguguggggggacagaggaguugucaggacagucggaggaugugauaucuaagccaagcucucugcugaugaagugaggcggccaaccgugugacugcugagagaucauuuauggaggagugaacuuacgguucaaaggcccugaggccaguguaggguguggucugccgagacgcuggguaaggugucguggugugaguaaagggaaaugaagggaauuucucacugggaugaggagcuuaugaccacuguggaaagaagaugagugauugggugcguccuguguacgcuuauacugugcugggcaggagggaagaagccagguggcuauuuccauggugugggucagagugacaugguuuagguuaagauggugacagacugguagaaugaccagauaccaacgugcucugaaagcacuccgauuuccaugaaaaguugcuugagucaaauccccaugacacagcggcucuaggacuagaguggagcauguuaucuugugucuucugggagugacucauagcccugucugcuccagaucuccugacccagcccagccaacgcacuauagcaccucagacccagauuucaauuuggguggugaccaugugugcgugugaaugugcgcauacaugugugugcauuguguguaugcgugugugucuguauccaugugugugugugugagugcaugugugucuguguguauaugcauguguaucuguguguguguguguguguguguguaagcgagugcauguguaucucuguguguaugugagagcaagugcaugugugucugugugucugcaugugugugugugcgcgcgcacgugugcgaguucauguguguaugugugugugcauguguguaugugagcgagugcaugugugucuguguguauaugcauguaugucuguguguguaugcaugugugugugugugugcgcaaguucaugugugucuguguaacuuugugcccuuuguacuugcccuagaaccugaacaugagcuguuccucguguauggcaagggccgaccaggcaucauuagaggcauggacaugggggccaaggucccagaugagcacaugauccccaucgagaaccuuaugaauccacgcgcucuggacuuccacgccgagaccggcuucaucuacuuugcugacaccaccagcuaccucauuggccgccagaaaauugauggcacggagagagagacuauccugaaggauggugagggcgucagaggugggcggugugugggaagagcuccugggggaugaggcgccugagacaggaagacaucagaggcuuagauugcucccucacaguaugaagaguccuugcugacaagcuggcugggcugguuggcauggagaugaggggauagacagguugaccccugugugacccccuucuuggcugagccaaaaagagucggaggauggauggauguguuaggcagugagggcugccuuggccagcccuugggaaaauucagggucucgccgccauuggcucagagcccuggagcuguguacagcauacagccaggagaggccauaggcccugaaucacagccgggccugccaugucagacagggcucauccacaaguguaaaugcucagaauguaugcagcuggaucucauggccacggauaucucuaccucucuguggccugagaacucugugucugucucucccucugaccuacuuuggcagggccacugugcaguggagccguuccccuugagggcuucugagcuguguguguuuuauaccucagaucuguuuuugggggccccaagaucugguuccuuaaccagucaaucuggcuugcuccccacccucugugcagcucagagaaccucagcagucagcaaucauaagacuguguggaaaucaagaaugacuccugucaggaagacacuggggaccccuguacaggggaacugcuauuuaagggacacuagauaaagccuuuggcuaagggaaaauucacuuccuaauuuacucauuuuugugaguacagguuuuuuaggcccaggaugguggcgucauacuggagcaaagagccagugcauaucgccccggcuguccaccuaagcacaggcccagacaugcccucaucugagagcuccccuuagucacguaguuuccuggcugccucaugcuguuuuucaaaauguagauguggcaucguagaugcaguguagauguggcaucugaaagggucgucuccauccccacccccaccucugccccacccucccucccccaucugcccaccauucagggcaccacaugccuccugcucccccugccuggccaccaucucucucugugucauguguccuucaagggucacccccaugcgcucucuacacccucacaggcauccacaauguggagggcguagccguggacuggaugggagacaaucuuuacuggacugaugauggccccaagaagaccauuaguguggccaggcuggagaaagccgcucagacccggaagacucuaauugagggcaagaugacacaccccagggccauuguaguggauccacucaaugggugagucugucccugggcgugggguggaugcauguacaucucagaggacuggggagggaagcggcaaagccaggggcguggcugaggcaggcaggcugcagaggcaggaacgggagccugaaaaaggagccugaaaagagagcguguguuuguccgucugucuugaggagggaaaacaaaacccugguacgcaaccggaagucugcuucugccgcuccacuacagagcucucuccugguuccccuuggcuccaagccgcccuagccuuugggucugcacaguucuugcuugccaacaucugcaccugccuuccuucccucacccaccacuuccugucccauccuuugcugucuggaacucccggauaccucacauuugguuucuugucagcguugggucucagagaagccccccaccccaucccuguucacccaaacuugcugccuagauucucuccgccacucacauuuaauuuuccuccugauuuuaucacuccgacacgacuuucuugaacaacuuguuucuccugggauguucgcuccuaagagauggggaaccuugguuuugcugcauccugggaugccagagccaugcuccaauuagaguagccauucaugguggccugaguugcugugaugugggguuuagagagaaauagcucagagagaccccugggaggaacucuggauaccaccuagauaccaccuagugccuagaaucacaacagaagcuguugugacaagggugaccauguggugcugaccagucacugcccacagguggauguacuggacagacugggaggaggaccccaaggacagucggcgagggcggcucgagagggcuuggauggacggcucacaccgagauaucuuugucaccuccaagacagugcuuuggcccaaugggcuaagccuggauaucccagccggacgccucuacuggguggaugccuucuaugaccgaauugagaccauacugcucaauggcacagaccggaaggugggcaggcaugugugcauuguuuaacccuguuucuauggaaacuccaugaggauguacaugucuguguguguagggcuucgugcuucuuacaggucuacacauggcuacucuaugaauguauguuuucauguuguguauauugucuucuuugaggaugucuaucugcauauggcugcccacaagcacaccugugugugcacuucugugcgugugcacauacauacauauaacacacuucaggguagucacgcagcaacauguaaggugcuaagggguagcauauaugcauauuuguucacuccguugguucaugaguuguguuugccuuuagguauaugggccaaacugucuuggugugucaggcccuucacaauaaagcucugggcaccucuaccaucuugugucuccuacuccccacaacucaacacucuaugaacaagcugcacuagacagcuuguuauuccagaacaucauaggccucugcucccuaagccuuggcuuccugggagucccccuaguucuucuuggcucucuuucucuugaagauuguguccaggucccucuucccacagauuaccuacauaugcccuccauaggacaauggugcucuuaguacccaucacagcucagcccauaauaaaucccaauaaauguugcuuagguagagaaauaaauggcugaauguugguguaugugugugcgcaagugcacauguguguucauacaugugugugugugugugugugugugugagagagagagagagagagagagagagagagaaacacauaaaugacauauugaacagccuuaugagagguccguauggacaguguccuuucugagucaccugauggagccagcaccaccagggccccuaguugucccuugggaaucucuauuugcccuccucuccucagaaacaucaccuccauuccuagauuguauaugaggguccugaacugaaucaugccuucggccugugucaccauggcaacuaccucuuuuggaccgaguaccggagcggcagcgucuaccgcuuggaacggggcguggcaggcgcaccgcccacugugacccuucugcgcagcgagagaccgccuaucuuugagauccgaauguacgacgcgcagcagcagcaaggugcuccuuuaugggcuggggauggcggguggguagggugggaccccuggcuuuaaugucaaagacuucccagaagccucuguuccccauucacuuccauucccucucuuucaacgcaaccuuccuuucccgacuuccucuuuggucuccucacuuuguguauuuuuccuuuccugacccugccuccccauccuuuuccugcccucuccugcaguggguaccaacaaaugccggguaaauaacggaggcugcagcagccugugccucgccacccccgggagccgccagugugccugugccgaggaccagguguuggacacagauggugucaccugcuuggguaugaggggccuggcuugcacaagggugggaagguagcuccagcagaagaauggcagagggcaggggaguucucuguguuuccaguagagauuaaggaagcaaagagggggcccugagaugcugacaggaagcaagggauaggguucagagaaggcucuggggcuaaaggaggauugggggugggguaguucugagggcacgaagauggggcaagugaaugaggaacgagacagcgaguaagaaaggaacuauucuuaacucauuuuagcuuuggcuaucauuacaguaaaauaacaguauuucagaacacuauaggcuggaacuacuccuuaacagcagcacucaggaggcagaggcagguggaugucagugaacguaaggccagaauggucugccuggagaauuccaggucaacccgagcugcagaauaagacccugucaaaaaaaaaaaaaaaaaaaaaaucaaaaguaaaacuggaaaaauucuguaaauuagccggguaagguauacaugccuagagucccugcacuguggaggcugaagcagggggauuauaaguuccaguccagcauggauauucuagcucaaaaccaaaaauuuaaaaaggaaauaaggagaaauaaaaacccugauccaaccagugaacaugaauaugaugugguaagucacacgagguacuuucuucccuagguggguaguucuguuuuauacacagcccucauccaguguguacaugaaucuccugccucuuucggcucuuacccgccacaguauucucuguuuuauccuuacuauuuauuuauuguacugaggaucaacccagugccucauauacacuagauaaucacuccaccaacgugcuacaccuucaguuccuuacauucaugauuuuauugauuaguuuuuacuuuuugguggguauuuugccugcggguaugucuguguuccauguguaugcagugcccauagugggugggcaaaagggggugccagauuccauggaacuaaaguuacagaggguggugagccaccauguggguucuggggauggaaucuggguccucuggaaaugcagccagugugccuaacugccucuccaucucuccaggcccuaagaucaugauuuaaauagccuugaucuccuaaacauaagaaggguucuagggaugcuggccuucagguaaggccuuaggucaaauucccagcaccauacacacaauuaagguuaaaauaaaaguagguacucgccgggcgugguggcacacgccuuuaaucccagcacucgggaggcagaggcaggcggauuucugaguucgagggcagccuggucuacagagugaguuccaggacagccagggcuacacagaaaaacccugucuugaaaaaucaaaaaaaaaaaaaaaaaaaaaaaaaaguagguacucauuguaacaauguaacaauucauuguaacaaugaauaaaugugcugugcagaaaaacauccuaccaggcccugaugccauuuuaggggggacuccuccccaauaugucugugugcauuuaugucuacauaaaagggcauugcugcaugcauguucuucuggccccugcuuccguugcuaagcagcgauuuuaguggccaaacuguaccguuuaguaaauguuccauuguugacucagccauuucucugcugauguguguugguuuuuggguuuuuuuuuuuauaaccacagccaacauucacuaagcauacauuaugugugguuuuaagaauuucccauguaguagcuuacuuguccucuaacacgucucuguggggacagcauuuuuuuauuuacaaggguugaaacugagguccaaguuaacacaggcaucccgauaugaaagucugaccccauuuauuuauuaacccuuuuguauugaucacauacuuacacuuucucauagcuggaauaaacuuuuuuaucacaguucugggagugaacuguaucaguagcuggaugugguggccuacaccuuuaaucucagcauucaauaggaagaggugcguggaucuuugugaguuccaggccaaccuggucuacacagagaguuccaagccagucagggcuauauaaugaaaucugcucucaaaacagaaauacaaaagggagaaaaaagaaaaaaaaaaaaaaggcucaguagagaucaauguccuguugagaacaagacagagggcugggagaagcagagggugugaaaggccagggcacuggaacugucuuugugaacacugacaucauuaagaauagaggcaaggggcuggagagauggcucgguagauaagagcacugacugcucucccagugauccugaguucaauucccagcaaccacaugguggcucauaaccauccuuaaugggaucugaugcccucuucuggugugucugaagacagcuauguauauucauauacauaaaaauaaacagcuggguguggcggcacacgccuuuaauuccagcacuugggaggcagaggcaggugaauuucugaguucaaggccagccuggucuacaaagugaguuccaggacagccagggcuauacagagaaacccugucucaaaauacaaaaaaaaaaaaaaaaaauuaacaaacaaacagagccaggacugguuguagagaagguggcaguggaccaggagcagagcauccuuagucuugaugaagcagccugagcaggucagcacugguuucuagaaaggaagggaaaaacagcuaagaagcggcugugcggaacaaggagcacacauaccaccuucaaggcccugugguccacggaguagaggagagagcguuggugacccaugggacccugcagagguuuuagaaacugggugagaaaagcgaaugcaaagcucaggugacuacaccaaaggucugcuuagaugcuaaggcagacagugauggagagguaccacugcagcuggggaugggaagaguggagcaugcagagaucuggggaucuguguuuacuuaccagguggagucaauggcuuugugaaagaccaaguccaggacaggaucuugggggcuccugagaugacaccuaggggccguucagagucagcaguggaccaagcacaucucugugaccuguagaacuauuuuacucucagaccacagggagauacagacauugccagggcaggguguagucccccuuaccguauugaaccgaauaaucugcucacggagaaaacaguaaaucagaagagaaguacagggguuuuagcgccugucccguggccugggucugaccuuaccccucacacuccuguggugcccacagcgaacccauccuacgugcccccaccccagugccagccgggcgaguuugccugugccaacaaccgcugcauccaggagcgcuggaagugugacggagacaacgacugucuggacaacagcgaugaggccccagcacugugccgugagucacuguucccauccuggguggccgggcagugggacccuggaugugugccacugcccaguagugggacacuggaugugcgccugcacagggcagugggacucugcauauguguccgugagaacagagagucgguucucacugaccccugaccucucccccaaaccccagaucaacacaccugucccucggaccgauucaagugugagaacaaccgguguauccccaaccgcuggcucugugauggggauaaugauuguggcaacagcgaggacgaauccaaugccacgugcucagguguggacucgggcacgguaguccaggagccaggccugggaagacagaagagcccaugaacccagagcaaagggaaagggacccugggcaggagaugggggucuuccauucccugccaggauggacagaccaacaggacuggguguacaggggaacagauuaacuuuagauggagaugaggaaaaaccacggauggagccuuuucccaaaaaccccaaagaucccuugggauauggggucaggcggcaccagugugauucgggacacuagagaauaacaucucaaacagaauggggggugggggguggugcagaggacgaugggagaggagaggggcuagaugaugaacuucugcaccugccccuccccccuagcccgcaccuguccacccaaccaguucuccugugccaguggccgaugcauuccuaucucauggaccugugaucuggaugaugacuguggggaccgguccgaugagucagccucaugcggugaggggcacggcaggcaagaaagucuggccagcuggcagaggggaggggcagaucacggguuggggcuggagguguguaccugguaggcuugaguaaguugucacuguggccuugauaaguucugucugcagcaggggauaauagcaccaccaucacauuggggggggggggcgcucgggguuugugaugaugccuagcagggguaaaugagcuauuuccagcgagccccucugccccaucugacucugcuagaggcuccugcuuguggaaguguccccuucaccaccugcuucucaaugugagaacgugugacuuugagggccccacucgacuguccuuucucuuucucucugacagccuaccccaccugcuucccccugacucaauuuaccugcaacaauggcagauguauuaacaucaacuggcggugugacaacgguaagagcuaagagcguaccucccuccucuuacuguaauuccuaggaaagccagaagccaggcaggccucagagaaggcaggcaagaucuuagacucgagccgggguucucugugguacacugaaacccugagagauuuacuagcuaggagaaacaggaaggagacagaaauaccauggggcaccaagguggacagaaggucccugcgguuguaucaccccugccuuagcagagcagagcugcccacccucuggcaggaaaguuaagugagggcagagcgacaaagcccagggccuagccucuucucccuaugcccucugccucuuggggucuuuacugcaugccccaggcucugggucucaggcuuggaagcacaccuggaggucagccacggaccaggugaugucagcccugagccacagggaccacgguguguguaagcacacaugcaaguggugguugugugugccguuucggacucuguccugucuggugugcugcuguguuguguugcaaugugcugccccaggaucuccagcccugcuucacaugugaggauggguugggucuguaccaugucucccuccuccgugccgugucucgagugccaaugguugcccuggcgguuucuguguuucagagaaggauuguggggacggcucugacgaaaagaccuguccugagccugccggucagugcauagaggcacaugcaccaucaccccagagccccagauggccucagccuucccagcacccuagguucccuggcccagagcugccagacacacacagacaaaagaggcagaggcaggagagaacuuggaggguguucagaggagagaggugacagagguggccccgaggaggcugagaccugggggaagaaagucaaagccaguuaaaagugggcaggaacacacuacacucagagagcacuuugagagugcucugucuuugagaguccugucaguaugugcagagggaaguuacccuagggcuuaggagccaggauguccacccagauaccuacuucagaagaauaguccucuagccucugggagccugcacccugcaccagugucuugcaaugcccaagcucaguguguggcuggguaaagaucuuuccagccagcagucucgccuacaccccacaccccucaucuuucaaaccaucaggaaccucucccuagccccccaaaguaggcaauccuguccccauauccugcugcaaaggauguccccacccccaacucucugagacucagggaagggccucuuggagcccacccacugccucccccacccugugggccauggugcaugcugcagucuaugcaguuucuguuugucuuuucugucuguuauuuucucagugggggguggggcgggcugcuggugggagugagggggcuaagcaggccaagcugggguuacagaaaggcuguucugcugaacccauccuuggcucucccccucuucccucgcccagacaaugacuguggggacaacagcgacgaagccggcugcagucacuccugcuccaguacccaguucaagugcaacaguggcagaugcauccccgagcacuggacgugugauggggacaaugauuguggggacuacagcgacgagacacacgccaacuguaccaaccagggugagcacucuggacuagcauccagccuguccagccacccaccccacuguugucgccauccaagaaccccgagauggcuuuguuaccacccugagaucucugaugcuugccccuuguccuugaggaggcuccagucccccaggagaggaagguugcuggcgaaucauuggcacgcacuguuacgauugaaggccuggcuguuggguggccuuagauuucagcuucagcucugcagcuuguuaucugaguggccucggacaaguuaccucaucucugugggccucuugaguuuucucagcaauuagcacugacaugguagugguuaucaggacacaggauguuucugggagcuguggauugacagggagucaggcauggcggcucacaccaauaaucccaccaccgagaggcugaggcaggaggaucgaucacugacagauaguaggucagccuggccuaggguagaaggcccugucucagaaagaaagaagaaagaguaccacggacaguacccagugcccauggggccucuugggagaggcugaguuucccagagggcacagguccucucugagggcgcuggugucuuagcucugccucgucacugccgagaaaaaaagaggaucaguauaaguuuggucuggcuuuaagaaaagacagaaaugccuuuuuuuuucccccugugaaauguacuguauucugacacuggcauaucaguuugcuaacguuucuguagcauagugccacaagcgagggacguagaugacagaaccgugcuccacacagcaugugagguagaaaagcaaacuguccugaauucaaggcuggcuccuccccagccugugaaggaaaacacauccuugugucuucugagaccucuggucuuccuuuguucuggacacacuacccugccccugccuucaucuucauguggcuucuucccuaaaugugucugucccuggguccacuuuuuucuuuuucuuuuucuuuuuuuuaagauuuauuuauuuguuuuauguauaugagaacacuguagcuguacagaugguugugagccuucaugugguuguugggaauugaauuuuuagaaccucugcucacuccagucaacuccacucgcucaguuccugcuugcuccggcccaaagauuuauuuauuauuuuucauaaguacacuguagcucucuucagaugcaccagaagagggcaucacaucucauuucuggcgguugugagccaccauaugguugcugggauuugaacucaggaucuucagcagagcagucagugucuuaccuguugagccaucucgccagcccccuacauuuuuuauaggaacauuaauacuauuaauuagugauuuuaauguacagagacauauuugccaaacaagguggcaugcggaguugagcaucuuuuuaggaaucgcacuucaguucaugacaacugauaguuuacuuaugggucaaaauauuucugcaagccguacauggcccaugagccuccagcuaggaguccccgcgucagaauuagcaucguccugagugccaugggccacucuacgcauucagcugagaggcagugacaagagggucacaggaagcucagucuucaggaccaucucugaaaaggacuaggggguuuaagaaaggauuccuuccuagaugggugaagcaaugcaggccuugcccaacaagccaaguagaucuggcuuccucugcaucugggcuuccucugcaucugaguauuagguggagaugggaggggugggaccuggcuuguggacagugauuggcagugauaguuaaccugugguucugagcuggcaugacccaguaccuugaggaggaagugggcuugcaggugauuucaguaccuguauaggaaaguguaaggcuuccuauggggguagugggaggcugguuagauggcagaugccucgugcagggacaaggaaauggggcuacuccgaaagcagcugcuuccaauagcauaaugacaguugggcagaggcuugaccugggaggcacuuuggaagaugggugguacauuuggaaaacaaccccagaaggaaauuaccuuacgcugaacuucaggcccccccccccagggaaggaagucagguuauaggcagcugcugagaguugagacauggacacacccugccaccccaguuacccgaucaucaaugcucacacugggggggguggcauuuccacuaugccacuggccuacaggauuaggugagauacaggaagaucccaaugggucagugaucuugugccccgacacugcccucaggcuucacaagcucucugcacacgugaaaaaggugcugagaccucugggcccuucacccaucucugauccauguucugccuucugccccuucccucccaacuuugccucugcugucccaucuggaaucuucccacaggaugcuccucuguuggcugugcagcugcacguaucuuaguggcucacucuucaauucauauucccgcugaggagguuucugcucaggggccugcugaggccgucuugccugacgugucauuucaucaggcuggcacuguuaaacuccugccauugccugcaaucauagccuagguccaccccccuccacuagacucuaagcuauguugaagaaaggauuuggucuuugaggcacgugggagggacgguguauacagagagugugcagggagugagggaaacacgguuagguugauguauuugaguucugcccugacagauggaauauguagcuaguuacucucauaagcuuagaggaggggcguuagauaagagggucacccggguccuugaagauacaacaucugagucucucgaugaguuagagcuuucuggcuaucggcaggcucaugggacacccagggcauccuuacuuggcucagcaucuaggcuaagcagagguaguggcagagaucuguccagggugccucucccuccugaugcacaccccaccccccgcccuuguccuccagcuacaagaccuccugguggcugccacucggaugaguuccagugccgccuagauggccugugcaucccccugagguggcgcugcgacggggacaccgacugcauggauuccagcgaugagaagagcugugagggcgugacccauguuugugacccgaaugucaaguuuggcugcaaggacuccggugagagggggcagagcagggcggggagcuucaugaguaggaggaggccaucuugaggauguaacaguggcuugguguuauguagaggaaagggcaagaaagagccagagucuguaugaaagaccccgggaacccaaacccuggccagaaucgagcaccggcaccuucugcagguucugcaccuucuucguuagcuguguggguuugacagaaaagguuucaagguuuacagugggcuccuaagcacuucagugaagacauucuuagcugggucugggcagggcacagugaguuccacucuccaggccugguuccucauucuguccccauccuggucccucagcccggugcaucagcaaggcgugggugugugauggcgacagcgacugugaagauaacuccgacgaggagaacugugaggcccuggccugcaggccacccucccaucccugcgccaacaacaccucugucugccugccuccugacaagcugugcgacggcaaggaugacuguggagacggcucggaugagggcgagcucuguggugaggcgcccaugcagggccugggguugcccagcaguggggagaggggaggucuuguccaggguaggacuauaggaaaugaucuggggcagaggaggcacugaccuaggacuugccuuggcccugccugaggugacaacuccuguaacaauuacuuuacaaaguggcccagguagacagccacugucugccaccaacugaggaagaagaagcacagagcccuuaaauaaacuaauccagggccaucccacucugaaggcagggcagggagggagccguuaagacuccugaccugggucagacacccucagucagaccacugaaaagggaggccaggcugggggugaggcacaggguugaggcaugauuugagcugacuucuggaggagggaauuuaacuggguucccggaaaugggcaacgugugcagaaugagugaggagggucgaggagaucugagcaaaccacaccgucccagaacaaacaagucaucugacuucugggaaagaggagugaaggguacagccaucugaggcuggcccagaaauugccaccguggggcguguugggaaggucagggcauuccccucugcacccugcccugugucacacgugaaucgggagggaucaaagaaagggccuugaccugaguauccucccaaagaggaggcaaaaugcccaggucccagccaucgacgugagggcaucgagagcacacagggguaaggaaaaaggaugaugguccugggugucagguucuagugucccaauccugauccuaagagagacugggaaggagacagaggcucagcagggcugagcugugguuagggcuccggggcucagaacaggauaaaaaaaaaugugaaggccuggcagggccauguccugcuuccucccagaucuugacccuaucucuuuccugucccccagaccaguguucucugaauaaugguggcuguagucacaacugcucaguggccccuggugaaggcaucgugugcucuugcccucugggcauggagcugggcucugacaaccacaccugccagauccagagcuacugugccaagcaccucaaaugcagccagaagugugaccagaacaaguucagugugaagugcuccugcuacgagggcugggucuuggagccugacggggaaagcugccgcagucuggguaagacgcaguggggucaaggugagccagccaagcaggccuggucacgcgccugagcuacagugggcugaaggccagggcuagcagggacgcuguauguauaucccaggacaggguggcacagugaguggcucuaagcccuucgcugaccugaacacuugccucccuccagaucccuucaaaccguucaucaucuucuccaaccgccacgagaucaggcgcauugaccuucacaagggggacuacagcguccuagugccuggccugcgcaacacuauugcccuggacuuccaccucagccagagugcccucuacuggaccgacgugguagaggacaagaucuaccgugggaaacuccuggacaacggaggugacucuuugggccugggagaguugccaggauuguacacagauggcacuuggguacucagggucacgggcccagauucagguggccccggagcugaggcuucggcugcccaucccccgugugcccccccucccccaguuaauuggguuggauuuugcugugggucucagagccugaugccccguaauuaucguaagcauugcugcugccugauaauuaacaaaaugaucacccuuucuuuggaacggccugaagccugguuccccagucuuggaauuuugggcuuagaaggaaaaugccauguagggauggaccaccucugucucgggguagccugagcuacacaggcucaguauuaagcaucuauugcgcuggauacagcagugaucaagacagauaguuuuaaguugugugucagggagggucccugagcagaggcaagcaagagacauguuuuaauagaggaguuuguguuguuuauuauaaaagaaacuuggaaacaucucaaauguccguccucaggagaauaguuacguaaacugagcugucgucacaugacaguuucuaaaauaauaagacacacggacacauuaguguagagugucuucaggacauucaauggguaguuucuagcacguuccaucauccuuauaguauguccaaacauguucccagaagcuuccaucagcccugaccuccuugcccagguuaccccaccucagaacaguacauacucaaaguggcugaccucacccccuccuccaagagcccccuuucccaccuaccucccaggaggaaagaggccugggagaggagagugggagccaggcccuucagcucucugggcagaggugucagggugaagguggaucauugagggacccugagauccaugccuucgccaagccccggcccaggagucucuaaccaccugcaaccuucucuuccuagcccugaccagcuuugagguggugauucaguauggcuuggccacaccagagggccuggcuguagauuggauugcaggcaacaucuacuggguggagagcaaccuggaccagaucgaaguggccaagcuggacggaacccuccgaaccacucugcuggcgggugacauugagcacccgagggccaucgcucuggacccucgggauggguaaggacucugccccacccccacccccuacccacccccgcuccguagcucuguguucagccuggccagggacaccugucuucuugguacuguugacucccccagcuuaucuguugugugaccaccccaucuuuggcccuccucccuuccucccucccucccuaggauucuguuuuggacagacugggaugccagccugccacgaaucgaggcugcguccaugaguggggcuggccgccgaaccauccaccgggagacaggcucugggggcuggcccaacgggcucaccguggauuaccuggagaagcgcauccucuggauugaugcuaggucagcagcauccgggcaggggagggacaggaccagcaugaagaaagaugaagccaagaggaggauggggggaggggaacugacagaugagaaggagcaggguuguaaccugcagucauccaucuacccuccgcucuucucauaccccguguccucugcugagggcucugccugcccagggcaaagagaaggugccuuuuccuaacucacccuggagcuccaaacgccaacuguagcccugggaaggaaaucuagaagauucccuuggggagggcauaaggcuaggaucccaacccaugcaaccuugcuuucucucuucagucccaggcaggacuugggaaggggaguucccugguguguugaguugugaggaugagggaaggugggcaccuggcagggcaccuugcugagacccccacugaccccuccauuacacccucaggucagaugccaucuauucagcccgguaugacggcuccggccacauggaggugcuucggggacacgaguuccugucacacccauuugccgugacacuguacgguggggagguguacuggaccgacuggcgaacaaauacacuggcuaaggccaacaaguggacuggccacaacgucaccgugguacagaggaccaacacccagcccuucgaccugcagguguaucacccuucccggcagcccauggguaaggggccuucaggcgacugaagaggagccaccagcccuuggaugggcgugggggaggugcugggauaauggggugugaggaggggaugagaccugggugagaagggccagggagggaucaacacaucccaggaugcucuugcuuccucucucugggccagcuccaaacccaugugaggccaauggcggccggggccccuguucccaucugugccucaucaacuacaaccggaccgucuccugcgccuguccccaccucaugaagcugcacaaggacaacaccaccugcuaugguaggaagccaucuccuccucuaacaguuacggguaaacugaggcugaaggagaggucccugcuguuaagcaaaggaaugacuggaaggaggggcucugaaaacuugcuagcgcuggaggaaagagccacaacugccaagaucugacacagucucuucacaguucucaaccugugggucucgaccccuuuggggguaucaagugacccuuucacaggggucacauaccagauaucuuacuauucauaaguauagcaaaacuacaguuaugaaguagcaaugaaaauaauuuuauggcuggaggcuacagcaugaggaagggucacagcguuaggaaggcugaggaccaucaucguagcaaaaggccaacagcacgcagggggauucaggggagacaccuaaccuagguaggugagaaacuugaaggcgagggacugccuucaaugacuuuccugcgucccacagaguuuaagaaguuccugcuguacgcacgucagauggagauccggggcguggaccuggaugccccguacuacaauuauaucaucuccuucacggugccugauaucgacaaugucacggugcuggacuaugaugcccgagagcagcgaguuuacuggucugaugugcggacucaagccaucaaaagggcauuuaucaacggcacuggcguggagaccguugucucugcagguucuggcccugcccuccaccccaaggcucauaccagucacauccccugugguccugauacuccuucuccaaaucuuaucucuagccuacuucuugacccucacuccccagguagcacacucuccucagccuauacccugcaaauaccaaccacggacucccuauuugugcccccagacuugcccaacgcccacgggcuggcuguggacugggucucccgaaaucuguuuuggacaaguuacgacaccaacaagaagcagauuaacguggcccggcuggacggcuccuucaagaaugcgguggugcagggccuggagcagccccacggccuggucguccacccgcuucgugggucagucugcagcccaggguuggggagcaccugugugaggaggggaggggaggacccuuacccaauucuugguuccuuucccagcaagcucuacuggacugauggggacaacaucagcauggccaacauggaugggagcaaccacacucugcucuucaguggccagaagggcccuguggguaugcacuugcccuucuugcuccugcaggcaucuagcuccauuaggagaugcuccuagugucucucuggugccuuaggccucuuccagcuuccagcuuggugccuacucucacuauaccuugucccagagccacaagguucagggagggcuccauggcucugacacccacucuucuuccaggguuggccauugacuucccugagagcaaacucuacuggaucagcucugggaaccacacaaucaaccguugcaaucuggaugggagcgagcuggaggucaucgacaccaugcggagccagcugggcaaggccacugcccuggccaucaugggugagggcucggguggaaggagggauggaaggagagcaggcuaggcacagcugaacaggugaugggggagauccugaaggccacuuuccacccccugcaagccuaaugacuucugcaagagagcugggggggcuagagagauggcucagugguugagagcacugacugcucuuccagagguccugaguucaauucccagcaaccacaugguggcucacaaccaucugcaauuagauccgaugaccucuucuggagugucugaagacagcaacaguguacuuacauauaauaaauaaaucuuaauuuaaaaaaaaaaucuauauuuaaaagaaaaagaggacuaggaaagagccuucccaagagucuuauucccuccuguugccccaggggacaagcuguggugggcagaucaggugucagagaagaugggcacgugcaacaaagccgauggcucuggguccguggugcugcggaacaguaccacguugguuaugcacaugaagguguaugacgagagcauccagcuagguaugcagugggcgcacaaugugguguguggagggggucugcggcgggagggaugagggguggcagagagacugcagggcugugaccaugagcagccuccagaacgggggggggggguggugagggcauagagggagggcuuuuuaccuuacccccacucgugugaaauguagacucagucuggccagaagguccagggaucuaagaagacaugagaccuaagaauuggguugggugugacccugacagguccagggugaauccagugacuguuguccucucugagcagcccaagccugucccccaccaaggcucacccuuucuuuucacuccuguguccucccgcagagcaugagggcaccaaccccugcagugucaacaacggagacuguucccagcucugccugccaacaucagagacgacucgcuccuguauguguacagccgguuacagccuccggagcggacagcaggccugugagggucaguucccggcauuuccucucuguccagccuugaccccuucuacccuauugcuacauuaugcguuugagaaagaugguguucaucguguguuaccaggaggcuucugggcuaaaugcuuauccagugccccuuucuggguacugcggacaaaagcuggagccagaaaguggggccagcauagugagaagccggaccacaaagcgcuagugacuguucaggaccugcaguagguuuuggugagauagacaccggcggcugacagaggcaggccagcuuggcagaagaggcgugcccugugcugugcccuggguuuauagaguggguagaaucugaugcuugguaccuugaagagagaaguuggugguacaauagggugugcuuaacaugcccugagcccugacuuaaaucccagcuaugugugcacgccuuggagacagacacucaugcuacauaagaggcaagaaauagggcuggugagauggcucaguagguaagagcacccgacugcucuuccgaagguccggaguucaaaucccagcaaccacaugguggcucacaaccaucuguaacaagaucugacgcacucuucuggagugucugaagacagcugcaguguacuuacauauaauaaauaaauaaaucaaaaaaaaaaaaaaaaaaaaaaaaaagaggcaagaaauauagcugagaagucaaguuccagggccgcugagcccugucgagggcagcgugggaagacugugauaaggcuuugagcuaggguggggaccugcggguucucagccaggagugccuagaaagugguguuuggagauuaacccaggggcagaaggcuugcagaauggaggagggaggaaccaaggcagucagaccaguuaggagaguauuaggagugugugcgugaggaggcaggcccgaggccuggcuacucaacuggcuugcaaggaagggaugagacauggaggcacuucacaagagccugcugguuuacaagcuugcccuuggacagcacuuuuccccaaagugcucugccagaaaccuccugcuuugauguggguggguguuacagaaaggaacccugggccgagcaacauguaaacauuguguuuuuacuguuuggcuccucagaacccugaguacacugagcauauuuugggagacuuuuagugucugcacguggugguggugguggugguggucgucucuucuucuucuucuucuucuucuucuucuucuucuucuucuucuucuucuucuucuucuucuucuucuucuucuuuuucuccuucuccuucuccuucuccuuucuccuucuccuucuucuucuccuccuccccccuccuccucuuccucuuuuuccucuucuuccuccuccucuuccuccucuucuuucacagaguuuaagcaaccaaggcuuaauggagggauucacuggggcacacauuguauucaagggaugggagucagggaggauucugggaugcauagagagcagugccuucucaaaaacaggaaaacuggaaagaagacugacccaggggcaagcaggauguugagaacuuuauguugggaaaggauuuggaacugagcagaggcagggcaaugagaaaguuaaggucagaccaagugccaaacugggaaucuagauuuuggagucuugcugcucugguugucugcugcgaccuccccugaggcccuuggaaggaagacuggggcagggugcugagaaagaaauguaagucucuuucugcccucuuguggugaauagugguucugcagguggucucccagagcuggggcucucagaagccaguuagguugccaucuccuguccaagguccgggccucacacauggugugagcguuuagagguucaggagauggguagaagaaacugccaaaggggaagcugagaaaagcaguuugagggugacaggaaccuagcuuugucagcaaggcucaugcuuaaaguguuuuuguguugcaggugugggcucuuuucuccuguacucuguacaugagggaauucgggggauuccacuagaucccaaugacaagucggaugcccuggucccaguguccggaacuucacuggcugucggaaucgacuuccaugccggugagcuauugucccggggauuagucagcaugccccaguaguuuaugggagugacacauuaaaguccuagaagggcugccuguacugacuguagcagcugccucacuccuuccugcugccuccccacuuccaagaaagcacccggcacccacagcccccauucggugcuauccugacccuccucgugauuugacccuuugccuugccucugcauugaggggcauucucaugucugccccucugcuuccagaaaaugacacuauuuauuggguggauaugggccuaagcaccaucagcagggccaagcgugaccagacauggcgagaggauguggugaccaacgguauuggccguguggagggcaucgcgguggacuggaucgcaggugaaaugaaugguagaaggaaaauaggcuuugggggaaaggcacaggccauggggacguaaagucugaagguaugggcagaagccaaugggagcuacagggaagauuuggauggaaggggaccagguacaaggcucccuaccaaucucccugaaccccaccgacugacucccuccucaggcaacauauacuggacggaccagggcuucgaugucaucgagguugcccggcucaauggcucuuuucguuauguggucauuucccagggucuggacaagccucgggccaucacuguccacccagagaagggguaaggagcuaggcaagcuggcuuagaucucuugaccacaguauagucugacaaggcccagcuucuaagugggauggacucucacccccacuuccaucccuacccacagguacuuguucuggaccgaguggggucauuacccacguauugagcggucucgccuugauggcacagagagagugguguugguuaaugucagcaucagcuggcccaauggcaucucaguagacuaucagguacggauacacccuggagcugaugaaggcgauaacccuaguucugagccuuucccuaucaguuucccugugguaaccaucaggguuagacguggaccagggagggugguggcagccuuuaacccauuugucaccgagaauaguaaucugcccuaagacgauggaggguggucaugcugaaguagaguaugagaaagcugggugugguagcauaugcuuaacacucaagaggcugagacaggaggauuacuucaaguuugaggccaucuuggacuauucaguaagaucuuaccucaaaaauuuaagauaaauacauagauagauagauacauagauacauagauugauagauagauagauagauagauagauagauagauagauagauagauagauacaugauagauacauaauagauauaugguagauguauaaauagguagaugauagauugauagaugacaaauagauaggugauagauaaauagauacauauauagaugcauagaugauagauagauagauagauagauagauagauagauagauagauuuuagauaauaaacauagguguagguaaauagauauauacauagauacauagagauacauagauauacauagauacauagauaagaagcuaacaugauauuugccuaacaugcuugguccugggacuagucucuaaugcugcaaaugagggcaguaacaauaaauaaauuaaaaaguauagagugagggugugugguccacacaguaagugugguuacacauggagccgaucccuacuggaaagcaggaguuagccccaaggugagcuggguacaucuguccacagggcggcaagcucuacuggugugaugcucggauggacaagaucgagcgcaucgaccuggaaacgggcgagaaccgggaggugguccuguccagcaauaacauggauauguucuccguguccguguuugaggacuucaucuacuggagugacaggugaggggggcuggguccugcuucucccauggguuucuccuuucuggcuuuuuagugacauacccuacacacggcuuucccuucuccagaacucacgccaauggcuccaucaagcgcggcugcaaagacaaugcuacagacuccgugccucugaggacaggcauugguguucagcuuaaagacaucaaggucuucaacagggacaggcagaaggguaaggcugggcucugggccaggccagaaaggugaacaaggacagcugaaccuuggaggaagagggacaaggcaggaaaucagucagagccuccagggcacuuuccagugauucacaagagcugggggcagggaguuaggacugagcgggauagaucaagauauuagauaccauagcuaagcagggaucagcugaaauuuccaacugauccgaggacagagagaccaaagagccucucuuuaugcuauacaccauacuaccuucugaugcucuaccuuccgauguucuacccuccgaugcucucugcccccagguaccaaugugugcgcgguagccaacggcgggugccagcagcucugcuuguaucgggguggcggacagcgagccugugccugugcccacgggaugcuggcagaagacggggccucaugccgagaguacgcuggcuaccugcucuacucagagcggaccauccucaagagcauccaccugucggaugagcguaaccucaacgcaccggugcagcccuuugaagaccccgagcacaugaaaaaugucaucgcccuggccuuugacuaccgagcaggcaccuccccggggaccccuaaccgcaucuucuucagugacauccacuuugggaacauccagcagaucaaugacgauggcucgggcaggaccaccaucguggaaaguaagccaagcccgaguccucccaauaaacaguggggcgaugggggacugucaguguguggacacacaggcaccaaccaaacccacaugcugggugggccccaaggcaggguuucccauaucagaaauacauuauaauucauaacaacagcagcaaaauuacaguuaggaaguagcaacgggaaaaauguacaguuagggucaccacagcgcgaggaacuaacuguauuagaggauugaggcaccaggaagguugaggaccacugaccuacggggcuggcaggauccacugccauugugguaaccugcacauuguccuuuacauggagccagaaggaggccucuuccuuccuugcacugauuucauuccacaccaagauaugcaagcacaggcagcagacacgggcccaggugcaacucucccugagugggagucagcagauccagcgagcuucuuacccugaacucaggagucagggucucaggggugugcacaugaaagcugagccuggcagccaguggcccugccagagcugugaaagccacagagcugucaccagaaagagucucagcacucagcacugccuuuuaccacuucagguuuucccuuugcugcugcuguugcugcugccgcugcugccgcuuccuccuccuccuccuccuccuccuccucccuccuuccuuccuccuccucuuccuccuucuccuccuccuccuccaccuccucccuccuuccuucuuccuccuccucccuccuuccuuccuccuccucuucuucuucuccucuuucuucuccuucuccuccuuguucuucuucuccuccuccuccuuucucccucuuguuuuucuucuccucuuccuccuucuccuccuccuccuccaccuccucccuccuuccuucuuccuccuccucccuccuuccuuccuccuccucuucuucuucuccucuuucuucuccuucuccuccuuguucuucuucuccuccuccuccuuucucccucuuguuuuucuucuccuccuccucaucuuccucuuccuccuccuccuccuccucucuccagccccacuucuucccggagcggaaggcuuaagauuuauuuauuuuauguauaugaguacaaugucacucucuucagacacaccaaaagagggcaucaggucucauucuggauggcuaugagccaccaugugauuucuggggauugaacucaggaccucuggaugagcagucagugcucuuaaccgcugagccaucucauccccacccccuucuucuuuacuucuuuacuucuuuuuuuuuuuuuaagauuuauuuauuuauuauacauaaguacacuguagcugucuucagacacuccagaagagggugucagaucucauuacggaugguugugagccaccauguaguugcugggaauugaacucaggaccuucagaauagcagucaguuaucuuaaccucugagccaucucuccagccccacuccuuuacuuuuuuaagaaacauuuuguagccacacauaaccuugauuugaacuucugauccuccugccugcacagcacuggggucaucugggauuauaggugugcgccacuaccauacccuuuuuuuuuauguugugguaggacuugaacccagagcuuugugcaugcuagguaggugagcacuguguuacccaaggucuauucccauuccuccuuuguuccucucuucauccaggagguccauucagaccagccaggugcugacuagguacugcauagaaaagaauagaccugucccucuguccuucugucuccuggcacacuuucucuacgacauccugucugugucuaaaaauggagcgucugagggcugguggagcucgugcucagcaugugcaggacguugggcccagccccagcaccuaaacuggauacucucaaucucagcuccaucaggagagacugggagccagccccuccuaucacgcucucuguuguccguccuacagugugcuccgccucuggcagucacauagacacgccccagggagccccggagccuccgcuggcugcugcucacagcacuguucagcucugucuuuuuaguuacaucugcuuuauaaaacauuccagcucagcccagcgugauggcgcacgccuucaaucccagcacuugggaggcagaggcagguguauuucuaaguuugaggccagccuggucuacagagugaguucaggacagccagggccacacagagaaacccugucucgaccaccccaugcucccccuccccccaaaaaauuccaguucaaggccucugcaagcaggaagcuuuccagucuggccccagaggaauaguagaauucaguuagccggaaucucccccauacaugaauaaacagaacuccacuucugaagagugugaccacacauaggccgggaguggggggugggcaagagaagaggaaggaaggugccacggaucaugacgcagguggugugacguggcucugugaggggcccuggggcccuggcaagucugaccaaagagcccucggaggaacucccgguucccacaauuccaggggagccagucaugcccuuagcaccuaccaggcugccccucugcuucugcugguuggcccuucucaacccacagcuguuccugucucuucacagaugugggcucuguggaaggccuggccuaucaccguggcugggacacacuguacuggacaagcuacaccacauccaccaucacccgccacaccguggaccagacucgcccaggggccuucgagagggagacagucaucaccauguccggagacgaccacccgagagccuuugugcuggaugagugccagaagugagcugcugggccuggggggugggagcuaugucauacgggaacagaaaggggacaggcagggcccaccauuucuggccucagugagaugcaucaccucucagggcgcugcuuaauacaagugucagaaaugaagggagguugagggccgugggagaugccucuggcuuugugacuggcauucaucacacaguaccgugggacucaaagcuucagcgaaggcucacugaccuugaggauaugggcugggccuguucaaaccccuugcugagcagaggucuuauuacagugaccaagaggcauugugaaggcaguugugagcacaaggccccaaagugagaaaagcaagaaaaggucaaacaggacagcaacgggacugcccaccauuugggcaaggcuagccugagcaggcagggagucuggucuaccuguccugccuacccugucuuucuucauuuugaugugcagguuacuagugagucacacccucugcauagcaguccuggcucacgucugagcgaccugcccuccccaguucagcuggaaucagaaugcuuucuaucagccucacuaggaaacuaaagcaaugccacagccuuggugaccucaccugucugggcugguccuggggccuguccuuccugggccuagagccucuggggaggggcugucaugauauuuuucugccauucuaaaagaggcauccucgguuucaaccaagucccuccuggcugagcccaggaaagugcucucucuuucucucucucucucuagagccccagagccaguggcuucaaaaaaacccaaguacacagagaauggacugguuggcagaggguggaggauuucaugacugccaaagaccugcccuguggaagucugggagaaugucaucagggaggcagcucaggggugacuagagggcugagauugucuuagguuaggggagagagcuggaaggagccaguaugucaggauagugguucagccagccagccauacuccuccugauccucacugaagcauuaguguccuuggaaaucagauaguuggacagguagaacguccacuguauuucuaguugcugacccucugccccaaggaagccuccccucccccaccccaccaucccacaaagcagcuuugccaaacucuuaacucaggguacaucccauguaagucaauuuggugcuccgcugugaguguggucuaggcuggacuugagaguguggaaaucacuguaaagccaggcugcacaagccaggaaacagcacucgggccaggcaaggugguccaugacuauaaucucagcacuggggagguggauguaggaacggugggaguugaggucauuaagcuauguaacuaguugaaggguagccugggauacaacaggcccuaucugaagaagggagagagagagagagaaagcaugcuacagcugcugccccaggacaggcugaaugggucgccaccuccauccauaaagaguccuguguguggugugaugcauuggggaagcagagcaggcagaucucuugaguucagggguagccuggucuacugagacagugccaagacagucagagcuacaggaaacucggucucauaaacaacaacaggccgauccugucccugaggaaugggucuccagggccucaaagagggaggcaagcguuacgcugugguugagcuggaauguagcucaucuggcagacgguuagccuggcacacguauggcagcauguucccguaauccuagcacuuggaaaguggaggcaggaggaucaggagguaaagaaccucaagcccaggcuggugauccuagagagagaagagaacgaaggggguaaacagacaaguuacaaguucaaguucaaacagacaaguuacaaguucaucagugaggucagagaagggaggggcugaggcacgguggccaggucuauucugaaacuguuucuguuuucuuugcugcaucucaaaggaacaugugcaaaggguucaccaccccaggucaagugaaugaaucaagcuguccaagggcgacccugcugccgcugugcugugcuugauccuccccaccccacacccaggcccuuagcaccacuccacaaacaguggggcauggcuuggccuuaaguucacauguccuuauguugugaagaaaacuuuuuuuguuuuuuuuuuuuaagauugauuuauuauguauacaguguucugccugcauguaugcaugcaggccagaagagggcaccagaucucauuguagauggcuaugagacaccaugugguugcugggaauugaacucagggcccuuggaagagcagccaaugcucuuaaccucugagucaucucuucagccccagaaaacuauuuuugaggguacaauccauaugugcccaaggaaauagucaauacuuagcaagaguuuccuggguaguuuguuaaagagccagcuuugauacagagaaagcaguuagcaguaaauacauggaaaacucucauugagaugaauacacaguacuuaguuuuuacaaccucugcagcaauauuaucccccacuaaauaauagaaaaauaggucagucagaguggucgggcaaguugccuaaaguaggcaaccuacuacucccccccccccccccccccagccuaccuggcuggaaagugguggagccaggacuuggggcugggagcugacucgcuuggccacacagccuccagucucagcaaaugcagauggucccuucccauacugcaguacgugacugugggcacacacagucagaucuagccacauagugcaguaacucagugccuuggcugggcuagucucaggcaccgaggcuauguuggcuuucguggcucucggguugugaggcucauccuggguucuaguugacuccuuagguuccugaucccuuugcccguuucccaucagccugauguucuggaccaauuggaacgagcuccauccaagcaucaugcgggcagcccuauccggagccaacguccugacccucauugagaaggacauccgcacgcccaauggguuggccaucgaccaccgggcggagaagcuguacuucucggaugccaccuuggacaagaucgagcgcugcgaguacgacggcucccaccgcuaugugaguguagggguggguggguggguggguggguggggauguggagggaaccaagucagggcagagcaccagacagggagacccaggacacggugagaggucccauucgaguccuuaacuguggguagccuuugcccugcgugguucugacaacacuuagaaaagagagaagacgaagccagauccuucccagacggucugugacuucccacggcccucuugccuccccucacugugcuguuaagaccgaugaggggcucgaaugcagagacgcuggugcuucugucucaucaggugauccuaaagucggagcccguccaccccuuuggguuggcgguguacggagagcacauuuucuggacugacugggugcggcgggcugugcagcgagccaacaaguaugugggcagcgacaugaagcugcuucggguggacauuccccagcaacccaugggcaucaucgccguggccaacgacaccaacagcugugaguggggcuaccacccgcagugcucuccugaucucugccugcacacaugugcacacgacagucuugucucuccuguucccugugacugcacacaugugcacaugacagucuugucucuccugaucucugugacugcauaauacauauaugauagucuugucucucccaggauuucuucuguacagacaaauaccuuuacauaccuuuggcacccagaaacuccuaaggccccaacauuucucaaacccaacucccucaagacaccuguguacauacauggacuugauauacucagguccaucucaugcaaaacugcaugcgcucacgcacacgcacacacacaugcacacaugcacaugcauucguacuguucaugacccuaggcucguccccaucccaggagauccuaucacucagccuaauaauuccaucuacccagagccaccuacacccuaaaccuuaccuuauacccacauaccagguguagccuaucauccccucccccagccugcacauagacauacauaccuacaccuggcccucucuugugugugugugugugugugugugugugugugcaguguccacaugccaccccaugcgagguucuccccgcuguugugaacccccauggcugcuggggucgugcagagcucuggaauguuaggugggcaauuugggaguguacagggccagggaacccucuucagcuuucgguccccccacucccaccccugcucaggugaacucucccccugccguaucaacaauggaggcugccaggaucugugucugcucacccaccaaggccacgucaacuguuccugucgagggggccggauccuccaggaggacuucaccugccggggugaggaagcaaguuggagcugggacaggggcugcuguggggugucagcacaagagacccuuauuccagacuccagcccaggcuacaaggcuggacucaggcuaggucgcaacucaugacaccuucucccuccgcagcugugaacuccucuugucgggcacaagaugaguuugagugugccaauggggaauguaucagcuucagccucaccugugauggcgucucccacugcaaggacaaguccgaugagaagcccuccuacugcaguaagggcccugcuccagccccucccccaguccccugugccaugugacccagcuccauagccucagcucaugaagagcagagcuuggaccuuaggaagggacggucauugguggggaggggggaaagaagccccuuccuaugccugcugugaccacgcacacccuccccucacagacucacgccgcugcaagaagacuuuccgccaguguaacaauggucgcuguguauccaacaugcuguggugcaaugggguggaugacuguggggauggcucugaugagauuccuugcaacagugaguacaucccagccucacccccaguacccugccacaccccugccuuaccccuaccucaccacagccaucugccucacccuagccuccugccucaccacagccaucugccucaucacugccuccugccucaccccugccucaucccagcuucauccuagccuccugccuuaccccugcuucaccccugcccucaccccugguuuuuagucucagacuguaccccguccucacuccggcugagcauuuguccccaggcacucugaggacaggcgagaacucuguccugggccuuucuggcccugcagagggacacuggccugaugguacuggugggcccuguucuagagacugccuguggugugggugaguuccgcugccgggauggguccugcaucgggaacuccagucgcugcaaccaguuuguggauugugaggaugccucggaugagaugaauugcagugaguaacagccugcucaugacugacagcuggcccaugacugauggccuacucaugacugacagucugcucaugacugacaguuggcccaugacugacagccugcccaugauugacaguuggcacaugacugacagccugcccaugacugacagcuggcccaugacugacagccugcuccugccuacuuuccugucccuccugccucaggcuguucugccuuauuuccucucagccccccuggccccaaauaguagccucuauccucucugaccuugcuuuuucucccuccauagagguagugagucagugggcagcaggcaccaaaucugaaaccauaagucuaacauggggccagcaauugcucccauagugugucuuagaaggagcuaggugugaccccucacccacccucaccaccccuucuauuccaucuuccacauuggccccuagguggcgcccugcccuuccucuucucucgugaccccacugacccacccucccuccaccagguaccacagacugcagcagcuauuuccgccugggcgugaaagguguccucuuccagccgugcgagcggacaucccugugcuacgcaccuagcugggugugugauggcgccaacgacuguggagacuacagcgaugaacgugacuguccagguuggccagcggaagcucgccgggugaacgggagacccggggcuggcagugucuucauggcuggcagagucuucacaucucccuucuacccccaggugugaagcgcccuaggugcccgcucaauuacuuugccugccccagcgggcgcuguauccccaugagcuggacgugugacaaggaggaugacugugagaacggcgaggacgagacccacugcagugagugcccugggacccuacccagcucccaccucacaguccuuauggaaagcgcccuacacggggagacaccuggguuccacugugucucauccucucagacuccagaauagagucacuucuucaguuugugaugagucgcucaccugcccugccuuuccuugucuucuuauuacuuucuccucuauuccagacaaguucugcucagaggcacaguucgagugccagaaccaccgguguaucuccaagcaguggcugugugacgguagcgaugauugcggggauggcuccgaugaggcagcucacugugguaagcaguggccugaauccgguucagggcggucaguguccuacccccuaaagaaggguccauauaccagugggccauguuaucacggcugccugcucugcccuguccccuccugagucucucugugucuccuugccccucaugcagaaggcaagacauguggccccuccuccuucuccugucccggcacccacgugugugucccugagcgcuggcucugugauggcgacaaggacuguaccgauggcgcggaugagagugucacugcuggcugccgugagugggagaggccgugaggaaugggugggcaucaagccucgcagccuugcuuugcaaacacuggcaaaugaggucaaggguaggaagaacuucagugggagccgugcguuuaaggagaucacagauccagaccccucccauucugcccauugcuaccacucauguugcaggaaacuuaggauugggggugggggagugacuaucaacagcuaguaaguagggcagggcaggaguagggcaggccugaggagggacucugccuccauccccaguguacaacagcaccugugaugaccgugaguucaugugccagaaccgcuuguguauucccaagcauuucgugugcgaccaugaccgugacugugcugauggcucugaugaauccccugaguguggugagucccgugacuggaggaguagcccugccuagccgugcuggagguccagccucaucauccccucccccaccacagaguacccaaccugcggccccaaugaauuccgcugugccaaugggcguugucugagcucccgucagugggaaugugauggggagaaugacugucacgaccacagcgaugaggcucccaagaacccacacugcaccagcccaggucagccucuagguggagcccuuucuccuuccugugaccccacugaccuguucccaccacccuccauguuggccucuagauggcucccugccccuuccuccuccucuucugugaucccacugaccaguucccgccacccuccacagagcacaaaugcaaugccucaucacaguuccugugcagcagcgggcgcugcguggcugaggcguugcucugcaacggccaggacgacuguggggacgguucagacgaacgcgggugccaugucaacgagugucucagccgcaagcucaguggcugcagucaggacugcgaggaccucaagauaggcuuuaagguacucaggggauccgaccagagcccuuuguuccucccccucaucccuccaucgaguacuuauugagaacccacucugccagcaguauacuaggcucugaggacauagcagggcagacagaagucccucuucaguuagagccucagagccagugggcuguguucacgggugagaagagaguggguugucaaguagauauguugcucuggagcucaagcuaaaggccaggccuggaggaagaauuaucaccccagagaggcuauuuaaacccccgaggaagugaauagagaugauaaaaggccuuagccagcacuaagcuacaucgagggacuaggaggcuagggaagccaccaagacagaaugacagccacaugaggaaaacucggagggacagggugcacagauugcagucugugugucacuugccucccccagcccuccugagggccucuaggcgucguugguucccagaagcauagacuccagccgcuuccucagcugcacaucccuuaccccccacagugccgcugucgcccgggcuuccggcuaaaggacgauggcaggaccugugccgaccuggaugagugcagcaccaccuuccccugcagccagcucugcaucaacacccacggaaguuacaagugucuguguguggagggcuaugcaccccguggcggugacccccacagcugcaaagcugugaccggugagacgggcacuuggagggugagauguauuucaggcagcugugggauugggcagcagguggcagguagggagagggcuugauacaauguagcuggagauagccugggguaccagggcugcuggagauagccugggggacuagaggugcuggagauagccugggggaccagaggugcuggagauagccugggggaccagggcugcuggagauagccugggguaccagagcugccagaauauaccuaagcuuggagcugagccgagacccuccuccuacagaugaggagccauuucucaucuuugccaaccgguacuaccugcggaagcucaaccuggacggcuccaacuacacacugcuuaagcaggugccaaaaccaagccuucuuuacacccguuguugacugcccgggcccaguauggccuccccaguucuucccaccgccaggccaugguugucuccuucucccucucccuccagccacauccugacuccagacauccuuccccagauacacaugugccccugcggcagcugacuucccuguccccaucccaaacccagggccugaacaaugcggucgccuuggacuuugacuaccgagagcagaugaucuacuggacggacgugaccacccagggcagcaugauucgcaggaugcaccucaacggcagcaacgugcaggugaaaacagaaggcugccccgugucggcugacaggcacaccagggccccgcugacgagccucacacccuccccauaguccuuugcuguaaaagagucuccccuucucucacaccugucaacacugcuucgcccugcuccucccugagccacagaaacguucugcucgcuucaccuuccccuccucucaacucaaaaguaugcaagcacaggagacuccuccugccuucccuugaguucugugugcucuaggcguguguggguggccccagagacccccugcuuggagcuccuggugauagccacuuacggucaggagaguggagaagccaugccccggagacugagggugccaccagcuccuccuucccuguguuccuuacagguucugcaccggacgggccuuaguaacccagaugggcuggcuguggacuggguggguggcaaccuguacuggugugacaagggcagagauaccauugagguguccaagcuuaacggggccuaucggacagugcuggucagcucuggccuccgggagcccagagcucugguaguggauguacagaaugggugaguggugggcagagggguugggggagcccuagaaaacacccaagcccggacaaccugcaggcuccuggugggaacagucucuagacucuuaggauucacugcuccccaccugccagguaccuguacuggacagacuggggugaccacucacugaucggccggauuggcauggauggaucuggccgcagcaucaucguggacacuaagaucacauggcccaauggccugaccguggacuacgucacggaacgcaucuacugggcugacgcccgugaggacuacaucgaguucgccagccuggauggcuccaaccgucacguugguccguaugcuagagaggcugcccaaggccagcagaccuggggggcagggaucuaaaggguuuaggguggcaagaaggcaaagugugcagaaaccacaacccagaggucuugggguuucaauacccuggcacuucucugggaugggcccagacuccaggccucaauccagcuccuuagaggaacaagggcuauccccugugcagcucaggauaauggccugaggggugggcacaugaggacuuccugaagaacaccugugcuucacacuuccugagagaagcugugaccuacuccagagcagugguauggcugcuggacagcuaucgcuguugagccuuaggaagucguagaagcaucaggaccugggauucauucccaucucaggguugugaugggguuuaaggaagacaaguaggcacagaaccuagccuguacucggugcccacuacugcugugucucccauagugcugagccaagacaucccacacaucuuugcgcugacccuauuugaagacuacgucuacuggacagacugggaaacgaaguccaucaaccgggcccacaagaccacgggugccaacaaaacacuccucaucagcacccugcaccggcccauggacuuacauguauuccacgcccugcgccagccagaugguaaucgagcagaaaaaggggggaguggcaagccuaguccaagcaugaaaggccuguucucagccagggucagguucccuccccggcacugacugagcguuccugcugggucccgaacuuacagaggcuauagguccccuagcagcuucagucugcccugggcucaauguggggucucugacagccaggcccuaaaguaguagagagcccagagauuagugaguguggaccaagagcaucagaggaaacccugaaagcagacauauucaggguaggauagagauguaccaaggaggccagacauccuuuagaaggcuggaaaccauucccggcaggacccacccucacagucagagaagccagugggcagccaugacccuucaaccucuuucuccuggcagugcccaaucaccccugcaaagucaacaaugguggcugcagcaaccugugccugcuguccccuggggguggucauaaaugcgccugccccaccaacuucuaucuggguggcgauggccguaccuguguguccaacugcacagcaagccaggugaaguuccuccuaagaugcccaugcugcaacaccccaauccccugaccccacacuccuguuucccggcacccacuaaugccugcaccucuggcaugccgacacccgcacacuuccugccuaccucuuguguccucacggcaauccuuguacacugccaccuuauaaacaccucuaauacugaucucaggaggaccuagaguccucgccuucccaugcucucccuguacagacacccccuugucuggcuuuccuagguccauuguagcccugcuuucuguccagcucugccaccccacaaacucccacuaugucccugaaacguuuccaccccgugaaagaaagccuucugaguuccucauacccuuuccaaccccucuugcccaccuguccuccaguuugugugcaaaaaugacaagugcauccccuucugguggaagugugacacggaggacgacuguggggaucacucagacgagccuccagacugucgugaguguccucgacgcccccaagggauggagaccucaguggccuauuugcucccugcucuuucuuuuuuagugugugcgugcaugcauguguguauaucuaugugugugugugucugugugcaugugugugccugcauuugugugugugccuaugugucugugugucuguguacauguguguaccugcaugugugugugcauguaugugcuuuuguggaugugccuacgugugcaugugugugugcacguaugucugugugaaugugugucuguguguauguguauaucugugugugcauguguaugugugugccgugugugcccaugugagugcgugucugugugugccugcauguauguguaugugugugugugugugugugugugugugugugccugagugccugcaugugugcagugugcauuugccagugcaggcaugcacaugcuguggugaaauguaugacaguccggggaaaacucucagaaauuggcuuucucuuuccucacuggguucugaggaucaggcuuagguggcaacacccaccaggccaucuugcugaacccaucuccuacuccuaacacugagucuccuuucucggcagccgaguucaagugccgcccaggccaguuccagugcuccaccggcaucugcaccaacccugccuucaucugugauggggacaaugacugccaagacaauagugaugaggccaauugcgguaaggagcugccuagauaccaaccauuccuuccgcagcacuuggggguucagagagugaggaugugccagccugcagcagcuuucucucuaggcuacauuucugggcuuaggaccgcaguccacccauccucuacaagggacagggaggcaccugccugcccgcccugaguucccuccuucucccucucccucucccucuccuucucccucucccagacauucacgucugcuugcccagccaauucaagugcaccaacaccaaccgcugcauuccuggcaucuuccguugcaaugggcaggacaacugcggggacggcgaggaugagcgggauugccguaugugccagguucugggaagugggugggggacguagcuggcacacaccguuguugcccacugcuucccauagaggcgcugaguuagcucuauuagcgggggacaucagucacauuggacauuuccugguuugcucguaaaaacacugugcucgguauggacagucugcagauccaggcuggggauaaucuauuccuuccugacugagaccagggccaggcuuucuggggagcgcgugggggaccaaagcugugaggagauaaaggguaagguccucguucucuguuccaucuugcagcugaggugaccugcgcccccaaccaguuccagugcuccaucaccaagcgcugcaucccucgcgucugggucugugacagggauaaugacuguguggacggcagugaugagccugccaacuguagugaguuguccgucgccccugggccauccuuccucacggccucuguggcuccauuacccaggcagacagaccccucccucggcugccguacccuugcccaguggcucucugguggggacgacuccuccucacccaugccgaugccuugcagcccaaaugaccuguggaguggaugaguuccgcugcaaggauucuggccgcugcauccccgcgcgcuggaagugugacggagaagaugacuguggggaugguucagaugagcccaaggaagagugugguaagcccagccaucuugagaggauggguguuugggguucuggguagaaagaaguucagugguugaccucucugggcggagccucgacgugacccagcguggggcucuuguggaccccauagagcugacacgggaaggaagcuuccccugcagugcccaccaccucugaauccugcuccucucccucucugccccucagaagagaacugugcagaaucucuacccuccuguucaccugucccacccccccaaaucagcugccuuccccaaacacuuugcuggccuuccccagaaccuccuguagauaccacacggcaauuaucacugccugagccccagagcaaucucuuucggggggcaauaaccaccuucucucugccgccggucucacuugucuacccuagacucuaacaucugccgcccacuccaccccugaccgccccaauaucugccuccacaucuugccucccccagaugagcgcaccugugagccauaccaguuccgcugcaaaaacaaccgcugugucccaggccguuggcaaugugacuacgacaacgacugcggagauaacucggacgaggagagcugcaguauguccuacgccuuacccugccccaucauuuccuuucccaggccuuggcaucucccuccucagcaccucaccccuucuaacccccaccccgcgcaagaggguggccuccaagggcaaggggucaggcaccccucagccgcgcucuacccuacucuauguccuuguacuugagcuugugacauuucaucucaucucauguuucucuccauuuucacacuguccucuugggguugcagagguaggugucucugguguaccccuguuccugccagcucugccucugccuggagccccgcccaucccugugcugugcuuuucugcccaccguccuuaacuggccucuuccccagaccuggcgcuugucucgguggucuuguucuccccucccuccccuaagugaucuguccuaaggacaggaccagggacccgugcccucucccaugugucuguaccuaauaggauaagugugaguacccuccugacccagccagucucgugaggacagccaguuaaacacuguccgccauugguugagugucucaaucauuacaccagucggcuguggccucuucacagacggacguagggaugagccuugugcuugggaguuaguauuucugagggcuggagaugcccugugcccacccugcugggaccugucucuccucagcaccucggcccugcucugagagugaguuuuccugugccaauggccgcugcaucgcugggcgcuggaagugugauggggaccaugacugugccgacggcucagacgaggugaggagagcucgaggaaagggguggucucggaagaauuagggcaggaccccaagggucugauugggcugcugguccccaugcccacagaaagacugcaccccccgcugugauauggaccaguuccagugcaagaguggccacugcaucccccugcgcuggcgcugugacgcggaugcugacuguauggacggcagugacgaggaagccuguggcacugggggugagugagccccuucauccuggugccuccacccucccugccuuccccagcccacuguguggcccaguuuaaucuuuuaauucagccauuuguugguacugcaacaaacccuuauuaagcauauacugcaagccaggcauagaccuaguguuggagcaguagacaagacucaggcucacuccgugugcauuuuaugcagguuuuacccuguuguacuaauucuuuucaucucacuggggguuucuacccuccuuuaaucacucaguucccagauaaaagacaaaacuuauauuuauagcaagccaauaauauaccagagcuaggcagauauccacccucuaagcuauuuagaaucuacuuccccaucaauaacccugagauacaacuugccauguuccaucugagcagcucuuaacuccaauuggugagcccucuuggacauguuuucaugacucaccuaccccauggcaucuucucccucuccugguggucccugccucagacccccagccugggaauugaaaccccaccuauuucucuuuuguccagcuauaggcuguaggcaucuuuauucaccaaucagggauaacuugagggacaagguuacauuagcaucacuugggucccugugaaaaucuccugcucccugggggcaaccaggaccaguauuuagcaauaugauacauagugauacaauacaauacaauacaaagugauacaguacaguacaauguaacagauuuaacaucagcggugcucuaaccuugcuaaggaggcuagcuagguagagaucaugcagacgccuguaguccagguccacccaugccuuuuccaccucccacccaguugccuguguuaagaggccaguuccuacucaucuuccuucccuggggcaggcggugagucaggggcugcucuagccaaacaugccugggcucagccacuggaggggucaguggacaccugucagaagagaagcaggggucucaccugcaaggcagccuucugguucugccccaugggcugaugguagcaaccaaagcuaagucuccaaacugccgcacaucugugccugccacagacuauacuagacucgggugucccaccucaccuacucaaggagaacauccuaaaccccugucaacacugccccaaguagccucuccucccccuaaauaccagaggaagcacauugccccucugcccacugggcagaaaaugaagacgacugaguuugauucagugacaguuucugugaugacccccgggccucagucccacccacggugcaagugacagacagcauccugcagccgcaguugcauucauucuuaccccucuguucacccugcacccagugaggaccugcccauuggaugaguuucaauguaacaacaccuugugcaagccgcuggccuggaagugugauggagaggacgacuguggggacaacucagaugagaaccccgaggaaugcggugagauguagggaggcggggggcuggagagauggcuuggagguuggagguuaagcgcacuggccgcucuuccaaagauccugaguucaauucccagcaacugcaugguggcucaugacaaucuggaaugggaucuggugcccucuucugguguaucugaagacagcaacaguguacucauacaaauaaauuagauuuaagauuaggggucauccacagcaaggaugcuggagaccuggcuucuauacuccccaguggccagcucuucccuaccacuugcccccaacacugauuguggcucugucuccuggcuucuacagcccgguucaucugcccucccaaccggccuuuccgcugcaagaaugaccgagucugccuguggauugggcgccagugugauggcguggacaacuguggagaugggacugacgaggaggacuguggugagcugagggcaaugagccggggcugaggggaccugcaucuggggagcagacugcuauaaggcuuucaaucuggcaagaguggagcccuugggaaagguauggguggccuccuggagcccugagucugcaaggucagcacacacacccucagcuuggcgagcagccaggacacaccuguguucaugaagucucuguggauguacggguagugugcucuguauccagagccuaaagccucuccccuccccagagccccccacggcccagaacccccacugcaaagacaagaaggaguuccugugccgaaaccagcgcugucuaucauccucccugcgcuguaacauguucgaugacugcggcgauggcuccgaugaagaagauugcagcaucgguaggaccagaccugagagcagagggugggugggcaccaggggguguggcucaggggaaaaccagagggcagggcucaggggaaaaccagggggccgggcucaggggaaggacuccaccaucuguccuccacagaccccaagcugaccagcugugccaccaaugccagcauguguggggacgaagcucguugugugcgcacugagaaagcugccuacugugccugccgcucgggcuuccauacugugccgggccagcccggaugccaggguaggagagccggaugggagauggggcaggaaccccagcuccuagacucccccaugacgcccaguguaacccccagacaucaacgagugccugcgcuuugguaccugcucucagcucugcaacaacaccaagggaggccaccucugcagcugugcccgcaacuucaugaagacacacaacaccugcaaagcugaaggugcuagaggccggaagggccagaagggccugaaggggcagggccagaaggaaggguggaagggccugaaggggcagggccagaaggaagggugggcagggucgggccacaccagcuauaaaauggagcuggccuggaguggaacauucccaauggcacuucguugcucagacuuggaugcccagacucaagguacaccgggaugccaucccgagcaaagcaaagcacaggaaagguagaagguaccgccuggcuuucuggggaaguucuaugagagcaacacuccuguguggcacacaguguccccuccccucuccuagauugagaguauaguccgacucacagucacaugcacccaccugcauguucccuccaugcccugacacagcacugcaccuuucauauguccucacaccguacauguacaugguaugcauauacacacucccauguauacauacauuucucaugccuugcacauauccuccacaucucuguaccgcuucagcacuuaucagagucuguagcagaccuacaugcuaaccagagaccacaagauagaauucuuggaacuaucaggaagcagguaagagaagaacagauuucugaagggucuggucagucuggaucagcuuggggcacagguuagagcccuuggaucugccauuggcuccacccacaccggaaacauccccuucugucuaaaacaaauggucugguuagaucggaggcuacuguagugugacagggucuuggucaaaugugucccagggauggaacucgggcccuggguucucaccucuaccuuucaagcccaucugauagguggucucucucacuccggcaggcuccgaguaccaggugcuauacaucgcggaugacaacgagauccgcagcuuguucccgggccacccccacucagccuacgagcagacauuccagggcgaugagaguguccgcauagaugccauggauguccaugucaaggccggccgugucuacuggacuaacuggcacacgggcacaaucuccuacaggagccugcccccugccgccccuccuaccacuuccaaccgccaccggaggcagaucgaccggggugucacccaccucaauguaagcauccagccugucagagaugggguggaagagcuccgcaggacagaguguaggggcugagagggcagaaaacuagaagacaggaguggucaggucagccugcuaggcacagcuaacagccagagcaauaaguaguauuuggggcuggagagauugcucagugguuaggaacaauaacugcucuuccaaagguccugaguucaauuuccagcaaccacgugguggcucacaaccaucugcaaugggauacgaugcccucuggcacucagcagcauagccuacucugauaccucugagucaguacuggccaacuugcuuaaugcgugggcuuuacuuuauugacaaaaugaauaauagcucuccugggcuuaaguagaguucagagguggaaugugugaaacccuaggcuugauccucagcaacaaugaagauauaauaauaccuagucuucuaagcuucuuuauagaucuggcugcuuggguuuuuuuguuuuguuuuuuuuguuguuguuguuguuuuguuuuguuuugugcuaaauuugaacuaaagacuucauggaugcuagccaacugcuuuagcaaugaacuacacucccagcuucagacugcuuuuuuuuuguuuuuuuuuuuaauacauugagugugugugugugugugugugugugugugugugugugugugugugugaaucacauguacauaccacggcacacauguagaagucagaggacaacuugaaguuuguucuuuguuccuaccaggagucccagggauuggaacuuagguccucaagcuuggcagcaagcaccuuuacccacugagccacuucacugcccccaccacuuuuuaaaagugagaauuaacuagaaaaccaugaaaaugugccuggcaugguggcgcaugccuguaacuccagcuguauucauagcagaggaaggaagagcaagagaaaagggucagucuaggcuacacagugaguuccagaucagccugggcuaugagagagaccuauucaaaagcaaaagaaccuagaaacuguggucacgucaguguggggugacagacaagaacaggugggcagaccaaggagaaugggggugacaaucagggagacagaagauggcagucgcugaacauaugaccccacuuagauuucagggcugaagaugccgagggguaucgcuaucgacuggguggccgggaauguguacuggaccgauuccggccgagacgugauugagguggcgcaaaugaagggcgagaaccgcaagacgcucaucucgggcaugauugaugagccccaugccaucgugguggacccucugagggggugggcacggguccugggggggagguaucugggcuggugucccucaagacaggugguaggcucgacauccacaggcagggggcagagaccucaggcugcuaggcuucuccaguccuggcccuccuaaagccucugucggggacucccaguugaauagcuuuacuggcagccaagaucugggacccccugcaggcauagcccugcccauucagaugcuauuggcuuagcacauuguaguuagagcagaugaugcuagcaugggucggcagcugucuccuggggcucauugaaggggacaggguguuuccucacaauacccaggagcguccacaccaggccaggugcccucucuuccaucucacucugucuccuuggcccugggauccaacccacucucauuucucccuucccagcaccauguacuggucagacugggggaaccaccccaagauugaaacagcagcgauggauggcacccuucgggagacucucgugcaagacaacauucaguggccuacaggucccuggggcagggguaggguguggaaggggcagacucugaucauggcugcuucagaagucaccccugcgugcaguggggcgggcaaucuccagcagaucaggccgagggccaugggagugcuucccggaugggcggcugggagagauccuaugagccggguaggauacaugccguggauaccagacagagucagcucuguucucugcgcccagccuggcgugacagaagcugaucucugacagacagcauucucucaccccagggcuggcuguggacuaucacaaugaacggcucuacugggcagaugccaagcuuucggucaucggcagcauccggcucaacggcacugaccccauuguggcugcugacagcaaacgaggugagggugcuggcaggcuugguucccaucaugguccccaacaucaucaucaggcuucucacugagcucaaggaugucucuucagaagccuggcacccagccagcccgugagccugcgccuaccugaccauuuuauucacucuaccaacaaguaucaaguuguguggggucagcaggguaaaugaagggagagagagcuaaagucccccauggccccagaaaucuugggggugaugagacaauuugccaguggcagggauaguucuagauauguuaggucugagacgccuacacugacaggugucuuaaagacuggguccagggcccaggcgccuguagugacuuaaccuggcugucccugcaccccaggccuaagucaccccuucagcaucgauguguuugaagacuacaucuacggagucacuuacaucaauaaucgugucuucaagauccacaaguuuggacacagccccuugaucaaccuaacugggggccugagccaugccucugauguaguccuuuaccaucaacacaagcagccugaaggugcaucagagggaaaacccgggguguggcagggugggucagugauaaggagggugccgggcagugguggcgcaugccuuuaaucccagcacuuggaaggcagaggcaggcagauuucugaguuugaggccagccuggucuacagagugaguuccaaggcagacagggcuacacagagaaaccaugucucuggaaaaaaaaaaaaaaaaaggaaaauguucuaaguccacacugcucaacaucgaccccuuccaacacccacagugaccaaccccugugaccgcaagaaaugugaauggcugugucugcugagccccagcgggccugucugcaccugucccaauggaaagaggcuggauaauggcaccugugugccugugcccucuccaacacccccuccagaugguaugcaugcccuuuuccuggguaccugaggaucccuuaccuauagccucuggcuccccuuacccuugacccccuuccccuucccaugcucugaugagcucuuacugcagccccuaggccuggaaccugcacucugcagugcuucaauggugguaguuguuuccucaaugcucggaggcagcccaagugccguugccagccccguuacacaggcgauaagugugagcuggaucagugcugggaauacugucacaacggaggcaccugugcggcuuccccaucugguaugcccccaaccagggaugguccucucccaucauccucaccuggccccuucuaucgccuccagcauccacuucaaccccaucuguucgucaaggugccuaggaucccugcuauaggcccaggugguccccagugccauggucccacucacagauccucucccaccaggcaugcccacgugccgcugucccacuggcuucacgggccccaaaugcaccgcacaggugugugcaggcuacugcucuaacaacagcaccugcaccgucaaccagggcaaccagccccagugccgaugucuaccuggcuuccugggcgaccguugccaguaccgugaguauucaccucaaccccagggaaggaagaggggagccagaaagaacccaaaggagcagguugagaggauggaagacguacgcagaugagccaagcccaggcugugggugcugccucucauguuggcgcaucugccuaagccuccaggcauucaacacaaggaaugcuuagggucauccuaguguucuggggucugugacagggcauuaggaggcucaggagugggugggaguuauucauaaguccuggacccugcauaagguacuuccucuccacucccaaccacagggcagugcucuggcuucugugagaacuuuggcaccugucagauggcugcugauggcucccgacaaugucgcugcaccgucuacuuugagggaccaaggugugaggugaacaaguguagucgcugucuccaaggcgccuguguggucaauaagcagaccggagaugucacaugcaagugaguggggggucuugccuccacauucugcucugucuucuggccccgccccauccugccccuccugggcccgcccccucuccgggcccuuccggccccgccccuaucuugccccuccuggcccgguuccuguucuagcaucccagauacccuucugcaagccccagcuccagauuuugauuccuuuccacagcugcacugauggccggguagcccccaguugucugaccugcaucgaucacuguagcaaugguggcuccugcaccaugaacagcaagaugaugccugagugccagugaguuggccccgccccaucaaaucugagcaaaggaacaauaugaccuaugaccuccuaguuccugcagcuaaaauggucguggaggugaugcccacccacugaguuuugcuuucuugccugcaggugcccgccccauaugacaggaccccggugcgaggagcagguuguuagucagcaacagccugggcguaagugguggggagggcagggcugccacgacauagagcaagaagagccuuacaccucccaucucccuaggcuucagacucaguuucccgacuucucucuccagauauggccuccauccugaucccucugcugcugcuucuccugcugcuucugguggcuggcgugguguucugguauaagcggcgaguccgagggugagccacugggagucugagaaauucuggcuguuauuuuacaauccgauaaccuuaccaacaucacgguucccugacuccugccucuccccagggcuaagggcuuccagcaccagcggaugaccaauggggccaugaauguggaaauuggaaacccuaccuacaagauguaugaagguggagagcccgaugaugucgggggccuacuggaugcugauuuugcccuugacccugacaagguaugccagaggccaucgaaggggcuucuggaacaggaucaaaggccggaggggugggguuggggugaucaaggcaaccagagguguuacacagaagugggagcugggguauucuaaucauaugaaccuuuuuuuuucccagccuaccaacuucaccaacccaguguaugccacgcucuacauggggggccacggcagccgccauucccuggccagcacggacgagaagcgagaacugcugggccggggaccugaagacgagauaggagaucccuuggcauagggcccugccccgacggauguccccagaaagcccccugccacaugagucuuucaaugaacccccuccccagccggcccuucuccggcccugccggguguacaaauguaaaaaugaaggaauuacuuuuuauaugugagcgagcaagcgagcaagcacaguauuaucucuuugcauuuccuuccugccugcuccucaguaucccccccaugcugccuugagggggcggggagggcuuuguggcucaaagguaugaaggaguccacauguucccuaccgagcauaccccuggaagcuggcggcacggccuccccaccacgccugugcaagacacucaacggggcuccgugucccagcuuuccuuuccuuggcucucugggguuaguucaggggagguggaguccucugcugacccugucuggaagauuuggcucuagcugaggaaggagucuuuuaguugagggaagucaccccaaaccccagcucccacuuucaggggcaccucucagauggccaugcucaguaucccuuccagacaggcccuccccucucuagcgcccccucuguggcuccuagggcugaacacauucuuugguaacugucccccaagccucccaucccccugagggccaggaagagucggggcacaccaaggaagggcaagcgggcagccccauuuuggggacgugaacguuuuaauaauuuuugcugaauuccuuuacaacuaaauaacacagauauuguuauaaauaaaauuguaaaaaaggaaaaaaaaaagaaaagaaaagaaaagaaac

SEQ ID NO: 5803 - RNA, 1325 nt, Mus musculus
cuuuaggagagaggaaaauaaugugguggagugggcuuggauaacaaaggaguuuugcuugagacuaauaaucuccagcugcaaaaauaccaaaggggaggccaggcuggcuagggacgucauuucuugccaauuccuuacagucaggucugcugaaugggacccugccuggucuuuggggaggugaggggagcccagccaagggcagacacaugagaacagggacugucacugcccugcuuucccagaagugggagggaacgcaagccaggagagaggcucccacucagguuccccccaucuugaggcuuggccugagaauggagcagcaucuggaagcagggcaccagcucucugcaggcuucuuccucuuucccucuugccaaggguggaugggugagcagggccaggguguugccaguccuagggcugggcagugacucagggaagccugaggaaguuggagagaaagccauuugugccagcuggugcuaaggaaaacagauuugacggaugauuuuugcacacaugccaguggccccccagacccccgcagcgcccaccaaguaaagggcacagagcccuguugauuucggcugcccugcuagcugcccggggccacaggaaggucccuacuuugggacuucaguuuccuuuggagguggcccaguggguuucauuuuaaucugguuucucuauggugacucgugugugugugugugugugugugugugugugugugugugugugugugagagagagagagagagagagagagcacuugcauugagcuuucugccucuaugacccuuguccucuucaugcuucccugccugccccccaaaauggaacagucuugggaacccagaggacagaguagcuggguuugggaaugugucagcacuuguagggguaauaccucaucccuaugaccucuuucuccaguugucucagggugggguuuaccagaggggaccugaagaggaagccauuuaugugagccuucagugacuacuucccccgcucgcuccucuguccucaguccugugacucugagucagucgucccagccagccaacuucccuggaugacauguuccuauucccugcacccccucccacuauuaagaaacagcuccuggaucccuguggggaggaagggggguuagggagggguugagcagaguucaucauuauaccuguagcuguguggcagagucaucccuacagggcugaguccugauagugugggccgagcuucagccagaggcaggcaguaaaaagacggcuggcuaccugcuguugaaacagugcagauaaaagucu

SEQ ID NO: 5804 - RNA, 2692 nt, Mus musculus
guuuucaaauucaucauuguauucucuaccugccccaucuguuauccaagaaauguuuuccaaaucacugucagugcgcaugacccagaaaaucccaaaacuguuugccgggcaguggguuugcaccuucugaacuguaaucgauuccgccaguugucugcuggugucucggggcaccugugcuacacuagaaugaacaucuccucuuccuuuucucucugggcagauuuugacgaguguuccguguauggcaccugcagccagcuuugcaccaacacagauggcuccuucacauguggcuguguugaaggcuaccugcugcaaccggacaaccgcuccugcaaggccaagaauggugagugggucugccagugaccacagagccggggaccugcaaugcggcuccccagugaauagucgccucaacgguuacaagucccaacugcccuuucucugucccauccccagagccaguagaucggccgccagugcuacugauugccaacucucagaacauccuagcuacguaccugaguggggcccaagugucuaccaucacacccaccagcacccgacaaaccacggccauggacuucaguuaugccaaugagaccguaugcugggugcacguuggggacagugcugcccagacacagcucaagugugcccggaugccuggccugaagggcuuuguggaugagcauaccaucaacaucucccucagccugcaccgugagucacucagagggcagggaagcgggggagacgggcagagucugagaccaggucugugcuccuugcacacaggagcagauugauggcuauucuuccuuuucacucugagccggcucuuucauuucugguucagggcuaagggaugccucagcggagaagugucaacugagaaggccacgaauggucacucuccagagaccagggacugucccgucuuugaaagcagagugucauuagaugcagaggggcuuucccauacagaagcaucugcaggggggcuggggaaggacggacauuguuaaguagcagagggcagaggagccugagccuggcuugcuuugggcuuccaugugauuuuguuacccucaggaguauggccagaaaggacguccugcuguuggguaggugccaagucccugagccuacuuccugucuguggcagucaaugagacgaagggacgaaccacgggccacuggagcauuuaggaugugcuggccauucccaugcaggcuucucuucucuuccgaggcaacuuugcugucuaagcgugaggaagggugucacaggcuggacucacgcauggcugggugcagauccccucucgugcuguuacacaaacaaacaguaauugcuucagagucaacagcuggccgagucacauuccccgaaaagccacacagggcugccgggaggggucuggccugugguugaucuguccccagcccucagacauagaucucugaccuugaguaaaccagagcuccccaccacaacuuaguucccuaaacugcguaaugggcuguuguuacucuguccagaucugauaaagugcaaacuggugguaaagauugccuugcuaaugaggcugagggcaaugaacuguggauccuauagccuuugguucuuaguuugguuugguuugguuugguuugguuugguuugguggugcucgcugacagaugcuaagcaggcauccuacggcuggcuagauccccgcuccuguaguaggucuguaagcucuucuucuaggccugugaggcucccucgaagaaagccaaggucccaugagguuauaaaggauucaguuugauugaggguccuuucaggggugggagagagggcgaugguggaaaacagagcaaaucuuccucucuguggccucaggauacugcucagacaucaaccucuagcucugcaguuaucaguguccaagguucaccugugauugggugucuguccuucuggagcgcacagcagagaacugccagacaccuuugggauagguagcucaaggagcccugugugcugagacuggagacaacuacccugccuguguuucuaguucaccaucccacucaacaggcgugcuugggcaaagaggguuagcaauggcagccuugccucggggccagacauggguauaccggguagguggcuaugaugugcccccugggaaccuucucaacuucugcccuggccuggcuauucuuccccaaagaagcaggaaguaaccuuggguagcgacaccccucccuuggcaaacagauuugccuugccuaccaggcuucaggacuucacugggccucuggggcagaguccaggaacucuaucuggaagcgaccaaggugcuuggagaaaauccuuucaggaggaaugauuggguuccauuugccccagcucccgucccucccuaccucguccccacccccacuccugacgccagagugucuggcugucacccugaggauggugguuugcucacaucccacaaacuaauuaugggcccuggcuugaggaugucggaagugucucuguaacacccucccccaccccugguacauccccuuccucaggaggaggccuucccuggggucagggagcuccaggggccccgguuacauaccugcacaggggcugcuguucuauaguuaguucucuggagaaugaaggaaaaau

SEQ ID NO: 5805 - RNA, 18826 nt, Mus musculus
cgucagagcgccagggagggaccugggcagacagagaagccggaaacagcaggccggggcagccaggguuuacagugaagaaggcccggagacgagugcgugcgugccuguguguguguuugugugugugugcgcgcgcucgagcgugugcgcgcgugccugugugcauaugugugugugugucuguacacauugaguuuuuagggccagcccaggacccgcuggacagaccuacagacccauggggcuugguagugcccucugagagagggagaagauagcagcggggcugcugaggugaggggacgucugcgaguagggaagguuaugggggggcuuugacgaaccacgagggauggauuuucggggccucucggauccuccccccugggcggggcaguugguccccugaaaauaguuucaucugggguuagcugacggcacuggguuuuggcaguuuccaacuuucgaaggacucggguggguacaggccuccacauuccgguccccaacgugucgcgucacuuuccccaauccucagcccugcgccuccugggucuugggacagucgcugggcagaggagaagaaagguucucuggguugggggacauggcugccuuucccuagaaguugaugcuccaggguccccgagccuguccaaccccuagcugcugcccgcuaaagguuccuacucaggguguggcuggagggugagagagacccagauguagaucucauggugccccagaggagggggacuuucccccucacuuuuuuggccgcaguaaacccugagauuuccccguggagggcagccggcuggggguuaacccuccucaugcugaccuggcuccaccuccucccacccuuucccacccccaccagcgccgccaccgucauauauacacgcacauuggacaacucagggaagcccuugacuuuugauauuggggucacacggccagcggacucggaaugcgggaguggaggggauagauuuaggccaccaagcuuacgaagaagcuucuagguugucgggcuuccccuacggcggggagggggagccuggaagggaaagcucgccccgccucuugaaguguagcuccgccuucccacccuaggggacugaucucaagaaaggacgguccuuguccuagcccgaccuauagacccugcaacguuaccggcagcucaggagaaaaauauggcuuaauggcgucuggggugggggaaggaugagacuugagucacucuacagggagauuuagaggaaauuggagcuguuccuggcuuggcggucccaguccccaguaggguaaggauagggccaaaggucuggaauccgaacauuccagagacugggaggaaaagggaacagaauccucucuuaaauuugaaaauaagacaaaugugacucuucgggaugccccacccaacgggguagacaguuuuagagcaaagucugguuggaggacccuaugcaagaguugaagacucugccuuugggagugagaacucagggagugggagagcaaccgggaagaugguuaaggguaggcaauguccugugaaguggccuccuucucuucuauaugggaguccugugggaguuaagaggcucaaaaggcaggaggaauuggggagacccagggaguuuccaucccaucuuccuccuccuccucucugagaggucauuauaaacugagagccaucccucccaucaaccacugagccaucccccucaacccagcccacucugaggccccugagagacucaggagccagcacucugcucccucucccuccucuuucccugccuuucuucuucucuuccucuggcuuuuuggcugucuuguugucccccacuuccagacugaucaguccucauugcuucucuggucuucccucccuuucccccuucccagcucuuccuguccuaucuguaaggugaugggaucucugagcuggagggaauucuaacagcacaguauagugauuaaucccaaugaugaguaagggccagauuacuaacuucuugcccaguggccuuggacaaguuaaccuuccugagccuuaauuucuucaucuaggaaaagggauaauuguaaacuuuaaaauaggccuggagagaugguucaguggcuaagagcauuggcuguucuccugaaggaccuggguuugauccccccaacaccccaacacacacacacacacacacacacacacacacacacacggcaacucacaacuguuucuaacuccauuucuagaggcacauauauacauaggcaaaaccauuaagauaauaaaaagcuaaaaauaauauugugagggggcaggaauguaacucaggaaagagcacaauguagcaugugugaggcccugggagacacuugcacacgugcacacaugcaugcauacacacguguauacacacaugcauacacacgagcacaggcacagacacacguacauacacacaugcgcgugcuugugcacacacacaggcacagacaaacaugcacacacauauacacacucucgugauugcgcgcaggcaugcgcacgcgcacacacacacacacauacaugcacacacaguugaguaugguauaccuguuauggaauagugcauaaugacuuguagacauuguuauucuuccaccaucuucaucaccuagcuuggugacuuuugcagugcugggcacugaacuuacaguuucacaaauacuaggcaggcacucuaccacugaggugucuuucaaauuuccucauuguaacucuuguuacaguaugaugcguaauuuauuauuguugucguugaucucuuugugugcccaguuuacauauuaagcuuuucauagcuguauaugggagaaaauauagaagacacagggguagaugcugcaagcugucucaggcccuauccauggucuugggucagaaugauguccugcaugcucuuuucagacacuggugucacauagauuaaaaucuaaaguuggagucaggugugguggugcacgucaguagucccagcccuugggaaguggagauaagaggaucaagaguccgaggcugaccagucauuguggugcaugucuuuaaucccagcaggcaggggcaggggcaggggcaggggcaggggcagggggauuucucugaguucaaggccagucuaagcuacauagggagcuccucuaauguacucagagcaccugccuaccacauccaagccccugaguuuguucacagcaccucuaaaaaauuaaaauuguuuccugcuuucaaguguuuaaaaagagaagagguauggugacauguacccaaaucucacuugaggggcugagaagaaaggacuccuugaguucaggaguucaaaggcagccugggcaacauagccagaaaaucuuaagacaaaaaauuuagaagguacccuauucauucagccuucuuuuuucaugauaagaagaucaaacuucauagaguacagucuuuauacccccccagaaccagaccagguccaccugucuccauggaccuugcuccuccccuuccguccuguguccucuuguccccucacugaccuggcuguagcucuucagcuugccugugucugccacugaagguuuugccuuguuuuggauacugcugccaagggagccuguggcuucaggugucuuggaaguggguaugaucaaauggcggaaggagaauauugugaugcaccacuuccuaacucaacucucugggacuuuagcuugaaccaugagaaacuagaaagaaccagaagcucuggaaagauccagcauucuaagcccagcaagacugaaggagguucucagcaaggccaucuguauggaggagcuguggcugucccagcagccaggcugcuuucuugggagccucacugaaaggccuuguucuucuuccccaggcacccuguauaucccagaucaugucucuguggggccuaauuuccaagauguccccagaaaaacugcaacggcucuauguugacuuuccacaacgccuacggcaucuccuggcugacuggcuggagagccagcccuggugagucuuguuccgugucuuccccgucuuuugagagcccuuguugcuaguagaauucagaauugaggacuuguuaguguguaucaaauggccuagacuuggugggccguacauguuaacauguagacauuguaccucuuagaaggcuaaaccaggaagggaagucagggcuggaauagaacuuuucuuacaagccagcagaguggggagcaggggucauggcuggcgacuacagagaaccuaccuagauagaggagagagaaaagaaaccugacuuccuugcuauaacuugagucucagaagcauuaaagaaauccugggggcuggcgagauggcucagugggugacugcucuuccaaagguccugaguucaaaucccagcaaccacacaguggcucacaaccacccguaaugagaucugucagcuacauuguacucauguauaauaauaaauaaaucuuuaggccagagcagucagcaacugagugagugaaguugaccggagcgagcagagguucuaaaaauucaauucccaacaaccacauugaaggcucacaaccaucuguacagcuacaguguacucccauacauaaaauaaauaaauagaucuuuagagaaguccuggccugaggcauccuaauccuacuuuccucacagggaguuccuggucgguucagaugcuuucuguuacaacauggccagugcccuacuuucugccacaguccagcgucuucaggccacugcuggagagcaggggaagggaaacagcaucuugccgcacaucagcaccuuggagguagggcaagacuggaagggaaaagguuggguugggucaugguagagcuggaaagagcaaacuggucacaugguagauguugaaagcacuugcuauuccugugguuaggugcuagcuggcaugaagaucgguuuuuaaagcaagcaaauguauuaaacuugagaucuaugcuuaugcucucuaacaguuugcacaugaaugggggcaaggaauuggagggagggagggagggagggggcauggguaagggaggcuaacagcucauuacuaucaauucuauagagcaucuaucagagggacccccugaagcugguggccaccaucagacaaauacuucaaggggagaaaaaagcuguuauagaagagguaaugugcuacccgacuuccuguguguauuagucacgguucucuggaggaauagaauuuacagaauggacacacacacacacaaaagauuuauuagaaugcuguauagguuguggcccaccuaaugcaacaauagcggucuaccaaacagaaggaccaagaauccaauaguuguucaguauaugaggcuggauaucucaucuggucuucaguauacacuagaauccugaagaaguaggcucuaaugccagugaaggaauggacuggcauugauagugagagcaagcaggcagagagggcaagcuuccuccuuccgcauccuauggcuacaagcagaagguauggcucaaauuaaagaugggccuuuccacuucaaaagaccuggauuaaaagugugucauuccuaaucccagcacuugggaggcagaggcuggugggucucuaaauuccaggacagccaggguuucacagagaaacauuguguccaucaacaaaaccaaacaaaugaaaagauguaucuuuccaccucagugaaggaacaggugugggucuucccacuccuuuacaggugugcagucauuuggguuuaauuaguuccagauacagucaagcugacaucuaagaacagccauagcaaguccacacccugucaccuugacacacaaucaccuccuuagaucaugcuuaauuuccaaaugaaaacaauaaccaggucauaauuacgccuaacauaacuauucaauguauaaucucaaacacauuauauucuuaaaauagacagugacaauaugccuuaaggaacauucuuuuaguaucuuaaacuuaacuauuacagccacugauauucucuuaauuaauguuacaauacaagauaaagaaauugagggaagaaaacacaaauaccuauacaaacacauuuuuuaaaaaauaugacagaaaaacucaugucaauuauaauucuuauuucuguaucucaucaccuggccuuagcugguuuggcuuuuuuaaaaguaauuuguuauaugugcauuugguguuuugucugcauguaugucugugugagaguguuggagcuccugaaacuggaguuacaaaaaguugugaucugccauguggguguugggaauugaaccuggguccuuuggaagagcugccagugcucucaaccacugagccaucccuccagcccccuuagcugguauuuacaaccuuccucuacuaccuauucugucuuucuuccacuuuuagcaaucaccucagcaggucuugacauuuucuuccuggaggacugacucauaucuucauuucugaaggaucuguacccauugguuuucugccuggauucggugguuauaauuucccacuggcuuuaauuacaggaaaugguagcaccaagagaccaagagaugccauaaaacagcaguucucaaccugugggucaugaccuucggaaaacaccuauuucuuuucuuucuuucuuucucuuuucuuuucuuuucuuuucucuucuuuucuuucuuucuuuuuguuguuguuguuguuguuguuuuguuuuguuuuuucagacaagguuucucuguccuggaacucacuuuguagaccaggcuggccucaaacucagaaaucugccugccucugccucccgagugcugggauuaaaggcaugcgccaccacaccuggcgggaaaacaccuauuucugauggucuuaggaaaugagacacuggcucaguaacaaaaugacaguuaugagguagcagugaaaauaaauuuuuaguugugguuccuaagaccaucagaaauaaguuuucugauggcuagaacccacagauaggaaaucuaugaccuaaaggauugccugcacuccaggcaaaaucucucuuaccuccuuuguagagaagcaauccaauguccccaugguaaucuggaucagucgucccuccuaaaacucuuauccuuucuuagucugugggcuucagggcaucagaaacccaaaguggccaaggggaagucugagcaauggaguauuugugugucuccuggcaagagcgcucccuccucuggaaccaaaacuccuaggccagcagaacuuaaggcugcaggaacaggaagcaaaaaugucucuacuagguugcuaggggugauugugagugcaacuauuuccuuuuccaccccuugauuccugggcccacagauccuaguccaagccaugaaaccuaggaaaaauuuaaacucggaacucaggacccaggauaaccaaaggaaguucuugggguuagaguaaaccccaaaccaaguuuggggaggcuucagacagaaguuaguucugccaggagaaaggucuuaccuugagaaaguucugaaagguuuggaaaaacugccaauggaacaagaaaaacaaauggugucaacuucuguggagggguagagguaaacauagaggaccgguuagagcagcucaccucuugguaucuguaccccguccccugcugccccaucccgugcaguuccgccaccugccagggcccuuccaucggaagcaggaagaacucaaguuuacuacagcccucggaaggcuucagcaucgaguaagggagacccggcuucuccgagaaucucugcagcaaggggcuaagacuggacaaggugggguucagggccucgacgccagaggguuugggggaggguuuagaagugaucuuuucuuggaucucugccuugagugaggcucuuuaacaccccugacuucugcuccuguccucagugucucugcagaauuugauagacccuccugucaaugguccugguccaagugaggugaguaauggacucaguugcugguaaacccgaaggauggaguugacugagcugugugaggggacgccagggaaguagggaaaaguccuccucccaggugucccaggagaaaacaacaguggcccuggcucaggcucuuuucugcucuuaggaccuggccaccaugcugcaggggacugugggggaccuggaggccacccaggcccuggugcugaaaaggauucagauuuggaagcggcagcaacagcuggcagggaauggcacacccuuugaggagagccuagcagggcugcaggagagguaaggacagggcuggcagacagggagcauacagauuauagguacccacugucucugcaagauggcgcaugggcggggggggggggggcgagagagaggaagcugaggacagggccaggacuuacaggagccaguggcugcgaggcugugcauggugcucacacagauccuucacugguaucucagcugagagagucauccaucauuucucucuucaaguccaugcccagaggaauggggaggcuguccuguuuguucuuaagacauagccuuacaguauaagauguccaggcuggccuugaacucacugcacgccuccugucucagccucccauguacugaaacuacacgugugggucaucagaccucacuguuguugggcaauaacacuuuccaguuuucccuaaagcacacagugccucugguaguagaacugugagaagagaccccugggcucuccacagggagucuggacccugucagugaucuccucauccagggccaagacagguccuagaagcgccuugcagacacacccacagcuaccccauucuugcucacacaauagcccggugcucucccuggguuugggcugaagaaaacaacccaaaaucugugcucccugacaaccauccuggccccaggugugaaagccugguggaaauuuauucccagcugcagcaggagauuggggcagccaguggagaacuggaacccaagacccgggcaucgcugauaagccgucuggaugaaguccugcgaacccuugugaccagguauauaccaugagucccuacuugacuguaaguagaccccagggagugaagggguuuguaaagaggggacccaggaucuaacacugcugucucccucucacgacuccagcucuuuccugguggagaagcagcccccgcagguucugaagacacagacuaaguuccaggcugggguucgauuccugcugggucugcaguuucuagggaccucagccaagccuccaauggucagagcugacauggugacagagaaacaggccagagaacuaagccuggcccaggggcccgggacuggaguguaaguagagacuggcccuggguuggagaagggucugaugaggugauaggaguugagggguuggcuucauaaagaauggaaccuggggaaagagaccucuggagcauggagacacuggacucugacuaguuaaggcagaggaagggacuagaucucuucaaggggaaucaucaagauuuggccaagauggagacuucucucuuaaaacccuagagagggaugccaacaagauggggcuugcugagugagccugaugacauggauuuaauuucuagaaccuauguaaagguggaaggagagaacugacuccuaaaaguuguucuuugaccucuauaugagcacaccccaucacacacagguacaacaacgaugaugaaaguuaaaaaccaaacaggugguucaagcgcagugggaagacagguucuuagcaugccagggacugggcucaaugcuagcaguauauauaaauacacgcagagaggaggggggacaugaguagggucauagagagccggggccagugacagcaguggucagcaccaucccccaaaggcccaugcugcucaccucggaugaggccgcucacacucugacuccccuggcagggagagcacaggagagaucaugaacaacacggugccccuggagaacagcauucccagcaacugcugcuccgcccuguucaagaaccuggugagaggcuuugguugcggguguccucagacuguguggcuaacccuucuucucggagaggcuguugggggcccagggaggaagcuaucaacaucccugcucucucuugcuccccugcguucucccccgcuuagcuccugaagaaaauaaagcgcugugagcggaagggcacagagucugucaccgaggagaagugugcugugcucuucuccacgagcuucacauugggccccaacaaacuucucauccagcuucagguaagcgcagaccucaccagcccugcugcagcccgggacccacucuuccucgccccacuagagcccuggaucccccuccugacugccucauagcucacuucguauccguguuucugggauagccgacagaggugggaggagcaagaaccggaaggacacaucagggaguuauguguguagcagccaagcuugcuguugugguggugguuuuguuuacuuugucuuguuuacuuucucgaggcaaggcagggucucgugauguagucuggacaggcucuagacucuuuuccuccaaauaucaucauuacugcgagggggagggggugcaugcacaagucacggugcacguguggaggucagagggcaaccuuuccacuuuuaucuggguucuggagguuuaauuugggucacuaggcuugugccgcacacauuucccccacuaagcccucuuacugacccucaaacucuuuuucauuuuguuccucuccuccccugcccuuccuuccccucuucguuuuuuguuuuuuguuuuuuuauagccuccuucuguagcccaggcuggcauuacaugcaauaucuugccuccgccucccaaaugcuagggaguauagucuuauaucacgaaacaucacucucuaacucuuaucaagcacuuuauauacauaggagaucagggcacuauuaucaaugauauacacauauacauacuuaugcacauauacacacuuguacacauauacacacuugugcacauacacacacuuauacacauacacacacuugugcucauacaucaagaucuuuuuauagaacagggcacuguuuccagugauaugcaaucacacacaguauggugguuuugggcuuaguuaggguuacuauugcuaugauaaagaccaugggcaaaagcaacuuggaaagaaaaagauuuguuacaucuuacaguucagguaacguccaucacugcggggggucaggcaggaaccuagaggcaggaacugaagcuggggccauggagggugcugcuuacugcuuguaccuccuggugugcucagccugcuuacacauacagcaggaccaccugcucagggguggccccacccacaaugaucaaggcccucccacaucaaucaccaauuaagaauaugcuccacaggcuugccuuuggaucagcaucacggagggcaguuucuccacugugguucccucuucucagauaacccuagcucaugucaacaaaaacccaacuaggacauguuucuagauaacaccauaagauagguacuauugcuacccucaguuuacugaugaugaccucgggucauagaauagguucaguaguuugcccaggucacacagccucuaggcauugggacuuguuugagccugaaagucuggcuuccuagcacugaguugcaacuguuucucuauaccgcugcccucacuccgucucacaaaguguccagugaugcacuaccaacccuuaacuaugucaugcgaacuaagggcuccccaguacacuggaguaacacucagcaaucugagggcacuucugacuccagcaaggagaaacuccucucuucacccugucuguaggcccugucucugcccuugguggucaucgugcaugguaaccaagacaacaacgccaaagcuaccauccuaugggacaaugccuucucugagaugguaaggaaagacccggagugggagacaggggcagcguggguucuucuguggugagauaacgggcuguccuggcugguggguggcaggcauguuaagucuuucuugugggcuugccuuucugcuucuacccaugcuggucacaccuaacagcugucacaccaugacaccacagacaacggcugagaaaucaugaugucugugagccagcucggagagcugggaagagcggaggccuuuaggaggaagacuggccaugcgcucucucuccguuuacccaggaccgagugcccuuugugguggcugagcgagugcccugggagaagaugugugaaacccuaaaccucaaguuuauggcugagguggggaccagccggggacugcuuccagagcacuuccuguuccucgcccagaagaucuucaacgacaacagccucaguguggaggccuuucagcaccgcuguguguccuggucacaguucaauaaggucauucuccugcuuucaguuucugaccccagcucuucacccuccagucacucaagagcuccuuugccucugcucguuguguagcuuaggcuguccucagacucaccagauagcccaggcuagccuugacuucacaauccucccaccucagucuccuacagaaaugcacaggaaugagccaccagguccgacaggagccuguauucugacuuuuauuuuauuuuuuacuuuuuaagauuuauuuauuugcugggcagugguggugcaugccuuuaaucccagcacuugggaggcagaggcagguggauuucugaguucaaggccagccuggucuacaaagugaguuccaggacagccagggcuacacagagaaccccuggcucaaacaaacaaacaaauaaacaaacaaacaaacagauuuauuuauuuuauguaugugaguacacuguugccgucuucagacaccagaagagggcaucagcucucauuacagaugguugagagcgaccacgugguugcugggaauuggacucaggaccucugaaagagcaguuguugcuuuuaaccaaccgcugagccaucucuccagccuguauuuccaacuuuuaauaucagcuacuguauuuuucucugucuccaaagugagguggcucaggacugagucaguuacaagaacagggaaaggaguccaugucugugaccauguuaucaucacgcaagucaccgaaugaaugcuaaagucacuuuucaagaaacaacgccuucccuuggcucccacuuuaggcuuuuccucuuucaagcaaacaaaccagagggugggggagaagaagcucauguggccagagaaagcaucgcugaggagaacaggacagcaggacaauuaucuuccucuggaugggccuuuagcaggucccacuggggaugcgacaauaggcugcaggcuuaaaccuccacccugucccgccaguaguguggaccuaaggaagucacuugccuuuccagcuuccauuccauugcucugauuguuaugugauauacagaaagauuaaaaaaaaaaauggggcuggugagauggcucaguggguaagagcacccgacuguucuuccaaagguccggaguucaaaucccagcaaccacaugguggcucacagccauccguaaugagaucugacgcccucuucuggagugucugaagacagcuacaguguacuuacauauaaucaauaaaaaaaucuuuaaaaaaaaugaauauacaggaaagccugaaggagugccuagggcgguugggguaagcaguugccauugaugggccuuagguccacuuuggucuucaacuguugauccucagacucucaaagccccaugcuuguuccagcucagcccuucccccacucaccucuguacuccuccccacuucaggagauccugcugggccgaggcuucacauuuuggcagugguuugaugguguccuggaccucaccaaacgcugucuccggagcuacuggucagaucggugagucccugccucagggaccaaacgccuauggcucccucuucacacccagaacccaacagccuuguccucuccuucacucugaccaggcugaucauuggcuuuauuaguaagcaauaugucacuagccuucuccucaaugagccagaugggaccuuccuccuccgcuuuagcgacucugagaucgggggcaucaccauugcacacgucauccggggucaggauggugagucaccacaauccucuaacuccaugcucucuccuggggugggagggguucugggggaaggaaaugccccggcuacccuugauguccaccugaucuucaggaacuucuuccuagcauuuuacuucccaucuuccugugguauaaccuucaacuccuauggcaauggagacaaguggguccccuucacucuagccuucacccuaggccuucucucaccugcccugguggguugagaauggaucuugugauggggcuggggaaaaagaaauuuggacgggaggacacuuagagucucauuccucuccuaggcuccucacagauagagaacauccagccauuuucugccaaagaccuguccauucgcucacugggggaccggauccgggaucuugcucaguuaaaaaaccucuaccccaagaaacccaaagaugaggcuuuccggagucacuauaagcgugagcaggcagcucugaaaccuccugucacacacugucucccugcccuggcuguugcccuuucugucgguugucucucuucucucccauuuuguagccccgccuccaccugcccaucaaucuucuucccucccucucucccuccaccugcccaucaaccuuccucccucccuccaccugcccaucaaucuucuucccucccucuuucacuccaccugcccaucaaccuuccucccucccuccaccugcccaucaaucuucuucccucccucucucccuccaccugcccaucaaccuuccucccucccuccaccugcccaucaaucuucuucccucccucucucccuccaccugcccaucaaucuucuucccucccucucucacuccaccugcccaucaaccuuccucccucccuccaccugcccaucaaccuuucccccuccaccucuguggcagugggauacuccacaguucuccuuuccuuccugccacagccgaacagauggggaaggacgggagggguuaugucucuacuacuaucaagaugacuguggaaaggugaauaaacgguuaguggguggagacugggggccguacuugucggcaggaaggagugaccuuugucagucacgugugcuuccuucccuccuguagggaccagccccuuccuacuccagagccccagaugccugccauggugccaccuuaugaucuuggaauggccccugaugcuuccaugcaacucagcucagauaugggguaaagagcuugagagacgggaggggacuggccugugcgcaggcuuucagcguagccagccggucggccgagcaagcuggccuuuucagacugaauuuuccuuucucggaggcagggugugggguuaucugggagggcucgcacuggaguuuguuuucuuuccccagguauccuccacaguccauccacucauuucagagccuagaagaguccaugaguguacugccaucuuuucaggaguaagucagaugcgguggggcagcgucccgucacaagccaugaauugccaggcuuugcggaagcagcccaggcugaacuccguccuccaugugcuugugggagugaugucuaagacucagaaggccaggguuagagguccuagccuccagcaauaacgauaaugacguuauggugaagguuacacgaauucauaauguguguaggcccgagcugagcgcuuacagcaaacacugcuagcauauucucucucaccugugaaauuuacagcaacuuauuugccguauauuugcuguauugcuguggugcuggggccuaagcucgugcuaaggacugaacaugugccaagcgcgugcucugccacugacgacaucccagcagcuggggugauuuauuauuuauuaaucuuuuuuaauccuaaaaaugaugcagacuuuuuccuuccucgaguaccuuggugguuucaucagcucuaucugacuucuaggguuugauguggggugggccuagggaacagaauaccuaucguucagacuggacacacuggaaacucauacuauuuuacgggggggaggggggcggggggaccugaucucagagcacagucagugagaugcuaagucaagacuuagcauggcagcuuguuuccugacucaugucuugacuuuugaauucucauucucucucuuuccucucucucucuuucugcacccgcuuuuccuuccugcuuccaggccucaccugcaaaugccccccaacaugagccagauaaccaugcccuuugaccagccucacccccaguaagugacaaagccauuccuggccccacccucucuguucuucccuugccuaccccaccccuccuaauuuccucuucugaccccuggcaggggucugcugcagugccagucccaggaacaugcuguguccagcccugaacccaugcuuugcucagaugugacuaugguagaggacagcugccuaacucagccugugggagguuucccccaaggcaccuggugaguagcaacccgggagugagggcugagacaaugggugcugugccugcuccccuacuucucccuccucuuugcagggucagugaagacauguacccuccccugaugccucccacugaacaggaccucaccaagcuucuccuggagaaccaaggggaggcaggaggguccuuaggaagccagccccuccugcaaccaucuccuuaugggcaaucagggaucucacugucccaccuggaccuaaggaccaaccccagcuggugaucccagcuggagaagcccagaaacaaagccucuucugucucuauggaccagcucuggacaccugcucaugcaggugccuuccgucucaacuguuccuuggucaagagaaaagaacuggcugggagaccaugugguguauggaacugcugugcucuguccuuccugccauaucagggccccccuuuuccagcacugggugcaaagggaugagugggguguuaaugcucgaaugugauacaacuguaucacaacacacacgcacacacacauacacacacaccagaacuguguugagccagggccugggacucaacauacagaaacauagagacauugugccaaagacagagggcauauaggccuagggcauugaagcugggcucaggugacucugggagggagaaaaaggaaaaaguggguauacagucacuggugugaguucuacccagauuuuaaaaaacaagacuccaaagcuccaaauucuugcaaaaaaagaugccuagugacauuugagacugcauucuaagagcuaagcuuguguauagcuguaccaauguuuacccaagacauguuaaccuauagaagucacacaucacuguaugaccgcacagaacauguaucuucugcuuuugccagugugaccuuaacauaucugaaaggcugagacauuguauaagacagcaacccaguaucauuuggggaguaacuauguggcugugacaugcauaaagcucuagccuggguaacuugaugcuuccaguguuuccuagagccugggauauaaguagggaugcagaccucucuguguaaacucccugggcguugaggcccucaacugcugucucuuguacuuuucuguccacugccagcucugccccccucccccggcucuuacccaguccuuuuucccucacuggaggggaagggggccauggauccuaagccauaaaauaaauuuuauuccaaaauaacaaaauaaauaaucuacuguacacaaucugaaaagaaagacacgcuaaguguucgacaggugcugcaguccugccggcugaggaggcccaggguccaacccaggccucuaaggggcugguggagggaacuucggggcacccucccacacagugcugagagaaaggucugcggggaggggggagauaagaacgggugggcaaacugcagcacuuguuaaauuaaagaaacaaacuagaagcacgaaaaauggggauggggaggggagacccaguuuucccaagcccccagucucagagugaagguuccacuguaagucgcuagaccuuccuggggaaguucuuucuccguguccaagugaaguaguucagcugcucacaccacugcuggccaccuggagaauaugugugugugugugugugugugugugugugugugugugugugugugguaugagagaaaggagagccccagcaggcuggaggcaaaguccgugccccuaagccgggugagggcacaccuugcaccguccuuguguccucuggccaggccccugccuguuauugcuugaagccccauaguccugugcccauggggcggaugggaggcagagggcagcagaaggauccuucuaggguaguggcgagugcaaggauggagaaugugggggucuaagugagccagaagucuggguccugggucugagacuucccccacuuucacugccggcuggcuucugccuccacuuuaacgcugcuccugcggcccuccaccagagcaggaugaggucccggggcagggcagcgguccagcaaccccuccucgaac

SEQ ID NO: 5806 - RNA, 7653 nt, Mus musculus
acucucacacucagguucucaucgggacccauucugacccacaaagggacccgggcaagugucucagcgaaaucuaucuucucuccuucccuccuggucccaaacacgggagccaaggccucagauucggcgucucuccaucgucuucuuuccuggaccaggaccaggcacacaguaaguuccggcuccccggcuucacgccccaagcuuccccacccccuaccgcggcacuagcugcccucccucucuccagaccccaggacuuagcgccacccuaaagggaccugugggagggaggggggcgcccggagcaaaggcagugugggcgaaggaugugcgucacggggagcgugggcaggggggagggcgggggcacgaggaaacccggggccagcggcuggcagcccagacuccaaaauaaccggacgggggagugggggaggggcgccgcacacauugaaggaaaggccgucuagucgcgcccuccuuaguagcaaagggucgggagaaggacccugcaccuuccuacaaucccuaguauguuuggaagacaaaaaccugagcuauugaaaucguuccuccuaaaguacccaucccucuucgggaaaccaagagaucccccuccucgucagucuggaaugaaucuggaauguagaacccgccccgacccacaccacccacgcccugcuggggcaagccacucacaagugcugagcagaggggcggagccgagguuucaaacuagagggacguuuccucuggccagucggccacgcuuuccacccccacccucccuuuccccaaaggccuacacaacccccgcgugcccaauaccccccccccaacccuccuagccgugggcguguaaugggaaccagaugggacuagaagaaaccgaggggguugggcuccuugaaggcgguccuccacgguggacagucacguagacuacucuuagccuuuugcucagcuuccacuucacuguccagagagguucaauaacucaugaccucagagaagguaccugccuuuuccuggcuuugcuaucuagucguccaagcaguaaggccuggccaucagaaaagagggugccacgaaaacaugguaaacccauccgggcucuaccuagcaaccccgacgugccuaaccaacgcucaaguaaauaguagauucuaguauaacuuacgaccaagguuugagagccgccucuucauauuacaaccuuuaggccagagaacgguguuaagauaccgaagggauuccugcgcagccccgcgcuaacagguuuacccuaaggauacauccuaggggagccgagcaggaggaacagcacaccccgacccuucgcuaacuuuucccccaucacuucuaacauucaaacuaacggcucggcgcggccagagugcggccaacgggcguccgcgucguuguuuggacgcgugugcacguacgugcgcgugucuuuguauacuugugcgugguugugaaacugcgcucucggcucacaggaguaggaguggugcagggaguaggaauguagccggcggggcgcucacguggguacgugggcgcagagagggccggcugugcauccggcgugggcggcaaggagcgaccugccccgcccguuggguccccaagcucccccuuccacagcucggccucggucaccucgguccccaacucagcgcccgauuccugaguccccgcuccgccuccacaccucccccccccccccuucccccaagucuccuccucucagucuccacagcagccucuccaaggcucaggccugggcucccacccaccgccuccggucccagcccccgguucugcccacgcccuccucccgccagcccggcagccagcgcagcgccgggccucgcucccugugcguccugcgggggaggaggcgcggagaggcggcaagcgcagccggggaggugggggcagaggcacagacagaggcgcggaggcuccgagagagaagacguggagggagggacggagccuggacagcgguggacccgggccgcgcgcgccaggcaaagagcagcgcgcagcaggcgccgggcaccgagaggggaggcacuggugaucucuggccguccaugcacagagcucccucucccacagcggaacagccaccuggcagaggggauaacacacgccggaccccgcaacccagauucaaguuagugggcaaaaggagguggcagggaguggagauggguggaguuggacuccggaauggggucuaaaggguggaggucgaaaagaggacguggggaagcgggacggaggugggagguggagacugauggaaaagggggugaguauucgaaauaggggauccuggaagcaaacaaagacccgaugaaccuggauacgauagaguacugccucguuuuccacuccagguuuacucagugggcauaaccuggcacaugagcccccugcaaagaauguccccccagccaggggaagcuccagagcuugaucugucaacagugugagggguggcggcucuuagcugucucagugugucauuagcaggcauccgggagaaggugguuccuuugaguuaagcaucugcgggccugaagggggugugcuucaggccucccuuguccgugaaaugaccauucacagggugaggaggggugcagccccuuccucaagagaccuucaaccucucccgcacucccuugucgaagauaaggguggaaaacaagcgagaggagaguaggcgggagcccccaggcgguuuucgcccacagacgcugcuacugugggagugugugggaagaagggccccagagcagaacaaucaaggcuucccucccccuuucccagaagagaggggccugcugaauaguaggaaggaucaaucaaaggagaggggguaacugaagggaacugggcagccuuuggaaaguugggacagagucuaggaagggugcuuuaauccuuggaagcgaagaacaggagcaagggucuaccagguucccuaaaugccaaggaagaggccacaccccucccucucagcuaccuggccaaggaguacagcugccagcaauagcucuuaguauucuaaguuaacuuuaauaugggauguuacauuaaguaauguugaggcugcugaguauuuagggggaagagguaaggacuuaguugggagggaaguggguccagccauuucagggaaguuaugaaaagucucagggcucaagauggugcugcccagaccagaaagaucaaaguaaaagacgagguaagcguuuuuccugauagcuuaggucgggcaaccggccuucugugcuccuggggaucggagggcacuguccaggaaagagggcaguuguuaguguggguugguaccccagcagggcacucauacucacugccucucuccugcccuuucuccucagggcaagugccccagccauggcacugccucggacacugggugagcuacagcuguaucggguccugcaacgcgccaaccuccucucuuacuacgagaccuucauccagcagggaggagaugauguacagcagcugugugaggcuggcgaggaggaguuccuggaaaucauggcacucgugggcauggccaccaaaccacuccauguccgacgucuacagaaggcucugagagaaugggccaccaauccagggcucuucagccaaccagugccugcugugcccgucuccagcaucccacuuuucaagaucucugagacagcugguacccggaaagggagcaugagcaaugggcacggcagcccaggagaaaaggcgggcagugcucgaagcuuuagccccaagaguccccucgaacuuggagagaaguugucgccacucccuggaggaccuggggcaggggauccccggaucuggccaggccagagcacuccagaaucugauguuggagcagggggagaagaggaggccgggucucccccuuucuccccaccugcagggggaggagucucugaagggccugggguuggggggguggcagcugguggugcagggggugguccagaccgccuggaaccagagauggugcgaauggugguggagaguguggagaggaucuuccggaguuuccccaggggugacacuggagagaucgcaucccuguugaagcugaauaagaagcuggcgcggagcguggggcacaucuuugagauggacgaucaugacgcccagaaggaagaggagauccggaaguacagcgucaucuacggccgccuggacuccaaaaggcgggagggcaaacagcuuagcuugcaugaggugaggaccccggguccucaaggcugcccuucacuccuggggcucaguucacuugccucugagacuucuuccgucuuccaccucuguaugacuguccccacgaccacccaagcuccuuccccacacucacacauacccaaccccugcugcugcuuuacguucuugucacccaaagggaagcugagauaauagcagugagccccgcacugcucacauccuaggugcaggaggcccugauagggacaauauccccaccccugucuuuaaguacaggcaguuccuggguauuauuuaaagcagacagucuuuggauggaccucccaguggugguaaaggggaaaaaaaacaguaggaaagucaaggacucacauuggcuguccucuugccacagcugaccaucaacgaggcugcugcccaguucugcaugagggacaacacucuuuuacugcgaaggguagaacucuucucacugucccgacaaguagcccgagagagcaccuaucuuucuuccuugaagggauccaggugagacccccuccccccucuuccccagggccauuugguuggaauccugccaaggacuuggcucuccccacuuguggcucaggcggcucuaggccugcuucccacccaccugcaugucuucaccuugccaacucaacuuaaacuugucugaagcuugcucucuguucccaacccccccgccccccauaaugauuggacuuccaacuccuguccaaccagcuucuuccugcaguuuuaaguacugcauguuuccuggccggauugugcaccccguggguuguggaguuguggggcccuuccuaauuccacucauuuuuuuuucuccguuuuuuuugcaggcuucacucugaagaauugggaggcccaccacugaagaaacugaaacaagagguagaguuuggggggcagggaacggcagccugccccaaccacugccuuggugaguccuuauuuuccaaauuuugggcauccacagguuggagaacagagucacaaugaaauccagcagccuccuccaggcccugaguccuaugcacccccauaccgccccagccuagaggaggacagcgccagucugucuggggagagccuggauggccacuugcagggugagugugcauuagagcaccuuucucugcuuugggaggcgguggaaguggggcggguggauugcaggaaugagccaggugucaacugccuggaacaggguugggaggccuggcuggauggggacagaggagccuaugggaaugacugucgguugaggguggguauuguuggcagcagccccugaccugaccagugcccaugcccacagcuguggggucgugcccaaggcugacgccgcccccugcugaccugccccuggcauugccagcgcaugggcuauggagccgccacaucuugcagcagacacugauggaugaggggcugcggcucgcccgccucgucucccaugaucgugugggccgccucagccccugugugccugcgaagccgccucucgcaggugaggcagccagcagugcugucccuaaacaccccaguuacucaggcccccauguggguccucauuuucuaggaccagagggaggaagagggauacagcugucagaacaguaggaggagcuccagcuagccagaccuugaacagggcaagcuacuacuggguuauuuccaagugggagggucugauucagguggggaucuuugaccaaggagcagagaacagaaugaggggugaaggugaacaggggagacagcaguaagggaggccuggcuagagcuaccuaaugcaggggauggaaucgcugggaguuguggggauaggguuccccagcuuggaaaccaaggagcccaaacugggcacuuuaugugugcauaggaaaggagagggccgggcagccgcugggcugagagugacgccgcaggcaaagccaccaacccuggcuugguauuuuuaaacugugcgugggugggaagugggggcggggacugaagggggugcuucucuugagggaggagcugggagucuagcuuccuguguuuccccugauuuggcuaccaaaaacucggggagcacuuauagggagggcgagaccugggaggggacccgaggugaguggagggggguggcugggccugggaagggggagggggagggagagaggucagagccaagccgcccccgcagcuccugacagaaccagaaauuccagcagagcagaggcgggcgagacagggaagagagacacacagagacagagagcuacacacaaccaaacuaggagggggagcugcauacgcuuggguacggaacccccauacacaugcagugggcaggaggcaguaauucaauaaauggagcugucuucgcauuuuucugugccuggccucauaacaacgcuucugcucagccuccaacccaguguucuaaccaaccuacaccucuuuccuacagaguucgaggagggguugcuggaccgcugcccugccccgggaccucauccugcucugguggagggccgcaggagcagcguuaaaguggaggcagaagccagccggcagugaaagugggggaagucucagacccaggacccagacuucuggcucacuuagacccccacauucuccauccuugcacucgccacuacccuagaaggauccuucugcugcccucugccucccauccgccccaugggcacaggacuauggggcuucaagcaauaacaggcaggggccuggccagaggacacaaggacggugcaaggugugcccucacccggcuuaggggcacggacuuugccuccagccugcuggggcucuccuuucucucauaccacacacacacacacacacacacacacacacacacacacacacacauauucuccagguggccagcaguggugugagcagcugaacuacuucacuuggacacggagaaagaacuuccccaggaaggucuagcgacuuacaguggaaccuucacucugagacugggggcuugggaaaacugggucuccccuccccauccccauuuuucgugcuucuaguuuguuucuuuaauuuaacaagugcugcaguuugcccacccguucuuaucuccccccuccccgcagaccuuucucucagcacugugugggagggugccccgaaguucccuccaccagccccuuagaggccuggguuggacccugggccuccucagccggcaggacugcagcaccugucgaacacuuagcgugucuuucuuuucagauuguguacaguagauuauuuauuuuguuauuuuggaauaaaauuuauuuuauggcuuaggau

SEQ ID NO: 5807 - RNA, 1647 nt, Mus musculus
cuuaguauucuaaguuaacuuuaauaugggauguuacauuaaguaauguugaggcugcugaguauuuagggggaagagguaaggacuuaguugggagggaaguggguccagccauuucagggaaguuaugaaaagucucagggcucaagauggugcugcccagaccagaaagaucaaaguaaaagacgagguaagcguuuuuccugauagcuuaggucgggcaaccggccuucugugcuccuggggaucggagggcacuguccaggaaagagggcaguuguuaguguggguugguaccccagcagggcacucauacucacugccucucuccugcccuuucuccucagggcaagugccccagccauggcacugccucggacacugggugagcuacagcuguaucggguccugcaacgcgccaaccuccucucuuacuacgagaccuucauccagcagggaggagaugauguacagcagcugugugaggcuggcgaggaggaguuccuggaaaucauggcacucgugggcauggccaccaaaccacuccauguccgacgucuacagaaggcucugagagaaugggccaccaauccagggcucuucagccaaccagugccugcugugcccgucuccagcaucccacuuuucaagaucucugagacagcugguacccggaaagggagcaugagcaaugggcacggcagcccaggagaaaaggcgggcagugcucgaagcuuuagccccaagaguccccucgaacuuggagagaaguugucgccacucccuggaggaccuggggcaggggauccccggaucuggccaggccagagcacuccagaaucugauguuggagcagggggagaagaggaggccgggucucccccuuucuccccaccugcagggggaggagucucugaagggccugggguuggggggguggcagcugguggugcagggggugguccagaccgccuggaaccagagauggugcgaauggugguggagaguguggagaggaucuuccggaguuuccccaggggugacacuggagagaucgcaucccuguugaagcugaauaagaagcuggcgcggagcguggggcacaucuuugagauggacgaucaugacgcccagaaggaagaggagauccggaaguacagcgucaucuacggccgccuggacuccaaaaggcgggagggcaaacagcuuagcuugcaugaggugaggaccccggguccucaaggcugcccuucacuccuggggcucaguucacuugccucugagacuucuuccgucuuccaccucuguaugacuguccccacgaccacccaagcuccuuccccacacucacacauacccaaccccugcugcugcuuuacguucuugucacccaaagggaagcugagauaauagcagugagccccgcacugcucacauccuaggugcaggaggcccugauagggacaauauccccaccccugucuuuaaguacaggcaguuccuggguauuauuuaaagcagacagucuuuggauggaccucccaguggugguaaaggggaaaaaaaacaguaggaaagucaaggacucacauuggcuguccucuugccacagcugaccaucaacgaggcugcugcccaguucugcau

SEQ ID NO: 5808 - RNA, 613 nt, Mus musculus
auuagugcugucuguuacaauguuaacugaucuuguugacuguaugcaggucuccugcagauaaccauaucaucagcaguagggucucaccaccugguccugcugagcaaugacaauaguucuuuuuuuuuuuuuuaccaaaaagcacaggguuuuauuucucgcccacugggcaggguucugcaggccuucgcagggcagggagcaggcucuacuugccagcgaugaguggguuccgcagcaccacgaugaccaaguccccgcgcaggaacaucuuggagauguagcgguccuuguugacaggcuuggauuucuucuugcccuugccgcucuugggaaccucaguccacaucuccuucacauuuuccagcaccauguugcagugccugucaaaggccuucacccggcccagcagcuucuuguuguugcgacaguuaaugagcacuuguguguuguucuugaccgacugcgugagcacugagaggggaccuguguugaauuccuccuccgcccgcuucugcagcuccucuggggucaucucacucuuggauuuauugaggagacucaugguguagguuucgcucgcagaucacucccgccucgacaauaguuc

SEQ ID NO: 5809 - RNA, 21235 nt, Mus musculus
cuuauuauauguaaguacacuguagcugucuucagacacuccagaagagggagucagaucucguuacggaugguugugagccaccaugugguugcugggauuugaacuccggaccuucagaagagcagucgggugcucuuacccacugagccaucucaccagcccccagguuauguuuuaagacagaaucuuguuacugaaccuggagcuuccuguucugauuggagugccugucaaugugguuccaugaucuuccucucugccucccuagguuugguugccacuagcauggucccuccccuccaaaaaaaaaaaaaaaaaaagcaagaugacaagagcaauuuggucaauacuugggguuugggauauaacuuugugaguacagcacugaaacucauaaaaccaggugugugacacaugccuauaagcccagcacuggagaaguaaaaauaggauccaggaagcuggggagauagcucacuaaguaaauaaccuuaccaaagcugacgaucugagcucuauuccaaguaugguaggagggaagaaguaacuccugugcacuguccugucacuuccaugucuacccuggucauccugacuacaugagaccccaucuaaaacaaaguuccaggcacagugacacacacuguaauucaggcaggccaaccuggucucuuaucuauauagaaaacucuaggccacucaaugcuucucauagcaaaacuuugucucaaaauaaguaaauuaacuaauuaauaucaagaauuucaaaagucauguaaauaauuaaauccauuugaguuuagaaaguaggaaacucauuccauguggaaaauuaguugaauggucuguaucuaagcacaggacauugaguguugugauucuggggcuucacacauauuagacaagcacucuaagcagagcuguuucucuagcuucauccacuuuuggagacaguuuguggcacccaagcugaccuuaacuguaagauuccccugccucugugugcuaucacaagugcuguaauaacaagaauaugcagggaccugaagaaaaaagugaugagucugugcuuuacucugcuccacagcaaccauuucuguuuuuaauguguaugggugcugagcauuuuggccuaggaggccaaaagauaauaucagaucuccuagaauaagaguuacagauugagguugugagccaccugacuuguuuggaauagaacccugcaagagcgaguguucuuaacuccugagcuaccacucuuggccuccacuuuccccacuuugaggcaggguaucugugguuugaaugagaauggccccauuggcucauguguuugaaugcuuaguucccagggaguggaaguguuugagaaggacuaggaagcauggucuuguuggaguaggggugacauuauuggaaaagugucacuagggguaggcucuaagacucucagcuacuucuccagccccaugccugucugcuucccaucaugauagugggcuaacauucuaaaccuauaagcaagcucccaauuaaaugauuucuuuuuauaagaguugcuuuggagccgggcaugguggcacucaucuuuaaucccagcacuugggaggcagaggcaggcagauuucugaauucgaggccagccuggucuacagagugagucccaggacagccaaggcuacacagagaaacccugucucgaaaaacaaacaaacucggaacuucccacuucuaccucccaacuuacagaugugugccaccauucccagcucaaaaaucuuuuucuuuuuagggacagcgacucacuguguaacuugcuauguagaccaagcugguuuuaaacucacaggguccagcaugccucugccucacaagcauuuuacuuuauuuuuauuugacugucauguuuugccugcaugugucuuugugagagugucagaucccccuggaacauacaguugugagcagugcugggauugaacuccgguccucuuaauugcugagccaucacuccaaccacaagcaagcucuuuaauugcgacuauugucaugcauguguguacuggcugguuuugucugucaacuugacacaggcuggaguuauuagagauaggggcuucuguuggggaagugccuccaugagaucuagcugugggguauucucucagugaucagugggggagggcccauugugggugguaucaucccugggcugguugucuuggguucuauaagaaagcaagcugaggcugggcagugguggcucaugccuuuaaucccagcacucgggaggcaggcagauuucugaguucgaggucuggucuacagagugaguucgaggacagccagggcuacacaucucuccagcccaaaaacccaauuuuuaccuagaacuccaggcuguaacccagaaauagaguucuugcugacaugauagaaccaagaauccaccccaacaccauuaagaacugagcacacuggugcaguacuuacaaucuagcauucagaauggaagcaggauugcuaaagucaagagcaccuuaaacucccuagcaggaagcaaucaaaauacaaaaacaagggagcuggaaagauagcucagcaguucagagcauugccugaacaucuagaggacacagguucaauccccaguacucucaggguacacauucauacauguagacaaauagacaaaacauguacacauaaaauccaaaaaacaaaacaguaaagcacccccccccaaguccucccuccugaaacccuucuuuugaauucagguaauaucuccuuaaaaugaugagugugggguguucguuaucacuauuagcuuuagagcacuggaacauacuuuuacgucagucagugguucucaaucuggaucaaagcaguaaacaaggugacacugcuaauucaggagugaaaauguacaggaggacaacacauucacuuuuauuucagucaagucacaacacuugucuggcugcugccaagugcccacagcuucccauuuacagacacacuuuacaggguuuccugugacaguacagcaagccucuuuguucaaacaggaccaguccaaauuuucccucaaaaaaacaaaacaaaaaaaaaaaaaaaaccaaacuccauuccaguaagggguaaauacaugaaauuacagcaaacagacacuuaaaaggacagccaagaaaucuuccaacaguuuauuagaaagaauguagacauuuaaaaaaauccccacugucaugaacauaaauugagguuuuccagccagggcauaagcugaaaucaaaacagaaaauaaaaaaaauccaauaguguauuuaacauuguccacucauuugccauacugacugugcaaauacaaaucuggucuaaaauguacauacucucaagcaacaauguacagcuuucuuuguccuccaugcuaagagauguaaaagcuuaagggccaaacaauaccaaguguauaggcuucaaaaaccaucuaaguuagggcauccacuaguuuuugcuaaaauacaccugaacacugacaagugaucacauacaaugauguaaaguacauuuuuuuuuuuugaaaaauaaacuuuaguggaauaauuuugaaagguauccugaaagaauggcagguuaucaguuuaagguauuagccaauuuguuuccgccuccuuuaaauccauggucuaggaucuaaaacuuucaucuuucccuaagcugagagcuuuccuaauguguaaguaauuguguuaugaugaaagacuuagaugaaaugcaauuauuuguccgagcugcuggagcaguugccuaggaucaacugccucauggaaucaugggaaauguucaugcauaaggauacugccuuagcugacuuaaaucgccccacacaaugguacauaaucaacccuuagugaagccuuucaaaaaaaaaaaaaaagaaaaaaaagaaaaagaaaaaaaaagguugacaacuggguuagaggaggcaaguacagcauaucugccuuuagagcuaucgacucagggguuuucucaauugugaaaucuugcagaaguuauuuuccuuucucaaaauccaggcgaugacaacagcccuuacuccagaucuggcaucucugaaagaauuuuacagacaagucagcaaggucuacaagagaacuacaagagaaucuaacacuuauauaaauuaaauggaggcagcaaaacuaagagcucccuaguaaucaugugaacacuuacuuacacacugaacauguaagcacaccuuaaauaauaaacccuccuaagaaugugacaagacuuuuugguucuuaguucacuagcccauauccauccuuggaaaugcccucuucuuucuaauaaguuaauucuaguccaugccuuauuggaggcuagagacauggcucagagguuaaaagcucugguuacucugcuagaaaauccaggcucaacucucagcaccuacauggccgcucauagcuggcuauacuccacaucaaaggacucugacacccucuucuguccucccaggcaacagguauacauacagugcagacacauauucugguaaaacacuaacaauaauaauaauaauaauaauaauaauaauaauaauaauaauaagcuaucauuuucccuucacuuuuccugguggugguuaggauuuucaucuaaccuguacucuaccacucuugugcuuaaaaagaaaauauagguggugucugcucugaaaguuauucucaguguggacaaucacuacagcagaaacauuaaaaacaaaaacaaaacccccaaaauacccaaaccccaagacacucacuuucaucaucacugucuugugaauccuguagaagaaaaugugaaaaaguuaccgaauugauuauacauaucucuuuauagaauaguguaccuuaaaaauccuaaguauuguaauuuuuuucuuccuuuuuugguuuugagacaggguuucucuguauagcccuggcuggccucgaacucagaaauccaccugccucugccucccaagugcugggaauaaaggcgagcucuauuuauuuauuuauuuauuuauuuauuauuuuuaauauaguaccaaaauaguuacacagaaccuaggaauuuaaugaugcgguuuuuuguuuuuguuuuuuugguuuuacaagacaggguuucuccguguaguccuggcuguccuggaacucacuuuguagaccagguuggccuugaacucagaaauuugccugccucuaccucccgagugcugggauuaaaggcaugcgccaccacgccuggcuuuaaugaugcguuuaaacucaaggccuauucuccuaaagugaauggcuuuguagcacaagauccaucuuuagguucucccccaacuuugucaaccuuucuuggcauucaaugaaaggaaaaauuuauacacagaagucaaugaauucuaauucuauauacuacagcugagaauucucccaacuauguaaguuuauauuaagauauuaauacauuucuggggagauaaugucuaaaguaguagaguacaccuuccucagugcauucacaucccuuuauuacuauagucucugaccugcuuuuaaaucccauuucuauccuugucaaaugauaaucuuucaacucuuaacuuuuauguaaugauuuguuaaaauaugauccuuaaugguucacaaaaacaauuucccuaguagguaaaaucuucuaauauguuaagaaacaagacagggccagggcuacacggagaaacccugucuugaaaugcgccccccacccaaggaaacaagacggggguagacuaaggauagggguggcugcacucuugagggcaacacugagucuauaagacgauugcaaguuaacagaaaaggggcacacauacuuacaucaucugcuccaucuacuucugguaaaucuacauccucaucaccacccaugugauccaucaucuauuugaagaaaaaaaaaaucagcuuuaaaauguuaaauucagcuuuacuaggcgguggcagcccagaauaggccuuuaggacagcauaaguucucaugaaugaaugcaaaagaaccuuuaaguacgcucuuucuauaaaaggcugaaugugagacaagagaaaguacacagguugcggcggcaagaagauucagaaguuuaagaucacccucaacgauacuagcggccaauauggcgggcuauaggaaaauuuuuuuuuuuuugcuaaauucacccaggaagauaucuacauauagcagaaaaugcaacugauaaaacuauguguugagcuggaaaaaugacucguguacugcucugacaauugcagggcaaucugacaucuuuauggcccccacaguaaaggagccaauguagguaaggaaaaaacuccugugagggaggucauauauaggucauacaacaagcaccuuuugagaugugauucuuaagccuaggguagcccaaacaacucugcuaccucugacuacuagcuagacgauaugagaaaguuuuauaucuaaauuuaagggaaauaacuuuacaugccacuuuguaagaaaaguaaaaacuuaaaauacuugaugcuauccuugauuucaggaccuaagauagcuuagaaagaugcgcaugagagugaaggugggguugggagagucgguucaauaacuaaagguuuaauucccagcacucacacagaugaggaccacaaccaucuguaacuccaguucuaggggaucaaucccauggccucuucuggcuuccaugcaaacaagccuuagccagacauacaauaggaauaguauguucagcccuaaaacaauagcagucuuuugggggugagagugggaaaaagaauagagaaaggaggguggcacaguggccugcaccuuugauccacacagcauauggaaggcaaaggcaggcacaucucagugaauuuggggccagccuggaguacguagaaguuccagacagccagagaagagagaugcugucuccugcaaaaagccaagaguuggacuagagagauggcucagcaguuaauagcacugacugcucuuccaaagaaagguccuaaguucaaaucccagcaacuacaugguggcucacaaccaucugcacaucuacaguguacccauauacauaaaauaaagaaaaaaagccaagaguuccaucaccucuaagagggauggucucuugcugggcaguggugacuugugccuuuuaucccagcacucgggaggcaggaugauuucugaguucgaggccagccuggucuacagagugaguuccaggauagccagggcuacacagagaaaccccgucucaaaaaauccagcacaccaugaugguccuguuuuuuuuuuuuuaaauucuuuuuaggggaguugaagagauggcucagugguuaggguuaccaguugaucaacaguaacuguccccuccccauccauccccugagacaggguuucucuguguagcccuggcuguccugaacucaagagauccaccuggucuacagaaugagcuccaggacagccagagcaacacagagaaacccugucucaaaggaacgcuucacccuaagaccaucucuucagauguuuguccaucauauguaagccuggugccugaacaguccagacaugauaaaggcuaccagauccccuagaaauauaguuauaagcaguugugacauguccugacuacauggguuucuguccagaaaaccaaaaagggugaccaaggagugguugagagcaccuguuacucuuucagaaggcugggguuugauuucuaacaaccacauaguggcucggaacccucuguaacuccauuaccagggacccugacaccaccuucagacucugccuuggaaccaugucccaaguggugcacagacacauauaugcaggcaaaaacuauccauacacauuaaaauggaaaaagaaaaaagggauuaaaaggauuauauagaauauauuaugggaacaggguagaaaaugcaauuaaaaaaacuuaccucagagaaacggucaaaauucgacaugucuucaucugagucauccucccagucuuuccaauuauugaaguccacacugagccaauuaagcuagagaucaacaauaucaccuccauguuauucauaaccaguaaugagacauaaaaucagcucaaaaagaaaaauccacaagaaaccaagagggguaauaagucaaggaaucauuuuucuuccccccgagacaggguuucucuguguagcccuggcuguccuggaacucacuuuguagaccaggcuggccuggaacucagaaaucugccugccucugccucccuagugcugggauuaaaggccugcgccaccacagacuggcuccaggaaucauuuuugacuguccaauuuaaccuuucauacaaaaacauuuauugggaaguauugcaugauaccuggaauuaauccaauuuacaaaggcuaacauucaacuauuaauccgucuuuagagauggauuauaggucaugcuguuagguuguuuccaaccuacagcuuugugcauauuagguauucugucaacugagauaccccagugccacuguuuacagucuacgcaguaccucacuaugaagguacuuggcuggccucaaauucaaagaaauauccuguuucuaacauacucuccccuuguaccaucuugugaucagaacucaggccuucagguuuggcaguuaaucaccuucacccugccagccuauccucaguuccuugaaucuugaaugucacuaaacuuugcuccccuacaguaaccaaguaacuuaucaguaugcuggcuaauuugucaccucaacacugguuacaguccucugagaggagggaacccaacugagaaaaaugccaucguaagauccagauguaaggcauuuacuuaauuagugauugaagggccgagcucacuuggggugggggucaucccugugcuggcaguccuggguucuauaagaaacagaggcuggacaagccaugagaagcaagcagcacccuccauggacuagcagcuccugccuccaaguucuugcucugcuaugauggacuaagaauaugaaguauaagcaauauaaauaaacucuuuccuccccaaauuguuucaaaugguguuucgucacaucaauaguaacuaagaaacccaggcaagcuagucuugaugucacaaccuuucugccuuagccucaagugugccaccacaccugaugcaaaaguuugucucuccaaugcaaaagauccuaaucaacuacggucugauuuuaugacauuugaugagaaugccaaguauagaacaccagcuuuuuuacaauuauaaaaauguauugccgggagugguggcacacgccuuuaaucccagcacucaggaggcagaggcagguggauuucugaguuuacaaagugaguuccaggacagccagggcuauacagugaaacccugucuagaaaagccaaaaaaaaaaaaguauuuuuaggcuuaaaaagauucugccuacaggccagaagagggcacuagaucucauuauagaugguugugagccaccaugugguugcugagaauugaacacaggaccuuccaaagagcagacagugagugcucuuaaccucuuagccagcucuuugcccuauuuuuauuuuauuuuuuuaaaguacagaauagagcuuauucaggacauagggaggggaguuaagagaauagcagaagcagagaaaagcagaggagaaaguggagaaguagaggccaaccaugaccacuuggagaggggagggggcaagacggaauggggagaaagggagagcaaaggggcaagaggcaagcgaaagaagcaggaguaaaagacaccuauuuuuaauucuuaaaacauuaaaacaaucaaacagaaaccaaaacaaaacaaaaaacccaaccuaccuuugcccuuuccuuuguuaaccuaggccaugacuggccggauucuccuuuucgcaaacaacauaaaaucgaucugucuguucuuuuaugcuuggaauccuacaacaaaagcaucauaucacucaucucucugcuaugauaaaaacagcccucccaccauacugcuaagggauaauauuuaggaccuugaaacaugcuaggaaaguucucuguaacagagcuggaccuucauaauuugguuguuacugugcagcccagucuugaacccaagauccuccacaauuagcccccugaguguuugagggauccucuacacaaaguuuugucucuuuccucugaggugguuuuccuacauaggcaaagcuuuucugaguugcuacuacuuccuaaacuuucagcuuauagccacaagccugauucauuuuuuaaaauuucuuuccaaacaagcuuuuuggcuacucaaaauuucugauagaagauagaaagauuucaaagguacugucauuuugccagugacagaauaaaaaauauguaggaagagagguugcugagugucuaaacuguuaggcuaagcagauuuaagauuuaauguuuauuauugugguaguuuaaaugaaaguggccucacaggcucauagggacuggcauuguugagaaggguggcacuauuggggggagugugccucuucaggugggcuuugaugucucuuccugccucuccagguguagaacccuuaguuacuucucuggcacaauuaucugccuacaugccaucaugcuucccucugugacaacaauggacugaauccuugagcuggaaaccagcccguuucccuuuauaaaaacugccaugucaugguuuccucacagcaacaaacccuaagauaacagcagcacgcccagcuucucaucauuuaaaucagaaaaaaagcaucaaugguacuuacauuuggaucgauacaaugaaaaagaucaauuucauuuaaaugcuuaaaauuaucgcuuccuccaagacaacuaaaaaaaaaaaaaaaagugagacagagaaagagauuagaaagccaguuacauacaguaagcuuuggguaacacagauguagaaagguggcuggcuaguucaugucaauucuacacaauccuagagacaggagccucaaaggagaaaaugcuucuauaagaucagacuguaagaaggccuauacuauaguacauuucuuagugauugauaggaaagggcccagcccauugugggugcccccaccccaggauucuguaagaaaggcugagcaagccaguaagcagcaccccaccauguccucuguccugcuuccacuuccuuugaugauuaacaguggauccauaagcccaauaauccauuuccacccaacaucaugguguuucaucacaguaauaauagacaccuuaaauaagacaaaaggcaaauuaccugaaaguaaguuuggauuuuucaaaguuuacauuaacaucuuuacugucuucaacacaaaauucaaugaauacauagucccuucgaucguaccacuuugcagaagcaggcugccuauaaguagagaaaaugauaaauucaaaaaggaauucuuugaguauuuauaacuucauauuuaacagucauuuauuucucuucuccaucacaaguuuaaauuucacuuuacauuuaucuuacauuccaaaggcuucaacaaaguacuuucaggaagacuuaaaacuuuccuaauagggaguuuauucugggagaugagggaaugaggcagggcucuuaaguagcccacauuggccuugaauaccugaucguuccuugcccuacccacacaaugccauucauuuaucauaggacaaaaaguaggcuuuggaaacaaacaaaccaggugguagcggcucaagcaguaaguaggaaggcaguggaaccucugaguuuugagcccagccuggucucaucuacagagugaguuccaguacagccaagucuauacagaaaaaaauauauauauaucucaaaaaaaaaaaaaaaaaaaaaaaaagaaucaaacgaagccaaaaauaaacacacaaaacaccacccaacccaaaaauaaccccccuuucaucaugguuaacaggacuugaagcuaagaucuaacauuuaaugccagucaaucacgaggugauaauucuuuaaaccaucacuacuacaacuaagacacagauuuaauuauaaagagaacuuaggcaccuucaaauaaauguauuauuuuacaauccugcuuucaacauuaguaacugggaauuaacagggacauaucgcaguggcauaauguuugccuagcauaugcagggucuggguuuuauauacuacagccuagaacaaaaguauacagcaagguguuagucaucccagacugcaggagacuaagguaagcggacugcaauuuuaggaugguucagaguacacaccaggcuauuguuccacagaacaagaacaagggcuggagagcacuugcuacucuuguagaugaucugggcucaauaaccagcacccacaugucagcucacaaccagguguaaccccaguuccaggggauccaaagucaauagacaaaacgcacauacgcacacaaaaccauaggagggaccauguguauguagccaagcucuacuacuugagguggccccugagaugcacccaguuuuggaaaacaccugcaaguugucuugacuuccaaacauguccagugguagauguauacacagcaaauaauauaaagucuagaaaaaugacauaugguagugccccaauuucaaaagacaauagcgagccagaauaaaauaaacacuaucuuguuaguaccuauuggcagaugucuugaguuuuucauauuaacuauaugccccugugucuugaauuuaacaaguguacaucacuuguucagcuugauuugauaucagauuucaaauaccccuuucccuuauaaaauuuauuacugauauaaucaguugguauuguuuuuauaguucuguuuaaacauuucuuuuuauguauacauaaacagguacccagcaaugggccuguaaagccacagaacuaguugcaguaguuggcucuuuccuucagucuuguggguucuagaaaucaaacucagguuguuuggauggcagaaaaugucaagauuuuucccugccagccagcccucuuuuuugccuugauccccauaggaucucauguggcacacccaggcuggcuuugaauucaggguuccaccugcuucuguuuaaagguguaugccacaaccaccugacaaaguuuuuauagccaggcagugagguuucuuaguguaagguggauuagauuugagaaagaagccaggcguggugacacacgccuuuaaucccagcacucgggaggcagaggcaggcggauuucuaaguucgaggccagccuggucuacaaagugaguuccaggacagccagggcuauacagagaaacccugucucacaaaaaccaaaaagaaagaaaauacaagcaaacaaaaaaaccccaaaaaaccccagacaacucuacauaaaaccacaaccauucacacaaaaaauaucaaugagccaggcaggcacaacacacaauuacagaaagaaagaagcagaccagccuggucuacagagugaguucuaagacaacuagggcuucacagagaaaccccaaccugaaaaaccaaacucucucuauauauaauuaugcauguaaaacauuuaaaagaaaacaaagaggggcuggagagauggcucagugguugacugcucuuccgaagguccugaguuugaauaccagcaaccacaugguggcucacaaccacccauaaugagaucugacgcccucuucuggagugucggaagacagcuacaguguacuuacguauaauaaauaaauaaaucuuaaaaaaaaaaaaaaaaaaaaaaagagacaugggaacguaggugugcagugguggcacaagucuucaauuccagaacuucagagguggaggcagccuagucugcagagaaacccugucuugugggguggggugcagggagaaccaggaaagaaauccaccuuauuuccucagucacauuaagaauucaacauuaugggcugaccuguuuucugucugaucacuucagaaugagacuuuuauuuggaaacagagcuuuuaaagggaaauugaaaguacaauccuaaaacuuccaaugucuggugcccuuauaagaggagaugaggaugcagaugagaagacacagaugguguuucuuaaacgaaagaguauaucaucuuagaaauauuacuuagaaaauaaaaauagccaaaaguaacuccccuuuuuuuuugguuuuucgagacaggguuucucuguguagcccuggcuguccggaacucacuuuguagaccaggcuggcuucgaacucaaaaaucugccugccuuugccuccagagugcugggauuaaaaaggcaugcgccaccacgcccggcugcaacucacuuuuuaauaaugguaaggucucacaacauuuuaggcuggccccaaaucugccuuacaguagcaucuacaauagucucuuuacaaaucaagucccacauguauauuuauauuuuuuucucuuggucuuacuugaaauaauugggggaaaauaggauuuaggaugcuggggugaagagaaagauuagcaucucaagaacuuaaaagucaggcaguguacacauggccuuuaaucccagcacuuaggaggcaaaggcauaggagucugaggccagccugcuguacagagugaguuccaggacagccaggaacuaccaagagaaagccugucuugauuaaaacaccaaaaccaaaccaaccaaccaaaacaaaaggacucauguucaguucuuagcaccuacagcuacauaaagguaccucauguagacuguaacuucagcuccaaaggacuagauacucuuauggccuccucagaaauccaauaaacacugguggcaaacacccacauauacauaaaucuguuuucaaaaacucuccgggcgugguggagcacgccuuuaaucuauaguguuaaaccccaacuaaaagauguuucugaccaaauaguccuaaacuaaaggacucccaugucaaaggcccuuuauauaugcaggcaaugauggcucguugaugcuuuucuauacuuucaaaaaccaaccaaccaaaaccacaacuuuuuuuuuuuuguuaaggucuguguguaugaggguuuugccugcauaagucagaagaggauguugauccucuugaccuggaauuaggaaaggcugugagccuccacauggguacuggaaaccauucaagucuucaagaacagugaagugcuaaguuuuuuacagacagaaucucuacauagcccuagcuuuccuggaacuauguaggccaggcuggccuccaacccaagagaacugccuggcucuuacucucaggcacuggauuaaaagcuggcaucacuacacccagcuuuuaaguacuggacccaagucucccagcauuacuaaccacuaccucacuuuuuaauucacuuaacgugagacauaguucaacuuuaagauuugcuacagagcagccaucaaaagcaucucauguaaccaugcuauagaaaauacauuagagcuugauaauuaaauguuuacuggagcugggcgugguggcgcaugccuuuaaucccagcacuugggaggcagaggcaggcggauuucugaguucggggucagccuggucuacagagugaguuccaggacagccagggcuacacagagaaacccugggggggggggggagggaaguuuacuggaagauuauacugugcuagaguuguauaauuggagaggaaaauuccagcucuucuuugagccaggaaugguguuuuagggagucuaaaguaggagcauuacuguagguuccaggucauccuggucuacguucucugugcaaucuaaaggcuauaauccaacuaauauggcaauguaggauaacugugcucaggcuucagcuucaggccuucacacacaccagcauacauuauguguagccacacacacauauaaucacagaaacugauuauguauguuugcaugcaauacauauguacacuuguagcuggccaacaagcuagugcccuguccccacagcaugguacccagcuuuuaugugggugucagauaugugaacccagauccucguguuuaucagcaggcaagggcuuuccuggcuguacuauuuccccuaucuucuuuucaguguuuuuaaaggaauaucuuguuaaugaggcagcuuuaacuauacaguccuagauggcugaaaacugcaucaaacuuccugcagggcugguguuccacagggaggcagaaggaucaggaguucacaagagaaugaaaacaguuuuaccuguaucaguuuguaauaagaaccagacaaagcagauaccacaguuuugcuaauggaaagccaggcacagucaauuaugcuuguaaucccaacauuugagaggugaaggcaggcauuccaggccagcacccucugccuuaaaaaagaaaaaguuaguuggcuguaaugaugcacaccuuuaaccccagcacucaggaggcagaggcaggcaggucucugugcauucaaggccagcuauagagacugccucaaccggacccccaagaguuugccaaaaaaaaaaaaaaaaaaaaaaaaccaaacaaacaaacaaacaaaaaaaaaaaaaacccaaaaaccccaacaacaaagaaacuggaaaggagauuuaaauaaaucuuuguuucucaaauuaugugccaagguaacauuagggcaccacagaggaaagucacaagauauuuuacaucagagagcaauccaauggcacacaguugaagaucaagagaaaucaucuaaaugcacaucaguuugaagagauuuagcugcauuacacccuguauuguuuuagggucucaaagcugggauuucaguaguucccgugauucacuuuaaaaagaggguuaguggagguguugguacauaucuuuuaucccaacacuggggaggcagagcuggggaucugaguucaaggcuaguaugguuuacagaguaagacccugucuuaauccuucccccccaaaaacccuaucaguucauccauacaauaaauaagagcuagggcuaaagcaaagugguagagcaguuugccuagcacaugugaaugaaaccuugugucugucuugguuguaagauuuuaaauacaauucuagauuugagacucuauacaaagcuggacaugauggcacauugauggcacaugcuuguaaucucaccauuugggugguaggaggccugauuacaaguuccacaucagccuggcauacacagugagaccuacuuaaaaaccccaaaccaccaaaaccccuaucaucuauuuuauauugucucccuggugugaaggaggaaauaucaguaacugcuuaagauccaaaaugauaucuuggcuucuaguucuuuaaaaugaaaaauacaauuaaacaguaauuuuaaauuagcaauaagaaaccgggcgugguggcgcaugccuuuaaucccagcacucgggaggcagaggcaggcggagaggccagccuggucuacaagugaguuccagggcuauacagagaaaccuugucucgaaaacaaaaacaaaacaaaaaaauagcaacaggaguaaccuacaacccagcaaauuuugccacuuuguuucuaugccuucuaguuaaagucuaacucagcaagaaaaaaagggaaaaucaguugccagguuacagugguuaggaaaucaacauugaacaaaggccaccaucagauacucuucucaaacuugaaccauauaccacaugccuacuaaaaguuuggaaagcugaagauuuugggaguuuugcagaguaaaaauucaacaaacaggccaggcauuguggaauuuaacuuuuaaucccaauaccuagaaggcagaggcagucugaucuugaguucaaguccaccuuggucuacaugaguuccaggaccauacagugagauuauagccggggcuauauauaguaagacccuauccuaucucaaagaaaaagucuguuuacagcaaacauuaaacuauacacuaucaaccagaauuuuccaauuucacuuuagaauucuacgucaauaguuacauaaaugacuugauguuuacaaaaugguauauagugaacauuuuuaucauugaaggaguuguuccuauuuacuuuacguguuuuuugccuacauguacauaaggacacugcuuauauacccaguguccacggaagccagaagaggguuccuaacccugauccccugaaaucugguacuguugucaaccaccaugugggguuugagaauugaacccagauccucugcuaaaggaugagccaccucuuuaacccuguagaaugaccauuuuaaaaagaccagguaucugaccucuucaaaaugugcacaauggugcaaaccugguccacacagaaaccucaucacaaaaaacaaaaauaaaugagaugugugcacacuauauagaccuaucuggccuugaucuuauauaaucccaauauauaauccuauuggguucaccuauaaucccaaauaauuaggaaguggagggaaagaguaggaguucaagggggauccucccacauauugggagguuaggccaccuagggcagcauagacgcuuucucaaaaaacaaucccuuuaaagaagguaauaggaucaggaguuguacaccuuuaauccuagaacucagggaggcagaggcagguguaucuccagcccaaguuccaggauagccagagcuacacagggagaacuugucucaaaaaaaaaaaaaaaaaaaaagcugggcgugguggugcacgccuuuauucccagcacucagggggcaggcggauuucugaguucaaggccagccuggucuacacagagaaacccugucucaaaaaaccaaaaaaaaaaaaaaaaccuaaaaaucaaaacagacaaaaacaaacaagagcacccacacacacaaagguuggaaagauggcucaaggguuaaaagcgcuggcugcucuuccagaggacccaggguucuagccccagcacccacauggugauucacaaaccucuagcuccaggguauccaacauucucuucaggccuggccucuagcagugcagaugauacacaaacauacagacaaaacauccacaccacacugcucuugcuucuacaagagcacccaagcaggguggcucacaacugccucuaacuccagauucagaacuaacaccucugcucucagcaggcaguugguucugguaauagaacuuggguucucagcaaggguagccagugcuguuaaucacugcgcagucucucuaccuccuaaauugcuacuucuggaugaaaagauguuucguuuggcuauguuuaucuacuaaauugauuauguuuuaccuagcaauucauuuuccccguacaguuuggaaaauaucaaaaaguuuuuacauaaacuuguccuaagaagccaacaugacaucagaauacaggucagucacacacaagagcuuuuucuuaacaucucaaagguaaaauuuaaauccaugcuggugagauggcuaagcaagugaaggcucuccguuucucuaccugacaacuuaaauuguuuccccacagacuguccucuuaccuccaggaacacgaggggguggggggagggcacacacaugaauaaaauuacuauaaugaaacacuaaaauguaaaaccugcuacauaucuuuguuuuuaugggggacuccuccaaauuucuuuacacauuuucuaguacuacauggucuucuucuaggaccuguuucucagccacuaauuggcucuaggacaucgucuaucaauuuagauuuuuagccauucaagcaagcaguuaaaacuuaaacuuguacaaucguuaaacuuuuuuuuucaacuacaauccguaacuuuuagugcugugcauagcagccacccacaccacccucaaguacuguaauucaauucucucauauuugaaaguuguccaggcuagaaaaauaagggcaaaaauucuuagauuaaaagaaucuguaaccuccauauaaacaaauuaagaccuucaggcaagugagauggucauuuuauaccuguuucaccuccgcauacaaagagcaugacgaaaugccacccaaaguuuauugagguacagagaagaaaagaguccacaaguaucuugugacuagacacgugcagaacuaccugcuccauaguaacuauuacucgcugccaaggaggugaccgcauuugcuagcguucaccauuuucaagagacccgagaugugggaacgggaaguuucguuguggugacggcauggcccccucuaguugccuagcagugccugccgccgagggccgcguggugcccuaccgguagcaccggcuuacggcggcacccacaaaugcucucagcccgguccugccggguccgggcaucagcaccgagcggcaggacuccacggcucccggcgcccucauggcggaaagcucacacacgaguuuagggccuaaggcuaaguucccagaguuccgagagagccaggcugucuagggaagaaaagugggauuucuggcacgaggaauccgggggucgaucuggagguggggaaacggacaucuggaggaaaaauguccuccaacgguaacaggaacaaggaugcaggcccucccaccccacggcagggcugccaccagcgcgggcggggagaaaggcgaagggccgaggguggggggagggcgaggggccguuucccggcagccggggcucccggcgcggccucgcuccgcuccgggacgaccuuccgucggcgggaugucgcacucacauggugaacggggcagagggccagacaaacgggugggcgggccucgcuggcggcggcuggcgagucgacuccucuccggcggcgacuccggcggucucugcccggucgcggccucuccucgcuccucuuaggcgacggcggcggcgggcucggccucgaugcccagaaugcaccgcgcggagagcggcucccucaacccgggagagaaggaaaguguaggaaaaggggcgcgaggacggagaaggagcgugcgugcgcgcgagggguggcgaggccgggcggcggcuggugacgcagcaaaaugcccgggccggccgccgcgcgugcgcaaucg

SEQ ID NO: 5810 - RNA, 38150 nt, Mus musculus
agaagguggcgccccugaguugccuguucuugguaguuugcucuuggagcuuggguugggggaaaugcuguuaccggguggggacagcuccagauccugacucgagucggcaaaaagcugauaaagaccuaagaguacacaggucaccucuuucugcuuugucacccaaguacagacuuggaaacugauauuuuaaaggucauuuccaucccgguguucguguucucuaagguuuguagagaaccuuucucucucgcuagcuguaacucuuuguuuccuucauccuuuacuguccccuucaaccacaguccuaaaguauuaauauaguucuaaccuuccuccauauuucuccggucggcccuguccucgccuccucccucucuccacccaaugaaagccccgcccuucccuccucccucccaccccagucugucauacagggacaucacccuacagcaguucaggcugugucguucgcaggaagcauacauuggcuuuuuugggguuugcgaguucccagcccauaguuggacaggauccaacaguagccuucaauugaagcaagacccaaggacagugagaaucuggguccuaauccugaguccugccagccugacauggguaaguaugauagcugccccugggaaaggccugagggaugcccagcucccucucuggcugacucagcagggguggggccuaaccuuugcucuuuugggggagugaaggaagagaaacggacugugggggggacacggggcuuagcuggugagcugcugagcauuggcaagcuccagcucuaaggaagagccugggguuguaucuuagguuagggcuuccuuccucacccuagaaccccccgcuccaauuuaagugcagagauucaaguaguauuuuacuguauucauuacuaguucagucuuggucuuguaagagaugcuuccccucccccuaguuucucucgguguuucuuccuccccccuuuaacccaccaccgggucggggcugcacugagcagcugcuuccuguugccccagagguugcugcaagggugguggugguggcuggggccaaaccgagcaaugaauaaagucgauucuuagcccugcaucagccucacgacccuguuacggauggccuccaccauugacaggacagagagcguuuugccucugugguuuccugauuccagauuuguacagcuguaguacggauagggccgggagaagccuguuuaccuagcagggcgcugugcgugaccccgacaugcucucggccuugaguucccucuccugcucuccuaggccuccuugaaucuuuguggcucccacugucucuccagccuccuuugugaauaagucuuagcugggcgccccgugccggcaaaaagagcucuucaaguacuccaguucagacccaccgcuguccccaacuacgccgcagaaguuucugucuuuuccugcaucugggauccuuccugguucuggccccuaggagacgccacccgccguccccucccccagcggagccuucgcgacagccgucccugagcgcucguccucacccggguggcuccugccccuuuaagcgccgcccccccccccuccgccgccggccucgggcugggggaggaggcgccgccgcccggcucggccaccugcgccgccgccgccgcccggcccggcccugcuucaggugaggcccggcauccgccuccaggcccgggguccagggcagggcguccccgcagccgcuuccuccccugggauccaagcucugaccuucccugcgcccgcugcccuugcucucucccccgcccugccuccucgcccguuccuccccuguccucugcgcccgggauccggaggcuucucacgccucuccgccauccucucccgggaaccccuccuauuccggcccuggaucuccccucccccgcgccucccucgccagaaagcucucccgcggucuggguuucgccuccucuucucuggaacuagcgcuuucccacgccauccuaaccccggagggggggggagauaaccgccaccccaaccccucuccugguagugcggggggcgggggguacgacgcacguuacgggcgcuguccgcccugcuccgcucacccuucaaguucagcuaagucucaccuaaagcuuuucuugccgaguuuggggucggacccgagcaccgcccccugaucucggugggaagggcgcucggccccgcuggagcuggccccucccccuaguccgggcgccgggggcagcggcgcugcgggaaccuugugauacuccgcuucagcggcuguugcggcagaacaagacuggggcuaagucucuaagggauugggggugcuggguaaggcaaaggaagcccaaccuucucuauuucagguuacuccagaaaacaaaacaaacaaaaaccccgagaugucacugucuuauaugccuaucauaugcccagcuguccguuggggaauuuggagacuaaauccgaggggcgcagacccacuuggagaaggggagggguuacaaucuuuuuggcauauuaugagagaaccuaaccuuaccaaaauacggugagauugucuccuccgaaccugagugccgaaaaggaaccaaugggaauugcuacagggccaagagcuguggcuaaggcaagaucgguucagucauggagugggaggucuuuauaauuacccuaccuucaauaggaaauacucuuuccauccagcugagccccgagcuccuucucuagugccccugccuccagaauuaguagaaugggugucaggguuugucuuauacuacucugagucacaacuaaaggugcugggaagggcgcaguguguguguccuguagugcuuaagguuggaugcuuggagugucuugaagaggaaagggaagguacagcuaggaugcauaccaccaucucauagccccagccaucuggcuccagaguggcuggcacaaugacagcugacccagagacagggagguacagcaggaacuuggagggugagaaggcgguggcagguguuuaucgccacuucacgucucaucauccucuggcuuguuuugugggagguucagucuguuccccagacacucuucucacagguugcuaauaaaaugaccguuggccccuuucucuuuggaguagcuucuugaagggaggcuuguuggcuaaccagccacauuguuauggggauugacaaauguuuggggacacaugggaucaaguccgcuuuuuugcguucagauuuggcauggggguggggggcaggucacaaguguuguauguuaaggcacccggcaaaaaguaaaaagcuuuggggcguauucccugcccaccuuuauccuucagagaguagggaagaucgcagccuaggugggauaaagcgauaggagcccuucuguaccagaugaaaaaacguauuaugcccuguuuuuccucuucuaauaucugguggucuucuaucuuaccucuuucuuuacuggcucagggcaggguuugggccuaaaaguagccgagguuacuaggccuggggcucggaaggggugggaacaguggggcacaggaguaaccggcucuuccggagccagcgguggguguguguggguguguggugaugaagcgaaggggcguggucacggacgucugacuggcgcaggcuccuccucugcgugcccugucucaaacugguuagccccgggugggaaguaggaagagucaucugcccuggaaaaaggagaggacagaaagauaccagcuuuccucuaaaucugucucuucccucuccugcccuuaggugccaguuccaaccuaagcuuuuuuuuuuuuucuuggugguggugggguuacacauuuuuguuuguuuguuuuuugagacaggguuuuucuguauaguccuggcuguccuggaacucagaaauccaccugccuuccccucccaagugcugggauuuaaaggcgugcgccaccacacccggccacacuuuuuuuuuggccuaaguuuacuucuccuuucuccagggcguggagguuagugggcuuuuggaaagauaagguguauccccccaggcgaccuuuguccuuuuguguuuuuuccagacaaagucucacaaugaaguccugacuagucuggaacuggauuuguagaccgagcuggccuugagcucacagggcgauccucuccucuaugccucuucaguguaggaaugaauuacaggcguagguugccgugacugacuuuauaaacucauuuugacaggggagagagauuuuguucugucuccuccuucccuuaguaaucuacuuagcucuguugagggagaggaaccaugugcugagcccacauuuuuggcuuaucuuaaagagaucuuccuuuugaaaccuaucugaacuuuuuauaaugauggguggguaaagcaucucccacacucagaaucccugucugggguaaagacauuggcguuagacugcggguuugguucaaucagacucuguccacacccagauuuccaagcucuugggaucccccagagaaaaauguauuuguugaccccucaaaaccagccagaaucuuguuucugugugucgcucuuucuaagucuucagacuuagcuuugcguaguuuaggcaauuguuuacauucuaaaacuacauuucauugauuugaaugggaauuaugaagccagaagucuugaauuggaaggaaggggaaugcaguucccuucuagucauauuuuauuuacugugugacuuugaacaggucggggagcuucugugggucuugaguucuucaccuagugagugagagguaggaacugaaaagaaaaagcuguaacauacgacacuguuucccaucuugggucccugcaauaacauucagaugaaagcuaagccauaauuccugucuagacuuccaguucuccaaagaacacagccauguagccuuguuggaaaagguuugggagaugggcggugguggcgcacaccuuugaucccaguacuugggaggcagaggcagaggcaggcggauuucugaguucgaggcgagucuaucgagugaguuccaggacaagccagggcuacacagagaaacccugucuugaaaaaccaaaaaagaaaaagaaaagguaugggaacagaaaaauauuugggucaguuuuuugguuaucuuacugcuuaucuucuacccuuuggccacauuuaggcuagauucagaucuugacuguguggagccagagccaagucuccuuuccccaugugcaggauucucuccaacgaccaagguccugcagaugacaccaggaaagcagugauccaggcaggaccagguugucccuacaggacauaggugaguauacugcuuccuuuucaucccuguaaaaucgcucccuauguaucaacuuccacuuuuucaucaccacccugcugaggaaauaaacagccccgaaaugguccuagaaauggguucuagccguuaugguuaauccugggauauggcucaccuuucaauuugaccugcgugaagcaagacuccaacccucaaagagaugcuggugaagcagggaacugcugggagggauucugggcgcuaggacccagauucggaucggggccgggcacuaggacccggcggccgcggcgguggagggcggugcugccggccccguuuccccgcccccuccguuuacuccucccccgccggccauguuggcucagcucaggccccgcgguugaaccgcgacccccuucccccucccagaccccgcacccugcaccccucucccgcgggagucuccucccuccuggcgcccggagccuggccaugugaaccgcccgucccccggggagaagcgagccccgaccgggcuggacgcggucgccucagguuuguugggugugcggccgggggccgagggucgggcgcccgguguccgcgggaguuccucaggcagcuggcgccucaggugaccgggacuucuccccgcugggacgccgccggagcuguugggagaccccggccgggcgcggguggcggcugacgaggcccccugagguggcggugcggucgggcucggcugggguggagacccauccaguggcggcggaauccccgggagggcuccaccuccuggggcggcggggucgcgggcgugcaggggauggacgcggggcuucccacggugggcuacaccugaggcucgugcggauggggguuucggccgcggugagugggggugacuccgcggugacuccccggagagccucggguuucuguucuccgggucguggagagggccuggcugucggucgugcuggccuggcuuggggcccuggagccccgggagaaucccugacucuagagauggggguugauacaacucauacuuggcgucugguuugaguagggccgaaaacugaggggaagaauaaagagggauuccuucccaaggaaauccucuccaaaggggauccccguuuccguagagagacggugcucucgcaucaucccuuucuuucccggcguucccgacuugcacaagucaaugccaauagcaggcauccuuuguggagcuuacaggaaugagggauuuguauccuucggggggagugguguuggugggggcgauagcuuccaccaccuccaucuguacacaaacugccccucccccagccucccgcaggaaguggccuggaaauggcagcugugcguucgaugcugcgucucuuguuguuuugaaaugaccauuuuaaucugauuugguuucauuuucugaagccuucugggcaggcuuggaucugccaaacguuagacuuuuuccacuguaguauucauuugucaucuaguagucggucaacuauaguugacccacugaucuugguccuccuuuguacacugucucuucuggaccccacuccugccccaaccaaguuagaggucauagaaaaucaaagugaguuaucacgagcagugaucacucuucagaacaagcagugcagauugaguguagaaagcugccaagaguacuugagaucuuuauggaauuagaguggcuuucuugauccuuaauauuuuuaagcaugacaguuuuucuuuuuugcaaaucaucggagcaaauaagcuuguggagaaaaggauacuuaugagauguggaagaagggaaagggggaagauguguacuuaugauuaguauauagggauggggacugauuauuauuacuaacgagaguguuaagcuuguuccucaguggugaguuuaguccaguccugcagggaaaccuccucguugacuuuuuuaccuuuuacagaacaaauuaggggaauuugcuaucaugauguaacuuucgucuauacaaggcuggcuggcuggcuuucuuucuuccuuucuuucuucuuuuuaaacauuuauguuugugaguauacugucagucuucagaccagaagagggcaucggaucccauuacagaugguugugagccaccaugugguugcugggaauugaacuuaggacuuugagcagagagccagugcucuuaaccacuaagccaucucuccagccccaaaagaauauuucuugaaggguaggguuuuuucuuuuuccuuaaaauuuuuguuguuguacuuuauguguaugggucuuuugcugcauguaugccugugcaccaccggugugccuggagccagcccauagagacccgaugcaggguuuagauugcugggauugggguuacaaaauaguugugaacugucuugugaaugugaagacugaacuccuguccucuggaagaacagcgcuuaacugaggagccaucucuccaucccaaaauaacgugcuuuuguuauuuuuaauuguuggucugcaggggcuggagaggugguucagcagaugagagcacuggcugcucuuccagagcacugggguucaauucucagcucccacauggcaguuuacaacugucugcagcccuauguaccaguucuagaggaucugacacccucacacaggccuacagaugagcaaaacuccaaugcagaaaaaaauaaaauuaaauuuuaaaaaaagggguguguguguaccaccauugcucagcugagauuuuuguuuuuuucgagacaggguuucucuguauagcucuggcuguccuggaacucacuuuguagaccaggcuggccucaaacucagaaauccgccugccucugccucccgagugcugggauuaaaggugugugccaccacgccuggcgagauuuuuuuuuuuuuuuuuuuuagagcuuuauuuuauuuuauguauucacauucagacacaccagaagagagcaucagaccccauugcagaugguugugagucacuauguggucacugggaauugaacucaggaccucuggaagagagcagucagugcucuuaaugacugagccaucucuccaccccccugguuuuuuguuuguuuguuuuguuuuuuuaaaagauuuauuuauuaauuauauguaaguacacuguagcugucuucagacacuccagaagagggagucagaucucauuacggaugguugugagccaccaugugguugcugggacuugaacuccugaccuucggaggagcagucgggugcucuuacccacugagccaucucaccagcccccuuuguuuuguuuuuaacuuuuguuuugagccaggguccuagaacucccugaguagacauggcuggccucauacucccgagaucaccuaccucagccuuuugagugccggacuuaaagucuuugucauugcaacacagagacuuguuuuuuguuuuguuuuuuucuuauaccaggaucagacuggccuagaacuaagcuuuugaaguuuauguuggcuuuaagcugggaguaauccugcuucuaccucucagauguugggauuacagaacagacuccacucugccuggucuaaccaagagauuuuuuuuuuuucucuaaaggauaaagugauaucacuaugaucuauaucucuccauuuuguuuuuuguuugaaauuuccuauccaccaccaccccuaagacagugucucauuagauagcccuagcuggccuggaguucucuauguagaccaggcuggccuugaguuuacagagauguacuugucucuguuucccacagaaugggauuaggugugugccccaugccuggcuccauccuguuuuguugucauuuggguuugcuuagggacacgacuugaaauacuaagaauggaaaugugaagaucauuugaagugcccugcaaacaugcaccugucauugaaauugugauuuuucuuuuucuuucuuucuuuuuuuuuuaaagauuuacuuauaugaguauacuguagaugucaucagacacaucagaagaggaaaucagaucccauuacagauggcugugagccaccaugugguugcugggaauugaacucaggaccgcuggaagagcagucaguguucuuaaccacugagccaucucuccagcuccaagauugcaauuuuucuaucagaaacuuguugucugcauauaaguccauagauugaagaucuaggguaggagcaggcuuauguaacuuuugugaaaaugguaucuuuauaaguaagauugaaucauugcucuuagugggguggcugacaaucuggaaacagaaacaggugugugggcauugccucucugaugcugacuggcagguucuucugaccaagaccguaaagggcaucugagugauaucagcugucugguuaugugugcgugcgugugcgcugggaauuuaauucaaggucucacacaugcuaugcuuuaccguuuucguauuuaaaagauauaguacugguguaguuauguuugucacgggguguggguagagauuaaagaacaacuuucaagauuuaguucuauccaaccauguagauuugaauucagcuuugauaguaggugccuuuaaccauugagucuccucaucagccccaccacuucuccuguuuuuagccuguagaaauugauuuuccuuguuggaguuaaaagagggaaaagauguggaaauaagaguuuggugguaaaaacauucuuuuuuguuuauuuuuuuguuuuucaagacaugguuucucuguguagcucuggcuguccugaaacucuguagaccaggcuggcuacaaacuccccacugggauuaaaggcguguaccaacaccugguucaccucuuuuuuuuuuuuuuuuuuuuuuuugguuuuucgagacaggguuucucuguauagcccugacuauccuggaacucacccuguagaccaggcuggccuugaauucagaaauccgccugccucugccuccugagugcugggaucaaaggcgugcgccacuacugcccggugguaguaaccuuuuuuauucuccuacucuuagagugauguaaaguuauuaauugguauagugugugaucuugucugugugugaagugagacaguaaagugaguuuuuauauuuuaggauauagagagguuuucuggguuuuucuuccccccccccccgcccccuuauuucggcaguaggguuucagguaagucuuucuguguaccccuagcucuccugaaacacuccauguagaccaggcuggccuugaaugcagagagaucuaucugccucuuaccuaguguguagagggccuucaggucaguccacagcaggaauguagaaaucaagaaauuuggggcccuuuccccucuagggugauaggucaauaaagugcuguuucguuuguuuguuugcuugagacauaaucucauugugugagauucuggcuagcuuaaaauugggaagcauagaccagacugacuuuuaguucacagagcccuaccugccucugcugugauuuaguccugggauucuuucucuuuagcacacaagcucaagcuggcuuucaacuccuguagcccaagugggcaguccuucugccacgguuuccuauuugguguugucuuguguugucuccccuaccuuguacaugguaguauauucuaucaaaacacuacacaaaacucuuccuuuggcagugaaguguaagaaugugauaugauuccuuuaguuuuguuguuguuguuguuuaaaagaaugguucuuauguaauccagacugguuucuaaauagaucauguaucgaaagaugaccuugaacuuguccuucuugccucuucccaauuuuuuuaaguuuuauuuuuuauuuguaugugaacacugcagcugucuucagacacacaguagaucccauuacagaugguugugagccaccgugugguugcugggaauugaacucaggaccucuagcagagcagucagugcuuuucacugagcuaucucuccagcucaguuuauugaguuuuuaauauuguuagaacuuuucuauuccuuuaucuuauuuacaaggaauaccuaacaagucuauuaaggauccuuguguuuaguucucagccuuggguuuaguucacagcaguauaugaaaggagaagucaagagauuuggggccuuuguuuguuugcuuuuuuuuuuuuuuucuuuucugagacaggguuucucuauguagcccuggcuguccuggaucucacuaugcaaaccaagcuggacuuaaacucagagauaugucuuccucugccucugcuggaauuaaaagguguguaucaucacuggccagcuacuaaaauuccuugaacucagaaaucugccugcuucugucucccaagugcugggauuaaaggcgugccaccaccaccgcccugcaaauuuuuuuaggcaguaucucacuguguggcccuggcuagcuuggaaggcucuaggaaauacagaccggaccuucaacuuccaccugcuucugcuaugacugaguacugggauuaaaggcaugagccacccaaauuugaucccuagaacccgaguaaaaaugucaggcaggcauggugcugugugauugugaaccuagcacuagggaggcagaacugaaagaccccuaaggcucacuggccagccagucuagccuaauugguauacuuaagaucauugggcacccugcuucaaaagagaugaaugguuuuagaaguccucugaucuacacguguacugacacauacaagcucuggcauguauaugaaauugggggcugugauggugguacagacagaggcaggcagauuucugaggccaaccugaucuccauagugaauucuacucuugccagggcuauauggugagacgcucucucaaaaaaagaauuaaaaacaaaauagagggcuggagagauggcucagcgguuaagagcacuaacugcucuuccaaaggaccugaguucaaaucccagcaaccacaugguagcucacaaccauccauaaugagauaugacacccucuucuggugugucuaaaggcagcuacaguguaccuacauauaauaauaaauaaauuuaaaagggggggggacuggagagagcucaugcaugcugcucuucaagagaaccugaguucaguuucuagcacccuagcacccaccucaggcagcucacaauauagucuguaacucucucugccuccaggggaugggugcaacaccuauuggacucuucagauaccucugcucauuugcagaaagaagacauggguucuauucccagcaccuacaugguaguucaaaaucauuuuuuuauuauuuuauuuuuuauuuauaugaauauacuguagcugucuucagauacaccagaagagggcauuagaucccauuacagauaguugugagccacuaugugguugcugggaauugaacucaggaccucugaaagagcagucagugcucuuaacugcugagccauuucuccagcucccucaaaaucuuuuuuuuuuuuuuuuuuuuaagauuuacuuauuauaugugucuucagacacaccagacgagggcgucaaaucucauuacagaugguugugagccaucaugugguugcugggauuugaacucaggaccuucggaagagcagucagugcucuuaaccacugagccaucucuccaccccccuaaaaaucauucuuaauuuuagcaguuucagggcaucugauguccucugcugaccuacaugggcaccagaugugcacaugguacaaguauaaauuuuuaucucuaugaaaaacuggcugugagugguagcacacaccuuuaauuccagcacuuaagaugaacagauagguggaucucugugaguuuaaguccagccuagucuacauauaggcuguuccaugacagccagggcuaaauagagagccuaucucugaaaaaaaagaaggaaaggaagggagggagggagggaagaaagaaaaaaaaagagagagaauauauuucucugaaaauaagcuuauaccaaucuucuagugguaauaacaaaacgcugcgccacacauucagcaguaaaucauuuggcucuuucucuacuuuaguguuaaauuaaauucuggaaacaugguggugagacuuaacauccagaugauuguagagaaccugcccggacaugcaguuuucuuugaguaguacuuuccuacuaccucaguguaaaauuucaucaccuuccuucaacuucacuuaggguucuaguuggaaauagagguuaaagaaaggacauuuugcaagagauugagccucagucagaacauguuuuaguuggucugauucugaguuccaaaagaaguuugaguagguuagauaagagggcauccuuuaaugugaguuuggcaccuggaacucuaauggaacaagcugacuuugggaggaugaguucucaagguaugaaauuuaaaggucaccacugucuccagugucaggaacugggaguauagaaagcuuggagcuucccaagaugugugggacagaauggggacaacuuguuucucaaccuugaugcucuaccuugggucauuuauaucacuguguccucaaucguuauugcucuuaaagaggaccugggaucuauucccagcaccauaugguggcucauagcugucuguaacuccaguuccagauaucuagcuccucaucugaccuaagggccugugugugguguacauacacaugcacuuaggugcacacacacauauauauauaacauuaggguuuuuuuaaaugcugagaagcaaguugacaugucaauauucaccuguaaucccacauuuuccagggucuaacuauuccuagcuggccuggaacuagcuaaguagaccaaguugaccuccucaaacucggagauccaugugcuugugccuuccaaguacugggauuaaaggcauuugcugccaugccugucauuuucuuguauucuuuuuuuuuuuuuuuuuaagauuuauuuauugauuauauguaaguacacuguagcugucuucagacacuccagaagagggagucagaucucguuacguaugguugugagccaccaugugguugcugggauuugaacuccagaccuucggaagagcagucgggugcucuuacccacugagccaucucaccagcccuuucuuguauucuuauauuguaacaucuaggaguuaaguuguuuuuguccgcccccccccacacacacacaauguaugugagugaguacauggucacuacauuugggcaaaccaggagggcagcaucagaucccauuacagaugguugugagccaccaugugguugcugggaauugaacucaggaccucuggaagagcagucagggcuccuaacugcccaggaguuaaguuuuauauauuaagucuggcuacaucaucucucuuguauuucccaucauacuauaaguuuuaaaaacaugccuuuuaaaagccaggcuuggugguacaugccuuuagugccugcacugggaggcagaagcagguggauggaucucuugcguuugaugccagcauggucugcaagaccaggacagucaggguuacacugagaaacccaucucgaaaagcuuguauguguguguuauguaaguaccuuuuaagcugggcgugugucucaugccuuugaucccagcaguuagaaggcagaggcaaauggguuucugaguuugaggccagccuggucuacagaauaagaucuaggacauucaaagcuauacagggaaacccuguuugggggaaaauuuuuuuuuaauuuuauauauuuacauaaauauauaauacauaugcacauauacaaaaagauaaacauucuuuuuacucuuugucuaauaagaaaaacuaacauggcugggcuuuauggacauaccuuuaaucccaacacuuaggguuuguggcaggggacgucucugaauccuaaggagucugaauuaucaggggcugacacucuaucaaacaaacuaaacauuuaauacaagggccuuuauauaaaguuucuuguuuaacucucacaaguuguagaagugcauaauaaauuuuuuucuaaguauuuuguccaaagucaaugaagccaguguagagcuaagauuugaacauggaaucuguucuuuugcucauugacuguacagcacauagcaaguauguaggaaugaaaugagugggauggcugugaugagaagaugcacuuaauuuguaaagucggaugugguauuuucucagagugauagaauggauaaguuucuuuguauauucaauaacaaaacaaaaccaaaaaaaaagaaauuaagugugacccaucuuugaggguauacuguuccgaguagauugauaugugacggccuaaaacugggggaaaaaggaggagugcgggucaaguggaauugguuccuuccaggauuucugaagugagcuauugcauguucucuuugcucuguggcuuaagcuuugaaaguaauccauccuaaaacaaaaauuuaguuuuauuguuuuacuuauuguuucacucaggauuauuaaucucuugauacuuacuuuugucuccaugcucugaagaacgggcuuuccuguaacggggacguccuggaugacggcggucuuuucaugugugcuuagcagauuagagccuacuauuuacuuuacacucgaucuuagccaaaaagcugagaaguggugggugggugggugggugugugcucacgcaugugcaggccucucuuucaaccauguggguuccagggauugaacucagcucauuaggcuuaccugcaaacaucuuucuuuaucuguugagcaucuugccagcucuuacuguaauuuuagaaugaagcuggaauauucuauaugagauauaaauuaguacagacaacuuuccugaguuaggccuuguggcacaugccuguuaacgacauauuuucuuuccuugcugaguugaggcuacucuagguugcaugaaacacacucaagaaacaagcaaacacacccauucucuccaccuugcugcucacuuaaauagaauacaaguugcuuuuauuucuuuuaguuagaauuaagguacuaguuguaauggaauugauuaagguacugguauuuaaaacuauaaaaucucagaaugacuaugcaguaaugcuacagaagguuuacauuuuagacucaauugcauucugaaggcugauugagauguuuuaguaaagucuucugcugccaggccugaggacugagaucaaucccuggaacaugguagaaggagaggccugauuuucccaaauuauccugacuucugcacauauaccauggcauguaugccuacacacauauaaagcaauuuauguguaugauguaaguauauuugcgugugcaugcauuguauguauuuauguaguguguacagacuguucaugcauauaccuaauguuuaauuuucaauauauagcauauucauaaacugauuucuugcuuugaaacaagaucuuacuguguacuccagucuguccuugaguuuugauccucucgccuuggccucuuaagggcaugugccaguaggucugacugauacacacacacacacacacacacacacacacacacacacgucuacaucuuagagauguaggccaguggucauauauuuucauaaccaacuuauccuuuuaaacagauaauuaaaauauuaccuaggucugcuuuauugcuucaacuuugggaacuugauaaaggaagcuuucuaauugcccagcaugggugcaugccuuccaucccagcacucaugaggcaaaggcagguagaucucuggaguucaaggcuagccugaucuacagagugaguuccaggacagagaaacccugucucggggaaaagaaaaaaaagaauguuuucuauguaagugcuuaugcccucuaaaaguuauuaacauaacccaaggccuuguuuguuuguuuuguguauaaaaucaaucucucacaugcuagguuaauaugcauuagcacaucacaaauguccgacaggucgggcuuucccaauaguucuuaguucuguuuuuauccucuuggacagaucuuucaguguuaaguucauuuucaccaagggcuucauuuccuaccauuccuagugcagggcuuauaguugagauaccauguuugacuuaaaguugggucucugcccagguuuaggacauauuuucuucucuuuuccacuugcaucuucucauaguaccuacauugaaggguauguaagggagggaggcacacagucucuaggugaucauagaaccuuguuuaaccacagauuauuuccccccuuucuccguccuacagaaauggaggcaaacgaccauuuuaacuuuacuggccuuccuccugcaccagcugccucaggacugaaacccucuccuuccucgggggagggccucuacacuaacgggucucccaugaacuucccccagcaagggaaaaguaaguaugggggccauagaucuggggagaggaugggcaccaucagaucaggcuggcaaggggagacugaggucucucucgggcuggccaccgcacaacucuuuggcagguagugaccagaagcaauccagagacuacuacagcuagagagaacgcaagcugcugagaagggggcuuaaggaagcuuuuuuuuuuuucccuuuuucugucuuggaucuagauuagaaaagauuuaaaaagacauacaagcuuuuccaucuuagcuugcucuuuuguuggcccuuuugcuggcuacuggcagaaaaggaggaagcuacuacugcuaaagaugaggguggugggucuaugacaagguaaggcccucuggaaagguuuuuuuguuucguuuuguuuuuugauuuuuugagacaggguuucucuguauagccuuggcuguccuggaacuaauucacguuguagaccgggcuggccucgaacucagaaaucugccugccucugccucccgagugcugggauuaaaggcaugugccaccaugcccagcuuggaaaguuguuuuuaggaaugaaaaaacuuuuggacuaggugaagagggugggugaaggucaugguaaccauguuuuuagcuugugcaggaggagugcuggggcugccucauguccuuguucccaaggguaggauggacagggccuccccuagaaauuuaucauucuacaugaaagugcugcuguugagguuauuuucuuuuucuuuuuuguuuucuuuagggguaauugcuuuuucugacccaggauggcuuugaacuggugacagucuuccugccucaguucuaucaauuaacauucuaaauuugucuggauuucaaaucauuuugcuuaaaaguccaauuucaaaugcuuucuccuuccuugcaguagaacaguucugacuuguacuugcuuuccuccugucaguuauaggacacuuggagauaaacacaaaccccucuauuucauugggauuuccacaaauacauaccuaccucccugcuguaggauuuccccaaccauacaccugcuugcagcuucuuaguaucuuagucccuuuuauuuauuguuguuuuuugcaaacucaaagauaacuguuuuuagagcuagauucuuucugcagcacuggucaugcaaagauuuuuaccuacugcauauuacccuccugggccuauggggaggggcuaaccccagccuucugagcuggaaucuugucacuguggugacugcaaauucuauucuuagcucagugcaaagugcuggaucugcauguggcagugagguggaggcugucccuucuggugccacuguagggccaaguaggcacuaagcaaagagguggguggggacuggagaauucagucagacccuccaaggaaagaauucccauaaggaaugagaguggggaagaaugcaagucauuguaggaaacguauguacagcuucauguagugaaaagcuugcaggagcaauaacagcugcugccaccagcuccugugccacaccuagaccgcagccucagcaacagcugcuaagcguacacaagagcauccaaguuuaguguccccuugagagguagaagauaaagggagcagaggagucccccuugcuuguaccuucaacauugucaauuugaaguuuauuugguggcguuauauguauguucauagccaaaccuuuucuguuuuuuuucugccagguuugaauggggaugugaauguuaauggcuuaucuacuguaucucacacuacuacuucagggauuuugaacucugcuccccacuccucuagcaccucacaccuccaucacccuaacguggccuacgacugucuuuggaacuacucacaguacccaucugccaauccuggcaacaaccucaaggacccaccccuucuuucucaguucccugggggacaauacccgcucaacgguauccuugggggcaaccgacaaccuucauccccaagucacaacacuaaucuucgagcugggagccaagaguucugggccaaugguacccagagucccauggggcuuaacuucgauucacaggaacuguaugauucuuuuccugaucagaauuuugaggugaugcccaauggacccccaaguuuuuucaccuccccucagacuucuccaauguuggggucuaguauccagaccuuugcaccuucccaggauguaagcagugacauccauccugaugaagcagcagaaaaggagcugacuucaguuguggcagaaaauggcacuggcuugguaggcagccuggagcuggaggaagagcagccagguauaacugggucugugagcugggaguggagaggggaagugggguugggggggggugcacaguagcuuuuugaagugaggaaaacuugucuuuccagcucucugcaguauaggcuaauuugcauguugauguaagcagagccaaauggcugggguuuuagugcagcagcaccaguucaagagugggaggcaaauuaucccaagcuugucaugcagagcugcuggccuggagagggcuggugggugaugggcaagccugaaguagccaggcagacuccaucagaaauggcuucuugggcuagggguguaucuuaguggguagcaugcuuguguagcaugcauaaauggggccuugggguccaccauaauggcaaauccuguaaucucagcccuugggagguggagguagaaggaguaguucaaggucaagcccagauacauaagacccagucucaagaaagggugggacaggguugcccuuuaaauagaugaaauggcuacaacauaaacagagcagugaagccaugaagcuaucuuaguugaggcaagaauaggugcugcuugaaagaguugccugaacaccugauccagcuacauuggaggcaucaucagcuuccuccauaguggugacuggcuuaugaauucgagaagaaaauaaucagaguggaucauugcuuaucuguuaagcuaccucccuccccccauccccucccccucucucuuucuuucuuucuuuuuguuuauauuaauauaugacaaucuuuuauuucccuaaaguaaauaaaaucuuagucuguaguucauauucaguguaaggguggcuacccuauuuaaaaaaaaaaaaaacauuuucucuguuccaguuguugggaaaacugacuagauauaugguagacuucuugucucaggccuuacucuuccucuuugcaugaugcauaauugguuuuaggaauaugucuggauacaaucuguuccuagcauagagcuagaaauaaagguugauugaauugaaugaacaucuuauuuuuaaagcaguuagaguuuauugagagaauguuuaacagauuugagcaccaguguggcuggaggagggccauuuaggacagagcaguccauaccauguacauaugugagcuucauuaaagaguugucuggacaccuacuguaacaccuaauauagcuaaauugaagguuucagcuuugacuuuccgucucuccugggauugaugccuagaacuaaagauguguggcuacaaugguucugucuccucuguggagucuuuacaccaagaagucuccguccuggucccugaucccacagugagcugucuagaugauccuucacaucuuccugaucaacuggaagacacuccaauucucagugaagacucccuggagcccuuugacucucuggcagcaggugggcucugcaggggguucccuuuugugcuggccugagccaaccuguuacuuggaaaaguuagaaaaccagggaauguuuuaaggaaucugggguauugggcuuguuggugaaccuuuaguaagccauagucuauguacacugcugccugggccaacuuuacucacuuugguccacuucccaggcucuuucugucuucuaguuggccaagagcccuuggcugcaauaauucacugaauaggcuauaacuaacacacaguuggauuauuuagguuuuaacuaaauagaaaaauuugccaauuaaauauaaaaacaaggucuauuuuaugauaaauaaaugauguuagguuucuacaaggaucuaugggguagauacacaguaucuuugccuucauuuucacagucuccugacuuugcuuuaagagggcuauauguuuccccuaauuuauauuaauguauugcaugguaggguagcugacauagcagaguugugacuuugacaugauccugaacuacauagugaguuucaaguuagucugaacuagagacccuuucuuucuuuguuuuuuuuucccccaacuccccaauucauacacuagaaaguagaauauuugggggggccuuaggaaaaucugacuuucuaacuuaauucuuaauauucugcuuuuugaauuuucuuucacccccauaagcagagccagugaguggcagucuuuaugguauagaugaugcggagcugaugggugcagaagacaaguugccucuggagggcaacccugugaucucugcccucgauugcccugcucucaguaaugcuaaugccuucagucuccuggcagacgacagccagacaucagccuccaucuuugucagcccuaccuccccaccugucuuaggggagucugucuugcaagguaagugacgagagggguaggacauauacauagaguugcaaaaacagugagagaauggguuccauaauuaagcccuuaaacugggaaguaugaagcuguaccuugcugacagacuaugagauggugucuagugggaauaaaaaggcauugaccaugguacuuugcccuguagagaacuugagagacuuggaaguugucaaggaaaaaggccagaggccuuucaagcuucaggagaaggaaagagccagcgcugcuuuguuaaaacuuaauuuugggggcuggugagaugacucaguggguaagaguacccgacugcucuuccgaagguccagaguucaaaucccagcaaccacaugguggacauauaauaaauaaauauuuaaaaaagaagaaaaaaaaacuuaauuuuguuuguaugaguguuccuaugucuguauaucuauguaucguguaugcauugguguccuuggagaccacaagaaggagggugucuccagcuagaccaauugggacuggaguuccagaagguugugagucacccacuugugggugcugacuuuucucacuaaaagaccuuaaaauaaccauguuuaccauagugcaaguuugaguguuuaaauucaauuuuauuuauacuguuguuugcuuguagauaacagcuuuggacugaacaguugcagugacucugaacaggaagaaauagagacccagucuucaaacuuccaacguccccugacugagccagcuccugaccagccaccuaguacucaacuacauccagcaguuucaccaacagccuccccagcagccuccuugacagcaucugcagaaaucucuccagcugucucuccaguagcauccucgccugucccuccugaagucuuuguagcagucucuccagcuuccucaccugcucugccagccaucucuuuggaagccucuaugacaacuccaguaacuucuccucaagguuccccugaaccuucuccagcagcugccuuccagacugucuccccagcaaggaaaaaugucagcagugcuccuaaagcgcgugcugaucgagaagagacgacuggaggagcaguugcagucucugguaguggugaguguccacacucugcucccaccugccuguucucuacagaagcacaugucacauauggugcccauccuuuuguuuuuugauacagugucucaguauguagccuugacuagccuggaacuugcuauguaaaccaagguggcuuccaauucaaagagaugugucugccucugccuccaagugcuuuauccuguaacuuugcuugacuucuuaucuugaugucucuggucuuguccucuaggugauguacugaagagacguauugcuaccccagaagaaguucgucuuccccuccagcauggguaaaugcucuagauggcuacacacauugaccucaagaagcucacgaaugauaggaagagaggagcuccucucuucaucuuggugggagaggacugggcuggacaggaguggacuacaggacaguauggagggugcaggacugggcaggacaggaguggacuacaggacaguacggaggguguggaacuccuggaagagcagcaaaugcuccuaacugcaggguuaucgcuccagaccaguucucucuucuuagggucugucucucacauucuuuguucauccuuggucuugauccuuuuucggacuaaggcccaaguauccaaaggagcuacauagaacuguuuccauagagcgggacagcaguuaagggagagaggcuuccuaccagugaacugggugguucuguggcagugauuucuguuggaaugcucucuguggaguuaaggucuaaaacaguaauuuuggugaccaacccagcuguugucagaggccuacauuuucuaggcuacuugaugcuaccaagucuucgugcaacugcaauauuuaagacagaaguaaggcugaguuuuauacuacacugcucagaacauagucauacgaccucgccuccuuaguuauuccaugaugucggccucuacgcgccuacucuuacacguuguucugagccagggcaguuaguuuccagcugcuccuuucaguagcuuuauaaaaaggaggguggggaaucuuuguacauguuugccauuuagugcaguguuuccucugaaguacuugcuucagcucaagcacugugagccuguuuaucaagcuugugugcugugcuguuucuguaugcaggacuguguaggacugucugcaugcagggcuagugagacagcuggagggggagucugcucagugggcuuggcuccuggguggcaugggaguggguaggggugugaccugguggcagggcccaugugcuucucuggcagguggcgaagagaagugcgcaucaagaagggcagccaucgguggcagggggagacuugguacuauggccccugugggaagagaaugaagcaauuuccagaaguuaucaagguaauagcaagccuuuucuugggucccaggagaacaggguagcauugucuccucuggggccuguucugcgugugcuguuacugccaaagccuuggaaugacuaugacuuacuaaugcuauuuacuuuuccucucaguaccugagccgaaauguggugcacaguguccgccgugagcacuucagcuucaguccccgcaugccuguuggagauuucuuugaagaaagagauacaccagaggugcuggccugaggauuaaauaguugggaaaaaauuauagcuuccuuucguggaguuagguggcucaaggggucugggauacuucagagggcuuugcaggccacugucuucucauaacucagugucgcucuuccuuuagggcuugcaguggguccaguuaucagcagaggagauuccuuccagaauucaagcaaucacuggcaaacgaggccgaccucgaaacaaugagaaggcuaagaacaaggaaguucccaaagugaagcggggccgaggucggccuccuaagaucaaaaugccugagcuguugaauaaaacagauaaccgacuuccaaagaaacuggaaacccaagguacaguguuacuuguagcucagauauugugcucccuucaggagguauugcugaauugcugauaacugaucuuccccggaaggucugacaaaccuaaauccauucuugccccuuggaaggcaugaguagaaccccaucucuuugugguuuuuauuuuuuguucuccaccccccccaaggcauuuucuuccuuuugaguuguguuuacuagaaaacuaagcuguggguuauucucacauauaguaauggccaaacgagaaggcugccaugguuuauuuugucuuucagcucuuugcauagacugaauuuauucauauaauuccugugauuuuuuuuauuguagagacuucaaaucacaccugaauccuaaagauuguuggagcacuauuuuagugggauagauaaaugggaaaaugucugauuuuuuaaaauaacccuuucuuaaaaaugcuuguacuaugcaguguacagaauaugaaauggucuuuuuaauuccauucacacaguuuuagcucuuuaaucugguugcaucuuuuuucucccccauguuggggaccaacccuaggacuuugaacauucuucuagcaaguccucuacaaaugcuaaaaccccaaucucagaauaucucauuuuuuucaaaagguuuauuuuauguauguaaauguuuugcacauaggcaccacguggguaccugugaaggccauaugagggugucagacccccuagaacuagaguuaaaguugguugugagcugcgagcugaauccagguucuuugcaagagcaguaagaguucuucacagcugagcaucucucuagccccuggguuucucuauguagcccuggcugucucacucuguaggcaggaguaaccuugaacucggauaucugccugcuccugccucccaagcauugggauuaaaggugugugccaccacaaaaucucuuaagugauuuauuugcccauaguauuuuagaaaaucuaaaaauguauggugaggcuggcgugguagcucacgccuuuaaucccagcacucgggagacagaggcaggcggauuucugaguucgaggccagccuggucuacaaagugaguuccaggacagccagggcuacacagagaaacccugucucgaaaaaccaaaaaaaaaaaaaaaaaaaaaaagguauggugauguuuauguaucagaaaugaaggaauagguacugucaggucaaaaugucagagaacuaucugcagauuuacacuuugauucagaucucccaguacacugaucuguggaagcugagcaugagcacuggcucuggcaguggugagcagauuguuuggaagaguccauuaucuucuuagugcacacuaggaugucaguauuauaagacugcaguacccucuuucccugacaguguagauuccggguucuuuucucagcucucuuugcacuaaagucaggccgugugcaucaguccaugcauugcuacccuugcugcagagccagggaaagcgacagauuauaaagguauucugcaguuguagcuuccuuuccaucagcuggaccauuucuaaagccguugaguugucgucagucuguggcuccugggcuggcagugcugugugagcgcuguauacaccgccucagcagaugccucucacccaucucucuuaauguuuuauuauguccacuaaaaaaacagccauucaaggagcugcaugagaagccagcuuuguccuagacaugugcugccacgggugcccagcaugguuucuaccugauuucuuucaacuuccuucuugccuucacagaaauacugagugaggacgauaaagcaaagaugacuaaaaacaaaaagaagaugaggcagaagguccaacggggagaaagucagacuccuguccaagggcagguaagggacaucagugggcugacuuuuuuacaaccugcuucauguuccauuucccacauuuccacucucaguauagcaguacacauucacuagguggaauuccuuaggcuagauuuagaauggucuuggucaagagcaauauaggcgccucuagagugagagaauggagccauugccagguccucaucgucccgucucaccucuccuccccagcacccuuuucuguuuuugaaucccagcccaagcagaggugcuuuccaagucauuugaggagaaaugacuucccuugugguuuacaggccagaaacaagaggaagcaagacaccaagagcuugaagcagaaggacacuaagaagaaauugaagguaugcacacgaauacaugucccaaguguaauuuuauuuucccaggguacauuaugcaugcuagacaagcacucaaccacagagcugaguucugcucucaagucuguuuguaaagcaccacagagguucuccaagugcacugugucagugcgacaguuagaucuuggacucgagugugagguccuaggaccaggcgcggcuggacggguccucacgcgcugacgugugucuuccucucugggugggcaggcugagaaagagaagaugaagacaaagcaggaaaagcugaaggaaaagguaaagcgagaaaagaaagaaaagguaaaagcgaaggggaaggaagggcccagagccaggccauccuguagagcagacaagacccuugccacacagaagcggcuagaggagcagcagaggcagcaggcuauccuggaggagaugaagaagcccacagaggauaugugucugucugaccaccagguauuaagggucauggaagggccagugcugaggacauuucucguguuaccagaaggacuugugaauucuagacagugccucuugugagucuaacaagauacccaugcgcuuuucucuccccagccccugccugacuucacacgcaucccugguuugacacuguccaguagggcuuucucagauugcuugaccaucguggaguuccuucacaguuuuggcaaagugcuaggcuuugaccuuaccaaagauguuccuagucuaggaguccugcaggagggacucuuaugucaaggugacagcuuggacaaagugcaggaccugcuggugcgacugcugaaggcugcacuccaugauccuggucugccccccuacugucagguagguguuccugggccuggguuacaguuuugcucucuccuugagaacacguaaaagcuuccccuaaagcaaccacagaaguaagggaaacguaguugcuuccuguuucuagccuuuauaugccuuuuucuuugcaaggcuucauuuguucauuuucucuuuucuuacuuugcaguuucucuuuguagucuuucaccuuuuucuuuuuuuuuuuuuuuuuucgagacaggguuuuucuguauagcccuggcuguccuggaacucacuuuguagaccaggcuggccucgaacucagaaauccgccugccucugccuccccagugcugggacuaaaggugugcgccaccacacccggccuuucaccuuuuucuaguaacuuuuucccuuaauuuuuaaauucuauuuauguguagacauguuuugcuugucuguuuguguaccacacguaugccugguacuacacugaccaaaaaaugguguuggaucaccugaaaucaagacucacagacaguugugagcugucuuacggauguuggcaacucaacccagguccuauggaaaagcaaucacugcuccuaacugcugacccgucucuucagcccaugucccugcaacuuucauucuuuuucuccuuuuuccacaaacauuucuuagagcuggcuuuggugguguacacuuuuggucucugggagguaaaggcaggugggccuauuugagccuguuccguauagcaaguuccaggccagcccaggcuacguaaugagacccugucagaaaagaaggaaggguucaaaauuuuuuuuuguuaagauuuaguuuuguuuuauguagacgaguguuugccugcauguacgcaugugugucguguguguaccuggugccccugcaggccagaagacaaggcuggauccccauaacuggauuguggauaguugagaacggccuuauggguguugagaaccagaucuguguuuaaaauuauguuuguuuauuguauguauuugcauguauguauguguuguggggaaucaguuguucuuccaucaagugggucugggaauuaaagguauuuguaucagacucaggggcaaauuccaugaucaucugagccgucuugcugaccucauccuuuccucuuacaguuuuaccuuaacccuggaacucucccaggcucccccaacuugaguuguuccuaguuccuucucauuuccauugugcuuccuuccaaacagucccugaagauauugggggagaagaugucagagaucccauugaccagagauaaugugucugagauacugcgcugcuuccucauggcauauagaguggagccauccuucugugacagucugcguacccagccuuuucaggcccagccaccucaacagaaggcugcuauucuagccuuccuugugcaugagcuuaacagcuccaccauuaucaucaagugagggcuugggugggaauggucaauccugugccuguguaggggaggggcuuagcucuccagaagccccugggugguguggguguugcucuucucugaggaugcuggagugauugggcauagacucauuguaagccuuccuuugucauccauccuguuugaacuagacugagauccaucccuacagcucuguaacacuuaaucuuucuuuucuuuuugcugccacuuuucccucaaaacuucccccauguucguuccccugcagugagauugacaagacucuggaaagugugucuagcugcaggaagaacaaguggauuguugaaggccgacuccggagguagggacaggacagaguagagcccagagggagggugaggcauagccagggcucuggaaaauguaaauuucaaguguuucuuuuuugguauuauauucuucaccagcgucuuagccuaauuucuauuucuuaagacugaaaacugcucuggccaagcgaacugggcggccugagguuaugauggaaggggcagaagacggccuaggacggaggcgcaguucucggaucauggaggaaaccaguggcauagaagaggaggaagaggaagaaaauacaacagcuguccauggccgcaggggucgaaaagaaggagagguacagaccaaagucaauuagaaaguuuucaucuuuuuuuuggaucugguagcucuccuuucucaauguccgcuuguuucugugcagauugauguugcagcaucuagcauuccagagcuagagcgccauauagaaaaacucaguaagguaccauguuuuuaaucucauaaaagucgggaaauguggguugcacaagagcugaagcccuuguucaaauuauaucaguuuuguagggagguugauaggcuucaguucucucauggguacugaaguccaucaugccaugauggaaaugguuucuauuccuuuuccauuuccuacccagcgucagcucuucuuuagaaaaaagcugcuucacucaucccagaugcuucgggcaguguccuugggucaagaccgcuauagacgccauuacuggguauuaccguaucuugcugguaucuuuguggaaggaucggaagggagcacagguaggugcaacuguggaaguuuggggugaaguccagacaaaagugagcacuuccuucugccuaguccucgugggcuuuugacucuguggcgugguagacuaaagagucaagcuacucaccuacuucugcugucacacaccagcuauaggcuucaguuucuucaucuguagacuguggccauagugauguagacauacguccuaggagagugagaauggggcuagagaggccacagaguuaagagcaugcgcugcuuuuccagaggaccugaguugggcuccuagcaccacgucucacaaccaccugucaccucaaggauccuguggccuccacgggcacugcacacacacacacagaauuucuuucaaagacuacaaaaaauuaaaauguuuuguacucuuuagugcuuaacagaccuuagauguagcuccaugccagguguuaacacaauauucugugguugaucccagacacagaaaagcaaacuuuaaaaagcaagcauguucuguuuauaggucucauucuuuuccauuauacaacaguauaucuuauguucuuuguuucucuucccaguuacugaagaugaaauaaagcaagaaacugaguccuugauggaaguagucacuucaacacccagcucugcccgagccucuguaaagagagaauuaacuggcuccaaugccucuacuucuccugcccggucccgaggccgaccucgaaaaccuaagccugggucucugcagccucagcaccuucaguccaccauuagggaaugugauucagagcaagcccagacucaaguucacccagaaccccagccucagcuucaggccccuacccagccccaucuucagccaaguaguggguuccuagagccagaagguuccccuuucucucugggucagagccagcaugaccucagccagucugccuucuugucuuggcugagccagacucagagccacaacucccuguugagcagcucaguccucacgccggacagcagcccagggaaacuagacucugcuccgucucaguccuuggaggagcccgagccugaugaggcucaguccugcccugguccucaaggucccugguuuaacuucucagcccagauacccugugaugcugcuccuacaccaccuccugcagucucugaggaccaaccuacucccucccuccagcugcuggccuccucuaaaccaguaaguagccagaucagucuguacuuaucuugccccaggcucccauaucuggcugugaggcuguagccugaaguaggaaauauguaaacuccuucuugucuucuuuguagaugaauacacccggugcugccaauccuuguuccccagugcagcucucuuccacucacuugccuggagggaccccuaagaggcuaucaggggacucugaagaaaugucacagagucccacugggcuggggcaaccaaagcggagggggagacccccuagcaaguucuucaagcagguggagcagcauuacuuaacccagcugacagcccagccuauccccccuggugagcaaacuuggcuaggauggggcaaacauggagguaauugcaguuuccauugugggcggugugauuggagccugguucccauccccuggccuauaugcauacccucuguacacagagaugugcucgggcuggugguggauccgagacccugagacacuggauguccugcucaaggcacugcauccccgaggcauccgggagaaggcgcuucacaaacaucuuagcaagcacaaggacuuuuugcaggaaguuuguuuacagcccuuaacugguaagugagagaccuugacccaaccugaccuagagaagcugccaucauuuauagaccacucucucuucccagaucccaucuuugagccuaaugagcucccugccuuggaagaaggcguuaugagcuggucccccaaagagaagacguacgagacagaccuagcugugcuccaguggguggaggagcuggagcagcggguuguccucuccgaucugcagauucggguaccugggguuggcauuggggagggaauugcuuagggaggguuuugguuuugguuugguuuauuuuuauguauuggauguuuugccugcguguugccugcauguacauuuauauaguauguacuauaguauauaguaugcgguguccucagaggcuagaagugucagauccucucacauugaucuuagagaugauugugaaccccaugacguguguucugggaauugaaccuaggccccugucucagccuuacagguguugggauugcaaacaugagccacuacaccuggcuggggagggugccaggacaagccuuggugucuucuuccugagugaccugccaugacaucaugacaugcaguguuucccuuuacaaugcguucuguuucucuuucccacuggaagggcuggacaugcccuaccccagacuccaccagagaagacuugaccuacugugagcaucugccugacuccccggaggauaucccuuggaggggucggggcagggaaggaacaguaccucagcggcagaacaacaacccucuggaccucgcugugaugcgauuggcuguucuggagcaaaauguggagcggcgguacuugcgggagccccucugggcagcccaugaggugguaguggagaaggcccuacugagcacacccaauggugccccugauggcaccucaacugagaugugagugacuccugcugccuguuccuuggccugggagaggcaagacaaaagcguauuccucacaugaaucacugcuuucucugcagauccuaugagaucaccccucguguccgaguuuggcggcagacacuugaaaggugccguagugcagcccaagugugcuugugcaugggccagcuagaaagguccaucgcgugggagaagucugucaacaaagugguaagucuggaaauacuugggagacaaacuagugagaguggggucgcgauagcaggguuagguuaaggacucacucugccuuuucacgaugguccagaccugccuggucugccggaagggcgauaaugaugaguuucuccugcugugugaugggugugaccgaggcugccacauuuacugucaucggcccaagauggaggcuguuccagaaggagauugguucugugcugucugucugucccagguaaggcuucugcucucccaucuccauucucaagcaagacuccgagaugucuucaucuuccuuucuuuaagcaacaguccucagauguccuggacggacccucaggugcugcucccaggaaugggccugugacagcauguuuggguugagucuguguuugaauaagccaccuacagucuuuaagccccagucauuuccucuauaaaauagcaguugccaugcauuuuacugacccucccauugauugucugaaugaguucacaugcuggcuuguaugugagcauuugaagccacagucauggguaggcaagacugaugagcagagggugagccgcgccacccacacugcugcucaccugggccuauccucagcagguagaggaagaguacacucagaggccugguuuuccaaaacgaggucagaagcggaaaaguaguuuuccacugaccuucccagaaggugacagccggcggcggauguugucaaggagccgagauaguccagcagugccucgguacccagaagacgggcugucuccccccaaaagacggcgacauucgaugagaagucaccacagugaucucacauuuugcgagugaguuaguggacucuaggacuaacuuucugucucugugccagagagacugcaggagucaaugugugcuuuuuguacuaauaggauuauccugauggagauggagucccaugaugcagccuggccuuuccuagagccugugaacccucgcuuggugaguggauaccgacgugucaucaagaacccuauggauuuuuccaccaugcgagaacgccugcuccguggaggguaagcugaucucucucuugcuucacccuuucuuucucucuacucacagucccauccacucugcccagguacacuagcucagagcugacagcucacagcccugucuuccccugcccagguacacuagcucagaagaguuugcagcugaugcucugcugguuuuugacaacugccagaccuucaaugaggaugacucugaagugggcaaggcugggcacgucaugcgacgcuucuuugagagccgcugggaggaauuuuaucagggaaaacaggccaaucugugaggcaaggaaguugggagucacuuuguggcaucuucuccaaccuuccaaacaaaaaccugccguucucaccugcugauggcugcccuggguggacucaagucagacaaugcugacucuugacucugcccuuggcagcacccacauccucuuguuccgaaucccuuuucucccuuccuccucuggcuccucaaauaagagaugcagagaugagguccuucuggauggaaagccaaaaaagaaaaaauuuuccugucucuccuccuccucccccccccccccauuaaaauggagagagacaaagaaguccuccuuccccuucccagcuuccuccccucccuguccaugccucagcauccuggggcuauuuaacaauagcaauaguucuagugaaugugugaaacugagaaacacucuguacugugugcggacccgcagugacggccaguaaaguggacuuaacucccaagugugucgagccggacaccgggcccugaacaugcugcuuccauguucaguccccucccugcuucucacuuccucucacucauucuguucuaacuccucccuauuuuuaagguuuugucucacccaguaauguaaaacuaucguguacggguucuuuaccuucccucccagucuuuuucccuuauguggaaaacaaaguugagagcucuccugucuuucuguccucaucuucugccucccuucuaguuaacccucuaagguguuggcuccuccucacaugcugaguuucugugagucucuagccuuuucugaagcucgguggcuggggagcggacaggcaggcagugcccuaggccuuccagccuccuuccccugcuucccaaaccucccucuugggaacuccucagggacaacuacugcugaguuugagugcuccuccgagaugggggccagguagcaauugacuggccucagagagaggaggagagagagguggguguggguguguguuuugugucugugugugugcacgugcacagaugagaguugugauugugacccuguagugugaugggacucauuguuccccacauguguuuauucccgccuucccauuguuucacaccaucaaccuuuugucuuugggaaaacacaagaacaaggguucucuggggacaaggcugucucuccucauggucauuucuuuuccagccucuucaaacugugcaaucuuuucagcaggaacucccucucccuucacuagcuuugaguuuuugcugguagggggguagaacuggaucuuuccuaaaccaugagugucuggguuuagcuguguuuuccuuccuuacaccgacuucaugucccaggaccccuuucuuccccagcagcagagacccuggagcacagaaugggcagagaggaggauuugggucuaccacugcccugugugugacugagcccagguuagcccccagcaugagaggacagcugcuaacuccaagcuguagccaugggccacuggccccugcuuuccugcucagccaagccccucccaucagaaauuacggguacuugcacuggggagguggcugcuagcugaccuaagcagggagccaaggcauccaagcaauguuccaugggugggcggaggaugccaggugagguguagcauuccuuguacuccagcaguacuaaagaguggggcagugcggguuccugggcagcccugacuccucgacccacccucaccgcacucccgguugccuguuucuaaagucgccuuuucugucgaugaaccucaaaacuuaauuuuauuugagaauuuuuuuucuuuuaaauaagagguggauugaagaauauuugaauugacuuuauauuaugcauaaauauuuauauuuuaucuaaauaacugcgcuguaacaaacuuuguguuagucagauguuuggaacuguuuccccuggcauaaaguguacuggagucauucgcuacuggaggugcgggaggagggagaguggagccucugcucugcucugugcuccucucccagccccaccucugcccucgggaccaggcacucagaaggaggaggucccagacuugauuguagaaauggggacugaagggauugugggcaggaugugaucaaaggggccauuucucacuuuucuuuccucauccucacugccccucaagcuagguggauuuuucucuuguugacaaagaguauuugguagggaaagcagguuaaaaauaaagacagcccuucccugcccuuuguguccccuuccuggugacagcaagaaaccaucaacaccaacaaguuuccacguuccuuuuacagcaaaagggacuuuuuauauaaccaaauguggugucuuagugacuuuuugauaauguacaguuuuuugugaauuuaaauuuauuucuuucuauauuuuuaggaccaaucucauuuuuaauaagguuuaaaaaaaggaaaaaaagucuagagaaaaaaaaauaccuuguuuuugccaugugauguuccacaggugcggcuguagaaaagugcuugucauugaauaaaaaccacauuugauaaaagacu

SEQ ID NO: 5811 - RNA, 61266 nt, Mus musculus
auacaugucccaaguguaauuuuauuuucccaggguacauuaugcaugcuagacaagcacucaaccacagagcugaguucugcucucaagucuguuuguaaagcaccacagagguucuccaagugcacugugucagugcgacaguuagaucuuggacucgagugugagguccuaggaccaggcgcggcuggacggguccucacgcgcugacgugugucuuccucucugggugggcaggcugagaaagagaagaugaagacaaagcaggaaaagcugaaggaaaagguaaagcgagaaaagaaagaaaagguaaaagcgaaggggaaggaagggcccagagccaggccauccuguagagcagacaagacccuugccacacagaagcggcuagaggagcagcagaggcagcaggcuauccuggaggagaugaagaagcccacagaggauaugugucugucugaccaccagguauuaagggucauggaagggccagugcugaggacauuucucguguuaccagaaggacuugugaauucuagacagugccucuugugagucuaacaagauacccaugcgcuuuucucuccccagccccugccugacuucacacgcaucccugguuugacacuguccaguagggcuuucucagauugcuugaccaucguggaguuccuucacaguuuuggcaaagugcuaggcuuugaccuuaccaaagauguuccuagucuaggaguccugcaggagggacucuuaugucaaggugacagcuuggacaaagugcaggaccugcuggugcgacugcugaaggcugcacuccaugauccuggucugccccccuacugucagguagguguuccugggccuggguuacaguuuugcucucuccuugagaacacguaaaagcuuccccuaaagcaaccacagaaguaagggaaacguaguugcuuccuguuucuagccuuuauaugccuuuuucuuugcaaggcuucauuuguucauuuucucuuuucuuacuuugcaguuucucuuuguagucuuucaccuuuuucuuuuuuuuuuuuuuuuuucgagacaggguuuuucuguauagcccuggcuguccuggaacucacuuuguagaccaggcuggccucgaacucagaaauccgccugccucugccuccccagugcugggacuaaaggugugcgccaccacacccggccuuucaccuuuuucuaguaacuuuuucccuuaauuuuuaaauucuauuuauguguagacauguuuugcuugucuguuuguguaccacacguaugccugguacuacacugaccaaaaaaugguguuggaucaccugaaaucaagacucacagacaguugugagcugucuuacggauguuggcaacucaacccagguccuauggaaaagcaaucacugcuccuaacugcugacccgucucuucagcccaugucccugcaacuuucauucuuuuucuccuuuuuccacaaacauuucuuagagcuggcuuuggugguguacacuuuuggucucugggagguaaaggcaggugggccuauuugagccuguuccguauagcaaguuccaggccagcccaggcuacguaaugagacccugucagaaaagaaggaaggguucaaaauuuuuuuuuguuaagauuuaguuuuguuuuauguagacgaguguuugccugcauguacgcaugugugucguguguguaccuggugccccugcaggccagaagacaaggcuggauccccauaacuggauuguggauaguugagaacggccuuauggguguugagaaccagaucuguguuuaaaauuauguuuguuuauuguauguauuugcauguauguauguguuguggggaaucaguuguucuuccaucaagugggucugggaauuaaagguauuuguaucagacucaggggcaaauuccaugaucaucugagccgucuugcugaccucauccuuuccucuuacaguuuuaccuuaacccuggaacucucccaggcucccccaacuugaguuguuccuaguuccuucucauuuccauugugcuuccuuccaaacagucccugaagauauugggggagaagaugucagagaucccauugaccagagauaaugugucugagauacugcgcugcuuccucauggcauauagaguggagccauccuucugugacagucugcguacccagccuuuucaggcccagccaccucaacagaaggcugcuauucuagccuuccuugugcaugagcuuaacagcuccaccauuaucaucaagugagggcuugggugggaauggucaauccugugccuguguaggggaggggcuuagcucuccagaagccccugggugguguggguguugcucuucucugaggaugcuggagugauugggcauagacucauuguaagccuuccuuugucauccauccuguuugaacuagacugagauccaucccuacagcucuguaacacuuaaucuuucuuuucuuuuugcugccacuuuucccucaaaacuucccccauguucguuccccugcagugagauugacaagacucuggaaagugugucuagcugcaggaagaacaaguggauuguugaaggccgacuccggagguagggacaggacagaguagagcccagagggagggugaggcauagccagggcucuggaaaauguaaauuucaaguguuucuuuuuugguauuauauucuucaccagcgucuuagccuaauuucuauuucuuaagacugaaaacugcucuggccaagcgaacugggcggccugagguuaugauggaaggggcagaagacggccuaggacggaggcgcaguucucggaucauggaggaaaccaguggcauagaagaggaggaagaggaagaaaauacaacagcuguccauggccgcaggggucgaaaagaaggagagguacagaccaaagucaauuagaaaguuuucaucuuuuuuuuggaucugguagcucuccuuucucaauguccgcuuguuucugugcagauugauguugcagcaucuagcauuccagagcuagagcgccauauagaaaaacucaguaagguaccauguuuuuaaucucauaaaagucgggaaauguggguugcacaagagcugaagcccuuguucaaauuauaucaguuuuguagggagguugauaggcuucaguucucucauggguacugaaguccaucaugccaugauggaaaugguuucuauuccuuuuccauuuccuacccagcgucagcucuucuuuagaaaaaagcugcuucacucaucccagaugcuucgggcaguguccuugggucaagaccgcuauagacgccauuacuggguauuaccguaucuugcugguaucuuuguggaaggaucggaagggagcacagguaggugcaacuguggaaguuuggggugaaguccagacaaaagugagcacuuccuucugccuaguccucgugggcuuuugacucuguggcgugguagacuaaagagucaagcuacucaccuacuucugcugucacacaccagcuauaggcuucaguuucuucaucuguagacuguggccauagugauguagacauacguccuaggagagugagaauggggcuagagaggccacagaguuaagagcaugcgcugcuuuuccagaggaccugaguugggcuccuagcaccacgucucacaaccaccugucaccucaaggauccuguggccuccacgggcacugcacacacacacacagaauuucuuucaaagacuacaaaaaauuaaaauguuuuguacucuuuagugcuuaacagaccuuagauguagcuccaugccagguguuaacacaauauucugugguugaucccagacacagaaaagcaaacuuuaaaaagcaagcauguucuguuuauaggucucauucuuuuccauuauacaacaguauaucuuauguucuuuguuucucuucccaguuacugaagaugaaauaaagcaagaaacugaguccuugauggaaguagucacuucaacacccagcucugcccgagccucuguaaagagagaauuaacuggcuccaaugccucuacuucuccugcccggucccgaggccgaccucgaaaaccuaagccugggucucugcagccucagcaccuucaguccaccauuagggaaugugauucagagcaagcccagacucaaguucacccagaaccccagccucagcuucaggccccuacccagccccaucuucagccaaguaguggguuccuagagccagaagguuccccuuucucucugggucagagccagcaugaccucagccagucugccuucuugucuuggcugagccagacucagagccacaacucccuguugagcagcucaguccucacgccggacagcagcccagggaaacuagacucugcuccgucucaguccuuggaggagcccgagccugaugaggcucaguccugcccugguccucaaggucccugguuuaacuucucagcccagauacccugugaugcugcuccuacaccaccuccugcagucucugaggaccaaccuacucccucccuccagcugcuggccuccucuaaaccaguaaguagccagaucagucuguacuuaucuugccccaggcucccauaucuggcugugaggcuguagccugaaguaggaaauauguaaacuccuucuugucuucuuuguagaugaauacacccggugcugccaauccuuguuccccagugcagcucucuuccacucacuugccuggagggaccccuaagaggcuaucaggggacucugaagaaaugucacagagucccacugggcuggggcaaccaaagcggagggggagacccccuagcaaguucuucaagcagguggagcagcauuacuuaacccagcugacagcccagccuauccccccuggugagcaaacuuggcuaggauggggcaaacauggagguaauugcaguuuccauugugggcggugugauuggagccugguucccauccccuggccuauaugcauacccucuguacacagagaugugcucgggcuggugguggauccgagacccugagacacuggauguccugcucaaggcacugcauccccgaggcauccgggagaaggcgcuucacaaacaucuuagcaagcacaaggacuuuuugcaggaaguuuguuuacagcccuuaacugguaagugagagaccuugacccaaccugaccuagagaagcugccaucauuuauagaccacucucucuucccagaucccaucuuugagccuaaugagcucccugccuuggaagaaggcguuaugagcuggucccccaaagagaagacguacgagacagaccuagcugugcuccaguggguggaggagcuggagcagcggguuguccucuccgaucugcagauucggguaccugggguuggcauuggggagggaauugcuuagggaggguuuugguuuugguuugguuuauuuuuauguauuggauguuuugccugcguguugccugcauguacauuuauauaguauguacuauaguauauaguaugcgguguccucagaggcuagaagugucagauccucucacauugaucuuagagaugauugugaaccccaugacguguguucugggaauugaaccuaggccccugucucagccuuacagguguugggauugcaaacaugagccacuacaccuggcuggggagggugccaggacaagccuuggugucuucuuccugagugaccugccaugacaucaugacaugcaguguuucccuuuacaaugcguucuguuucucuuucccacuggaagggcuggacaugcccuaccccagacuccaccagagaagacuugaccuacugugagcaucugccugacuccccggaggauaucccuuggaggggucggggcagggaaggaacaguaccucagcggcagaacaacaacccucuggaccucgcugugaugcgauuggcuguucuggagcaaaauguggagcggcgguacuugcgggagccccucugggcagcccaugaggugguaguggagaaggcccuacugagcacacccaauggugccccugauggcaccucaacugagaugugagugacuccugcugccuguuccuuggccugggagaggcaagacaaaagcguauuccucacaugaaucacugcuuucucugcagauccuaugagaucaccccucguguccgaguuuggcggcagacacuugaaaggugccguagugcagcccaagugugcuugugcaugggccagcuagaaagguccaucgcgugggagaagucugucaacaaagugguaagucuggaaauacuugggagacaaacuagugagaguggggucgcgauagcaggguuagguuaaggacucacucugccuuuucacgaugguccagaccugccuggucugccggaagggcgauaaugaugaguuucuccugcugugugaugggugugaccgaggcugccacauuuacugucaucggcccaagauggaggcuguuccagaaggagauugguucugugcugucugucugucccagguaaggcuucugcucucccaucuccauucucaagcaagacuccgagaugucuucaucuuccuuucuuuaagcaacaguccucagauguccuggacggacccucaggugcugcucccaggaaugggccugugacagcauguuuggguugagucuguguuugaauaagccaccuacagucuuuaagccccagucauuuccucuauaaaauagcaguugccaugcauuuuacugacccucccauugauugucugaaugaguucacaugcuggcuuguaugugagcauuugaagccacagucauggguaggcaagacugaugagcagagggugagccgcgccacccacacugcugcucaccugggccuauccucagcagguagaggaagaguacacucagaggccugguuuuccaaaacgaggucagaagcggaaaaguaguuuuccacugaccuucccagaaggugacagccggcggcggauguugucaaggagccgagauaguccagcagugccucgguacccagaagacgggcugucuccccccaaaagacggcgacauucgaugagaagucaccacagugaucucacauuuugcgagugaguuaguggacucuaggacuaacuuucugucucugugccagagagacugcaggagucaaugugugcuuuuuguacuaauaggauuauccugauggagauggagucccaugaugcagccuggccuuuccuagagccugugaacccucgcuuggugaguggauaccgacgugucaucaagaacccuauggauuuuuccaccaugcgagaacgccugcuccguggaggguaagcugaucucucucuugcuucacccuuucuuucucucuacucacagucccauccacucugcccagguacacuagcucagagcugacagcucacagcccugucuuccccugcccagguacacuagcucagaagaguuugcagcugaugcucugcugguuuuugacaacugccagaccuucaaugaggaugacucugaagugggcaaggcugggcacgucaugcgacgcuucuuugagagccgcugggaggaauuuuaucagggaaaacaggccaaucugugaggcaaggaaguugggagucacuuuguggcaucuucuccaaccuuccaaacaaaaaccugccguucucaccugcugauggcugcccuggguggacucaagucagacaaugcugacucuugacucugcccuuggcagcacccacauccucuuguuccgaaucccuuuucucccuuccuccucuggcuccucaaauaagagaugcagagaugagguccuucuggauggaaagccaaaaaagaaaaaauuuuccugucucuccuccuccucccccccccccccauuaaaauggagagagacaaagaaguccuccuuccccuucccagcuuccuccccucccuguccaugccucagcauccuggggcuauuuaacaauagcaauaguucuagugaaugugugaaacugagaaacacucuguacugugugcggacccgcagugacggccaguaaaguggacuuaacucccaagugugucgagccggacaccgggcccugaacaugcugcuuccauguucaguccccucccugcuucucacuuccucucacucauucuguucuaacuccucccuauuuuuaagguuuugucucacccaguaauguaaaacuaucguguacggguucuuuaccuucccucccagucuuuuucccuuauguggaaaacaaaguugagagcucuccugucuuucuguccucaucuucugccucccuucuaguuaacccucuaagguguuggcuccuccucacaugcugaguuucugugagucucuagccuuuucugaagcucgguggcuggggagcggacaggcaggcagugcccuaggccuuccagccuccuuccccugcuucccaaaccucccucuugggaacuccucagggacaacuacugcugaguuugagugcuccuccgagaugggggccagguagcaauugacuggccucagagagaggaggagagagagguggguguggguguguguuuugugucugugugugugcacgugcacagaugagaguugugauugugacccuguagugugaugggacucauuguuccccacauguguuuauucccgccuucccauuguuucacaccaucaaccuuuugucuuugggaaaacacaagaacaaggguucucuggggacaaggcugucucuccucauggucauuucuuuuccagccucuucaaacugugcaaucuuuucagcaggaacucccucucccuucacuagcuuugaguuuuugcugguagggggguagaacuggaucuuuccuaaaccaugagugucuggguuuagcuguguuuuccuuccuuacaccgacuucaugucccaggaccccuuucuuccccagcagcagagacccuggagcacagaaugggcagagaggaggauuugggucuaccacugcccugugugugacugagcccagguuagcccccagcaugagaggacagcugcuaacuccaagcuguagccaugggccacuggccccugcuuuccugcucagccaagccccucccaucagaaauuacggguacuugcacuggggagguggcugcuagcugaccuaagcagggagccaaggcauccaagcaauguuccaugggugggcggaggaugccaggugagguguagcauuccuuguacuccagcaguacuaaagaguggggcagugcggguuccugggcagcccugacuccucgacccacccucaccgcacucccgguugccuguuucuaaagucgccuuuucugucgaugaaccucaaaacuuaauuuuauuugagaauuuuuuuucuuuuaaauaagagguggauugaagaauauuugaauugacuuuauauuaugcauaaauauuuauauuuuaucuaaauaacugcgcuguaacaaacuuuguguuagucagauguuuggaacuguuuccccuggcauaaaguguacuggagucauucgcuacuggaggugcgggaggagggagaguggagccucugcucugcucugugcuccucucccagccccaccucugcccucgggaccaggcacucagaaggaggaggucccagacuugauuguagaaauggggacugaagggauugugggcaggaugugaucaaaggggccauuucucacuuuucuuuccucauccucacugccccucaagcuagguggauuuuucucuuguugacaaagaguauuugguagggaaagcagguuaaaaauaaagacagcccuucccugcccuuuguguccccuuccuggugacagcaagaaaccaucaacaccaacaaguuuccacguuccuuuuacagcaaaagggacuuuuuauauaaccaaauguggugucuuagugacuuuuugauaauguacaguuuuuugugaauuuaaauuuauuucuuucuauauuuuuaggaccaaucucauuuuuaauaagguuuaaaaaaaggaaaaaaagucuagagaaaaaaaaauaccuuguuuuugccaugugauguuccacaggugcggcuguagaaaagugcuugucauugaauaaaaaccacauuugauaaaagacucaagauugcauguuucucuccugaagcauaggucacuguaccuuagagaaugagugugauggguugaccugugcucuggguuagugcucuguguccgcugugggggugggacaggaauagacaaggcaccagcacccucccuacaccauggaugacacuagacaggaggcuuuuguguuuuauuuaaaaaagaaagguucacgugagcaaaaguaaagcucuuccaagucacaggaaggaaauggaaccagaagucagccacggagagugagcgauagguaguguuggcauagacaugggaguaugaaacuacagguuucuggguaaaggggaaauguacaaaaugcaucuuaaguauaaauuaacuucccuccaggguaaggagugcaucuagaagucaucacccgacccgcccagagggcaggagcagagacguccauuccagcucucucaaacugcacaccaccaccacucaaguccuuacucucugcggucuuaagcuaugcuccaaaccuggcauuugacugcacagcauagucccuggcuuguccuacagggacugacccauauggagaguucgcucuuguagggagccaacgucacuggagaagacgauccagaaagagcaguuuuggguuguggaacugaggaguuugcauuuguuccaaccccacaaagacaagggcaguaaaggauggugggaggcaaguaggugcuugugugccuugaguugucagacugagguaguugaguaaugaggacgagggaguuuagggauuugcuuggacaggaaaugcuuauuuugaacauucagagcgguggucacaagggugaugagggcaucacugccacauggagaccaccuccgggaggugcagcaaagaguagaggagacaaauugguuuuagcugcugagggaaggcuccuguagacccugaaucuacuacugggaucaaaggcacuuuuaagaggcagguuacccagaaguagagccaccggcuugcuccgaauugguaagaauuggucuaacaagcauugguuguauauaccucuagacucaccuuauccucugaauucaggucuagaaauggcugggugaguuugggucuaccaccuacucaacuguauugcucuuggcgacaaaaugggaggugcccacuugaccggaagggccagggacaaaaacaaacuaguccuuccgaaacccucagcaaauaacgcuucacuuccaccccauuuuuuauuauugagcacuugcccuuuccaaagccguuuugcuucacaagcuuggucccuaucauuguucccacauauuccuaaguaauagcaggaccugucuccaaaaguccaguccaucuacagucugacccaaugagaugggauaggccuggagccuagugaagagucacacgaggucaggugugagcucuaguccacucugauugauuggaagcaaaaccacaauguacuaaaaugaguacaggugagauauagagugcagagccaucuaucuggccuccaugcaaacaggacucaggagacuguuaggagccuugggcaggaugauggagaggaggcuuacaacucaucccucauggcuugcauacuacuuccugucuucagucgcuaccuuucugaguaaugagcuaaugaggaaaagaguggauggaaaucacuaagcagaaauuacacagugagugccauuaaccacuauaaaaacaaaauuacagguugcccucauuucccaugcucacaccuguucaaccagaaacacuagaacccuaaccaguauacucaaaagaaaaaccuaaaaagguaauuucaaauuuuaaaacugucaguuauucaaauugcuuuagaacuacagaaaaaggaacaauuuuuaauaggcagugaaggagcagcaguggcagcaagacugucagcaggguuuccacaggacagagcucugagucugucacugagugcuagagggcuagaggucgauaacuggguaugaccuuccugauguuggaagcaccaaugagaaaacuggucauuuuguacuuuaugcuguccauuguccucagccccuuccucagucuagaacgcacagcagcacagucaggccaggauucccaauucuguagugugcacagcugcugagccaguuucucaccaucaccaugcccugcccuuccucuuucacacugaccucuggacacacuuccccaucuccauugcuuugucuacuggagguguacuuaugacgugaagggaugugauguaacaagucacauuuugugcugaaagucuugcagaagggaauaguuaacggcaggcauguuuacaagucccuccugaccuuugaguggccagggagcugugagucuugccuuuuucuauccuagcaccccgucguccuuccacaagaaggaaaauuauuucugguggucugguucccuggggaagggguccaaacaccagggcugggcuggguaugcugcauagagaaagcucaguccauucucaagcaugcacaguauacacaacaguucuugcuuucaucccuucaaacugugugcacuuggcauguacauacaaccaagggugagcccugcuaaauaagauggcuccugcugaauuaagugauucagccaaguaccacuugaguacagccaugugcagcugggaugagaggcugugagaacccaggcagaaaagauccuccaggaggcaaagucacagaugucacugcuggccaaguacaugaacuaacaggcuccauguccaaggcuggacugggguuuagucuacaccaaauaacugccagggaauaagggguggaggaguggggccagguucugucagguguucaggaccagcacacaugauacuccccaggcuugguaaucaaggaugaugauggacaagacagcagccucucggggacaaaacaaccuccugguaaaguggaaggcagaacuugcucagcaggggcaggggcugugagaccuggggcaggaugaagacccaagacccuccaggaggcagagcagguauccaggaugcugaagcuggaugccacuucucaguggcacuugccaccagaguugguugaaggugguuuccaaaggcugcaugguugucacaugucugcuuccugaagucaaagucuaaccccuccuaggccaggagggcagagggaaagcaaccucuacugccacacuucucuaccugugcguugcucucccuucccccaauuccacaugaaauuuaaaucaaauucauaaaauuaaaaauuguaaaaaggcaaaguaggcaggcuaagcuaaauggaaaagaaaaaaagaccauuguggagaaguuuuaaaaaacaacuagccgggcggugguggcgcacgccuuuaaucccagcacuugggaggcagaggcagguggauuucuaaguucgaggcuagcuuggucuacaaagugagcgccaggacagccagggcuacacagagaaacccugucuugaaaaaaaaaaaaccaaaaaaaaaaaaacaacuagcuaggcauggcggugcacucagacagagugggaaggaucgcugaguucaaagccagccuggucuacauugucagccagccaggacugcacugugagacccugccuuaaacagugcgugggagggaggugggugggugugugcaaaguguguguugagagcuuugcaaaacaaaaguuuuaagccugcauaucuaaaacacacauugaaaauagucccuaacugaaccuggcaagcagcgccccuucacugacuucacagcacugcgauuguucuuaaaccauuuuaaaagcccaacauacccaaaccucucgaagaugagaagcaccucaacuggugucuuugggguaggagaaagguucgcugcaauuaaauacaaagcaagaaacuucuuuugcaaaagaaaaaaaagucuuuuugaucuugaauguagcacauucaaaaaaaaaaaccaacgugauuccucagguuccaucagccacaggaaggagcccaaggaggacugcauaggcuucucuccccaggucuggaccugugagggaaugacagccagguguuagugcucagcaggcuacagcuaggcuuguaacuugcuaaaccuucuggagucugugagcaucuccaagaguuccuuucuguuuaacaaagauggggggaaagaauccuaaaggaggcauuagcuggagacgauacgaagaggacacgacuauuaauuaaccugucuggcuauuggcagaacaaagcugcaagcaccaucuuccaguucagcauagcauagcagcauuccccaccauaaaguucuuaccucauuauuugcugaacuggaaaggauagaccccguggucugaggggggcuccacugccaguugauucugcuggccauugcucuccuguaucacagccaaggaaaguuacugaagcauuccuacacgcaccucccacuaaagccuccccaauucagccacacacacacacaccgcccccaacgcaugugugcauccaacauccagacugccagaaagcgggcaaagugguccagcuaccuuggaaaauacuucagcauuugcucauuuucagaguauugaggcagcugaagucagcaucccugucuaaauugaacagagcaggcuggcuaaacaccaaugaagccgccuccugcucuccucacaaccaccagugaggaugccggcgguaggcaguaccgagagaggaguacacaguucagagaucugcccuugauguguccuggccucacugcaaaacaaaacaaaacgaaccgaaaaagcuccuaccucagcagaaacacuggaagaaggcacagcuggguacugggagauguaagccccaugcauagcagcagcugccggcaugaacuacaaaaacaaaaacaaugguucucagcuaguuuaaagcccucaggagcuucagaaaacacagagaccuuuauuguugugggugcuucuuuaaaaugucccuggagugcccgaggaugccagcuagagacacguugaugucccucccucacugcguucccucucuuccuccacacccucaacucacugccaccagcucuccugcaccagucagaccuaaaagagccuugagcuucaucccuucccuuucaguguucugaugagcucuucuaggagauaugcacuggcgccuaagcaaauucacaaauguuuaaaccacauuuaguuccgugacugggaagcagguaagagguaggcaggaagguauauccccagcuuacugauucuuuucuguuuaucaauggccuugaacuuuuuuuuaagauuuauuauuuuauuuuauuuauaugaguacauuguagcugucuucagauacaccagaagaaggcaucugauccccauuacagauagguugugagcaaccaugugguugcugggaauugaacuccaaaccucuggaagaguugucagugcucuuaaccacggagccaucucuccagccuggccuggaacuuuuaagucuuccugacucagccuccugaguauaaggauuagaagcauuuacugcaguucugagccugccuuugcugacccugacacacuugcguccugcguaaccacagguaccaaggagcauuuccuaggcacuucuuauucugcaggguuaauaaccacagacaauccuuuaccgugcccagacuguugagugacaggugacccaguugcuggguaagaggucccaucauggaggcaggcuggagagagagggggugguccaucccuggugucagaacugagcccuagagaaggcaaugaagggaaggguuaagcagcacccuccuguaaagacaccugaguggcaaggaugccaagcagggccaccaguguuuuguuuuuguuuugcuuguuugugucucuugacagguuuaacccuggcugucccagaacucacucuguagaccacucuggccuugaacucgcagauccaccugcugcugccuuccaagugcugggauuaaaggccugugucucuacacccagacuuugauuugcuuuuuaagaacaguuuaagugcacuagaaucaggaagcaaacuauucgggaacuagaguaccgucugcugacauuuccaaguccugagaauuaacccgaguucuacaacaggaacaacagcauccucaccuuuagucugcagggaccuacgucuaagacuaacaaacccacagaauuaagguuacuguuggugcgccuacugccugagccagagcucacacccacacauccugccaucaaaacccuuugcuuugcuuuacaucagauugucucuuucccuucugaacacucacugaaggcugcgugaaguacaacugguauugcauccaagauggguuagguacuuguagaggagaugucugagucacucucuaacauaagcaaagacaaauaaaaauguuaacugccuaggcucaaggaaugagacuguucagcaaagccccccgcaaacugacaugucccuucagagcacaaaccgcuuagccagacugugguggcacacaucuuuaaucccagcacucagaaggcaagaggcaggcagaucugucaaucugaagcuagccuggucuacaaagagaguuccagauuugccagggcuacauagugagacccugucucaaaaacuuuaaaagagcacacuguuaacaaauacuagcagcuuauaacucagauaacgcaguuaaaaacaggcaaagggguagaugaaauaucucagcagguagaggcacuugcuaccaaaucuaaagaccugaauuagauccccaaaacccacgagguaaauggagagaaccuuccauaaauugccuucugaccuuuacacacauacacacauaugcacgcgcgagcacacacacacacacacagcagcuaagaccauguucugcucucccagaagaaacacucauacagauaaaguaaaaggacugcuuaaaagauguugugagaauaacaaaauauauuaaaugagauuacuuuuuuguuuguuuguuuuguuuuguuuuuguuuuucgaaacaggguuucucuguauagcccuggcuguccuggaacucacuuuguagaccaggcuggccuugaacucagaaaucuaccugccucugucucccaagugcugggauuaaaggugugugccaccaugcccggcuauaaaguuacauuuuuaucaaacaccuuuaaucccagcacuccaaaggcagaggcaggcagauuucugaguucgaggccagccuggucuacaaagugaguuccaggacagccagggauauacagagaaacccugucucaaaaaacaaaaacaaaaacaaaaccaaaaaacauuuuuaucaaaacgauucccaaggccccaauauuugaguaucuacucacaugaaagugaucuacaaugaggguaaaaagagaagcaggaugaugugggguuuuuuguuuuuuuguuuuuaaagauuuauuuauuuauuuauuuauuuauuuauuuauuuaauguaaguacacuguagcugucuucagacacuccagaagcgggagucagaucucguguuacggaugguuguggaugguugugagccaccaugugguugcugggauuugaacucuggaccuuuggaagagcagucgggugcucuuacccacugagccaucucaccagcccgauguggguuuuuuaaaacagggucucucuuauauagccuugguuguccuggagcuugcuauguagcccaggcuggccucaaaaaaucacaaagauccaacugccucugccucccaaaugcugggauuagagguguguaccaccaugcccagcucaagaggauguuucuaucucuaaaaguguuuauaugcacuguaugcauggguauauauguauauacacauacaggaauaauauauauuauuauauauuauauauuacacacacacauauacaucuauauauacacacacacauauacauauauauauauauauauacacauauauauauauauauauauauauauauacacacacauaaaaaucacauguuaugcuccaacauaccauuucuuuguguguacuauauagaaaagcuuuacauucguucacuuaacacacacaguaggaaaagccucacaccucaccugauaggaagacacaggagauggaagauacggggcuagcgcagauugagcaagcauccugcugugggcgauacuguaaggagcugcguagaaccugcaggagaggccuuuguucagugagaagccucggggagccagagccaccuccacuaacugcuguuugaaaauuagaaugaaacacccuuacccauucugaagggcagcaguggggucauaggucaaggccauaccgcccuguaagaaagaagguaguguccauauugccagcccagaauacccacaugucccaugacagguuuuggggacugcgcuaaagagcgaguagacaccagggcucagccacacaucuuacucucaagcuucccaccuacacgcacagaagccaggcugcgccauuuccaacucuaaugcucucaggguucgugcuuccucggggaucuuuuuaccaugucuccguuccuuggccaggcccguccauuuugcacguaucuuccuuggcucugucguuucuuuggcccaccgucagcaaauuugcaaagcaaagggucagaaggugcugucaagagaaaacauacacaguugcugggccacggggcaguacccauuccuccaauggcucccagcccgagucccagaggccucaccugcuacuccagggggugucuuuauauacuuuccauuaaagugggugaugauggcuucacacuucucuguugacuccauccuaagacgcacaugaggaguaagaccaccuguccgggauauguguccuacacauacucacaggcuccuagacccacaaauacuggagaauguuuauguccuacauguucauuucgaggcaccuagcuuuccuuuuuauuuauuuuuuuaaacacaggcuaucucucuguguguguauuuuauauauaccucugccuggccucaaacccugugucugagaauggcuuugaucugauucuccugccucaguguuacaacugcagaaaaguucuaccgugucugacugcuauggagugcuggaaguugucaugcagggugagcccgcacucgcugacugaguagcccaggcccuaauggugagcugaugagaugguucaguggauaauggcauuuuuuucagcaggcccaacgacuugaguuccaucccuggaacccacaugguauaaggagagagccaacuccugauaguuguccucugaccuccacacaugcacuguaacacacaaacaugcacauauguacauaagaaauaaacguaaaguuuuuucaguggucauggaacuauuuuuuaaaaauuccuaaugaugucagcaugauggcgcaugacuuugaccucagugcucgagaagcagagacuggugucucucugaguguuccagaccagccugggucuacuuaucaaguuccaggccagcuggggcuacaaugacacugucucaaaaaagaaaaaaaaaaaaaagaagugaagugaaguggagaaauggcucaguggguaagaguaccuauugcucuugcagaggacccagguucuggugcaaguacuaacaggauaccucacaaccauguguaauaacuuacaguggauccaaugcccuccucugaccucugaagauaacaggcucacacuuggugcacauaaaugcauguacacagaagacucuuacacauacaaguaaauauuuaaaggagagaauugacuccugugagcuuccucuggccuccacagaaaugugaugccauauuuguucuccccccaugaauugauaaauaaaugccuuuuuuuuuuuuuuuuuuuuucaaagcagaguuucucuguguagaccuggcugcucuggaacucacucugcagaucaggcuggccuugaacucagagacccaccugccucugccuccugagugcugggauuaaaaaggugugcagccacuacuaccugucauaaagaaaugcuuuuuaaagggugugagggcucuugccccauacgugauacagagggggaaagcacaagaaaagaaugaagguguagguaccaguggccguucaccacccaaggcucuguaagucagagcacucaggaaaagugaccacauccucgucuaugcaccagcuacagcuuccuuccgaaguacagacugcugagcgguuccugcuuguuucugauuuucugaaaugggaaucuuguuguauagccccugucucaguguucacaugcugggauuucagcagcucuauacuuggacuggcaagauggcucagcagaucagagagcuugcugccaagucuaaugacaugaguuugaucccuggaaccgacaugguaaaggagaaaaauugauuccuaaaaguuguccuccauacacacacacacucacaaauuaacaaauaaaauguaauagaaacauaaaugagggccagagagauggcucagcaguuaagagcacugacucuuccagagguccugaguucaaaucccagcaaccacaggguggcuuacaaccaucuguaaugagaucugaugcccucuucuucugguaugucugaagacagcuacaguguacuuacauaugguaaauaaauuuaaaaaaaauaauaaacaaaacacaggcaguuauuuaaucccagcugcuggugaacuaugugaagaacugccuguauuggguuuaacugugagcuugucagcaugucucccagggacugucuuccauuaauucacuuggguggcaccauucccuaggcagggacuguucccuagaugggggcccuaagcugugucagaguggagaaggcaaagugagccuaaacgggcaagcaagcaugcaugaacucauccuguccuggguucuguccgacagggccucucaguauaagcuuuuucagccuggaacugacucuauucaccaagcugucccuuccacuccacccacuucugccucuugagugcugggauuacagggaccaccacacccuccuuccuaaguauccuuuugucccgguguuuaagcacaguaacaaaaauggaaccaggacacaucacaaaagaaaaagggccaggcgugguggcgcacgcuuuugauccuagcacucgggaggcagaggcaggcagauuucugaguuggaggccagccuggucuacagagugaguuccaggacagcuagggcuacacagggaaacccugucucgaaaagcaaaacaaacaagcaaacagugugugagccgaaaguggaagaacacaaguccaagacucuuccucuuguauuacccaagguugacauuagguggcgcuacgcagacugagccuauucagaacuaguauuuuucuagccacagccucuauuuuauuggagaggcuguucuuugagacgguaucucacauaguccaggggcuccccauccucuuccaaaugucaggauugugaugggccaagauaacccacuucacucccagucugagcaggcuaagagacugaaacacaaaacccagaccuuuaagcuaaaaacaauuaacaacuaacagacucuccucucaagugaaacucacuuguuugauuuuucaauauuuuauuuauuuguuuguuuauugagcuagggucucacucucaauucggcaggucuugaauuccaagugaucccucucaucugagcuacagaucaggccuugaauaguuuguuguuuugguguuuguuuguuuguuuguuuguuucaagagaagaguuuuucuguguaacagagccuuggcuggccuggaacgugaucuauagaccaggcuggcccugaacacauagagauccuccugcaucugcccucucaaccacugcuugacuuccacuguugauuuugagacagacucuuaaaaaaaacaaaagcaaaaacaaaaacaaaaaucaacuugggcugacuguaaacagucuauguacaacuuuccaagcacaaggguuacagguguguacaaacuuugagggguucaccuucaacuucugauucuccugccuccacaacccaagugcuaaaaugucauuagauacccauuuuauuccaugcuguagaucaaauuuugggggggggggucccaugccuacuaagcaagcacucuacccacagagcuacauuaccacccugucuugagcuuggacucaugauguaguuagugcuggcuagccuggaacucacauucuuucagauauggccacuuugaacuugcagagauuuuccgccacucaaaacaaaaagucuuugcaacaauguuucacauguauuuauuuuguauguguuagcauucucucuaagauccaucccacaguuaccuggcaacagccagggaugcuccaccccacaguaccuggcaacacccagggaugccugaugagcugcuugcucccucuugcucauguucuguccucuccucucucuccucccuccccuccaucucuccacgugcucauggcagccucuucuccucuacuucuucucuucucuucuccucuacuucucuucucuucucucugccuuucucugccucuacuacccucuuaacuccccccucccaugcccuuaauaaacucuauuacuauaccaucaugugguugcucccucagggggaagggaugccucagcaugggcccaccaagguacccccucccccccauaccugacuauaccuccauagaacauaacucccccccccacuuucuuugucuuuuuauaaaaacaucaguauguguguguagucaugugaguggugggggggggucaaacauguuggcaggcuucaacagcaagcaucuuuacgugcugaucaaccauguaagcacccaagcaaaaucuuuuuuaaaaaaguaagucauuuuuagguaggcuaagaucaggugaagcuccaugacacaugagcccaggagagggcagccuagagaaggagagaucuggguaaucaaacuccacagagaacgcuaaagcucagcaauguccuacaacacagggcagccacugcacagguuguucuaggauagaagucucccugaagauccagagagcauagcaaaucuuccacuucauccuacugaucugaggacuagguccaggccugacagaguuuaaaugagguguggagugggaauggucagcuguaagggcacagaaucggacgaacaaaagcuagguuagcagaggcaaugggaaaggaagccgaaggacauccaugaggugaggcgugguggagcaugccuagaaucccagcgucugggaggcagaggcaggaggauugcaggcaguuuuuguuaugugccaggcccuuaguuuaauauucaacacacacacacacacacacacacacacacacacacacacgauuuacuaccaaggguuuagacaacuugcauucauguauguauuauguaugugcagaagcugccgcacaugugaaggucagaggaccaccuucuggggucaguuuuuccuucuaccgucugggcuccagggaucaaacucaggucaccagguuugcugucaagcacuuuuaccugcugagcuacuuugcugccucuuauuagguuuguuuguuuugggguuuuuuugguuuuucaagacagagaaacccugucucaaaacucaccaggcuggccucgaacucagaaauccgccugccucugccucccaagugcugggauuaaaggcgugugcuaccacacccggcuuauuagguauuuuugacaauuauuuuggucuaguucaggggaagggcacuguguguguguguguacgccuaugugucuauauguguauguauguguguaucucuguguguauuugugugugucugugugugauucugugcgugugugucugugcgcaucuguaugugcaucuguguguguauguguuguuuccuaaguuauuucuugcuagccacucucagucaucccuuaccuugcaaagccgaccccucugcuggccccacuagugucucgaaggauccgaguagagaugaccuggccaaagggcuucagcauccccuccaguuccugcucguccauugacagagggagguuugagauguauaaguuuguagggucuugcuccuguugcuauggacacgaaggugaaaacugaggcucacaucuugcuccccaucccauccucagcccucaugcacagaauaacauuugagaagagaagcauuaagggggggauccaaacacagagaaccuucuguuuguaauacccagaacugucaccguguacuacacaccuaguccaggaagagagauuauaauauuuaccacgucuacugcuguacaauccaguaacacaagccaccuaccagcugucucuuuaagaagcaggcagaacaaguuuuccucuugcccugcagccuggcccugagguuagauuccuuucuccugacuugucaacuccacaguucagaaugauuucucucccucucuucugccacagcagacucggcuaagggggcuaccuggucacuggcggaugggagggaagcagggagggcagcaggaaggaaacagaaagggcagggugugcugugcagugauuuaccccaaagguguuugggagccccagggagaggcugcacuaggggcaggguggagguuccuggagggcucaaugacaguucugccuaagggcuugauuuugaauuccugauccuucugucuccuucccaagugcugggaucacaggugugugcacaacacccacuccagagcuguuuucaagccugucaaucauuacacugcuuuagucaguccuuuucagcaaccuuaaucccacuuucaacuuccguuucuuucccuuuuuuuuccaccuaaaauuuauuuuuuacuuuacaucuaugggugguuuuguuuguuuguuuguuuuuuguuuuugccuguauguaugucuguguauggugugcauauaagcauccagaaagaccaaaagagggcacuucccuggaacuagaguuaagaugccuuuaagguaccgggguggguacuggaaauugaccccaggaccuuuggaagaacagccaguguacucucuccaauccacucaccuccugcccuucucuccucuuccuccuccucucccuccuuuuccuuuuccucuuccuccuccuccucuucucuuucuccuuuucucuuuugagacaagcaaggucuuacucuguagcccaggcuggccuaaaacaaacucucacuaucuuugccucccaagugcuggaaugacuugagacaucacacccagcuucauuuccccuuuaaccuuuagagaaaagaauggcuauguuggggcuagagcgaugguuaaaagcacuggcugcucucugagagaucuugaguucaauuccuagcaccucauggugauguacaacccacuguaacucuacccuuaucagccucuucagaguauucaaggugccucaguaugguugaaaggauuucagaaaggcuucuagcuuucuagagacugacaugggggagagugagcauacaacauuuucaucucuagggaaaucaaagcagaagguacaguucucuuccuuucuugcuguagcuuccucccuuucccucagccccuuccccagcucacucccugucccacgggagcaguggcaggucauggaaagcacucuucagaaccuaaguugcacaauugggcuucagagaauguugcaaaacuagaaccaucuguccuaggaaaguggggccaggguggagugccgagaggccuggcucuccugcuugccacacacugcacagucuucucuagcagcucagguggacccuggccugucaugccuguguccagaugcuaccagaaagcacugcagagggugagagauggcaaggaccugaguucaaucaccaucacucacaucagguggcuccacacugcugugcacaugaacacacacacauaugcacaugcacacacacacacacacacucacacacacacacacacacacacacgcacacacaugcacacacacacacacauacucgcgcacacacacacaaacaccacacacucgcacaugcacacacacacucacacacuugagcacuguagacaauucuugcucaucaauuucacuuuccucaacauuccgacauagcugaaacuggcacuuugcugcugacuguaaucccuggagaggcagauggggcuggggagggggugggcacuacccuaccuuugccauuugugccugcacaccacuggcuuucagugcaguuacagcuuucugugcugaugacggacugucgaaguccacaaagccauagccuggaagggaaacagcgucacgucacgggaggugggagguauaagagaggugggaggccuaggcuuuucaggagacagaagaagagguauggacuauguaaaugauggagugggggcugggggggaagggagacugagaguuguccaugggaccccucaccagagcucagacccacucuguggcuaaggacgcccagggacaugagaacaccuugugguuggcauucugccuuucuccucauuaagaaagaaccuagagcuucagaccugguuuuaaauccuauacccucaugcaugucuaaaggcccuccagcuccucugcagaaagcccccagaaaucuagggagggaggaauacagcacagcaagcugguaccagauggaagcugcccuucucagagauguccaacacacacacacacacacacacacacacacacacgcccccucaccccccugaccccccccccccccggccgcccucccucucacccccaacuauucagcaucggaaaaagaacaccuacugggcaguucccccaaauccuagaaaagguguuuacauagaccuugagaaacuucucccagcaccuucccaccuggggaaagacacuucacccagagggagcugagaagggauggcacaccacacagccuuccuuccuucugccagcacugccccuaacaguauuuucagcucuagcucucgagccaccagugagucuaaauacauguuggucuuuaggccccaaaccucccagccccucccaggugcugucugcccagccucccagcaggaggagacagaggugcagagagcagcuggucucucucucaccuuugcacuuguuuguggucuuguccaggauggccuuaguggagacaaucuugccauaccuaaggaaaaggaaaacacaaggugaugaucugugauugggggggggugggggugggggcuguucggggcggggcuuacaaacugcagagagaagagccaggugcaguagcauacaccuuugaaccaagcacucaggagguagaggcagaggugcagaggugaaucagaggccagccuggucuacagagugaguuccaggacagccaggauagagauuaaggcaucaucuagauuacuccaagcccuuucuuucuccgcuaguuuuucuagucauuacauggaaacaaaguaaaaacccagccuggcguuguggcgcaugccuuuaaucccagcacucaggaggcagaggcaggcgaguucaaggccagccuggucuacagagugaguuccaggacagccagggcuacacagagaaacccugucucaaaaaaaacaaaaaaaaaaaacaaaaaaaacaaaaaaaaacaaaaaacaaaacaaaacaaaaaaacccuuagucaauuuaaaaugcuacuugugcaguaaguaguggcgggcaccuuugaucccucugcucaggagcagaggcaggugaaccaggcuagccuggucuauauaaugaguucuaggacaauaaggauuauauagcuuugucuaaaaacaaacaaacaaaacaaacuacuguguuaauuuucaucccugcgacaaaaugaccaaacaaacacuuugauuuuggcucaugguuucaguccagcacagcagagaggaugaagcacugcuccuagcauggggaaaggagggagggggauauaaacaucuauuuccccuucucuuccggccuauauucauggaagaucucccugcuuccuuuuaucgaccccggcacaccuggauguguacuucaguaaucucaagggcuggugugguuuucauuggaaauguccccauaugucccgaggcugaggacugguccccagcugcugacauuguuguaagggguacagccucauuggagugaaugggucacagggauuuuacagccuggaccucccuggcugcccuuuacuuuguugacaucagugugaccaucucuugccacagauccuacccaccaugaugaucuguauguuccccucaaaguguggcuaacacaaagucuucuucacugaaauugcuguuugucagggauauuguccucacaaagggaaaagucacuauagugauccucgauaaggucagcugucacaguguccuuaauauaacccuaaccccacaaaggcaccaccugaaagugacugcagcucuuacaauaccaacacauuuguccauuuuaagacacuuuuggggaaagaagcuuggcccacacauaaagccugugucugaaggcugagagcucuguugggauuccuugaggaucagaaauaaccuuuucuuuuuccuucaguuuuucaagacaggguuucucucuguagcacuagcuguccugauucucucuguagcacuagcuguccugaaacucacucuguaggccaggcuauccucaaacucccagagauccaccugccucugcugggauuaaagguauacacaaccaccacccaccuagcaaaaauaauuuuuuuuuuuuugagacuggguuucuccguguagcccugacuauccuggaacucacucuguagagcaggccggccucaaacucagaaauccgccugccucugccucccaagugcugggauuaaaggcgugcgccaccacgcccggcucgcaaaaauaauucuugauucuacuuuucuuuuagacaaacaccauucauccuauuaaaaauaauaaaaauaaacccaaaaagaugacucagcagcuaaguacacuaggaccugguuuugauucucaguacccgcaugguggcucauaacugucuugugggcacuaugcaugcaugcacacagugcacagacauacaugcaggcaaaauauucacacucauaaauaauacaauuaaagaugaccaucuuaaaaauaauaaggggcuggagagauggcucagugguuaagaguacugacugcucuucuggagguccugaguucaauucccagcaaccacaugguggcucaaaccaucuguaaugagauccaaugcccucuucuggugugaagacaguuacaguguacucauauacauaaauaaaucuuuaaaucaucaucacgacaaugcuuccucugaccccuacacccaaggcucuacuggucccuugaugaggccagccugauccaaaugucuucggcucaaauccuaacucugcuacuuucuaguacaacugaucucagacaagucccguggcuuccuauguucuggccucaucacggcaaccuuaucccaacauuucagugccaacaaguaucuccucgugcucuuugaccugguuuuuccaucuugucuccuuuaggaaugaguuaaauuagucugugacaaguuuucacuuuguauuugaugagauuuguguuuuccagcuuuuuggaaaacccuguuggcagcagaggccuggacagcuggcagagcucuagucaugaagcaguacagaucuugggucagaaguauccuacaaggaaaaaguaucccagaagugugaaaaugucagagacagaacagcagcccugaacaaagucagaaauucaagggcugaagagaaacaguuggcagaaacuaaauuugagauuaauauuccagaaagcauuaaaaaaaaaucuauccucuuauuccuaaagaacauggaugccugauuaguuuguuuuugccccuggcugccucucucccuucagcuuuuucagugcagcuucggaacccagaggauuagacaaaauaagcuggagaaugcccuggaggcugagagaaaaaaaaaagaaagaaagaaaagaaaaaggaggcggggacuggugguccuugggucuuuugaggcaaagagucauaaggaaugacugucggccagaggacacucgagcugcuauccccaucaaggccccaggguggagccugcugcagcccagcagccugagacuuugagcuagaguuuccacugcagcuggcaacagcugggucagugcugcuuccuccuccacaggagccccuuccagagaaccagaaguucuagucccaggccacaccuccccuuccggcccaccagaguuugggauccagcaacccaggaagagaucccggggacacuggcaggaaguccuucugagcaggagagcccgcccuucucagauaggcugggccccucccucuccucuaucaggcuccacccaacccaugccuucucccugcacuuacuccaacauuuuuguuugacugguuuguuucuuccuuuauuuuauuuuauuauuuuauuuuauuucugagauuagguuucucuguguagucccguagcuccaucugcagaccaggcuggccuagaacucagagauccaccugucuucucugcuucccaagugcugggauuaaaguugggcgccacuauagcccugcuucuuugauugauuuugacacaggcaugcacgcacaccaagggguaaguuucugucauacaguuugcauucauaauagccauagacuggcaacaauacaaauacuuucaacaacagaauggacgacucaauaaacaaacaagaacagauggagagauagcucagcagugaagagcacucccuggcuacucuuccagaggaccuggguucaauucccagcauccacauuaaguggcucacaccugcuuauaacuccaguuccagagcaucugaugcccuccggcugcagauacauauggugcacauaaacucacacaagcacauaaacaugcauacaaauaaagauggauuagaaauuaaaaugaaugaauaaaauaaaaagcugcuauagccagguagggugggaaaugccuuuacccccagagguagacacagaaggacaaggaguucaaguccaaccuggacugcaugauacccugcuuuaaaaaaauacauucaccccauggagaugaaggggauauuucugucaaacuaugucagggucagugguaauuaucaguuugacagaaucugagguaccugggagacaggcaccuagcaugccugugagggccuuaaccacuguggcacugagguccugggcuggaauccaggacuaggaaaugcagaaagggaguugagccacagcagcaagcagccguuucccuuucauggaugugacaugaccagcuuccucaagcuccuucaccuggacuucccaggagaagaucaagcucugagcgcaaagaaacccuuucucccuuacauugaucuuaucugaaaccaggcuaggauccaugagaugcugacucaaaacaacaaaacucaaaagagcggcacgugagcgcccuggaaugugccugugacugugggguagaaguguaauacuauugcaauucucccuaagagcauguggcaagaagccagcgccugggaauccgugcuaucccuggaagccucuguauuggggcugcaacucacggcugacagagcuugacaagguccuggucaguggugccuggcugcaguccucggauauacagguugguuuugcucagcuggucguucccaccacucccgccgccgccuccgccgcugcuguugggggugcuauuccuuggacuuggaggugccauuugcugagccacauauagcugcagggagacacgaagaucagaaggucagagagacugugcauuuacacacuagagacugaagaagacauccuggaaauagauacaaaacauuaacagcaaugaacucaaaggggaguaaagcaguuaaaaagaauaagaagauaggucaucucacuggcucaaugcauaaagugcuuaccaccaaacguaaugagcagaguuugaugcacauggggguaaagaacagacuccugggcuggagagguggcucagcaguuaagagcacugacugcucuuccagagguccugaguucaaaucccagcaaccacaugguggcucacagccaucuguaaugagaucugacaccgucuucuggugcaucugaagacagcuacaguguacuuagauauaauaauaaauaaaucuuugaaagaaagaaagaaagaaagaaagagagagagagagagagagagagaaagaaagaaagaaagaaagaaagaaagaaagaaagaaagaaagaaagagagaaagagagagagaaaggaagaaagaaaaauagacuccuagaaguuguccucugacuuccacaugugcacugugcaugcccauacacacucacaugugcacacaauugaaugcacaaaugcacacaauaaauuauuuagcagagcauuggugguaccuuuaaucccaccucuaaucccagcccuuguaaggcagagggaaguggaucuaugugaguuugaaggcagccugaucuacagagagagugucaggacagccagggguacacagagaaacccuguuuugaaaacaaacaaacaaacaaaauuaaauaauuauaaaauccauaagaauuccucuacuauaaaagaauagaaugcauagcuaucuuaccuaucagccaggaguaauaagaauacaauaacccuguuugggaaaagggugcccuguaguauagcaggauguuuguaaucauaaauauguugcagaacaugguuaauuuaaugucugccucucaaguccagaacuuaugaaaccauaaaggauaaaaauaaauguaaucacaaaaauauucaagcagcaacagaaaagagucccacaugauacuuauagguaguugaacauuguugcaaacuuggauaguaaggagaaauguuggggcuggggagauggcucagcuauaaagggcuuaucaucuaagcaggaggaccugaguuuagacccuuagcaaccaugcagaaagcugggugacacacaucgguaaucccaacacaggaagacagagacaggugaguucacuggccagccaggcuagccaaauccaggcucaggcucuagguucagagagacccccucucaaacaaacaaaaacgcccugcuguggugucacaagccuuuaauaccaguacuuuggaggcagaagcaggaggaucucugaguuucaggacagccugauguacaauguaagcuccaggccagccaaggcuacaugguaaaaagcaaacaauaaaagagaguccaagagacaaaacaccgagaaauccccuaaguaauugacuucccagaaagaugacacaaaccaaguauguucaccuaauagguuagagaaaacgaggcugcaugugugagcgacuaggaaacugaauacucuuagaggaagugggaagaauaccaaagagcuauaguuugcucuacacccuaaacuaaacccauaugauucaaaaauccuuguguuguuuccuguuuaaagaccccauauaucucaggcuaguuuuuuaacaccucuggcuucauuuccucaaugcugagauugcuuauguaugcaaccacaccugguuacaauucaaagcucugguagccacucauuugucaccaaauucauugucaaccugaggcccuuaacuucauuauuaaccacuagggcaagagaaaagccuucccauaugugaagccauaguuccugguucauagcaggcauagguauuugugaagaugagagaaaucaacuuauagaauauauuaucauauucuuuaaaccuacagucucacagauucacccaagugaccugacuuuauaauuaugauggcaaccugcauaugaacgauccauacgauaugucccgaagcuaguggccucuagguugugcaacauaacuauuuuugcuuguguuccagucauaauacuuccaaaaaaagggaagguucacauucucugugcaguaacagauuccccacuaauugcucaugagacccucugggcuauuucagucauucagugaauuauuaaauugcccacuccaugugaguacugacugaccccgugaggaacgauuaaaagaacagguggaauaucucacaaugccuucugauuuguguggugcugcggauugaacccaggccuuggcuguauguuagggaagggcuacaucuucaguccuuuuuacuuuuuagcuugaggcaugaacuauguugccuaagcaggccuucaacuuucgaaauucgacuugguaaaccagugagguguuuuuuuuuuuggggggggguuacaugcagaaauaugagcgaggggcuacuuacagaagcagaaacgaauaaagacagccauaacaccccagcauagguguccagaaagcuggacaccugaggcacacugcacaaccugaagacagcucaguagguuggggagugucuuuuccaggcagauggguuggccugagccucuucugcgaaucucugcuuguuugagugucuuuguaguccauacuacucauauaagcccaugugagcuaucccagggugaccucagacuccuccugggccagccucacuggcugagugcccaacuaugucugcccauaauguauuuaaacacacgcccacaaagaguuuccaggggacccaacacccuucacacagacaugcaugcaggcaaaacaucaaugcauaugaaauaaaaauagaugaaagaaagaaaaguauggggacuggagagauggcuccagcgguuaagagcacugacugcucuuggggguccugaauucauuucccagcaaccacaugguggccaacaaccaucuguaaugagaucugauaccuucuucuggugugucugaagacagcuacaauguacucaaauaaauaaaauaaauaaauaagucuuaagaaagaaaaguaugugcuaacaaggauccaagcgaagugguuaaaagaacaugaagcaauaagcaauuccugggagagguuuugaaaaagacgucuacauuuucccuugaaaggacaagaacagagaguucagaagaggguaaaugcugacggcuaaugcagacauuuucuuuagugggauaccaacggguaaagugcgcaugagucuauaaacaaacucuacccacacucucauaaauagcccuagugaagcucagggggacacauagaauagaaagggggacagcggagaggagggaagggacugcugguaacagaucugugugugugauagaaaugcaucauacagauguacgaaaugucauagagagccaggggccaggacaggggaugcagagguuggcgaaucgcugaguucaaggcuggcuuggucuacagagugaguuccaggacagccagagcuaccugucugucugucagacagacagacagacagacagacagacagacagacacuguccuaaaaaaaaguaaaaaugaaauucuucugcauaguuaauauauucuauuaaaaacaauuaaguaggggcuggcgaaguggcucagcggguaagaguacugacuacucuuccgaagguccugaguucaaaucccagcaaccacgagguggcucacaaccacccauaaugagaugggaugccuucuuuuggugcaucugaagacagcuauaguguauuuauuuauaguaauaaauaaaucuuugggcugggcgguggugguacacgccuuuaaucccagcacuugggaggcagaggcagguggauuucugguuucaaggccagccuggucuacagagugagcuccaggacagacaaaacuacacagagaaacccugucucggaaaucaaucaaucaaucaaucaaucaauuuuggaccagagcaggcagggacuaagcaagugggguugaccagagugagcagggccaaccagugugagcgagguccuacgaaauucaauucccaacaaccacaugaaaacucacaaccaucuguacagcuauagugaacucauauacauaaaauaaacaaauaauauaggugaaacaacaguaugaacuaaccauuacccccggagcucgugucucuagcugcauauguaucagaagauggccuagucggccaucauugggaagagaggccccuugguauugcaaacuuuauaugccccaguacaggggaaaugccagggccaagaagugggaguggguggguaggggagcaggguggaggggaggguauagggaacuuuugggauagcauuugaaauguaaaugaagaaaauaccuaauaaaaaauaaaaauuaaaaaaauaaauaaacaaacaaaucuuuaaaaacgauuaaguaaaugcugaaucaggugaacuggcccaguagguaaggacacucacuacauccugcaaccugaguucaaacccaaauaaaggcaggggaagagaaccuuuguccuaugaucuccacaugcauacuguagcuuguguaccccucuucauuguacacacauacacauuaauaguuuuuuuuuuuuuuugguuuuccgagacaggguuucucuguauagcccuggcuguucuggaacacacuuuguagaccaggcuggccucgaacucagaaauccgccugccucugccucccgagugcugggauuaaaggcgugcgccaccacgcccggcuauuaauaguuuuuaauuaaaaauuaaaaccuaagauagaauacuaagauacuaaacccuauaccucaugauccuucugcucagccccccaagggcugggaauacaugcaugugccaucaggcucugccuugucuuucuuuuuuuuuuuuuuuuuuuuuugguuuuucgagacaggguuucucuguauagcccuggcuguccuggaacucacuuuguagaccaggcuggccucgaacucagaaauccaccugccucugccucccaagugcaaggauuaaaggcgugcgccaccaugcccggcuguguucuuguguuuacauuaccucuucugcuuuuagguuuuaauuuuaauuuagcuuuuaacagaggucagaggguaacuugguucuuugcuucugcauuguggauccuggggaaucacacaggguucaccgggcagacaccaauaccggcugagccacuugcuggcccucugcuuucuuaaaaaauuugagaugugcccacaguauaugccaggcuggccucaauccuccugugaugguuuguauauacucugcccagagaguggcacuauuaguagguguggccuaguugaagugggcuuuaagacccucauccuagcuuccuggaaguuaguauucugcuaggagccuucaggugaagauguagcacucucagccccuccugcaccaugccugucuggcuacugccaugcucccaccuugaugauaauggacugaaccucuaaaccuguaagccagccccaauuaaauguuguccuuauaagaguugccuuggucauggugucuguucacagcaguaaaacccuaacgaagacaccuccuuuaaccucaagguuacacagugaauguggagcauugugaguaugugugauguguguucaugcaugcaugccuguugagugugggugcuuaugugccuuaugugccuuuucagguauguggagauugaggacaaccucagggcucgggccucacccuucuugaggcagggucucuuucuuguuuccugccucacucgccagaccagguggccaguggaggccugggauugcaaagagagcuggagagcccagcggacuuggguucuggguccucacacuugcaugacaagugcuuuagcuacugaguucccaaggcccagacucuuaauuuuaaccugugucacauggcucccgagucuauacuugucuacugccgucucucuaaccuggagcugucaaugacuuucaccaacuaugagccucuauuuauaaaacaagaagucuauuucuaaaacgugcuuaaauccagucuugaauaagauuuaaaaauaggcaaagaagaggaaugcugguuuacaccuauaauccuaacacuugggaaucgaaggcagcaggaucagaaguucaaagccaaccuggcuuauaugagacccccaucucaaggcuuagaauaaaccauuccuuguccuuuaauggcuggagauuuaguucaguagcagagaccuuaccuaauaugagcugugcaagaaccuagguucaagauucaucucugugccccaccccucaaaaaauaggcaaaaagaucuaucccaaucauuaaaaacaccuacuagauuuaagaguuggucugauauucacaaauaaaccaaauuaaacaaauccucuugcaucgucguuagauugcaaaacacuuaauucucuaccccugcuucagucagugucuuuuuuuuuuuacuuuuacaauuauaaaacaauuuuauuaaaaugaauauagucauucaaaauaacuacuaucgauaauuauucagaguacuuuucuuucuuuuuuuuuaaauuuauuuuuaauuagguauuuuccucauuuacauuuccaaugcuaucccagaagucccccauaaccuccccccagucagugucuuuaaaagcaguagcacaggccuaucaucccagcuacugggcgggcugggggggccugggcaacagugagaacccagaagagaagaacagggagggagaagaggaagagacacagggcagacaggcaggcgggcaggugggcaggagcacaauuccccucucaaaaugugagaccuggcagcuagcaagugcagagcugaccugagcagaccaagcugggccauguggggagagggagggagacaaagggaaagaggggaagaacugggugcaaggcccuggaggcuccggguaaccaaacuggcuggaauauauaagaaaggcaaagcugggcgugguggcgcaugccuuuaaucccagcacucgggaggcagaggcagguggauuucugaauucgaggccagccuggucuacaaagugaguuccaggacagccagggcuauacggagaaacccugucucgaaaaaaccaaaaaaaaaaaaaagaaagaaagaaaggcagcccaguccccugggcuggauaguucaggguaaggagagguguauguaagccaggaagacccuguaacagguaggggcugagggaugcuggaagaaccuagcugccagguuugaugugauauguucaguagguaccucagccauuuguccuacgaucugauacuuaacaguuuaguuuuaugggagaugaaucugucugguucuagauuuagcauuagaacauccaguggccuggagauguaaacugucuugcuguuguuguuguuguuguuugacacagaccuccucguguaacccaggcugguuuuagacuccagauccuccagcgucccgagcuaggauuacagaaguaagccagcaggucuaaacugauugauagaggaucuuuuuugaagauuagucuuacuagcacuaaagcauccgcuuuuauugucauuugcuacuuuuuuuuuuuucccacaagagugaaggaaggaaaacgcuucagauccaaacccuucagaccucagcaagucugaagggcuggaaaaggcucuggugguugacgcgguagggugaacguuaaagcacggccuugucaguuugcaggucccauuucuguaaaugggauuuaggcaggaguggcugguugcucauaccuagaauccugacucucggagggggcuucucccaucacagcugugguauccugaacuaaggcaguggccaaggaugcccuggaacuucugauccuccugacuccacccccuggaugcugaagcuacacacaugcauacauaaucaguuuuauguugugcugggaaggggccuuagggucucgugcagacugggcuagcacuacagcagccaagcuacaucccacuauuucauacuuaacauaaggucuucauuuucagaugagaaaagauuauucauaauuuaauaagauuaauuccuggggcuggagagauagcucagugguuaagagcaccgacugcucuucugaaggcccugaguucaaaucccagcaaccacaugguggcucacaaucaucuguaaugauaacuaaaucucuucuggggugucugaagacagcuacaguguacuuacauauaauaaauaaauaaauaaauaaauaaauaaauaaacuuuaaaaaaaaagauuaauuucuggauaacuacucagcuguugcugagcagugguggcacaugacuuuaaucccagcacucaggaagcagaggcaagcagauuucugaguuugaggccagccuggucuacagaggggacuagacaugggauaaaaugaagaagaaaguagguagaaucuucuaggcugcgguaaaguauucaagguuucaugcucaaugcaggagaccguggauaauuuuaaauagaaaaguuccuguuggguuucagaccagggacaaggggcugcgguacauauuuaacauaccaaaguagaccuggccuccagguucucucagcaucccucggucccuaccucuuacuagguauagcuggcauauccugcucuuugcccucaacuuuccagcccagggccuccccuagaaacuccucccuauauaacccagacaauuugguccccucuucucucucuccccucucccccuuccuccaugucucccuccccaugguaacuucccuggacuccuucauugggaccagugaaccagcccaagaacagcuucccaguaaaccugccuuucuauacuuuaaucuagcuugaacugacucauuucaucaguggagaauaacuccccaggucuguuuugaagcaauaaugcucacagugggaugggcauuggaggguagcucacugaugggugauugcuuagcauacacuggguccuuaguucaaucucuagcaugcgugugcacacacacacuugccugaucuggaacucaccugccucuaccuccuaagugcuacauacuaaagguguacaccaucauacucugugcucuuacaaaugccuuugguuuccagcacccacauccaaugguuuacaacccuccagaguuaaccaccuauaaccccagcccagaaggaucugaggccuguggucucuguggguaccuacacacccacacacagacacaaacacauacacauuuaaacaacuaaaauuauuuuauaauuuauuuuaagcacauuggcguucugccugcaugugugaggaauucagaugcccuggaacuggagcuacagacagcugugagcugccacgugggugcugcgaauauaacccaggaccuacggaagagcaaccagcgcucccaaccgcugaaccaucucuccagcccuaaaaaaaaaaaaaaauuuuuuuuucaagucaggguuucucuuuauaguccuggcuguccuggaacucacucuauacaccaggcuggccucaaacuuaguagaaauccaccugccucugccuccuaagugcugggauuaaaggcaugggucaucacugcccagcauuauuuuagagacaauaauaucccagaacuagagagauggugauaaagaugagauccgacuuauaguagcaaacaacuugcugauauaaggcaagcacucuacagcuccaauuucuaguuucggaauuuuuuaagacaagguguagcaauggcccaacuggcuucaaaguugcuauguagccaccacggcugacuuuuuuuguauucaccucccaagagaugggauagcaagugugucccaucauguccagcuauuauuuauaucacucuguaguccagguuagcauggaacuaaccuuguauccaaggcuggccuugaauuuauagcagucauccuguuucagccucaugggugcugagacuauagcacgacuaagcuuguuaggacuggcuuauucucugaggaaaaugcagagacuccagagucauaaucgcgaagcacagccgaauaggaaugaguaccaagcccaaaacaugcugcugugucucuggugccaccucucucugagaaacuaacacaugcaacaaagaugcccggcacagggcaacccucagugcucccucagugcccccugggugcuccgucaugccuuagcuuaauuacuuuacaaucaagcccacuacuucccaugcaaagaaugcuuccaucugguaucuuaaugccuuccacuuaaacagccccaaaccaugagacauaauuagaagaaaaccuaugaagucagaaaccaaaacaaaaaaagaaaaucaaaaaaggaacucagagaaaaaagagcacagggggaaagaaacacaggaacaugaggaaagaguugugagaggucaaaacaaaaguaauuccuucuacgaggcaaaaucagagcucaucagagacaggauuguacagccuggcacacgucggcaaggcuggggcaggagcuucaguguuuguuccuagaccaggacuagggugagaccuugucucaaaaacaaacccaaacaaacaggaaugcacaaaaauggugaggauaacaccuguugaaagaaaaauaugauuuagccgggcagugguggcacacgccuuuaaucccagaacuuggaaggcagaggcaggcagaucucugaguucgaggccagccuggucuauagagugaguuccaggacagccagggcuacacagagaaacccugucuagaaagaaaaaaaaaggaaaaaagaaaaguaugauuuuagauuucaaaucuauggauacuagggcuggaagauagacuaaagggaaccgcacagaaaguagaauuuaaaaauaaaaaaaauaagcagguggggcuggagagauggcucaguggauaagagcacuggcuuuucuugcagaguucugagguucaguucccagcacccacacaauagcucacagcugugugacuccacauauaagaauuacuuauuauaugggaguacacagucacugucuucagauacaccagaagagggcaucggaucccauuacauacauauuguaugagccaccaugggguugcugggaauugaacucaggaccucuggaagagcagucaguguuccuaauugcugagccaucucuccagccucucuaagaacacgggaucaguaaccaaauuagcaagagucagcaacacuguaaaaucauaggauaacaaaauaacuccucaacuaccaauuauacauucagucaacugucuaucaagcacuucacuaggaaacauuuucguauuuacaaguuaaaacaaaacaacaucccuuugcacuuggugacacuucaccugucuuagucaggguuucuauuguugugacaaaacaucauguccaaaaugcaaguuggggagaaaaguuggcuuacauuuccacaucguuuuucaucaccaaaggaagucaggacagaaacucacaaagggcaggaacccagaagcaggagcugaugcagaggccuuggagggugcugcuuacuggcuugcuccccauggcuugcucagccuucuuucuuauagaacccaggaccaccugcccagggaugacaccacccaccaugggcuggggccucccccauugaucacuaauugagaaaaugccuuacagauggaucucacagaggcauuuccucaacagaaucuccuuucgcucugauaacucuaguuugcgucaaguugacacauuaaaccagccaguacaacugaccucuuguaaagcuggcacacaaacauauagcuauuaaaccacaacccuuccuuucuucuucaucccaagauuucucauaaaaacauaaacaacaggcaagcaccaaucccugauauuauugauacuuacaggagccuagcauaacuguccucugagaggcuccacccagcagcugacuaaaacagaugcagagacccauagccaaacauugguuggagcucaaggacucucauggaagaguuggaaaaaguagggguaaguccacaggaagaucaacagauucaacuaaccuggacccuugggggaaucucuuugagauugaaccaccaaucaaagagcauacacaggcccuaggcccccugcacaugugcagcucagaugugcagcucagucuucaugugggucuggaacaacuggggcaggagccaucccuaaagcucuugcuugucuguggaauacgcucuccuaacuggacugccuugucuggccucaguggaagaggaugugccuacagaugcccugcagaggcuugaugugccagaguggagggacauccaagggagcccccauccucucagaggagaaggggaggggaugugggaagggagugugugagguggggacuaggagggugggacacaauagguauaaauaaaaauaauaauaaaauaaauagauaaaagucccacagucuuuacaaacacacuaacauuucagcuucuuuaaaauauccaaucuacuuacugggugguguuggcaauguacacacaccuuugaucccagcacuugggagccagaggcagggggauaucugugagcuccaggccagccuaguguacaaagaguuccagaauagccaaugcuacacagagagacccugucucaaacaaaauacaaaacaaaacaaacaaacaaacaaaucuaaucucucuaaaaauccaaaaucucuuuuaaaaguucaaaguuuuucagcugugggcuccuguaaaaaaucaaaaucaaauaccuucuucaagagggaagaauuguggcauagccauaaucugaaccaagcaaaaccaaacucaaacgauauaaauaacuuaaugucaaauguuugggauccacucgugaucuucugggcuucuccaaggguuugggucacuucuuuagcucugccuucuguagcagcacacagugugucuuccaugguucuggcagggucuacuccacagcugcugcuguucuugguggucaucucaugguccuggcaucuccaaaaugcugggucuucuacugcacggcugcacuuucaccaauagccauaggcucucuucauggugccaagccucaaguucucugcaugaacccuucaguucugggcuuucaucugccacugaggcugcaccuucaccaauggccucuccuguccucucaaagggccaagccucagcugcucuccaugaccccuucaugccuucaaaacaaauaccgcugggcaaugguggagcacacccuuuaaucccagcacuugggaggcagaggcaggcgaauuucugaguucgaggccagccuggucuacagagugaguuccaggauagccagggcuacacagagaaacccugucuccaaaaaaaaaaaaaacaaguaccaccaucuuuuuuuuuuuuaagauuuauuuacuuuauguagaugaauacacuguaacuguacagaugguugugagccaucauguaguugcugggaauuaaacuuaagaccucugcuggcucagccccgcucgcucuggccaccugggugcuucuuacacauugccaacugcuaacaugagguacaaccuuggccaccucuggaacacagcuucucugugcucucaggaaacacuuccccuagaagauuucaccucagugaugcuggucucuucuaauucacugcuaauuucuuagcuccagcugaccagcaucaauugucccaguaaggcaaagguucccuucaguggugcuagucucuuguuaacugcaacuguuguuucagccccagcugacaagaauggcagaaucuuaauucaaaauagcaaaugccacuaauagucuuuaaauuucccucugaaacuucacaagccaggccucuacccuccacauuuuuaucuuccaagcucccacacgacaucccacugaagucucaacauuuaauggcuuuucuagcccaaaguuccaaaguccuuccaugauccucccaaagacuuggucaggucuaucacagugcaccacacuacaccguuaacgauuggucuuaaucaggguuucuauugcugcaaugaaacaucauaaccaaaaaguacauuggagaggaaaggguuacacuuuuuuuuuuuaauuuuuuuuuuuuuuagauuuauuuauuuuauuuuauuauaugugaguacacuguagcugucuucagacacuccggaagagggugucagaucuuguuacggaugguugugagccaccaugugguugcugggauuugaacucaggaccuucagaagagcagucggugcucuuaaccacugagccaucucaccagcccaggguuacacuuccauaucaccauucaucaucuaaggaagucagaacaggaaccuggaggcagcaauugaaucagaggccauggaggggugcugcuuacuggcuugcuuccccaggcuugcucagccugcuuucuuauaaaacccaggaccccagcccagggauggcacugcccaccaaggccaaaggcaugcaccaccaacccuggcuuaagaaguugaaugaucaaggaagcacaaguuuggacuaaaauggaagagaggggaaacggggagggcaggggauguagcucuaaagagcucuggccugguaagcccucacauuaaaccgugggagagaagaggucucugcccucuguugcaaacagaucauuucucacucaagaggaagaagacaggagagcagguaagagagccaaggguuaugacuguugaccuaggagccaggagagaagagugaagacuccucccacagagcagaaguagaagucuauguggacugagauacauguggggcaggaaauaagguuuuuuugguuuguuuguuuuuugagacacauuuuagguagcuuccaguggccuugacccaagaacagagcugaggcuacucuugaacucacugccucuugccuggaccuccccaagugcuugaacuauuuaugaacaucaccaugccaugugagcaaaaucuauggggaagguaaauuaucucaaauaaaagacagucccaugccaggcagugugguacauuccuacaaccccaggaucaggagauaaggauagccugagcuacagagagaccccucucaaaacaucacacacaacagcugggagauagcuguaaagaaauuugccaagcacucgggaaugccacaaaucccaagugaacuugugagcuaccugugugugacuccaggccccaaagguggcugugggacauggaaccccuggaacaagcuggcaagccagagucugcaaugcugagcucugcuucaaccggcagaccuugccucaaugaguaagguaaagauugcugcccucagucuuuuuuuuuuuuuuuuuuuaaagauuuauuuauuuauuauauguaaguacacuuagcugucuucagacacuccagaagagggcgucagaucuuguuagggaugguugugagccaccaugugguugcugggauuugaacuccggaccuucggaagagcagucgggugcucuuacccacugagccaucucaccagccccgcugcccucagucuugagcacaccccccccaacacacacacaugagcacagcuaccuaacacagacacgugggggggaggggggguaagaaaaacaaaguagccccuuuucuuuuccuggaggaaauguuuguugcugugaggguuaaguuuaacaacagaugccagggagaugaugucaaggaaggcgugguuagaaaccucacaaauucggauuccuuuauuccuagacauuuccccuccuacucaccuaucucaugucugugagggggcaguccugcuaaaaugaaggcacagucucgagaccuacaacgaaccuuucuugcucuguuauuuaucuaacucaaggccauuagcuuuuuuuaaaugaucacauuaaaauaucuuguacaagccuuuuugaaauccacaccuuuccaucuuguaacuuucccccucuugguauuuugaggcccuggcuguccuggaacuugcuccguagaucaggcuggccucaaacucacagagaucugucugccucuuuccccaagugcugagaucaagggcacccacaacuacugccugggcuauuuuguaacuuuauauuuacccacagcucccucccucccuacuucccuuccuuccuuccuuccuuccuuucuucccucccucuuuccuuccuucuuuaagacagagucuugcucuacugggcugaaauuugcucugagaacaggcuggcugaccucaaacuccauguaguuauucuguuucuguucccaaaaugccaggauuccaagcaaaugcugacaagcuugcuucccuuuuguugcuauuuuaauuccaaugcauagaaauuuaacacuauaucccaagaaagacugccuuuauuagcugauuuuagguuuuuuuuauuuaucaauuuauauauuuaguacuagggauagaacccagagccuugaauaagccaagcaaguguuuuaacauagaccuacaacccuaucccuuagggagggaggaagggagggagggagggaggaagaaagaaggaaggaaggaaggaaggaaggaaggaaggaagacagacuuuuaggagcuagagaaauggcuuaguaguuaagagcucauauugcucuuguagaggauccaaauucaguucccagcacccacaucugguggcucacaacugcuuguaagucugcaucuaagggcaauggcaccccuggccucugcaggcaucuauacaugcaugcacguaccuacauacauaaacagaauuuaaaauaaaauuuaauuuaaaaaaauguaaugaucucuaagugccagcuugccugucuccugugcccccuccaccccggcaugugugugugucucugugugugugugugugugucugugugugugugugugugugugugugugugugugugucugugugugugugugugucugugugugugugugucguuggugugaauaugagcuccuggcuccugagagcaaagaggccagaggcauccaguccuucugaaacuggauuuauaggcaagguaccugagaugggcauugagaauguaacucuggucgcuucaagaguaguaaccucagagcucccucgcuguuguucccuuccuuucuuucuuugaggcaaggucuuacacagccaagacuggccuugaauacagucuugaucucagucuccugagucaccgggauuacaaguuuguaucacuacacuuguccuuauauuugacuacauuacuauagcuaugacagauaaagaaauuaaauuaaaacuaaggacuggggaggcagcuggguaggacauaaggaccuggguucagauucucagcaccagcggcuggaguguuuaagcaucaguguuuaagagcacugaacgggcuggagagauggcuuagcgguuaagagcaucaacugcucuucccaaggucgugaguucaaaucccagcaaccacaugauggcucacaaccaucuguaaugagaucuaaugcccucuucugaggugucugaagacagcaacagcaagugagucacagcgagaagaaaaagugucugaagacaguguacuuacauauaauaaauaaaucuuaaaaaaaaauugucaucugcauugaccugguauuaaaaaaaaaaagcacugagcacuuacaggggcuauugcagaaaacccagauucaguucccagcacccacguggcagcucacaaccaucggacaccuucuuauggccucugcggacaccagacacacaugugguacacauuuacaugccgcaaacauucuugacaugaaaaaaaaguuucuuccccagaauacacguaaaaucaagcguggccucacaugacuauuaaccccagcacugggacaggacaagaggauccucagagcucacugguaaagccagccuggcugaaaugucugcugcgcgagugcacgcaugcacacgcaagcgcagggaacaagaaaaccagccagacguggugccacaugaagucaucccaggacucgagagguagaggaucaggaauucaagggcagccuuagcuacuuuaucaaggcugagaucagccugagcuacucgagauggucucuacacacaaaauaagucgaaaagaaaaucaugacugucacaaacuacucaugagaaaucuucccuuggaaaguaaaaaauaugagacaguucaaaaauaaaacaauccugguucuguuuguguugucuuuugauuuguuugcuguuguuuuucugagauuuauuaauuguuuuuuaagugugaguguuuuacaugcaagaauguauaugcaccauguguaugcuuggugcccaugaaggaaagaaccgccuggaaccagaaucuuggaugguugugaacuaucauauagaugcuugggaauaaacccagguccucuguaagagcaccaaguguucucuguguuuuguuuuguuuuguuuguuuuugacauaggguuucucuguuuagcucuggcuguccuggaacucacucuguagaccaggcuggccucgaacucagaaaucugccugccucugccuccagagugcugggauuaaaggcgugcgccaccaccgccgggcuuuguuuuuauuuauuuuuuuuauuuauuuuuuuuuuuuuuugguuuuucgagacaggguuucucuguauagcccuggcuguccuggagcucacuuuguagaccaggcuggccucgaacucagaaauacgccugccucugccucccgagugcugggauuaaaggcgugcgccaccacgcccggcuuuguuuuuauuuuuuaagauuaacuuuuaucuguaugagcauuuugcuugcauauuugucugugcaccacuugcgugucuggugucuaugaaagccagaagguugguuacaucagauccucugaaacaguauuuacagauaauugugagccgucauguggguucuggguaucaaauccagguccucugaagaacaaccaaggaauguucuuaaccacugagccaucucuccagccccuguuuguuuuuuguuguugcuguuuuaguuuggcuaguauugauuuuguuuugguugcuuggcuuuuugagacaggguuucucuguguagcccuggcuggccuggaacucagagaggaccugugcuaccacaucuggcuguugcugucuugagacagaaucucacuauguagcuggccugggacucuaauucagauaucuaccugccucuaccucccaaauacugggauuaaaauacacaaacacuucaagccuuucuguuuuauaaagacagggucuuggguugucuauguaacccaggaugacuauagaccuuccaagugcugggacuacaggucugcagcacacuaguuuaugcucugauggaguugugcuaggacagaauccagagcuucgggggugcuaggcaagcagucugcuaauacacuucccauuuuuacuacauccuuucaauuuugaauuauauauucauuguaugugugcaugcuacagcauguguguggaggucagggguaaacucaucacagagaacagcucucuccuccaaccucgaggcagggucuuauuacuucugcugcucugcugcuuuguauccaagaggagagcuggccugagagccuccaggcaguucagccaucuugccauaggcaugcugggguuacagauuugcaccaccucaccaccucauccggcuuucuuucuuucuuuuuucuuuuuuucuuucuuucuuucuuuuuuuuuuuuuuuuuuuuuuuuuuugguuuuuucgagacaggguuucucuguguagcucuggcuguccuggagcucacuuuguagaccaggcuggccucagaaauccgccugccucugccucccgagugcugggauuaaaggcaugcgccaccacgccccgcacauccggcuuucuuuguggauucuaggacccaaauucagauccucagauccgcaggcuguguggugagggccuacuaagucacuugcaauacuugcagguucuuguaaguauuucuuaugcuagaaacuagaacuaacaacuauaaacagcaguaaacuauaauauaaaauuuuuccuuauaagaaacacaucuuucggggcuggugagauggcucaguggguaagagcacccgacugcucuuccgaagguccagaguucaaaucccagcaaccacaugguggcucacaaccaucccuaacaagaucugacucccucuucuggagugucugaagacagcuacaguguacuuacauauaaucaauuaauaaaucuuuaaaaaaaaaagaaacacaucuuucgcuuuauggcuuuuuggcaucggggugggaguuaagguguuaaaaucaaaacuauggccuuauuuuuuaguuuuauuguuuuuaugcgacagggucuuacuguguagcccuggacugggcuagaaucacuauguagaucaggcuggucccaauuuuguggccuuugagggugaggauuucaggcuugugccauuuaggccuguuuguguggugcugggagcuggagauuagugagcaagaauucuaccaaaugagcuacaaccuagcccaacccuuauauuuuuuuguuuuuuguuuuuguuuuuuguguuuucuuuuuucuuuguuugaggaagggcccucaugcaaguuaacucaaacuauguagcuuagggugaccuugaacuccuaaucuuccuaccucuaccuccccagaguugguucaauagaacacuggguuacagggccacucggccucccccaccccaccccccaggcuuuuuguauuacacugauccacacuguauaacccuggcuagccugggauuuguagcaaucuuccugccucugccucccaagugcugagaucacuggcuugugugccgccaccacaccuacauuaacacugucacaacaggaagaaacaccugaaagaacaugcacagcaaauuaaugucacucauuucccuccaggagucggauuugagugggaaacuacagggcuuugacagauuuuuuucuuuuuaauuuuacaguguacauuuuagauuuaucacuaaaaauuagcaaaagauccuuuugguguuucaagacaggguuucccugacuguccuaaaacucacucuguagaccguguggccuggaacucagagacccaccuaccugccucugccucccuuagcccgggaucaaaggaguaaacuacuuguccaggcugcuugcuuguuuuccuugagacuaguucucucuauguaaaccaggcuggccuugaacucacagaagaccaccaugcccagcccagaaucuuuacaauguuuaacuuuagguuuaaaagugcacaaauugggcuggagagauggcucagcaguuaagaacacuggcuguucuuucagagcaugcagguuggguucccaucacacagcaguucacuacugucuauaacuccaguuucaggggauuuaacacccugucuagccuccaagggcaccaggcacaugugugguaugcagacauaacugcggacaaaacacucauauacauuuaaaaaaaaaaagcaugaauugcuuugcauggugauacuggccuauaauuuugggaaacugaagacugaagcaggaagauugagcaguugaaagcagcuugguauacacagcuacagaguaaguuucaagccaaccagggauacaaagaaucaaaaauguacaagaccagcgcacucccacccccaaaagcacagauuuacaugagaaaauacauugaaacacuucucugaaacaagaacaaaggcaccaaacucucugugucaacagcaagauggagagcaacauagcccuuucaguucauguacccuaaguucacaagcccauacacacacacagcaucagucuugugcacagccacaauaugcacaaagugcaaauauggcuuccuuagauguuucagaacauuggcuuguaagaauccaaagaaugcuuucuccacuuaacacuuuaauuuauugugugcauguaggggucagaggacaacuugugggagucuccuaccuaauauaggucccgagauaggacucaggcuugaaggcacgaccuuugccaucuaagucauccugacagacccccagaggcuuuuuuuaauuacuuauuuuuuuauucuugcuaucauuaguguaucucucugagugaguacacaaugccacacugugugugcagacagcaggacaaauuucaggaagggagugacuuucuccuucaaccaugggaccuggggcuugaaacgacaauugcuuucacccacagggccaucccaccaucccccaaggucuucuuggcaaauacaauuagugacuaugcagcugcucccacuccuacccuauccaaagacaguauuuccugaacuguuucccagaccuuauaaauuaucaggaagagauaugagauuaaguugaaaucugcaguccuaucucuugguccccaaguucuccuacacuuacaaucuaaacaucuggcuguuggcuuagucaccaagugcaugugcaaggccacacguuccauccccagcaucagcaucaacaaaaaaacaaaaagaaaaaaaagaaggaaacuaaaucuuagacaucccccauacuccaaagggaaaggagaacugagaaaauauuuuagauauauucaaauacauaacaaccugaaagagaaaauccauuuccuuuuauucuaauggguauccugagaaacuuggaggggaaaaagaaucagaagaggcuguguaguaggagcccugggaaggcugagccaggaggauuacaaguuugagggccaguugggcuacauaauaaaaccaaauuagaaagaaaggaaggcuagcacuuaggaggcagagacagguggauuucugaguucgaggccagccuggucuacagagugaguuccaggacagccagggcuauacagagaaacccugucucaaaaaaccaaaaagaagaagaagaagaagaagaagaagaagaagaagaagaagaagaagaagaagaagaagaagaagaagaagaagaagaagaagaagaaaaggaaggaaggaaggaaggaaggaaggaaggaaggaaggaaggaagagaaagaaagaaagaaagaaagaaagaaagaaagaaagaaagaaagaaagaaagaaagaaagaaagaaagaaaaagauaagaggcaauggcucauucauaucugugauccugugaccagccugggcuacagagugaguuuuaggccaacuuggagcaaagacggagaccaugucucaaaacccaaaacuaauagaaaaugagaaugaaacuuguauacaguacuauaaagagcugaggagaauaaagauagguggaauguucccuuucaaacacacauacauauaaaaugaauuauauauacauauauacacauauaacauauauauauaugcauauauauauauuagaagggcaucaguuaauaccuauugaaauauauaauauaauguuuguauauguguguaaucaaaaauaugcauagagcuucauuucuuuuuuuguuuuuguuuguuuuuugacacaggguuucucucuguagcucuggcuguccuggaacuugcuuguaguccaggccgguguugaacuuagagauuggacugccucugcuuccuggguacuagauuuaaaggcuugcaccaucaccuggcuguagagcuuucuuucuuaagcacauaaacagaaugaaaaccacauaaacuacccaccagaguacugcccugaugagauacuaguauucgagucucugaaauggucuuuucagguccacgaggauaugaaucucuccccaccuccaacauuccaucaaacaagcauagaucucugcaccacguguuuucuuaaagaacagcuguaaugcucaaaagagaccaaaaagucuuccugcuauggcucaaagcuccuccuccagcauugcauaccacaaaaugccaagaaacugccaaggauacucucuggcaaaugugggcaagccugucuaucucucuccaggcuguucauucacucaaacauaccuuaacuccucaggcagccagggguuaaucauaaagacuccagggauccuugcuaagccuggcuaucugcaggguuccaaguauccucucaaaaggcaugacccaaagaaucacagagcuuucugccuuaaucccaaagcauguuaucuccccaaauuccucugccaggauggguggggugggguagggucucucgucuagaagcacacacuuaauucuugaugagccuugagaccucucaaacuaccuguaauuuuucugcuaucugguggguugaguaaaaagcgaagugagguggggguaaggguggaugcaauuaaccaaaaugauaaaauaaucuugccgggugugagccuagggacaaggucugaguugucagacuauccccgggaccaugggcgcagcagcagacaggcagacuaacuucguuucagaagauacaaacuugcaaaguugguuguuuuuauuccgcugccuccuccagccucacaaacuucugcucuaaauuccuuuaacuccagaaccaggugcaaaaaggcaggaaagacgcgguggaaggagaggcgcugaagggggacagaggaaucucguuccccucuuaaaggagaauucuaaaaccaagggcgcuccuggaucccuaggaaaggaaguagcugauuccccaaaagcacuuuuuuccuaccuucuuguuguucuuguuauagccaaaagucgaaaucccaggccuggaagucacugauagcagcauuuuuucuuuacuguuacggagcugagagagagaaagaagagagugaaggaaagggagggagaaagagggagggaggaggggagggggaaaggagagggagagaggaagggagggaaagagggagggaagggagaagggagggggaggagaaagaggagaaaaggagcacgcaagagagagagagggaguggggggggggccugcggggaagaaugagcuaggucugcuccuuacgucacugagagaaguuaacccaaagucagaacgagccacuuccacuggguccuaaugcccgggauguucuguuuugguuuugguuuucauaggcuuaguucaagcuagaaagaagaauucuuaggucuaauccuuuucaaauguaacccuguuucuccaugaacaaguucugauuauuaugaaaagacaauuaaccuauuauuaauaaaagacaaugguuuuuguuguuguuuuguuuugauuugaagcuuucuuucccugagaucucagcuacaagauuucaaacuuggccugaaaaaugucuuaguaaguugccaggccuaugcucaguucccagaucuacaugguagaaggagagaaccagcuaccaaaaauuuuucucccccgaccccagcacccaauguggcaugcccacauaugcacauacaaaaagaaauaaaugaaauaguauauauauauauauauauauauauuuaaagacaucaagcuuaguguaaaaggaccaucuugacugccucccagagcauggaaagaagacuauauggcaauaccgugugugagagcucagagcucagacuaguuuauauuagggugauuuuuuuuuuuuuuuuuuuugguuuuugagacaggguuucucuguguagcccuggcaguccuggaacucacuuuguagaccaggcuggccucgaacucagaaauccaccugccucugccucccgaguacugggauuaaaggugugcaccaccacgcccaggcccagcuuauauuagggugaucuugaugcaguaagaaagauuuuggagucuggagagcuggcucagggguuaagagcauggcugcuacuccaggagagcacagcugauucccagcauccacaugaggugacucacagucaccucuauggccacuagcuuccauggauaccagcaugcucacacaugugugcucucucucccucucccacuccccccccccaucauauacacaugcauacguauauacacauacauaaguacacaaaacacacacagagacacacauacacacacaauguuuuauuuuuuauuuuuugagacaggguuucucuguguagcccugaauguucuggaacucacucuguagaccaggcuggccuggauaucugccuaccccugccucccaaaugcugggaucaaaggugugcacccccacugccaagcuaauuuuuuuaacauuaaaaaaaaaguaucuuggagcuggcgagauggcucagugguuaagagugccaacugcuuuuccgaaggucccgaguucaaaucccagcaaccacaugguggcucacaaccauccguaaugaaaucugacgcccucuucuggagugucugaagacagcuacaguguacuuacauauaauaaauaaauaaauaaauaaauaaauaaaucuuuaaaaaaaaaguaucuuaaaauuaauagggcuggugagaugguucaguggguaagagcaccuacugcucuuccaaagguacugaguucaaaucccagcaaccacaugguggcucacaaccacccauaaugagaucugauacccucuucuggugcguuugaagacagcuacagugaacuuauucuaauaaauaaaucuuuuaaaagaaagagaaaaaaguaauuaauuaauuaauuaauuaauaauaauacagagaaacccugucucaaaaaacaaauaauaauaauaagaagaagaaaaagcauggccuagggauggugauacacugcuuaaagcuggaacuccagcauguaugaagaaagaucaccaaaagccugaggccagccaaggccacagagugaccagugaccguaggauccacugcagagcuugagggaaaaggccagccuaggcuauacuuuuuuucacaugauaguucagcagguaaaggugcugaaagaucuggauuaauuccugggacccacgggguacaagggagaagaaccuacuccugaaauuuguccucugaccaccguaugugcuauaguauacacucaccaacacacacacacauacacacacacauuuuaaauguaauaaaagaggacaaaagugaguauguuaaaagcauauacaaauuaaauauacaauggcaauaacuucagagcccuuguuccguucugucuggggugaccguucccagcgcgaaggcaucaucccgagaccaaguccacgcaccucgcaccucggugcuuuugaacaaguggaagcuuuacauuuuguuauuauuuauuuacuuauuuauuuuuggugaucucgggaauucagcaugcuaagcacgcacucucccaagcacuaagccaagccuucagcccaugugagagcuaucuuacuuaacuuuaugauuaauuuaauuacuuguugauguaagauagggucucacucuguagugcucacugacuucaaacuccgcaucucccugucuccuuagugugcuauuacuggacauacaugaacgaucgccccccccccccccccguuuuguuugguugguuuagguuuggcuauguuguuugagugugcuagaggaucaagcagucugccaaagagacacagucccacacuuccagcauauacuucauccucuuuuuuaacaguuaauguguuuaaccguuuaugaguauugugugccacauguguuccuggugguaagagcuaacuacuucacaugucugaaaccuuuuuuaaaaaauuauauuuauuuauuugguuuuuccaagacaggguuucucuguguaggaacacggguaagaagucugaagugggcaucagacucccuaaaacuggagucacagaugcuggugagcuaccgugugggugcuaagaauaaagucuggguccucauagcucuuaaccacuaaaucaacucuccagucuuguuugguacguuuuuuuuuuuuuuucaaacagggucucauguagccccggcuggcuggcuggcuggcauugauuuccaccuaaccaagaaaaaaaaaaaaaacaaacccugaacuccuaaccuucaugcugcucuccugagugauaaguuuccugcaucaucuugcccagcuguuggacuuuuuaaucuauuauuucuuagcccuuaagacccaugaagcuuaaacaaggauaaaaacucaccagguguggaauuuauggccaagccaaaugacguucacagaguccucucugagcugucaaacagacaaaucguaacucuuuaaaaagcauguuucacaaagaaagaagaguauaacuuaaguaucaagaaucucacacagcugcaguaacacucaccuccaauaugcccuccaaggaggaguuggaacaggaaaagaaaacuuacaagugauaccaaagaagccuauccauccaccuagaacagggagggagacugaaugccuucagagccccuccucaggccucccacugcugccacacacauucuccagaaguaaauuaacuccgucuuugucacaacagaccucaagcccagacucucucuaaaacaaagcucugcucucuguuuuuccugcggcugcuuugcugugauaacgaaacagacagugccggcaugcugcagaauaaauacgugcacggcuaccacccccaauuccuaacuuucauuuccaacaggacaggaagug

SEQ ID NO: 5812 - RNA, 372 nt, Mus musculus
uagaggcacucaggaugguccagcguuugacaaacucucguaggcuuuccuacaacacagccucuaacaaaacuaggcugucucgaaccccuggcaacaggauuguuuaccucuacaccaugaagggugggaaagcaccuaaauccgcaugugguguguccccaggcagacugcaagggguucgugcugugagacccaaaguccuucugagauugucuaaccaaagaagcaugucaugacgcagggccuaugaugguuccaugugugccaagugugucugugacgggaucaagcgggcuuuccuuauugaggagcagaaaaucguuguggaaguauugaaggcacaagcacagagucagagagcaaaauaga

SEQ ID NO: 5813 - RNA, 372 nt, Mus musculus
ucuauuuugcucucugacucugugcuugugccuucaauacuuccacaacgauuuucugcuccucaauaaggaaagcccgcuugaucccgucacagacacacuuggcacacauggaaccaucauaggcccugcgucaugacaugcuucuuugguuagacaaucucagaaggacuuugggucucacagcacgaaccccuugcagucugccuggggacacaccacaugcggauuuaggugcuuucccacccuucaugguguagagguaaacaauccuguugccagggguucgagacagccuaguuuuguuagaggcuguguuguaggaaagccuacgagaguuugucaaacgcuggaccauccugagugccucua

SEQ ID NO: 5814 - RNA, 2553 nt, Mus musculus
cacagguggggcaacauuccccuggacgaugcugugcaguucaaccaccuggagguggucaaacugcuucaagauuaccaugacuccuacuugcucucugagacucaagcugaggcggcagcugagacccuguccaaagagaaucuagagagcaugguaugagcacaggcccaggggcagucccugcuucagaaaaagcaugagcuggccacacauuuaacccacagccaccaaaaauacuacggcaagcugcuuccuuggggaucgacacagccauuuggugacacaggccaguguuuucugagaaucaaaacgccccaucaguucagugcacagcacagagaaaagccucaauggauaccugagcagagcuagcuacagagaccuccagauacagcucgagaguagcccgggucuuuacccagguccccuuuuccucucugaagaaaucaucaugccaacaagcaacuuccuuggagagccucuagcuacaugcauauguaucugccgcagaguaagagaaaugggugagagccaaaccacguggcuuuagaagucugcggagaucuguccaucuuagccaggacacgcugcuacugcugacagcaauuuuauagacagaguauuuuguguucaaauaaacuuuaauuacaugaauuauaauuuuuauuuuauauuuugcuaaauuuagucguucucuuucuccccuaaggacaucaucaguuaucaccauuguagcacccagggucagacaaguccaaacugaauauuccgcauacauauucaacuguuucaccagguuuuccucaaaccaaaauacugcuuuuauuaaguacauucuguggccaagggagaugggaguugugggucugaacaggcuccaaaauggauuguguaaaguugucuuuuuucuggagcuuugaacuguggcagauacacagaaggaacuuaucgaggguaacguuucuggcaccagagccauacaugucucccuagugucucuuucccuuugucacauaacuggcacaaugguuauggcaaacugccuagguaucagguauccagaagacagauggacucagaguggagauagcugcaucuggguuggacugacaucucuagugcugagguacaacugaggaagccagaacccaagaaucugaggugcaucagagaaaaggccaagccuguggcugccacuccuccagccagagguagagagcauuuacucuagagaaucuggugagcccccaaaacaaguuacauguggauaagggacgggccgagaggcaggaccgcaggacugaacagucuaaggugugugggcacaaguagaaggacccaaagaacuggccugaggaggcgaauccccugaugaccuaggaaacuggcgacuuuggcuguauaccuagcucuuacagaguagggcccaggggaagauggcuacaauauugcacaaaggaucccaacagaauugugagagcuaccaguugcuugaaacaaaguaaaaucgcuuuagacacuaaggacagaaagcugaccaugagcacgauucagggucuuggccacauuagaggcccuugggcacuucgaguccugaguggguuagcagcucuccaucccaaagagcaaaagcaggugccacugggccccggaaaucugucuguaguguguggaucacagagauccgacucacauccaccaggcucagcuucuuugccucauaguccagcagcagccccaccuucucugguugcccaauacccuuaauuggagcuuuuucguuggccaacaugcugugccacuugcgcugggcauaggagaacacccaggaacgaucaucagcaccaacgcagcugucccgggacauguccacgucugccacuccuauccggaacugcugggagcgcuucacuguuaccucccaguagugucugccacuggugacuguggugucuccgagcaccacugcccacucccggaagcgcuccaaauucagggccaccuugguggguuccagucccaccaagccauauuugacacccgugucgccucugaagagugccaggcugcugugggccguuuuuucuuccaguuugaaacugaugccugagggcagagcaaaaaagaacucguaaaccuagggcuguguuugaucugaaagcuguccaggcgaugacgggaaaucgagaaaagucaaugucaaauguuaacauggaaagagcagaggugccgcuuuaguaagacagcccugggagcugcaaaucacugacuggggaagccagaagccggugccccagguuuggaaucuugcuagaucaaggcagaggggagagaggagaaaugaggaguggaguucucugaucgcgcucugggaaugacacguuaacuacuuuggagugacaguaaaaaagaaauaugccuaccucuccgggauuccacagcagggaccccccaucgcuuggugccccagcgguacaacuuccaacagcgugcaaagggcagcgccaucuugugccacagaugcacggggcacgcccccaggggacaccg

SEQ ID NO: 5815 - RNA, 2553 nt, Mus musculus
cgguguccccugggggcgugccccgugcaucuguggcacaagauggcgcugcccuuugcacgcuguuggaaguuguaccgcuggggcaccaagcgauggggggucccugcuguggaaucccggagagguaggcauauuucuuuuuuacugucacuccaaaguaguuaacgugucauucccagagcgcgaucagagaacuccacuccucauuucuccucucuccccucugccuugaucuagcaagauuccaaaccuggggcaccggcuucuggcuuccccagucagugauuugcagcucccagggcugucuuacuaaagcggcaccucugcucuuuccauguuaacauuugacauugacuuuucucgauuucccgucaucgccuggacagcuuucagaucaaacacagcccuagguuuacgaguucuuuuuugcucugcccucaggcaucaguuucaaacuggaagaaaaaacggcccacagcagccuggcacucuucagaggcgacacgggugucaaauauggcuuggugggacuggaacccaccaagguggcccugaauuuggagcgcuuccgggagugggcaguggugcucggagacaccacagucaccaguggcagacacuacugggagguaacagugaagcgcucccagcaguuccggauaggaguggcagacguggacaugucccgggacagcugcguuggugcugaugaucguuccuggguguucuccuaugcccagcgcaaguggcacagcauguuggccaacgaaaaagcuccaauuaaggguauugggcaaccagagaagguggggcugcugcuggacuaugaggcaaagaagcugagccugguggaugugagucggaucucugugauccacacacuacagacagauuuccggggcccaguggcaccugcuuuugcucuuugggauggagagcugcuaacccacucaggacucgaagugcccaagggccucuaauguggccaagacccugaaucgugcucauggucagcuuucuguccuuagugucuaaagcgauuuuacuuuguuucaagcaacugguagcucucacaauucuguugggauccuuugugcaauauuguagccaucuuccccugggcccuacucuguaagagcuagguauacagccaaagucgccaguuuccuaggucaucaggggauucgccuccucaggccaguucuuuggguccuucuacuugugcccacacaccuuagacuguucaguccugcgguccugccucucggcccgucccuuauccacauguaacuuguuuugggggcucaccagauucucuagaguaaaugcucucuaccucuggcuggaggaguggcagccacaggcuuggccuuuucucugaugcaccucagauucuuggguucuggcuuccucaguuguaccucagcacuagagaugucaguccaacccagaugcagcuaucuccacucugaguccaucugucuucuggauaccugauaccuaggcaguuugccauaaccauugugccaguuaugugacaaagggaaagagacacuagggagacauguauggcucuggugccagaaacguuacccucgauaaguuccuucuguguaucugccacaguucaaagcuccagaaaaaagacaacuuuacacaauccauuuuggagccuguucagacccacaacucccaucucccuuggccacagaauguacuuaauaaaagcaguauuuugguuugaggaaaaccuggugaaacaguugaauauguaugcggaauauucaguuuggacuugucugacccugggugcuacaauggugauaacugaugauguccuuaggggagaaagagaacgacuaaauuuagcaaaauauaaaauaaaaauuauaauucauguaauuaaaguuuauuugaacacaaaauacucugucuauaaaauugcugucagcaguagcagcguguccuggcuaagauggacagaucuccgcagacuucuaaagccacgugguuuggcucucacccauuucucuuacucugcggcagauacauaugcauguagcuagaggcucuccaaggaaguugcuuguuggcaugaugauuucuucagagaggaaaaggggaccuggguaaagacccgggcuacucucgagcuguaucuggaggucucuguagcuagcucugcucagguauccauugaggcuuuucucugugcugugcacugaacugauggggcguuuugauucucagaaaacacuggccugugucaccaaauggcugugucgauccccaaggaagcagcuugccguaguauuuuugguggcuguggguuaaauguguggccagcucaugcuuuuucugaagcagggacugccccugggccugugcucauaccaugcucucuagauucucuuuggacagggucucagcugccgccucagcuugagucucagagagcaaguaggagucaugguaaucuugaagcaguuugaccaccuccaggugguugaacugcacagcaucguccaggggaauguugccccaccugug

SEQ ID NO: 5816 - RNA, 20881 nt, Mus musculus
ccccgcccgcgcaggcgcagacuggucgcucucagccgaguggcgggaaaggcugcgaccccgcaccucagggccucaggcucugcgaggcuucagaggacucgcggagagcgggugaguguguccggaggacccaggaccgacaacgggcgucccugagguggugggacggcggggcggcgagcagcggagcagugagcggcuacuuucccgccgcgcgguugaagggcgggggcggggcucccggcgcgcacgcgcguucugauccugcucccgggcgagcgcgccggagaccugccggguuuucgcgggucucugcacaccccgagcucgggcuagggaagggacggugaggccaggaucuucgaguuccgagaguagaacagaacccuucugcaguccagacccgaagacacaguggccuggaggucgucaggagccaggauucucaggcuuuggggucuucauaggccugguucgauccucuugccuaagaaggacacaaccucuaggggugucagcuaggacaagagccauuaguuaagcuucuuuccuggagugucauuucuuugucuuugaugcugucacuagaaccuuguuuuggaaaacaaaaaucaaaaaaacugaagcccgugguuuuacauuuacuuugaaaccccauuuuggucgcguacgguuuugcuuacccaggugggugucuugcgucccugacauuuuucucauccaguuugacuuccaaccucagggaaaggauguguuugcuucgcguccgcucguaccucaagguacuugaacucccucugcuggagaguucuugucacuuaagugcaguugcccuaaauuccaguaauucaguuuauccagcccuccaagcuaguuaccccacagacaaagccucagcagguuggguugcuuguuaccagccugaggauuugaaugaagucuuaggggcccucaugguggaaggagagaacugaaucccaugaacaggaacacacagaaagaugaaucauaaauaaaaggacagggucucaguccuggcugggcuggaauucucuguguagaccaggcuagcuucagacucacugggggaaaggagcuugcaguaggaguuucagcccuucaugguaacaugauuaaaagcagacccuggcaugguggagcacaccuuuaucacagcaggaggaucuuugugaguuugagaccagccuggucuacauacugauuucuaggacagucaggaguacauggacuaacuuugccccaaaguugggggaaacauaaauaaauaaaagaguuucuguuuaauuuuuuuugugugauggagcaaacacuggauguugaaagcauucuucaacugagacagcucuuucaucuuuuuuuggggggggggggcagcuucuuaggcccaccuuuggaaaagacagguaggaaaggccuuuggucuguuacagaugugugugggcaugcacauauuuauacauacauauacacaccuaagcaugcacacaauacaccaguggucucccuggaaaagcugagugucuuugagcagagucggauugcauguacagaagcuaccucaccagagaccaggucucugagaacggaagcuaccucaccagagaccaggucucugagaacgggccagaagaaaaggcuccuuccaguccugucguucagugaguauugcaccacuuccuugucuuugucagaguuucuauuccugcacaaaacaucaugaccaagaagcaaguuagggaggaaaggguuuauucagcuuacacuuuccacauuacucuagccucugccuuccuaguacuggccacuccccucuuuguguuccugaagcauuguagcuuuguuuauuaucagugccaguaaacaaaguuuaucauacauggcacucagugccaagagaugagagcagagguccuggccuugaggacugguggaagacaugcagguauaacuucugcaguugcacugacaggaauuuuccccagcucuucccucucagugugcucacuggcguguguccugauuccuccccauuuguagcuuuaaccucccucccagacuugucuacuucagucuagggaucagcguuuacuaagcaccuacaugaucccugggaucaaggaguugacauuuuaagugcagcuguccauugaauuguauuagaaucaccugagaaacauguuucucuuaucugucuucccauagugagaguugaaccaaaggccaaccacaccaagcccugacacuauguucuaguucuccuucccugccuuacuuaaagguagagacucccugaguuucccaaacuggucuccauuuugagaacaacaugcccuggacucccaugcugggguuucagauguccuauaccccaccaccaccaaguguaagcagugauggagugggacccaggaauuccugcauccuuggccagccagcugagcuccauccccacgaaccaggaacaucuucagaacacuggccgagccccacucccuggaaaucauuaacugugccccacaaacucgccgucuuaaacaaucugcuuugacuauccuguacacaaaauguaaaugccgugagguaggagaaggggguggcuacugggucaagaagucacaacugucauaugagcagucuucuaagcccacaacuuaaauguagcuugaaaggugaccgugggaagaucauuaagacuauauugugggcacggguggagcuuuuuguucuuaacugagaaagggucuucuguagcccaggcuggccucagucauucugugugguucuucccauagugagaauugaaccaaaggcccaccacaccagagcccugacacuacauucuaguucccugggucccauuccugucacugcuuacacuggguguuagcuguguuccuaguuucuuuuucuucuguacuuaaucuaucuaccuaccuacccauuuauuuauuuuugucauacugggauuaaacccagagccuuaugcaugcuagauaagcauccuacaacugagcuacauccccaacacaaacuuacuuucuuuccuucuuuuuuaagauuuuauuuuuaguuacguguauaugcauguauuugugcaguugccuguggagaugcuugaucuccugugagcugccacgugguggccgggaauugaacccggguccucuggaagaacagccagcgcgcuuuuuuuuuuuuuucauuuuuuauuagguauuuagcucauuuacauuuccaaugcuauaccaaaagucccccauacccaccccucccacuccccuacccacccacucccccuuuuuggcccuggcguuccccuguacuggggcauauaacagccagcgcucuuaacugcagagcugucucucuagccccagcacaaauuuucuugaagagaaaucugagcagaccucuccaugguugccacaguacccucucuuuucaagaggcauaaacugagcaugguuuguuugguaaaggauguucagacaccgucuucugaccucacauacaguugcguucugcagucuuuaacugugugucuccuguauggauuuagugcauucagaaauacauaaggcagugguuagcaaagaaagagaaauguccuggguaggcugacguaagacagcacagguauuggagugagaauagcuuguguggaccucuuaggcgucccaccccugaccugcagguggucagggaaaagcucacgaaggaaugguguguggacugcaucucgaagggcacauagguucggaacuuugggaaauaacagaagcagaagaugucuccaagauggagggaauaaaccgugagggguuucacguguugggacaugaaagcuuaugucccuaagugaagguccuuacagccagagaaagcaagcaguccacggaucugagccaugugguugugcauccacaguauuggcuauguacggaucugagccaugugguucaauagugaguauccacaguauuggcuaucuaggagaggugcagucagaguaaacagguuucaguuaacugaaugaaaagaaaaauaaaaugcucuugcuuccaaacucuaaagcaaaggauggaaagaggaggaugaacucuuaacuuuucuguucccaccauaccccccaccuuccagucugaggcugagccuuucuuguuuccgaugcgguacugcuuaguccaggcauagccggcccucacagaggggcacuaccuuuuguaugcauccuugagaucugaacucgggucuuucagcuucuguggaaaguguucuuaccuacugcgccauuuauuagcuagccuccucuuuguugcugucaaacauuugguagcagagaaagagaagaaacaauucuggcggauaagagcaggcaggagguuauauaagagagccaggcuuccauuccuaaucccuugcagauguuuugaauggagaggcaguguaaaggaaaaaguaggucagagacuauggucaggagccccacagccugacagccacucccucgaacugggggaaaggagcuugcaguaggaguuucagcccuucaugguaacaugauuaaaagcagacccuggcaugguggagcacaccuuuaucacagcaggaggaucuuugugaguuugaggccagccuggucuacauacugauuucuaggacagucaggaguacauggacuaacuuugccccaaaguugggggaaacauaaauaaauaaaagaguuucuguuuaauuuuuuugugugauggagcaaacacuggguguugaaagcauucuucaacugagacagcucuuucaucuuuuuuuuuuuuuggggggggggccagcuucuuaggcccaccuuuggaaaagacagguaggaaaggccuuuggucuguuacggaugugugugggcaugcacauauuuauacauacauauacacaccuaagcaugcacacaauacaccaguggucucccuggaaaagcugagugucuuugagcagagucggauugcauguacagaagcuaccucaccagagaccaggucucugagaacggaagcuaccucaccagagaccaggucucugagaacgggccagaagaaaaggcuccuuccaguccugucguucagugaguauugcaccacuuccuugucuuugucagaguuucuauuccugcacaaaacaucaugaccaagaagcaaguuggggaggaaaggguuuauucagcuuacacuuuccacauugcuguucaucaccaaaggaagucaagauuggaacucacacagggcaggaagcaggagcugaugcagaggccaugaagggauguuacuuacuggcuugcuuccccuggcuugcucagccuucuuucuuuuuuuuuuuuuuuguuuuuuuguuuuuuuguuuuuguuuuugagagagacaggguuucucuguguagcccuggcuguccugaagcucacuuuguagaccaggcuggccuugaacucagaaauccgccugccucugccucccgagugcugggauuaaaggcgugcgucagccuucuuucuuauagaacccacgacugccagcccagggauggcaccacccacaaugggcccccacccccacccccacccuugaucacuaauugagaaaaugccuuacagcuggaucucauggaggcauuuccucaagggaggauccuuucucugugauaacuccagcugugucaaguugacacacacaacuagccaggacacuccucaaauugcuugcugggcuuugcggcuccggaguagguuggcaguggggguggcggugggguaguaggauagcaggcaaugugaaguagaccaguuauguaaguaaaacuugagugcagggagauagcaucaaccggugcaucugggcuuuuggaggcuuauuauccauuucccaugggguggagucagggcuuaaagccaggaaccacagccaggaaaggucuuuuuagaggacgcaggaugaggugcaggggaagaugcccaggggacaggauugaugcauauuccugaucuuccacaggaguggguaaagaugcaguguguguguguguguguguguguguguguguguguaugugugugugcgcgcgcacguccgcgcaugguauucaugucagguuccagucacucaggauucuggguuugugccuuugugccaccugcugagaacgcagggaucuggauaauuggggaagugcuccauaagaggaaacugccgcuucuggggcagaggcagggaguuuauuucucccgcuugcugccuuuacuucguguucugucagagcugacuuaccacugacauuacuggaucacagggagagcuuccuuuacaaaugucagugccucagaagccugggagauccuagggggugucaaguccugcacagcggcaccgucugaggaggcagucauuugaugaaaguacaagcagugaccuggguucaagccccagcacucauagaacaaccaggcuugugguuuguggcuguaauuccauugcugaggaggcagagacaggaagauuccuagggcucacugaucagcaagucccacaccccagucccagugagagcuauuguuuuguuggguuuuuuguuuuucucaaagauuucuuucuuuuuuuuuuucuuuuuaagauuuauuuacuuauuuuauuucuaugaguacacuguguagcuguacagaugguugugaaccuucaucugguuguugagaacugaauuuacaguuuaaauucugcucgcucaauccugcucacuccugcccaaagauuuauuuauuauuauaaauaaguacacuguagcugucuucagacacaccagaagagggcauuggaucccauuacagaugguugugagccaccaugugguugcugggauucaaacucagggccuuuggaagaacagucagugcuuuuaaccacugagccaucucuccagccccugagagcuauuguuuuaaaaugaggugggggugucugaggaaugauaucagauugaccucuggccuucacacacacacacacacacacacacagagggagagggagggagaggagagagacaagcacacauuuauaccucuggacccccagcucuuacauuuauaaaucuuucggagggaguggaacauuugcagucaggacaacuugcggggguugguucucuacuucuaccaaguggguucugugguacucagguuaucagccucaauggcaagcuuccuuccuuaccauugagcuaucucgccagcccaaagcugugacuccuaacuccugugguauauccagacuagggcuguaugaggaagcuguagaagauggaggauucagucuaacccucccaaggcugcagaguguccaaggugaacaucucagcauugaucuggcuuccuaccggguugucuuaacucugaaccauguuucucugguuucaggaucuggcuguaguguggcccaggccuuaauuccuaaacuggaguuucucugcuuucuagucaacuagaaagcagccuuaacaaaaagcuuucccuggggcuagcagauguagcucggguagagcacgugcccacugugcacaggagccucccuggguuugauuaguuuauauauuaaaaaaaaaaauguuuuccccggccugggagcagcacuuuuagcucagacagaagcgaagccauuaaggguccugagugcaagcccagcuuguucauuuuccuuaccacggacaucccucuuccuagucccguaggccucacccucuccguccaccaucucuacugcccgcucugcugguugggccucugguguauggacuuguacaugaugaacugugaacuucuagccacguguagcgcccuuggguacuuggaaggagggacuuaccacaaggagccggauugccugggugaguaaucuuuugaggaaucggaaggaaaaaaaaaacuucaccaaauuggucuggugaguuucccuggccguggguacaaacaacucauggggcuaggcagcuccuucuggguaaguguuuuauccuguccucuaaagagagugugaaggauuugauccgauaccugaggcacgaggaugagacccgagaugugcggcagcagcugggagcugcacagauccugcagagcgaccuccugccaauccucacgcagcaucgccaggacaagccucucuucgaugccgugaucagguucacuccucagccuuucgacucuuaucucgggcggcguccgaguugucaaggaaaccugaccacucugucuucguugucuccccaggcugaugguaaauuugacacagccagccuugcucuguuuuggcagcgugccuaaggacuccaguguacggcaccauuuucugcagguucuaacguaccugcaagccuacaaagaggugagaagccuuucugcagagguccuggguugguguuuggagaggaaggaaagacaagguaggcgcuaccuacgagacuguucccugucccacaggccuuugccagugagaaggcauuuggaguccucagcgagaccuuguaugaauugcuacagcuggugagugagucugcaucacacacaucccaugugccaguuaguacuucaccuccgcuaccucugcugaaccugggaagguccucagcccuuagagauacagguucuguguagccaaggcuguccuggaacucacucuguagaccaggcuggccucaaacucagaaauccgccugccucugccucccaggugcugggauuaaaaacucgagccacuaccgccuggcuucuagccacucuuauuuugcuggacuggaacuaagaggugguccugucccaucccccccuuggccuccccccgccccccaccucccgagagcugggauuaaagaacugugccaccaugccugcucuuuauuucuaguuuguauuuuuagaaauuuaucuaaugggguauguguguguguguguguucaugugcacauagaagccauaaacaaugacagauguuuuucuggauguuuccuggauuauugagugugugcuggggucugaacuccuagucaucacgauugcguugagagcauuguuaaaccacuaagccaucucuccauaccuuuuccuucuuuuuagucccaauucucagggcucagucuuagagccagucuuuucuccuuuugcccagggcugggaggaucggcaagaagaagacaacuugcugaucgagcggauccuucugcuggucagaaauauucuccaugucccggccaaccuugagcaggagaaggugaagaggguuuggggaacaucggaguucuugcacugguuagggugaacuccccucucuuaggcuuuucugucuucuacgagucugggggcuagccuuagccacagagugagcugcuggggacucuggaggcuguccugaguggagcugaguguguguguuuguauuguugucauguccccccacccccaccccccaccugcucagaguaucgaugaugaugccagcauccacgaccgucuccuuugggcaauucaccucaguggcauggacgacuugcuccucuuccuguccagcucauccgccgagcagcaguggagccuccaugugcuggagaucaucucccucauguuccgagaccagguggggccuuacuuauacuaguccucuacuccccgccaugugcuuccgccguguggcccgaggagcccugguggggaugggggauuacccgaggaaggugaugcgugcccuggcuguguucuauccaaggcccaugaauagcucucaguguuuguguuuucccuuccgaguaggagcgaacuuguccugggggcuggagagauggcucagcaguuaagagcacugacugcucuuccuaagguccugaguucaaaucccacaacuacauggugguucauaaccaucugaaaugagaucugacacccucuucuagugugucugaagacagcaacaguguaguuaccuauauaaauaaaucuuugggcugaagcaagccgggcuggagcgagcagagguccugaguucaauucccagcaacuauaugauggcucacaaccaucuauacagcuacagugugcucauauacauaaaauaaauaauucuuuaaaaaaaaagaaaagaagagaaaagaaaagaaaagaaaaaagauuacuguccuagcugacacuucccucuuuauuccaaaccuagaccccugagcagcuagcgggaguagggcagggacgcuuggcucaggagcgaagcacggauguggcagaauuggaggugcugcgccaacgggagauggcggagaagagagcucgggcccuccagcgaggaaacagguggguggcaggcugcuccacugugaucugacccaaagcagcaaacaccgaacauucggaccaguccgaggcuggguuauauuuuaaagcuaacucuugaagagcugcugaugaaagagaauggccuaauacuuggagagaauugaggagucauuuuggaaucccuucuuuuuuccuuuacuugaaggcacucucgauuugggggcuccuacauuguccagggguugaaaucuauuggggagaaggaugucgucuuucacaaaggccuucacaaugugaguaugcaccugugugugacaggaacuuuggagucacagggccuaagagggguggcccucucuguuaaagcugcaguguuucuuuuuuuaaaagauuuauuuauuuauuauauguaaguacacuguagcugucuucagacacaccagaagagggcgucagaucucauuaccggugguugugagucaccaugugguugcugggauuugaacucugaaccuucagaagagcagucagugcucuuacccacugagccaucucaccagcccaacugcuguguuucugacuuagaacgugcaugagagagaacacauguauugaccacaccaugcccacugauggccucgccgccaccagagacaaauguccuccuaggugucuuuuucaagaaaauucuggaacaguggcuacagaaugaacuguaaggcuugaugguagccaggacuuucucuaacgccucaguccauacucucagcuccagaacuacagcucagaucugggaaagcagcccaggagggugcccaagcgucgucaggcugcccaggagcugucuguccaucgccgcucuguccugaaugugagacucuuccucagagacuucugcucugaguuccuggagaacugcuacaacccgcucaugggcgcggucaaggugagaacccaggaaguuaggguuagagcagagagaugcuagccagagcgaugauguggccagugaagggcagcuugccaaggagccaagggaaagcugaccucggaguggggccccagacagaauggagauucuaagggguggguggauuauuauuagcaagacuaaauauaaaaggucugggugggacaaaggagauaguuuggcaguugagaacacuuccuccaaaaaaguuugauucccgugccccaagucaguuugcucaaagcccuguaauuauagcuucagaucugauucccugcucaggccuccagggacauccacacccaugugugcaaacccacacagagacuuauacguuaaauaaaaauaaagagaaucuuuuuuuuuuuuuuuuaaauaagaaaggcucuggagcugggugugguggugcacaccuuuaaucccagcacucgggaggcagaggcgggcagauuucugaguucgaggccagccuggucuacaaagugaguuccaggacagccagggcuacacagagaaacccugucucgaacaaaccaaaaaaaagaagaaaggcucuggaacaguuugaggaggcugggaacugcuuuaaaguccaggguccaagcccucaucacaggcaugaaagaccggcaggggguuagccgcccugaggccacgguggucucuccugucaggaucaucugcuucgggagagagcgcagcagcaugacgagacuuacuacaugugggcaauggcuuucuucauggccuucaaccgagcugccaccuuccgccccggccuuguuucugagacccucaguauccguaccuuucacuuuguggagcagaaccucaccaacuacuacgagaugaugcugacagaccgcaaggaggccgccuccugggcgcgcaggugagaggggcggccgcugggggucacaggguaccuuggccgugucugaaucccagaaucuuggguagcauuuuccuuguucaagguuauguuugacagagccuucaguugccucccuuccaucucacccuuugccguccacuuuggcaggaugcaccuggcccugaaggccuaccaggagcugcuggccacggugaacgagauggacaugugcccagaugaggcuguuagggagagcagucguaucaucaaaagugaggcccccauccgcgcucugaccccgccuucccguuuccugccuaggaucucauucuuccagguccaucucuccuuuuccaaacccucuuguuccuuccuuguucccacccccagacaacauuuucuauaugauggaguaccgagaacuauuccuggcgcucuuucgaaaguuugaugagagauaccauccacgcucauuccuucgagaccugguggaaaccacccaccucuuccucaaaauguuggagcgcuuuugccggagccgcgggaaccugauggugcagguacagggcagccccaaggugugggaacagcuauaagggagggugaaggacagaggcuuguggcauugccaguguggaacugcccaucggguuuacuuucgucuaucuuaaaagggaagguggaaggcgugccaacucugccauguguucauacguguacacacacacacacgcacacagccucgcaaacaaugcagauacacacacucacacauacuauagacacacacacaaaguaaguaggucaggcuaguccuguaucaauuacuauuaaaauacacucaagcaacccaucuccaggucacuagacugagauuguguucaaaacuuggaaguagauggaaagccaacaacaaaagccaaaggaagaacuccaaggaauuucuaucuuagggauacagauucugcuuugcaaaaccauguuuguuuuugauacaggaccagcaagauaucucaguagguaaaggcauuuacuucugagccuagcgacuggaguuagagcccuagggcucacuuaauggaaggagaaaaccaauuccccaaguuguucucuaucugucucugccugccugccugucugucugucugucugucucucucucucucuuucacucucucucucacacgcacacacacacaaaguaauaaauaaguuuuuuuguuuugauuuuuaaugccaggaccuuccuauauuuaagggugcuauaguuuaaaauugugucagaacugaggcagagauuuggcucagugguuaaaagcacuuacucuuagcugggcaugauagagcaagacuuuaauccuagcacucagaaggcagagagcaggaggaucucuugaguuugagggcagccuggucuacuuagugaguuucaggauaaccaaggcuacaugucucagccccuccuaccccagaaaaggcaaacaggauggacagauggaugaggaauucaaggaugauguuugacucaaggacuucauaaucagauacaucaaaggcgaacucuuacuccaggaaauacacauuuucuguuuaucugcaucagagcucuuacccacuguaauggcaucuuccccugacuugccugucucuccugagggcaaggaaauauacagugcccauugcugcugcccguccuccucugccuccucuccaccccacggcugcuccccguccuccuuugccuacacugcacuaacacugcuggacagagaccuugugacucugcagacucuaccauacagugcucuccccacagaacaaaagaaaaaagaggaaaaagaaaaagaagguucaggaccaggguguugcuuucucacaaagccccggggagcuggaggccauguggccagcccuggcagagcagcugcugcagugugcccagguaggugguuagaaaacucugccccuuuuaggacaguauucuuguagacagucuggguuuccucucacccugcucccauggcuaugucugucuguaggacccugagcucaguguggaccccgucguucccuuugaugcggccucagaggugccaguggaggagcagcggguagaagccauggugaggauccaagacugccuuacggcuggccaggccccgcaagcccuggcccuccugcggucugcccgguaagaauccuguguacugacacccuccugggcacugagggaauagggaggccuucgcugggguccgggguccucagaguucugagagaggagucuuaacugaggcuguggaucuccgcaagcaacacucuuugucagcucuaucacugguuggaguauuuuguuuuugagaauugucaaaaaacacagucaacuaaagaacaauucuaccaaccaaccaaccaaccaaccaaccaaccaaccaacguuaaccauguggaugaauggccuuccagugucuguacuauguaaagauaccuugugucugccuacagacacacuugaggguuguuuuuacuucuguguauagaugcaggucagacuugcuuucuguguacaagcauuuugccugaauauauguuuguacauguaccacacgcgcuccuguuugccugugggggccagaagaggacguuagaucccuuggaacugggguuccaggcaguugugagcugccauguggguggugagguugagcucaggucuucugcaagagcagugugccuugugaggaaaaacauucccuagcuuguuucaucucugaaguagcgguuuauaccccucuuucaguugacaaaggaacuaauuuugccuucuaguccugauugcaacuccaguuuccugugauuaaagccuuuuccgucugucuccagggaaguguggccugaaggaaaugcguuuggcucuccagucauuuccccaggggaagaaaugcaguugcugaaacaaauccucuccacgccccuuccccgugagucuccacccuuucccgucugucucuucccagcugugcucuacaccagcacagcagaaacccagcaacagacacucuuuguacagggcagcaggagccagaagaaggagaugcagaggaggaagaggaagaggaggaggaagaggaguuacaggugguccaggugucagagaaggaguuuaacuuucuggaauaccugaaacgguacauacgggcugagagggcugacuaccuccaccaccaccaccacccaacccccaccccgugagggugagcagucucuguccagugcugaauaauuucccucuguccuucgaugcagcuucgcauccucaaccaucgugcgggccuacgugcuucuccugcggagcuacaggcagaacagugcucacaccaaccacugcaucgccaagaugcugcaccggcuggcccauggccuggggauggaagcccugcuuuuccagcugucccuguucugccucuucaaucggcugcuuagugacccagcugcugcggccuacaaaguaagggaggggcugccugccaggggggugcacggugggggucaggggcugccuggggggugcacggugagcugugagugguucuuucucuuucuuuuuaaagauuuacuucuuuauuuuauguauaugaguacacuguagccgaacagaugguugugagccuucaugugguugucgggaacugaauuuuaggaccucugcucucuccggucaauccugcucacucacuccggcccaaagguuuuauuauuauacauaaguacaccgucgccgucuucagacgugccagaagaggacgucagaucucauuacagaugguugugagccaccaugugguugcugggauuugaacuaaggaccuccggaagagcagucgggugcucuuaaccucugcagcccaugugggugagauagaaaggcuaaagcagggcagagacauggacgcaguggagaggucagcaggcagguugaggaagacgcauggaggccagaagagauauagugagcaaggcagaggcaagcugcgaaugggcaggucugaauucauuugcgcuggggcgccauguagcguuucuuuccuacaggagcuagugacuuuugccaaauacaucauuggcaaguucuuugcguuggcugccgugaaccagaaagcguuuguggagcugcuguucuggaagaacaccgcagugguucgggaaaugacccagggauauggcucccucgacaguggguaagcucagggcuggggacggaaugggaggcgaggaagaccgugcgguguggucacggggucacuugcagaacauucgaccuaagguuucuuuuuccuucugagacaagggcguagucucaugaggugagacgcuuuuccugagguuacccagaacagaaacaagacugggcaaagucuuccucuaccuuaaguuuccuucccugucagcagccuucacagagguugccccugaugacagcggaccaggccccacaguuucugugggcuuucuuaaaaugugcaucuguggucccagcacuuaggggacaggcaguaaggucagagcuaaagguccacuggacuaccagcaaauagaaggccacccugaguuacacgagaccuuuguaaaauaagauaggcuucacauugguguuuguccuccucugguugguguccuuccucucucucucucucucucucucucucucucucucucucucucucucucucucucgcucucucucucccccucucccccucccccucucuccuucugcauuuucccucuggccuccucucucucucauacacuagcaucuuuccuauagucuccccuuaccacccucuaugcucuuuuucuuuuuuuugcuuaguccuuggagucagguucuguaggccaagaucaaaaauguccugguuugggcucuggaguucuucuguggagaauaaagcaagaggccuuuuuuaggucucugcugaguugccugcuccacccucggucuggugugacagagagagcuucgcuugucucuguaagccaguggccuccucacaccuguuccucuuucaccauucaggucuuccagccacagagcuccucuguggagcccugaggaagaggcccagcuucaggaacuauaccucgcccacaaggauguggaaggugugugguuuaagaucucaggagacuuugaggggggcagucugggccccagacuccuccuuacugccccauucccucuccaccacaggucaagauguaguggaaaccauauuggcgcaccugaaagucguuccucgaacacgcaagcaggucauccaccaccugguccggaugggccuggccgacagcgucaaggaguuccagaagagguaaaggcaugggcucugagggagcugggguacagacaccuugguuugccccagaccuccccuggcacugaccccuggcugaauaggaaagggacccagauugucuuguggacggaggaccaggagcuggaguuacagcggcucuuugaggaguuccgggacucugauggugagugaggucucagacucagccgaggugagagccaggcugcccucgcuccacgccucacuucccgccuucuguucacuugcuacauuugggucacucggggugagcugaguuagccucugguuuccauuauuccuuccaaacacacucucuucagauguucuuggucaaaucaugaagaauaucacagccaaacguucacgggcucgaguaguggacaaacuguuggcccugggguuggugucugagcggaggcagcuauacaagaaacggagaaagaagcuggcgccuucuugcaugguaaccaucuugucuuggcucuuccagccuaggccucaccccacaaagcacuguaggacuccuccugccucaggcuguucagaccgggcccuuccauggguguacagaaaccagaagcccacuaaggccccccugaggccauuuucucauccgugugucuguaaugaauuccagcagaauggagaaaaguccccgagagaccccuggcaggaagauccggaagaggaagacgaacacuugccagaggacgaaagugaagaugaggagagugaggaaggcuugccaucaggacagggucagggcagcucaucucucucugcugaaaaccucggugagagccuucgucaggaagguaaggacuugaguugggagagaugucaaagguggagggguagcaagggaaggagaucacguacaaguuuccccucugcccaggccucucugcuccccuccuguggcuccagagcucccugauccgagcagcaaaugaccgagaagaggaugguaagcacuggacacuggguggccugggccuggugugauccagagcaguuccucugccacauugucaccgugucugcaggcugcucccaggcaaucccucuggugccucugacagaggaaaaugaggaagcaauggagaacgaacaguuucagcaucugcuacgcaagcuagggauccggccgcccagcucagggcaggugagugucagagcgagcgagcgggaccgugucagcccuggagcucgcucugguccuccucagaggacaccguguuguugcccagauccucccugcugccuugccuuugccucccaagguucccaagucaggucucuuacucaagucucucuccccuuuagccuccccuucccuaaaugguguucuacacugcccccuugucugucugcagcacugaugguucugugugccgcagccuccuggaggcaugucugucuuugcguggccauccagccacaucugcuuuacaccacagccaaccccgacugcuuuccacccugcacauggcaggucuguucaugcaugaccaguugaucugcccaguccuauuggaaggcugcagccacacauccaagguccacacacacagacaugugcacacccccacauaccuucuuccucuugacccucaaccagccuucaagggucagcucagaacuugcacagagaggcaaucuuacugccugucugacccaggaagugggaauaguugcucgggcgcccaguccaguggcgcuuuaacaucuugcccggccgcuccccucgcgcccccauugacucugaguguggaucucacaggcuaacuuuuuacauggcccagauccuucccuguauucauugcuaauagcuguauucacagugaaugugaccugguguagcacugagcuaggugcuggguguaaguccaauucacaacuccugugggucauuccugguugggggggggggucaugcuuacucaaugacugauagagcagaagaguggccagaaaggccgguccucccuggcagcgaucucaccugcuguguaccuguaggaaaccuucuggagaauuccagccaaacugagcuccacccagcuucggaggguggcugcuucuuugagucagcaagaaaacgaggaggaaagggaagaggagccagagccaggaguccccggagagcagggucccagugaggagcaccggacagaagcccugagagcccuucugucagcccguaagaggaaagcaggccuggggccuacagaagguaaagugccauggcccccgcuuggugacuuacucugugccaccguguggcgugagggcuguugagacgaugcagggccgguucccgacugugucuuacaucacugcagaggaggccacuggggaggaagaauggaacucagcgcccaagaagcggcaacugcuggacagcgacgaagaggaagaugaugaggggaggaggcaagguagggacucuugucuucaguggagacacuggccauuugccuuauccuuuuacauacuuagaugcuuuccauuucugucucuuaccugucauucccauggcagcagugucgggaacgccaagaguccacaggaagaaacgguuucagauugaggaugaggaugacugaaagccagauguguuugaccgaugugaguuggaggcacaaaagcuacuuuugccugcguuggaagcaaucuucucuacauugacagcccaggaauuuuaggcagcaguguuggguggagucuuugcggucaguccuugccccagguucaucagcgugcacagccggucucuggguccgucucguagcaaaugaagaguggcgaaagguucaagguggcuuguccuccucuaaggacugcgucuuggcuucugacggggagcuuuauaacccagcacgguuguucauucuguccucacaaagcacuggauugcucccauuuucuuucuuucaucccaggacacaugauugaacccguuucuacaguugagggagagcugggaugcaccacucucaagcugacaagcaucccugauuuguguuucauauuaaauguguacaauuaacaguugcucaucucagagcggccagccagccaucuguugugucuucggaagaacuuuuaagaguaaaauuaaaagacauguccugaacugagcuugguagugugagcuaaucccaucgugugggagacagaggcaagagaauugccaugagggagaggaaagagucauauagcccuacgcgugggccaauaaauguaauuuaaaaaaucagcuugauaauaaauauaauuuuuaaaaaaagag

SEQ ID NO: 5817 - RNA, 2616 nt, Mus musculus
agagguucuuagccagcauucucacccggggaaugcccuuacuuacuauuucuuacugccccucugaggcuucucagaucacagaaggugaucuaagaagguggcuucuaucaccuucaaaaccagggccgccuggugaaaagaacauggaaagaaggaaaugccuuggucuuacauagaaggcaugacacgggaaccagacuucgaaucugaggucaccaugggauuuggagaugaaugagugcuguuuugguuuucccucgggcaagaggaagugaggaaaucggacugggguuggguaagaauaaagccuugagaagcaaaaaaaaaaaaaaaaaaaaaaaaaaaaaaaaaacaauaucaggcagauuacacaggaaggaacuggagauauucauuuaaauguccauuacuucccugccccuucugcagucuucuguguuccuggagagcaugacacaugugucccgaccuaggccucuagccacaacaaccucaccacucauuuccccuggaacugaagcggcauaccugggcucuccaaagagggagaugauguagggaggggaaucccaccugcucugagucaccugcuagugugaagggcgggccuuacagugcagggaccuuaaaaagagacugggagacaaaaggaagaaaucaggaagccgcuuagaagucggacuacagaguuagacucagaaccaaaggagguggauaggggguccacaggccuggugcagaucacagagccagccagaucugagaagcagggaacaagaugcuggauugcagagcaguaauaaugcuauggcuguugcccugggucacucagggccuggcugugccuaggaguagcaguccugacugggcucagugccagcagcucucucggaaucucugcaugcuagccuggaacgcacaugcaccagcgggacauaugguaagugucagcuccugggaccgcgcagaaaaccuucccaguccuccaaguguguagguuuaauggaagcuguggccccggguggaucuggaggguuggaagccaucguggaaugagauaggacagaagacuggggcuucuggaagaguugugggccggcgguugagcggaaugcaaagcggucaccucgccucacuguucccacucccuccauuacagaaucuacuaagagaagaagaggaugaagagacuaaaaauaaugugccccguauccagugugaagaugguugugacccacaaggacucaaggacaacagccagguaccacuaagccgauguugaugugucuaggagagggaggugagaggaagcugagcguccauggccauuuagcuuugucugagaugacgaggagccauaguuggcuugaagccagccugagcugugggugguaaguuuaaggccaaagccuaagguagugaaaugcugucuaaagaaagaaaaaggaaaaacaguggaaggaagaaaggcaggcaggcacuaggaaagaggaucuaucugucuugauuguuuucuucuuucccaguucugcuugcaaaggauccgccaaggucuggcuuuuuauaagcaccugcuugacucugacaucuucaaaggggagccugcucuacucccugauagccccauggagcaacuucacaccucccuacuaggacucagccaacuccuccagguaugaacuagggaucuggaagauagggcuagccaguguuugaaaaagaagcucggagcuuaguaucuggaguccuuucugacuguguccugugucuuucagccagaggaucacccccgggagacccaacagaugcccagccugaguucuagucagcaguggcagcgcccccuucuccguuccaagauccuucgaagccuccaggccuuuuuggccauagcugcccgggucuuugcccacggagcagcaacucugacugagcccuuagugccaacagcuuaaggaugcccagguucccauggcuaccaugauaagacuaaucuaucagcccagacaucuaccaguuaauuaacccauuaggacuugugcuguucuuguuuuguuuguuuugcgugaagggcaaggacaccauuauuaaagagaaaagaaacaaaccccagagcaggcagcuggcuagagaaaggagcuggagaagaagaauaaagucucgagcccuuggccuuggaagcgggcaagcagcugcguggccugaggggaagggggcgguggcaucgagaaacugugagaaaacccagagcaucagaaaaagugagcccaggcuuuggccauuaucuguaagaaaaacaagaaaaggggaacauuauacuuuccuggguggcucagggaaaugugcagaugcacaguacuccagacagcagcucuguaccugccugcucugucccucaguucuaacagaaucuagucacuaagaacuaacaggacuaccaauacgaacugacaaauacuaccacuaugaccugugacaaagcugcauauuuauuaagugggaagggaacuuuugauauuauuuauccuuguaacaguauagaugaugguuauuuauucuauuuauaaggaauuauguauuuuuuuuuucaauaaagauuuauuuauguggcuc

SEQ ID NO: 5818 - RNA, 1744 nt, Mus musculus
acacuuaaauuuauuuauuauguaugugugccacaguaugaaugugaagacaaccacauugagucucagggauggaacucagacccugacaguugguagcaguauccuuaccugcuguaccaucuugaaauccucuuucaccuuuuugaaaagaaauacauuuuuauuuggaugagggggguguuuugagacagggucucacugucuaaccuuggucggccuagaauucacuacguagaccaagcuguccucaaauucacagaaauccauucugccuccugaguggugggauugccaucccacuuagccugguuuuuguuuguuugaaacagggucucauguaaccugacuagccugggacuugcuauauagaagaagcuaaccuugaacacuaauccuccugccucaggauuacugccauuacaaauauaccuccacuaugccuggcccaauaaaugcuuuaaaaguuuuauuauugguguuuauuauuggugagaacuuucuuccacaggcaccuguugaaagggauauucaccauguagccauagcaagccugguccuuacuaucuauguagccuaggcuggccucgaauuuguaagggauuccugccucugcuuuaauaaugcagguauuguagguauggaccacuaguggcacagggccuuuaaaaacagagaugacagagcugaguuugggcaaccuaagacaucucacagccuggaccaauuccaaagcaguuuaguacacagccaguacccccaaauauuuuagacacggugacacacucucacaggagagggagaggcaguaggaucucuuaguuggagauuaaucaagaaccccucagaauagcuacagcucaguugacucaguuuacuguuuaucucucucuuggggucaauguccagcuccacggucuaggggaauuuugacagucuaggagacuuguuucuugggaaaauuaggggaccucuggggacgacacaaacauugaugggaauuucagauggaugccucuagaaauagagaaaagguggccacuugggccacacuagaagucaggcucccgcuuccuuuuucuuccccacaucuagaagucauaggaaaugccagugaguuucggggguacagggucagagguauuggaauggcucacaggcacagcaagaugaaggucuauacgccgggaaugaugaaggccacgcugggaauacccaccgggcgagucccagugcuuagccucuggcgccccuuuagucuaguucuuauucagggagcguaaaagcuuggcuucaaagucuaaaguuaauuuugcuuaacaaagccugagagcgaagggauuacuuuucguaacaccaaauagauccgcgccugauucaguuuguccccgguggcauuccguaaccuuguuuuggcggaggcuacgucacucuccuucucaggcgcugccuguaccuggcuuuuucugauuggcugggaugagcccguggcccccgcugauuggaagcgauggcugccaauccaccguccgucuugcuuggguuagguugagcuagaggcgggggaguaguagggaaacuggaauuucccgcggagcugacggcgcuuucucuacccccuacucguuugaauuccacgcgcuccaaaauauccgccauggagaaaucuugguaaugacccauuccccguaagcaucccaggaacacgucuugaccuuugcccuaauccuuccccucccguccc

SEQ ID NO: 5819 - RNA, 1744 nt, Mus musculus
gggacgggaggggaaggauuagggcaaaggucaagacguguuccugggaugcuuacggggaaugggucauuaccaagauuucuccauggcggauauuuuggagcgcguggaauucaaacgaguaggggguagagaaagcgccgucagcuccgcgggaaauuccaguuucccuacuacucccccgccucuagcucaaccuaacccaagcaagacggacgguggauuggcagccaucgcuuccaaucagcgggggccacgggcucaucccagccaaucagaaaaagccagguacaggcagcgccugagaaggagagugacguagccuccgccaaaacaagguuacggaaugccaccggggacaaacugaaucaggcgcggaucuauuugguguuacgaaaaguaaucccuucgcucucaggcuuuguuaagcaaaauuaacuuuagacuuugaagccaagcuuuuacgcucccugaauaagaacuagacuaaaggggcgccagaggcuaagcacugggacucgcccgguggguauucccagcguggccuucaucauucccggcguauagaccuucaucuugcugugccugugagccauuccaauaccucugacccuguacccccgaaacucacuggcauuuccuaugacuucuagauguggggaagaaaaaggaagcgggagccugacuucuaguguggcccaaguggccaccuuuucucuauuucuagaggcauccaucugaaauucccaucaauguuugugucguccccagagguccccuaauuuucccaagaaacaagucuccuagacugucaaaauuccccuagaccguggagcuggacauugaccccaagagagagauaaacaguaaacugagucaacugagcuguagcuauucugagggguucuugauuaaucuccaacuaagagauccuacugccucucccucuccugugagagugugucaccgugucuaaaauauuuggggguacuggcuguguacuaaacugcuuuggaauugguccaggcugugagaugucuuagguugcccaaacucagcucugucaucucuguuuuuaaaggcccugugccacuagugguccauaccuacaauaccugcauuauuaaagcagaggcaggaaucccuuacaaauucgaggccagccuaggcuacauagauaguaaggaccaggcuugcuauggcuacauggugaauaucccuuucaacaggugccuguggaagaaaguucucaccaauaauaaacaccaauaauaaaacuuuuaaagcauuuauugggccaggcauaguggagguauauuuguaauggcaguaauccugaggcaggaggauuaguguucaagguuagcuucuucuauauagcaagucccaggcuagucagguuacaugagacccuguuucaaacaaacaaaaaccaggcuaagugggauggcaaucccaccacucaggaggcagaauggauuucugugaauuugaggacagcuuggucuacguagugaauucuaggccgaccaagguuagacagugagacccugucucaaaacaccccccucauccaaauaaaaauguauuucuuuucaaaaaggugaaagaggauuucaagaugguacagcagguaaggauacugcuaccaacugucagggucugaguuccaucccugagacucaaugugguugucuucacauucauacuguggcacacauacauaauaaauaaauuuaagugu

SEQ ID NO: 5820 - RNA, 2217 nt, Mus musculus
cagucauucuacuuggccccuuaagacagggucucucuguguagaucaggcuguccugaacucugcagaucaggcuggccuugaacucagagauccacaugccucugccucuugugugcugcuacuaaagguacgugccaccacacccagcuaagacuugcaugugugcucuguguugggauauacacaccaaugcaggucccugcagaguccagaagagggcaugagauccacugacaccucccacuguaggugacggcaacugaacucggguucucuacaaaaugcucugaauacugagccauuuucucaguccccaugcuuuuuguuuugauuuacguuuuauuguacaggagacugauuugguguacagcgccuggcaccuuaugagcaaucacucugucaucuggcugcagcccuggcuuguacuguuuuucuuucuuaagaccuggcaucacuauggugcccagccaggacuugaauucaccauuuuucuguuucaaccucucaaguagcugggaucacaggccugggaucuuuacugucuucugugguccuuaggcccauucuaagcaaaccuaggugaaagcacgguagucugguggacgguuacuuccuucuccaacagaaagguagaugggguuacccuugcugagcugugucucugcucaugggccuguccuacccagugcugcaccuguuauacccaguacugcgcccaucauaccugacugggagaugauagcaaggcgggaaguguauguggggaugaaucguaagaaggccggauccacgugcacuugaagaggugugauggcacgcaucaugcgcagaucguacacuuugaggaaacggucacaggccaggccgguaaggcgacuggagaagccgcaggcagccagcagguugccaugaacaucaaaaucugacagacucccugagaaggcaucaaauucaugcuccacuuuaaaacuacggaggucucgcagggaaaccugaagaagaaaagaccuguuaucugccaccucugugccagggaagagacccugccaccuacuuaacccugaaagagccuugacagagaagaccaagguucuaggguacugucagagcaaagaaaggcagagagagaagccaagaguuaaaaagggacaacccaaagaauuccuuuauccuuuugccuccaaggcacccagcuguagaaaacaccaggauccaagaugaucucaacacagaaagcaggacauggcuuaacuccucacagcccucaucuuuucauccacagggaaagcagacccuaguaucuucugaaacaggccuaugguggggagagacaugggaucugguuaccuugccagauguguggccacagaagaagaaacgauuugucugucucaugauggugacuccgggugucucgacugcauacuggagagagaagccaaugagaugauuucccaugaccaagaaacagggaagucauauccacaucucgacacacgacggcccaagcacagccccaccaugacuucaggucccacaagggucuuuccuggacacgaccuaagugcauaccuucugagucuccuggacaguguucaggucaaucuccaguacgugguucugcagccccccaacgagcagagugcuguugucugucaggaggacgcugugcauauccucguuuucauccagccugcgugagaagagccgacaggccaggggcucaccagcugacaauccuauggccuuccugucauuuucccccuuucccagcugaacugaaaggccacuuacaaauagucaaauauaaugagcccuccacgggccauguacuugagguuguucuuggugaggaagaggauaccguucuccaggcucuggauuugccgaaugucgucaccaccauugaccugaaaggaugaguagcgcuccagagcugggccgaagaaggagguggcauggcccuggggaggaugcaaacacaccugggugaggcaggggcauggcagacacuugccaaggauggaguacgccucagacucccuuucugucuagacaacagaggcguauggcuagggaccagucaaccuuagugauaaagcaaugauuacucuauguuacuuucaugcaaaucaguauuauuuuuaauuauuaauuaacugaagcauuaccuaucauuauggucauagugagaauaaaaugguuuauauaauu

SEQ ID NO: 5821 - RNA, 5905 nt, Mus musculus
agggguccucgcugccucggaggcgcuccuaaagcugccugcucgcgcgagaguuuggaggggcgggcuuagggucaguuucgguggggggcucgcacgggacccucagaucuccgcuuaggugccuaguuaagugcgggaagcugggccaggcggucacuggccacccugaaccuggcgggagccggagcgcucuggagaagccgggacagccccguuuuucccagccagcugcuaggguugggacccacagaaaacaaagugagaguccggcugcuuuccagagccugggccacggcggcggccgugggagcagaggugggacagaugcgagcgucagaggcugugggcgcacugagguugggaauggacccgagcaaagcgauggcggaguccuuacaaaaggggcuggucugucugcacgggagcuacuuacauucuagagauggggauuccggaacccuuggugcuagguccacauaggcccugguuauggagugugcucgcuggcuucauggccugacugguuccuugcuggcagcuccuuucugcccgucauucucacguaaucgauaaccuccaucucaaagcuacugcauagcucugugaguccucaguguccucaaaguaucaaaacccaggcccucaccuguggaggacauaguuucuggaucugagucccagucccgagcucucacucccuauucccccaucccgaacuccggucccucggguguuuguaacgagguuuuuuccuggaaaacaauccgaaucacaccaaggccucugaaggccuuggaaugaggggugacggucaugggggaaauggaucgcucuccucacaccuguguuucauuuucauacaaauccagguggagcgacccuguuacacuaaagaugaaaggcugggguuggcuagcccuacuuuuggggguccugcugggaacugccugggcucgaaggagccaagaucuacacuguggagguaaaagcacgaagaccaguggagaagugggaggaagaugacccgugggagucaugagauccaaagcuuggaacaaggauggauagaaaaacccucauuccccucaccauccccacucccuguucucuucccugacaccagcuugcagggcucugguggaugaauuagagugggaaauugcccgcguggaccccaagaagaccauucagaugggauccuuccgaaucaauccagauggcagccagucaguuguggagguaauuuacuaucccucaaauaaaguagcucacucgggcuuagaguaugaacuuguucgaagagaagaaagcaggaagucauucgaccuguaaugauaaugaucucaacccucagaggcgggaccagaaggaucuuucugaguucuaguucuggucuaccccauagaauuagguacugucuucgaaaagaaaagaaacagccuggugugaugguacauaucauuaaucccagcagaggcaggcugaucuugaauuugaggccagccuggucuacaaagagaguuccaggacagccaaggcuguuauagagagaaacccuaucucaaaaaaccaaccaaacaaacaaacaaccaaggagccagaacauugauuguguaucagaaggacugggcucuaagccacuuaugguauuugcaugccuguaauccuaguacacaaacagcagagcaguuggguucugccuaucuggaagagccuggaaaguuauaaccacguauuucuuugccccaaaccucaauuaauuguuucugcuguagaaguuaggucuugauuagucuguuucuccucauccccaguccgcaugucucuuguuucacuauagcaguauuguauauauacauuuauuuaaaaaaagaauaagaggucuuguccagcugggaauguagcucaguugauagagugcuagccucgcaugcacagaacccuguguuuggcccuuaacaucccauaaacccagcauacugguacacuccugugaugccugcccucaaagucuucccuggagcuagagagaugguuccgugguuaggagaacaugcugcuguugcagaggacuuggcucagauucuagcacccauguaguggcucauaacucauucuggggaaucaaacauuuccuuccggugucugugaucaccaggcauguauacaugcaagcaaacacucgugcauaaaauaaaaauaaaucauuuuuuuaaaaaaagucuuuguauucaagaaauuuauauuagcuagaagcauaaguuaaagcuauaccuaguaagaaauaugcaaggaaauuuauuuuaaugauugauuuauuuuuacuuuauguggauugguguuuugccugaauccaugucugugugaggguggaguuaaaaacaguugugagggcuggugagauggcucaguggguaagagcacccaacugcucuuccaaagguccggaguucaaaucccagcaaccacaugguggcucacaaccauccauaacgagaucugacucccucuucuggagugucugaagacagcuacaguguacuuacauauaauaaauaaauaaaucuuaaaaaaaaaaaaaaaagccaggcgugguggcgcacgccuuuaaucccagcacucgggaggcagaggcaggcggauuucugaguucgaggccagccuggucuacagagugaguuccaggacagccagagcuacacagagaaacccugucucgaaaaaccaaaaaaaaaaaaaaaaacaguugugagcugccauguguaaacccagaccccugggaaaucagccaguguucccuaaacacugagccaucucuccagucccaucaaggaaacauuucugugacgcauguuggugugcugucaucgaaaccuauacccccucuuuacauuuuuguuugguugguuuuuuauuuuauuuccaagacucugcagcccuggguguuccaaggagcucacuauguagaacaggcuggccuugaacuuacagacaucugccuaccucugccuccuggguacuggaauuaaaggugacaauauaucuggcuuuuaauguuauuuuaauaaauaauaaauaucuauguccacaaaaaaaaaacuaaacaaguucacggggggaaaaaaaccauaguucauuauaguugaucaaagugguuuuugccuauaauucggagcuaaggauauuggugcguguuuuauaaucaggcaaaauaggauuguacauuugccuggagugcagguugugaguuacgcugugcacugcugguucuuggaaguuaauagggauucucggggacacagauugggaguuggggguagauuucuaugaguucaaggccagccuggucuacauaguugcaggccaccaaccaaggcuacagggugagacccuguuccaaaggaugggcaaacaaaaugugcacauuugaaaguaacuugagaggaagaaagaaugggcagaugucgccacaggauaucauuagggaagguuucuuuguuuuuagaaugaguuguuugagcuagauucgaaaggaaaggaaagaguucaaaugaguaacaucugagguagaagggagugaccaaaggcugaguucauuucuagguaccuuaugcccgcucagaggcccaccucacagaguugcuugaggaggugugugaccgaaugaaggaguacggggaacagauugacccuucuacccaccgcaagaacuacguacgcgucgugagccggaauggagaauccagugaacuagacuuacagggcauccgaauugacucagauaucagcggcacccucaaguuugcggugaguuaccgcugugccgugaguagcuguuucuugggaguuauagggauucccuggcacaggaugggagauggaugcggaagugguguugccuacuuguaaccuaagcacuccaggggcagcgguuggaagaucagcuuaaguuugaggcugggccuaguucauagugaguucgaggccagcugggcagauauaguaaggcccugucuauaaaauccccacccccaccccaaaaccaaguagagagcugagccagugucuuugcccagcuugggaucugggucaauucucugucuucuugguccgcagugugagagcauuguggaagaauacgaggaugagcuuaucgaauucuucuccagagaggcugacaacguuaaagacaaacuuugcaguaagcggacaggugagcacccccgacuuuccgucccacgcucacagcccuguguaacucggcuugcggcccugacccucgccacacagaauguguggccacacgcucagaccucugacaggugucccacacugcuggcuuccauuucccuuggcuuaggguuuggagugauuucucuccagucucugccuaauaguucucagaguaugugucucuguuacccuggguucaggagagggagcugugggaggugguuggccacggugauuguugguuggcgcgggugcuuucuggugagggguguaugugugugugaggguggcuguuuccuucacacuguuacguacuauuugcagaucuaugugaccaugcccugcacagaucucacgaugagcuaugaaucacuggagcaagcagccuacaccaaacgugauggaacacccccaggaggggaagauggcagcauugccuuuuauauuacguuuuuauggaaaugaacugaaaaaaacucuugaaaccgaaaguacaaacuguguugucuuuuuuuuuucucauuuugguuuuuugagacagguuuuuucuguuguuuuguuuuuuuguuuuuuauauagcccuggccauccuggaacucacucuguagacaaggcuggccucgaauucagaaauccaccugccucugccucccuggugcugggauuaaaggcagcgccaccacugcccggcacuguguugucuuuuaugcccaaaggcagccuuuguaccaggcuugaagguugggggcuacagaugggaagaaaaugaagggauggguuguaauagcguacauuuaaaagggcccuggcccauuaauucucugucauguggaauucuguucacuuacaaacuggagaugaguauuuauucaguguguacuuaaugauguguuagcagcuguggugcuguggagaaagagccugaaugacagcacaaggcgcugggaggucccuguacuccugcuggaaaaacauugaagaugggaacugaucuggacggaaguaaucgagcaaucgagcugcguucuuuuguucuuuucucuuuuuuuuaagauuuauuuauuuaacagguaugugaguucaugcucgcugucuucagacccaccagaagagggcauugcaugccaucacagacgguugugagccaucaugugguugcugagaauugaacucgugggaccucugaaagagcagucagugcucuuaaccacugagccaucucgauuuaucauucuuuuuuacaggugaagaaaaugagguccagagaagccacaaauucuaaagucugaauuuaguagaaaaacgaucuauaaucuuucugucaagcugaucuaaaguaguuacaaaguagcuuuauuuuaagaauuauuuuguuguuguuauuauuuugagacagggucuuaccagguagcccugggugguccagaauucaguucacgauauagacuaugcuacccucuaauccaaaaagaucugccugccucugccucuccagaacugggauuaaaagcacaugcuacauacagccgggugguggcggugcaugccuuuaaucccagcacuugggaggcagaggcaggcggauuucugaguucgaggccagccuggucuacagauugaguuccaggacagccagggcuacacagagaaacccugucucgaaaaacca

SEQ ID NO: 5822 - RNA, 6947 nt, Mus musculus
cuuuuuccuuuggucauacuuuucccaagagcgcuuguuuuuuccuugaauccugggacguaguauucaccuuugggcuuucugccugugaugucucguccuccauugaguacacauuuuuccccgacagugauggugcuuuuuucuaaaaguaaauuuuggcuaguaguagcucacaccuguaauuccagcaacugggaaguggcagcaagaaggugcauaugaguucaaggucagugcagguuacagagcaagaucaugacaccccaaagcccuccuggagagcaugcaugucuguaaucucagcagcuaagagucaggacgauauccaagaguuccagggcaaccaagcuuauauagcgagggcgucucaaagaacaaacaaaccaugucuuauguuugguuuggucugacaguagggcuugcuucuuguuuagagcuggcuacucuaaaacuggguagguagcccaggcuggccuggaacucguggcaacccuccugcuucugccucagacuucuuuccauaaauauuagggaggaaauucugcuccuagggacguucaugaaggagcacugcaaauucaaggccugaauugucuugucucgaauaacgagaaggggaggaagggggaagggcguguagaucuaggagagauuauacaagucagcccagaacuugcaaaguuaauauccuuuuccaaagacauaaaccggcagcaggcacugcaaaggccaguaggaugaaaagagccucuccuucuaaagggcucugagaaacguuccucuggacaucgacagccaucugccguugacacgcccacgacgucgccucugcgucuacguaucagguccugugaccacagacucgccaaguaguuugugccaggcgaucucgcucccccgagccaucucugcagcuccuccgacacgcacccagcgcccuuucuuucacgccagaggugucaaagaaacuacaucucccgacaggcagcguugucccuuccuuccucgcgcucccuccucccgaucccuggcaacggcgugacgugaggggacccagagcugcggucaccgcuucagugacagccuauccggcgcgcgggccggagcagggcgaaggcagccggagcucgcgccgcccuuccugcccggccuccccuacagcucgccgccgccgggagugccaggcaggggcgcgcgcauggccucugcgggcgcgcggaggcucccggccccgacgcgcgcggccgcccggagcugcugcggcuucucgcucugccggggcgcgcgcuccgucccgaccccgcccccgggcccuccgcggccgccgcguccaaugaggugagaggcaggcacagacguccgcgcaggaccggagggggucgcccggcaccccgaaguucagcgguggaggguggcagcccuuagacggcaggccggagaagggcuggcauugguggugcccugggaguucgaauggaguucuggagauacgcguacaagcuagaugcucggggcgggugcgugccagccacuucuuggccuucgccggcguucuggcuuugaugugccuggccugacccuggcgucagagaugcuucaguuugcuugcagcaguaguguugccucaaaggcagcuggcacuuaggacgugcccuucuuuuucccauccccaccccuggcccuguccucagccgcccucgaccuuucgcacucgugacugccuggccagccagcccagcuagcugcagcaggugcuaggggcagaaaagcuugcccgaaccaacgaccuuccucugugaugcaucccucuuccccuucaccugaagugguugaauacaaaaaaagaaucgugacgcugccucuccuuucuuuuuggcgcuagguuucugauuuccuguaaucucuucuugccucgcgcugcccaggccuuggcagcggaggcuggccuaccucauagucguuccuucaugggcuuugcugcccccuuuaccaacaagcgaaaggcuuacucggagcguaggaucauggggugagcauuccuuuuuuuccccuucaaauaaauaaccauguaccaguaguggguaagauucauauugggccacuugucuccccagcaacguuuucgcugccagccuuucaaccuaaauuucccaccuuaguuguucugcacguguauuagucuagaauuguguuacaucauagaaagguaaccgacuagguaguacagccuguaaucuaagcuugaagcuuccacggacuacauagccagagcugcaucauagguaucucacacacacacauuuugagacaggcucucacauagccuaggguuggccuugaacuugauauacagucaagaagacuuugaacuuauaucuugccuccaccuaccucccuagagcugagauuauagacaugugccaccaugcugcuguuuuucugcagugcuggggauugaacaugcuaagaaaccacuuauuacaggacuuaauuaagucacagcuuuuuguuauuguuguuugagccaaggucucaagacauaccucuggguaucuaccuuggaacuauguagucuaggcugggcuaaaacucagagaucugccugcuucugccuccuaagcacugggacuaaauggacuuuacuggcuaccaggaugucaggcuuuuguuuuauuuugauaaucgguaucauuauuuagacuuggcuggccggucucccaagugcugagauuaaaggcgugcaccaccauguccagcuauagcaaaaaugcuuuaaaaaauuuaaacuauaagggacuggagaguuggcucagugaugaacacucguugcugcaaagggucgaguuuguuucccagccccaccuggaggcauacugcaaccucaagcgggagcauguuugauacacagauaaacauggaggcaaaacacucgugcacauaaaauaaugaaaaaaaaauuuuuuuaacuaaaaauauuggggcgggagguuggagaaauggguuaaugucuaggagccugcacugcugaguuuaguuccuagcaccuacacuaggcagccugugacuucagcuccagaggaucuuguguccuguucuggauucugugggcaccugcacucauguguacauccccuccccaaaacauacacauucauuuuuuuaaaauuugguggugguagaagcuuacaacuuuagcagcccuaggcaggaggauccuuaucaguuucagcccacuaaccugcacugcaggcuauaaaguuaaauuuaucuaaaaagauggugguggugaaauggcauuugaggugaggauacuuacggccaagguucaugacuugaguuucaccccucuggaucugcacgguggaaggggagagccaauugcuggagguugguuucugacuucuaguacaaacuggcauacaugcucccauacacaaauagauguaaaauacucaaguugggauuuuucuauguagccuuggcugucuuggaacucacuguuuagcuaucuuuccuaugauugccaccuauauaguaaauaacaaugauugguuuugguguuuaucaagacaggguuucuuuguguagcccuggcuguucuugaauuuagaaauccaucugccucucuaguacugggauuaaaggcuuguggauaccaugcuuggagucacauauuuaaaaagacagcagggcauuccugagcuccccaaugugggugcuggggaucaaaccuggguccucugcaagaacagccauugcucuagcaccacacauguauguggugcuggggacugagccuaaggcuucccauaugccaaguaagaucuaccauugaugcuaagcuccaucuccaguccaugcacauaggcauuuuacccagauugucucauucgggccucgugagcacaugaaccaaguauuaccagcuccacugugguauaggcaagauuggaggcacagguaguuucuaggaagcuguagagguauguuccuagcacucaugauguugagcgaggaggaucaggaauuugaagccaacuugggcuccacaguuuaaagucagccugggcuauauaagacuuuuuuuguuuuuuugagacaggguuucucuguauagcccuggcuguccuggagcucacuuuguagacaaggcuggcuuugaacucagaaaucugccugccucugccucccgagugcugggauuaaaggugugugccacaacgcccggcuuauauaagacuuuuaaaaacuccaguggcucaguauguaaaggcaccugccaguaagccugaaggccugauagagauuccacaaauccacacaauggagaacuguccgcugcaaguuguucucugaucuguacauguuccauacaaaacaggaaauuuugagaucugacuaccaauaaaacuggcaaccuguuguguacagucuauauugggauaaaauaauauaaaagcauuguggucugaagaugugucucgguuggcagagugcuugcuuagcaugcaugaggcuguggucccuaacaacacaaaccagguguggugugcauaucuguagucucagcucucucaggaaguagaggcaggaacauuaguucaaggucaccucaacucuacggaguuuagagcuagccagggcuacaugagaccuugccaggugggggugggaagcuuccauucuaauuguaaaauaugccaucuggguuugucuguguuccuugguuaaugggcaaaggccuuacuucaagaccaaucaauggcaaggaagcccugacucggaggcaguuccucggccucugauuccucuugcuguagguacucaaugcaggagauguuugaggugguguccaacguccaggaguaccgagaguucgugccgugguguaagaagucacugguaguauccagccguaagggucaccugaaagcccaauuggagguuggguuuccaccugucuuggaacguuacaccucugccgucuccauggucaaaccacacauggucaaggugaggccugccugagagggauucccuaggaaguuuuauguuccuuaccaguuucacggucaaagacuacuuugguuuuuccuguaauuacuugaugucuauguguuaauuuuuuuuuuuuuuuuuaccaaauauaacauuaaagggaagaaaaugacuuuuacuuauuuugagucaugcuaggccaaccuaggauaucacauaugcuguguaaaugguuccacugagcugagcccucuagcuuagugguucucgaccuuccuaaugcuaagacucuuuaauacaguuccucauauuguggugagcccccaaccauaaaacuauuucuguugcuacuucauaacugucauuuugcugcuguuacaaaucauaaauuuuucccugaugguuuuaggugaccugugaaagggucauuugauaaaagaguugugacccacagguuaggaacuguugcucuaacacuaccccucuuccuuaacaauaggaguuaacuagaauguauuuuauuccauccaggcuguuugcacugacggcaagcucuucaaccacuuagagacuauuuggagauucagcccugguauucccuccuacccucgaaccugcacuguggacuucucggugagucagguuuugugacacaggccugggacugaggguacacguaacacuucaagucaucaaguacccagaggucgaaguccauauuagauuuacauuuugcucaguucuaaguuaggauucuuuuuuuuuuuuuuuaagauuuauuuauuuauuuaguguucugccugccuacaagccaggagagggcacuaguucucauuacagaugguugugagccaccauaugguugcugggaauugaacucaugaccucuggaagagcagacagugcucuuaaccucugagccaucucucuagcccccuauuuuuuuuuuuuuuuuuaauuauauguaaguacacuguagcugucuucagacacuccagaagagggcaucagauuucauuauggaugguugugagccaccaugugguugcugggauuugaacucaggaccuucagaagagcagucagcgcucuuaaccacugagccaucucgccagcccccuaaguuaggauucuuaagugauggaauggagggaaagaggagaagaagggaccacagauaaguguccuugauuuggccaggagcuacccaccauggucuugauguuucugucucuuguguuuccagauuuccuuugaguuucgcucucugcuccacucccagcuggcgaccauguuuuuugaugagguuguaaaacagaauguugcugccuuugagcgccgggcagcaaccaaguuugguccagaaacagccaucccccgugaacucauguuucaugaagugcaccaaacuugagacgagggauuguuccuggccucuagcccuccucacacccaguuuuauuuauugguuuggcucuugcucugagaggucuaaucuccucucaauucuuccuaaacugggcugcaugcugucugagcacaggaaagauagcaggaauggaagugagacagaagaaagugucagguacauucugaaagccucacacgcccaaggccguugcacaccaaauaaaaaccagggcugucaccgucucugugccuggucgggggaauacaguaguaacuuccugacacagagauacuggcuagcaagaagccuuuacccugcuaagcuucucaggagaaaaggcagccugccucaguuuaggaacacauccaugcugucugacagguagaaggugaggagcugcuuuaccacagcgccacagagcagaggaggagaaagcacucaacagugugguccacguuguugggaugcacuuuuuuuucuuccauguggccugaguuuuuauaaaacuucaauaaauggugacagugugaauuug

SEQ ID NO: 5823 - RNA, 940 nt, Mus musculus
ggcaucagauuucauuauggaugguugugagccaccaugugguugcugggauuugaacucaggaccuucagaagagcagucagcgcucuuaaccacugagccaucucgccagcccccuaaguuaggauucuuaagugauggaauggagggaaagaggagaagaagggaccacagauaaguguccuugauuuggccaggagcuacccaccauggucuugauguuucugucucuuguguuuccagauuuccuuugaguuucgcucucugcuccacucccagcuggcgaccauguuuuuugaugagguuguaaaacagaauguugcugccuuugagcgccgggcagcaaccaaguuugguccagaaacagccaucccccgugaacucauguuucaugaagugcaccaaacuugagacgagggauuguuccuggccucuagcccuccucacacccaguuuuauuuauugguuuggcucuugcucugagaggucuaaucuccucucaauucuuccuaaacugggcugcaugcugucugagcacaggaaagauagcaggaauggaagugagacagaagaaagugucagguacauucugaaagccucacacgcccaaggccguugcacaccaaauaaaaaccagggcugucaccgucucugugccuggucgggggaauacaguaguaacuuccugacacagagauacuggcuagcaagaagccuuuacccugcuaagcuucucaggagaaaaggcagccugccucaguuuaggaacacauccaugcugucugacagguagaaggugaggagcugcuuuaccacagcgccacagagcagaggaggagaaagcacucaacagugugguccacguuguugggaugcacuuuuuuuucuuccauguggccugaguuuuuauaaaacuucaauaaauggugacagugugaau

SEQ ID NO: 5824 - RNA, 1232 nt, Mus musculus
cacagacacagcuacaggggccauggaaacaggugggggugccauccccugggcgauggucugagccagagcggcugacagcggcgugaucucgggguucagguguggaggugggggcggcggagcggcaggaggugcagcauuagucgggggagcagccggugccccugugggagcaacaaguucuugcugggacacaggccgaggcuguagagccuggcugcucagagugguaugagucugggcgaugccaugguuaaaaguggccacugugcccacagugggggccagggucugcucagucgcgggggcaguggagcucagagucaucaccuuggccugauuccggaacugggcauucugcuccagaaguaccucauugguggccagcagguugcugaccugcuucuucagcuccuccacgcguuuccugagcagggcguucuccuccuccagcagucugcacucaaccccacggagcggagccaaguuacauucguaggacucgaaaugggggccgucaggagggcagcagccaccucuccggcgcuuagggccugguucgugguccucaaagccccuuuccggaaggucguagaugucauagagaucaugacggcguccugggggagcagagccuguggagccuccaccuccagugccuccuccaccgcgagcaucaaacucaaaaucccuuugcaggugacgaaacuugcacuuggcuccucucugacagucaccuuugaggaagucgcggcagauggggaccuccuccuuaccauuggguaggucggcgggugagagacccagcccagcggccacuuucugccucagccggggaggcagcucuccugucuucuuauagccauccucauccuccuuggagccguggaugaaacgacaguuggggcggcuacacuccuuguuuuggaagucauggcagaagauaaauucauuuuugcuuacccccaaauuggauaccucacucaugucuggguggcgguaucgacaucgcuugccucguuugcagacguuccucaggaagucucuacagauggcaucugagguggcucccccgcugccugucccugccccacuggccuccucacugccaccaccuccagggccuccaccgcugcugccagugccguuggcauagcugucccggucaggcauccuggucccccccaagucagggucuucuuccuuuucuugccacucuuggcgacugu

SEQ ID NO: 5825 - RNA, 8462 nt, Mus musculus
aacagugagcaaauccaaauuuauuuuaaugccaugucauuucaaaaaccucagccuuaguucccugggacagcaugccagagguacaaauuguaacuucucuacaaccccccagcaagcauccaaguccacagcuucagaaagccaguucucuucagucuacuccucugcuuccugguuuuucuuucaagagaggaaacucaaaaguagguagcuaggugugguggugcacaccuuaacucuagcacugaggaggcucucugugagggcuagccugguugacauaguuugaagccagcuggaauuagcgagacccuguuucaaaccaacuccaccccaccuuacacaccaaacaauuuaaacaggggaaaaaacccacugggauguucaauguagggccuaaaaucaagugagggaaaaugcacuggacccagauggcgggaaacaagguaugacuuacuuacaauuuugugaaaauggguggaaggauugagggacuguucagaacaaaaauggcuaaaaauuuuuacaaaugaggauccauucaauagauuaaaaaaaucucuucuuaauggagaauucagcuucuagaaauaggaagggccuaaacagacacccugccuaagcaggucacaaggaaucugccaccacagccagcccucuuugagggcagauuaaauacuugaugacagauagggggaaacagaaaagaaaaacaaacccccccaggagugagaaaugcugucagugacaaaaaauccccaguccaggccuccaugcugguggauaaccucaccuccuuucuguuuuguaguugggccacaaaccuugaccaagcggaguagaaaaggcuagaaagaggggcuugacgacgguggauuuugacuccugauuuuauuauucaauuucuuuucuacuaaaaguagucuucgguggcugggaagccuggccucccaacaccagagucagucggagcugguuuuuuguugaaaggaguggguggguggguuggggaccgggaugagggcugaagaccccccgcucugcugguagucuuggguggagaagacgaacugcacuugacagagccuggggugcggugggagggggugaggcaggaaugacaagcuggggaggggacccaccucaguccccagcuccauucucuucuaagguuucuccacugguggcauucucuacagucuuggaggccuacagacaggagaaagacaaguaauuuguaugcuggugucucagagcaggaggugagcuugcaacccacccauuauuaacaucacacaccuucuuuuucuucuuuuucuggguuuuucuacuugcagaacucuggagaagagccuggaaaacagaagcaggcguccugagcaaugugggaucauaaagugcaguacuuuggaaaucuuuccaggacguccacaaaugucccauguucauauuccauucaacacuaaccuucagcucugcaucuugaaccuccaucucagacuuguacaggucaggcucaaagggaccacugguuauccgcauggggccguugggcaugaguagaacuguaaauuuaaacugggcaacaaauucaccuaugggaaagcaaaaaguuauuuaguuucuucugaaguuguagggagggagcucuugaaugaaaagacuuagaacucacccuccuucucauagagaacguuaaauggcuguaguaacucauguuuggcacacucuaccacacccauucgagccuucuucucaucuucaaaugcucuggggagagacgggauucagguuuccuuaacaccuauccggcaucaccauuucuguauuagugugggauuaccauguaugacuggagaugggggucagggggcaaccgugugaagcugguucccuucuacucuuaaaugaguuucagggguugaacuuagguuggcagucuuacacaguucuugggcugcaacugcacauugaauggcccugcuguucaagacaggguuuugcucaauguagcucaggcugucuuaaaacucuugaucuuccgccccuggagugcugacaucacaagcaucugccaccacacucagcauguucuuaaaucacugccauccuugugcagaaauuauguuugggguuguuccauauuauauucaacaaggagauggguggaacaggggacgugcauucauucaggagcuacaagucugggcaggagagcaagggagggaaggagggagggccaagggaugggaaaccauuccuggguguacaaacagugucagacugguuucccaguacugcucuugccacacguaguaccuuaaaguaaacggcauggcaucaaaacgccguuccaccucacugaaaaaggcacgugaaguuuucauuuucaggccauauuguuuagaggggucucgcuuguagauggugguucucuguccugcaucuuuggccuugccuucuccugagcugacgaggacaucuacagcauaaaccucaugcaccucaaauucugccuuuucaugguccuuccuaaaaggaacagagaaggaacccuaagaguacaaaagccagauauaggggagcaagccugugaccuuagcauuagaaggcaggggcauugcuacaaguucuaggccagucacacacacaaugacaacugccccucaaacacuccucuuacaggaccugaguucaguucucaucacccaaaccagguagguaggugugccacuugcuccaggaauagacagacacacagacauaauaauuaagauccuuaaagaaaacaaggaagauccacagugaccuguagcaguuuggaggucaucuugaucaaaguaggggccuagacagacaacaugugacagcaaaagacaaacggggcugggcuuacuucugcuggucuguaggguucuggauaaucgucuucucuccaucaaucacaugcugcuucaauuggugugacagcauaccugcagacaggauaaaaccuaugguaccagcuacagggauauagggcccccgauagcuucuaaguccacucauauaagaagauuauacaugacuauggaaacaagguaugggggguuucugccuuagacaaagccagagccaggaaggagacuuaauugaucugguuaucucaggucucaccuucuauuggugugcaguuaaaugagugagcaaccuuguuccaugcuucagucacuuguguguucuagaagagcaaacaacaggugagacuugucugcggccuacccuuucucacggcagauuucuaacauccuuuauuaaaugccagugacucucacacaacccaucacaucuacaaacucauauccaggggacggucccagcacuugggaggcaaauguaggaggaucucucagcucaagaccagcuuggucuauagaguccaggagaguagggcuacucgaaagaaacccugucucaccccacaaaaaaauugcauaaacaugauccaaggagacaacagagcaaaucuauauaccccaauccagaggaaagggaaacagacucaaaaagguuaacuaauuuauccaaagcuaagcgaguauuuuuagagaaaucuugcuauaaaccuguauuucccaacaagacuagagauguaauuucuuccuguggaaccuauaaaggcuuaucaauucuguaugccugaucugauauauccccagugccgggaauaaaggcauaugccacccuccccuggauagaaguuuguugguagaaaugaugggguugugugagaaucacuggcuuggcauuuagagaacaaauagaaccaaaaaacauucgucucuaauuuacaaaaacaaaacaaaacaaaacaaacaaacugugccuaagccaggcaugguggugcaagccuuuaaucccagcacucaggaggcagaggcaggcggauuucugaguucgaggccagccuggucuacagagugaauuccaggacagccauggcuauacagagaaaccccgucucgaaaaacaaaaaacaacaacaaaaaaucugugccuggcaaaguagugccuuuacuaccagaacuuggggagacagaagcaggagaacccgaguucaaggccagccuggcauacacaauauaugagcuguuucaagauaagcaaaagaaaauaacauuauuuagugugugcauacauuuauuauuacuaaguaaauguaaguuguagggcuugguuuuuuucaagacaggguuucucuguguagcccuggcuguccuggaacucacucuguagaccaggcugaccccgaacucagaaauccuccugccucugccucccaagugccaccacugcucucggccaguucuuguuuucuaucagguaggcccuagggaucaaacaggccaccaggcagaguacaaagggcccuuacccauugagacaucuugcugacccuaacaguccuccucauccaggguacuggucccucggacacuuuuccuaguuuacagaugaggaaauuugaucacacacgugaucccaggggaggaggauggacaccagggaagaaaagaugacuuaaaaaguugagcucauagacugcaucugauucaacagcuacagacuaaccauuaugcaaauagccaguaaaaaaaagacuugccuaacuuacuacaggcuggguaccuucaaagugcuagaaaacucugaaguuguuaucagaaggacacaaagaauuuaaucaggggaaugaauacaaacugagcacagugugcgcacucagcacacacacacacacacacacacacacacacacacaccccaccaccaccaccaccaccaccaccaccaccauacccggcuguauggucacacacaacuguaaaaaauuguuucuguuaguuauuuuggggucaaaacacacaaacaaaaaucuaagaauggcuuuuauagguuccacaggaagaaauacauccccuauaccuugcauggauaguaggcacucaguuaacugcuguuuauaaacgcccgauucaucuuuuucccucugucaagcuuuggaauuacaaggaagugccuuaccugguuuccagguuugaccagucguaaggcagcuucagcacauaggugagcggccuuaaugacaucugcuuuccgcccuguuaccuggguccccuguaaauaaagaaauacauccucuauuauuccagaaagaccacuagugugugaccaaacuuugugguacuacaacggagauuaaaaacaaauggcaggauauccccauaucaagacuuagcaaaguucaaaagcaugcuaccuaccugagcuacaccaauuacaaaagugugagccacauuggcaaugaagccauccacaugaaccccaaggucacuggaaggcaaaacagcacugcauuagaaaccaacagugcgcgcacacacaggaaaaugacagauacuccagaacagcucagccuuacauuuuuaccaagucaccuuccuugaguauauaguccuggucacucuucaaaggggagaagugacacacacaguuauuuacggaaaugcugguaggaaaggcaauaccuguaaaaagaaccaucaaccuuacugccuuguucucaccugggaacacuuccugcccuuuagaaaaguugaaggggacugguuuucgguuuagucugggaaggaaacuguacccaucccacuugcuacuuagauuuucaaauagcuuaaccagggauuugggggggugggguguguuugugggagggcaacuagguggcuggguucaaauaggagaaaucaagagggaggguuuuacccuucuuaccuuucuucaucuccuuuuccuucuugaagaucuucccugucucuuccauaaucauggcaucaccuuucucacacaagcucagcacagacacaccugagcuggaagccuccaccaaagaucgaagcaccccugggaacaggagaaacccaucagcccugcaugcguucaucaugugaccagaccacaaacugaauuucguuucucauacucccaacacuguucauuguccuaagguagagagaggaaagguuuauguccuggaauaaucuacccauguuuaacgucugcguuuuuguuuuugagaaauaccccugacuguccuagaauucagcguagaccugccugccucugucuccccacacaugugcuggcacugaaggugagcccaccacacccugcucuacuuccuaccuucccuuccaaaaauaaggucagcaccagcuucucuccucuccaugauuugacacuuaggccuuaggccucacacaucccaaagaugcuguggcaacccacuccacacacacaaacagaccaaaagacauuuauaggcgucggggacaauggggagguagagaacugcugagucaaaguugaagcauuguuaaauguuaccuccgucccuccccagacacaaaguaguaaucauaauuuauguggcuguauuuccccaugucuaaguauauaagcccaggggaauuaaccuaaggucuuaaagauucagagggcuaaaacuuuacuuccaguauaucaagaucacauguaaccaguuucaaaacuauuaucugaaguugccugugggguuggagauucugucugauucaaaccaacagcaaauacuaaaacaucaccccaaauaagguuaucauuuuguguaugucuuuaugaucaugggaauucuagguuugaugauuucuuauguguuuuauucucuggauuccagaggaacuaagauguaaccaaagacacccuaaauaccuucuuccaaguauuuugucaaguccauucuaaaggccuaaggcaguuuuuuuuuuuuccucaagacaggguuucucugaaacucagaaauccgccugccucugcuccccaagugcugggauuaaaggcgugagccaccacugccaagucuaagacaguuuuuaucaagugaauuuuaauuuuuaaaauguuaaagagccgggcaugguuacacacaccuuuaaucccagcacucuggaacgcugaggugggcggaucucucaggccagccuggucuaagggaguaccaggacagccaaagcuacacagaaagccccaaaaauaaggggguaagggagggaaagaacuggaaagagaaaacaguaaaguuaucuguccaaguggcagacaacuguuaggagaguaaagaucauuuaagaaaugcuuauaauccuaaaauccgugucucucuccacuucuuuucaguauuauagacaggcuugcccagcugucuaagcagaaccucaaaacacuguagaggcucuaggaacaaauauuaaaggccgccuucaaaaaccggagcaguggucauacaggaaagccagguuguuuuagaagcuccagaagugucuuccaacggccccucgagcuaggucaaggggcgaaggggguccccacuaagaagaccugaaguaaagacuuuagcaaagcacgugguggggaagcacgguaggagaggaaguggggagccaucgauccgcacacagggaccuggcaacacgugccggcucagcucccgcgggucaagagccgcgacuggcagaggggcgcuuccgucgccaacagcuggccgcuuccuuuucgagguggccucacugcugccagucgggagcauagauccggacagaccgaaggguaugggcagaagacgacgcgccuugccuccuuaccaaccgcccagggucggagcaugccugggccccucucuguacuccucgcggucgccggcccgcaccuccacucuccagcccaggcauggcugcucaguccccagggcgacaccagaucuccccaccacgucgcccccggcagucggcacgcgccccucgguggcucacucggcaagacccagacgccacagcccuccggagagagccccaaaccucucccucucagccucgacuccaagacccccgaggccgcacucacgguuggcgaugucgccccccaucuuauacuuggucacgaccagguccucggcgauaguuugcuccugcugcucgucuucgcccgacaucuuccuacugcuacuacugcagcuucacuuucccugagcugcggccuccgucucccuucccagccacaggcuguagcuagagucucuucgauccgcgaggaaagcgcgagcaagcaagggagcgggagggcgggcagagagagcgagaagcugcgagcgcgcgggcugaggcgcagggcacacugggacaaugaguccugcugucggccaguucccagccgcccucgcgggcucuagaacuacaauucccagccugcuccucgcgcccguccgccaggcccugggaggacuugccuucccaagucugcgcacgccggaaucgccgggcacgcugggaagagucuggccccggcgggaaggcggagccguuggggagcuugagggaaagcguggu

SEQ ID NO: 5826 - RNA, 2851 nt, Mus musculus
accugagcuacaccaauuacaaaagugugagccacauuggcaaugaagccauccacaugaaccccaaggucacuggaaggcaaaacagcacugcauuagaaaccaacagugcgcgcacacacaggaaaaugacagauacuccagaacagcucagccuuacauuuuuaccaagucaccuuccuugaguauauaguccuggucacucuucaaaggggagaagugacacacacaguuauuuacggaaaugcugguaggaaaggcaauaccuguaaaaagaaccaucaaccuuacugccuuguucucaccugggaacacuuccugcccuuuagaaaaguugaaggggacugguuuucgguuuagucugggaaggaaacuguacccaucccacuugcuacuuagauuuucaaauagcuuaaccagggauuugggggggugggguguguuugugggagggcaacuagguggcuggguucaaauaggagaaaucaagagggaggguuuuacccuucuuaccuuucuucaucuccuuuuccuucuugaagaucuucccugucucuuccauaaucauggcaucaccuuucucacacaagcucagcacagacacaccugagcuggaagccuccaccaaagaucgaagcaccccugggaacaggagaaacccaucagcccugcaugcguucaucaugugaccagaccacaaacugaauuucguuucucauacucccaacacuguucauuguccuaagguagagagaggaaagguuuauguccuggaauaaucuacccauguuuaacgucugcguuuuuguuuuugagaaauaccccugacuguccuagaauucagcguagaccugccugccucugucuccccacacaugugcuggcacugaaggugagcccaccacacccugcucuacuuccuaccuucccuuccaaaaauaaggucagcaccagcuucucuccucuccaugauuugacacuuaggccuuaggccucacacaucccaaagaugcuguggcaacccacuccacacacacaaacagaccaaaagacauuuauaggcgucggggacaauggggagguagagaacugcugagucaaaguugaagcauuguuaaauguuaccuccgucccuccccagacacaaaguaguaaucauaauuuauguggcuguauuuccccaugucuaaguauauaagcccaggggaauuaaccuaaggucuuaaagauucagagggcuaaaacuuuacuuccaguauaucaagaucacauguaaccaguuucaaaacuauuaucugaaguugccugugggguuggagauucugucugauucaaaccaacagcaaauacuaaaacaucaccccaaauaagguuaucauuuuguguaugucuuuaugaucaugggaauucuagguuugaugauuucuuauguguuuuauucucuggauuccagaggaacuaagauguaaccaaagacacccuaaauaccuucuuccaaguauuuugucaaguccauucuaaaggccuaaggcaguuuuuuuuuuuuccucaagacaggguuucucugaaacucagaaauccgccugccucugcuccccaagugcugggauuaaaggcgugagccaccacugccaagucuaagacaguuuuuaucaagugaauuuuaauuuuuaaaauguuaaagagccgggcaugguuacacacaccuuuaaucccagcacucuggaacgcugaggugggcggaucucucaggccagccuggucuaagggaguaccaggacagccaaagcuacacagaaagccccaaaaauaaggggguaagggagggaaagaacuggaaagagaaaacaguaaaguuaucuguccaaguggcagacaacuguuaggagaguaaagaucauuuaagaaaugcuuauaauccuaaaauccgugucucucuccacuucuuuucaguauuauagacaggcuugcccagcugucuaagcagaaccucaaaacacuguagaggcucuaggaacaaauauuaaaggccgccuucaaaaaccggagcaguggucauacaggaaagccagguuguuuuagaagcuccagaagugucuuccaacggccccucgagcuaggucaaggggcgaaggggguccccacuaagaagaccugaaguaaagacuuuagcaaagcacgugguggggaagcacgguaggagaggaaguggggagccaucgauccgcacacagggaccuggcaacacgugccggcucagcucccgcgggucaagagccgcgacuggcagaggggcgcuuccgucgccaacagcuggccgcuuccuuuucgagguggccucacugcugccagucgggagcauagauccggacagaccgaaggguaugggcagaagacgacgcgccuugccuccuuaccaaccgcccagggucggagcaugccugggccccucucuguacuccucgcggucgccggcccgcaccuccacucuccagcccaggcauggcugcucaguccccagggcgacaccagaucuccccaccacgucgcccccggcagucggcacgcgccccucgguggcucacucggcaagacccagacgccacagcccuccggagagagccccaaaccucucccucucagccucgacuccaagacccccgaggccgcacucacgguuggcgaugucgccccccaucuuauacuuggucacgaccagguccucggcgauaguuugcuccugcugcucgucuucgcccgacaucuuccuacugcuacuacugcagcuucacuuucccugagcugcggccuccgucucccuucccagccacaggcuguagcuagagucucu

SEQ ID NO: 5827 - RNA, 1197 nt, Mus musculus
ucugcacccgaucccacgggggcgucaaacgucagagucaucagagggccaugugacgggcucugaggcugaacuccaagagagaguaucaauguguaggagccggagccggagccggagcccacggccacguggggacagugccuaccauucgcagcgacacagccugcuuacucccgucaccccgcucuccccaccaggguuagaggaagaggauggcaaugguuaugucaugccagauacgcaccucagagguaccugucacuuccagcguuacccucaaaucuucuaaucuuuuuuucuccaagcuccccuuaauuuuuuuuaucuucucugaugacucgcucgcucccauuccuucugguuauuucuaugaaguucuauauauacuuaagaguuucucucaaccauagguacauccucuucccgggaaggcacccuuucgucaguaggucucaguucugugcuggguaccgaagaggaagaugaagaugaggaguaugaauacaugaaccggaagaggagggguagcccggcucggccccccagaccugguucccuggaagagcugggcuaugaguacauggauguggguucagaccucagugcuucucugggcaguacgcagaguugcccacuccaucccauggccaucgugcccucugcuggcacgacuccagaugaggacuaugaauacaugaaccgcaggcguggugcgggcgguuccggaggggauuaugcagcuaugggggccugcccagcagcugaacaaggguaugaggaaaugcgagcuuuccaggggccuggacaucaagccccccauguucguuaugcccgccucaaaacucugcguaguuuagaagccacugacuccgccuuugacaaccccgauuacuggcauagcaggcuuuucccuaaggcuaacgcccagagaauuugaccucgguuccuugagacucuuggggaacauuugauggcagcuagugccucuuugaggguaacccuuccucaccccuuucucugaggucccaccuccauuucuccaagaaugccaucuaguucuuggagauuugucaacauaucgucacaaacuuuuugcgguacauagccggcugugcacucucuucucuucccaagccuaggaaagagaaguuucccugugucucucccuuccugaucccguuccucagggagacu

SEQ ID NO: 5828 - RNA, 4189 nt, Mus musculus
cggcgacccggcgacccggcgaccgggcgacaguugacaguccucgucaagagcagcugcaaagcuaggggccaauagcugcggagccggcgaggggcgucaggacgccugcacaaacuguacacgucacggccgagccccgccccgccccgccccuccgcucugggccgcucuagcccugcacggggcgggugaaauuguuccgcugccgacauccagccggguaaggggacugcgaccgggagagaaaggagggagggcaacggugggaccaaggcggccagugccgccaaaucuuggaguaacuuggagcaaccuccaaaucuuagcaguagcaaaagaaccaguaucuccauauaugaugucggugugcuccuggggucgcaggcugguguucuguccgaauucuggacagacacacccuccuaccuaaagugucucagagaguaaggacuacucuugcaccacggaguagcauuucgguauuuagcaggccgcuccucccaaaccuggaacggggcugguaaaaagcagguugcugaaauuaagaguagauggcaggaagaguagggauccccguggcccaggcguaaagaggagaaaaauucgccuuuuccaucuuccuucgccauuuguaagagucccaucccuagcaucucagcaaccagcggcuucuuacuacucuccacuuugaccauccuaggucagagaggcacuagguugugaggaagacaccucagcaggacagagagcagaaaaauuaacuuccuucucuagcccauccccugacacccuggccauugacucugcucaguuugcugagaucacuagaaugccauagacuacgaggucaggguggagacucugaauugagguucaguucucagaugggguauuuauuuuagaaggguggagggagaaaagaggaaaggucugagugaauguuauuacuuguuuacucuucguaucaguuccucuggguagagaugaggauacaaguucagagaggcccgcuguguugccaugggagcugguuaaugacaaggccugguuuugcaaaccccaggcaguuugcuuccaggauucuggcuccuucaccccauuagguugcagccaccucuugucuguuuucaucagucucaauuuagaaguaauuauaaaauaggggcugaggauaugacucagugguagaguuauaauauucucaagaccuuagguucaauacacagcaucauuagaaaaaaaauuggcaaaccucuaaucuguccuuuagucccuuugccuggggcauuguucuuucuagaagccucuguaccuuuccauccccacuccacccccauuccuuucggcacagugugucucugaagugcuccaaguguacucuuaagaacacauuuggaccaugcacucucaggucucccaaacaugggguuuucuugguuugaaaccuagaaucuaucuucuuguuguaggucuugccacgaugcugcugcagcuauacagauccgugguugugaggcuuccacaggccaucagguagguuuucccaagccaguacuuaucuccuagccuaucucauaauuaucuuaucugguagauauuuaucuuaucugacacauaauauaguacaguauuggaggaaagagaaagccauauuucgcugguccuacccauccggaagaaaccaaauuccaauugcaaacuggugacuaaugagggagaggugacugaccacacuacuucacuggugcuuucuugggacguucugugcuacuaauaucucugucuuccagagucaagucaacccccuugaggcucugcauucaagcaugcuccacaaaugauucacuugagccccagcaucccagccuuaccuuuucugaugauaacucaaggacucggagauggaaagucauggggacccuguuaggccuggguguggugcuggucuaccaugagcaucgguguaggguaagugggaaaagagcuuccaugccggaacaaagggaucuuauaggcucugucuucaugaacuguagaaauacaaccugcucccuuaauuucccagacugacuguggauggggucagaaugaccuaaagugaguuaauagucucuuccuuuugcuuucucccuccucaacccucaggcuucucaggagucaccacggauguacucuaaagaggaugugcguucucacaacaacccuaaaacuggagucuggguaacucuaggcucugaggucuucgaugucacaaaauuuguggaccugcauccaggaggaccaucaaaacugaugcuagcagcuggagguccccuagaacccuucugggcccucuaugcugugcacaaccagccccauguacgugaguuacuggccgaguauaagauuggggaacugaaccccgaagauagcaugucccccuccguggaagccucugacccuuaugcugaugauccuauucgucauccagcccugaggauuaauagccagcgccccuuuaaugcagagccuccuccugaacugcuaacugaaggcuacaucacaccaaauccuauuuucuucacccguaaccaucugccuguaccuaaccuggacccacacaccuaucgcuuacauguaguaggggcaccuggaggucagucacugucucuguccuuggaugauuugcauaaguuucccaaacaugaggucacugucacucugcagugugcugguaaccggcgcuccgaaaugaguaaggucaaggaagugaaaggucuggaauggagaacaggggccaucagcacagcacgcugggcuggggcccggcucugugauguguuagcccaggcuggucaccgacucugugacucugaggcccaugucuguuuugaaggacuggauucagaccccacuggaacugccuauggagcaucgaucccucuggcucgggccauggauccugaagccgagguccuccuggcuuaugaaaugaauggucagccucuaccucgugaccauggcuucccuguacggguggugguuccugguguaguaggugcccgucaugucaaauggcucggcagagugaguguggaaucagaggagaguuauagucacuggcagaggcgggauuacaaaggcuuuucuccaucuguggacugggacacgguaaacuuugaccuagcuccaucaauucaggaacuaccuauccagucagcuaucacacaaccucaagauggggccauuguagagucaggcgaggugacuaucaagggcuaugcauggaguggugguggcagggcugugauucgaguggaugugucuguggaugggggacuaaccuggcaggaagcugagcuagagggagaggaacagugucccaggaaggccugggcuuggcgaauauggcaguugaaagcucaggugccggcugagcaaaaggaauugaacaucauuugcaaagcuguagaugacaguuacaaugugcagccagacacuguagccccaaucuggaaccuucggggcguacucagcaaugccuggcaccguguccauguucagguggucccaugaaagcauggaauggcaccauuuguacccaaagaaccaccuagaccucuucaccaacccagccuuaauccucauugcuguagauaaacauuuccuuccucuccuugauucguaaccuuguacguacugugucuuaagcuguaccccagcacacacaucucuucuggccccugacccugugcuuggagagaggcugcucgggugagagagcagcucgaaagacacugcuuucuuacccuauggucaucucuacuucugaugcccccccaucugggccuuauuuugcauugcuuagauucuucagaugugugugugguguguggaauguguaauuacuguacauuuuucuuuuucuucuucaucaucuucuuguuauucuuuuuuuuucccccuuucaaaacaggguuucucuguguagcccugguuguccgggaacucacucuguaccaggcugaucucaaacucagagguuugccugccucugccuccagaaugcugggacuaaagguuugcaccaccucugcccagcuacauaacuauuuucaauugccucugggaugcaaggggauuucccucuuagagugcuacuuuuaaaacuauuccaauaaagugucuguuuaagauuaugacugga

SEQ ID NO: 5829 - RNA, 656 nt, Mus musculus
gcuaucuuuuuuuguuguuguuguugguuaucagauagucuuuuauugaaauauuuucuuguugcuucuuaacuagcugggcacuccacugcaccacuguugaugucaucuaugaugucaugagggugguggccauccacauugcagcccacagacugugcaguacccaggaucuccuugauagucccagaaaguucucuagccaaagaccggugucucaucugcugggcaauguugacaaucucaucaaaaguaauguucccacuguguuuaauguucugcuucuuccggucucuugguggcucuuugagggcuuugaugaucagggcagaggcagagggcaccaccucaaucugggccugucuguuguggauggucaguuucacuguaauucugagaccuuuccagucacugguagccuuggcaaugucaucaacaacuuucuucggagacagacccagaggaccgaucuucagggccaaggcggauguggcaccgaccucgccuccggugcaccucagguacacgacuuugaccucauuggggucgaacuugggcggcaugguggaggcggcuggugucggaugaaccuggauucgggacgaccgaagaaaguugcaccguugccuccuccaagccgaaagccgaaaagcccc

SEQ ID NO: 5830 - RNA, 19021 nt, Mus musculus
cgaggaggaggaggaggaggaggcgaaggggguaggaguuugguugagcugcagcuguuugucuguuccacacaggcuugggcccgacgggggauacggagccccagguaccgagcugauggagcccacaagggcagaggcggaggucccgagaggagcgccgccuggccuguggcagaggcggggcgggccgacgucagggcuccagaaccuccuggagagggccgaaggggcugucccacaggccuagugggcgcugaggaggugaucggcagggcugggagccgagccucuaguugggaggcggcuggguucuggcugugguggccgcucgggggccgggcgcggggacccggagccggugaggaccagggccggccucgggacucugagcaccgcggugaggagggaggagcuggggucggagaccaggcagugagggaggggaagccagcccauuuggcuggagguguggaggggacagugcuacgcccagccccgaggguagccgaggcugggucucccgagacauccacuguuggggcucuuagccgagagaggcauucuuuucagggaaagugacuguugaaaggggaacuagggguacugguguugccgagagggauuuggucucacugaagucaaugaagaauguagaagaccaaaguggaaggaaguagaaacgguuugcuauuaguaaugggaacuucuggaaugauggugaggggaggcucaguaucuuggaaguuccuuacucuucuguuccuuuagugcuuggguguggugauuugaaguuuugggguacuucaggaauagggaaugaagacaaagguaaaauuauguauuauuccauggcgccuggcagcucuacguccagccccccccccccacacacacacaccacuuuaguuuacccugaccucauagcuagucaugacugcacuccuguuuccuuuagguuugcuauuguauucguuguuuuuccuauuucaucuacugugagagaacuaagaaaauuugggagugcuuugcucagucuuucccacuucauaaugugaucuguggugacuacgcuuauuuaaccuagauuugaggaacucugucauuugcauggaaaggggcaaagcaauccccagccauuaaaaaaaaaaaaaaaaaaaaaaaaggaccauguuuauugaaacuucugugagacuugcacuugagcauuuccuagauaguuaaugggacagacuauucacgccaggaacugugaggugauaucccugaagggauuuggggaagaauugagagguuagcuaccagaagguuggcaccauccuuucuucuuugcccacuuauucaggaacgugugugugugugugugugugugugagauuaguuauuuaggucaaaccuugagguauuuagaaagauggauuauagagaaugaagaagucuuuaaauuauauuauauguaauaaccugcauacauaugugagccacaaugucagaggauaacuuguggcuguuugguauucaaacauggcauguguguguguguguguauguaugcauacauauauacacacacacacacauauagagggagggguuugcuaaccugucaaauuuuuuauagauuggacccuauugguuucucccuuaggguucuaccuccucuuccuccuccucuuuccuuucuauacuaauguuagugaucacugaauuuauuuauuuuuuuuaccacauaguguccugcauauauaccacaugcaugcaggaccccucagaggucagaaaagguacuagacccgcuggacaauuaggagcugccguguuggugcuggaaacugaacacaggucucuuacaagagcacuaagggccgccaagccaucuccauaacuuguaucacuacauuucuuaauuaucaaaguaacacauacauauauuaaaguguuuaagcuguacagaaauauauaaaaucugaguccuucuauacauagcuuauuucauuuaggacaguuagagguauuaaauaagacuaaucaagagcagaauacuauggaaagaaugagaccaucauuuagugagcacaugaaaaaaacccaagcaaagacagguuuuuuucaugugcuccuaaaugcuguucucauucucuccacgacauucucuuggaugacacucugcuauuuauuguguucccuuugccguucaucuugccuucuaucaaauucagaacaaacauagagcuguccuuugaguuaucauuugccuucuucaguguauacacauaguggugcacuggguagucuagaaaccgcccaaaugcauaauaagcaagacuuuuauaggcaagaaagaaacaauaaggggaauaauuuuguuuaggauaguuguuagcaucucuacuagagugaagaaucagaaaccccucguucauccacauuuucacaguacuugacugucucuuccuuaucucagggagauggucaugguuccagaagagggucuuguaccuggcuugguauagugacccaagaaguucccauauuucucugaauuugaacuuggacuuuuuugacuuuuugaagcccucuaauauggucauugcacgguguccagcaaaaaccucaguuuaccccuccucccacuuucucaccuacacagucaguccuggagaaaacuauugggauguguguauguguguucacccucuguaaucuuugccauccuuuuguuuuguuuuguuuuguuuuguuuuucgagacaggguuucucuguauaguccugacuguccuggaacucacuuuguagaccagccuggccucuaacucagaaauccaccugccucugccucccaagugcugggacuaaggcaugcgccaccacgcccggcugagguuuuuuuuguuuguuuguuuguuuguuuugguuuuauuuuguuuugcuuuuccuaucuucuccuuaaaaccuuucaagaagugaucuggaagcugggcauggugguacuugccuuugauuccaguauucaggagacugaagcagcagaguucaaggccaggcuaagcuacauaacagacacuaucccaaacaguaucacuacugcccacaagguuuuguuuuuguuuuuaaauuuaggguuuaggauuguagccuagugguagaauauaugauuagcauuuaccagauccuaagcacaaagagaaugaaaauagagguuguauuuggaauugcuaaaauuuaagcuguaaauuauucauagugacuuaaaauauuaucucccaaauuuaccaaagucuucugcauauuuagggagcuaaagaggcuuagcaauguccaauuucaaacacaggccuggaguuacaguaguauacuaggagaagagggcuuucuuggucccuuaaacaucguacucuguaucuucucuuacuuugcuuuagugcaagaaugaguccguggugguuugcuugucuguguguguguuaauacauuuggcuucugagaaggagccacagaucggguaggagaagcaacagacaccuacuuccuaacccugagacaucucaggugggaaggggaucaguagcacagcuugugugaggccaaauggaaucaaagugugaaacagugaacuugaaguaaggaagcgcaauggcccuccgagaggaaggaugccacaaaaccauagacaguauauacucuuacuucccaagaaaguuucaggaaagacuuagucauucauugaacaacaacugaauugauaaaagaagucacccggugaggagaggaaaguacagguuucuggaguggcuagaguguaccuuucucuuagggguuguggauaccuggcugucugugaccuuuauuucuaaacuuguuucucaaggccagggauaaugaccuuuuuaaaaaacugcuucucaggugugguggugcacgcccuuaauuccagcacucuggaggcaguccuaucucugaauuugaggccagcccaauguacaaagagaauucuaggacugccagggcuauuacgcagaaaagcccugucucagaaaacaaacaaacaaacaaaaaucugcuuaacaucaccuaaaaccucaaagagguuuguuuuuuaaggcacuaggaguugccucaguguuacagagacacugugauuaggccaugggagacauaauaacggguggcaggaagagcaguuggcccaugugaauuacaacaguacuguguggguggggucacuccaucggaagagaacuguucuaaaaccugucaagaacucccuaaacugaacugaggucuauccagggaggaguagguuggggaagauuucaggaauacuuaaugaacuacuacuacuucucugaagguuuauaauuacacguuuuuaaaaaucccacuuuuugagaagguuuagcagaguaaauggauauaacucagugugguaaauacaugauaggaauauguugcugguuggggagauagcucuacagguaacgaaagguauugaaagcuugaugaguguucgagucccagagcccacauuauggaaggagaaagccaacucccagcggcuguccucugacugccacaaauguacuguggcagucaagcacacauaugugcacauauacacagaaaguaaaugguuuuaguuuuuuuauguuuuguuuugcuuugcuuugcuuuguugacacaggguuugucuguguagcccuggcuguccuggaacucacuuuuuagacccauuucucuggcucuuaagucuuggucauaauuagcuuuuugggguagucuagagcaaugaugaauuuuacuaucauaaggagauaauuauguaguuucacaagugacauuuauacucaacccuauaaguuugggauuuucuagguagacaaauuagggaagguguucuaaucuuucccaagucaauaauugggaguuagcacugccaugcugauaagcgauaagcaugcuuuuuaccuuuuggagaaacaagggggagcagggaggagguggaacucuuaagccagugacucacuggauaauguugaaucaacaguuaaagagcugagcuaaguaguagaacucucaguugaagauuucagugauuugggucuaaagcaaguagaaaggaaaugaagguauuuguuggcuucugccccaucuuccuuuaguaaaucucacauugacuccaaaacucacugaauccuacaaauugccacaguuucccuuuugccaacuauccaggcagggcuuguuuaaggccugcuacagaggaguaauggcaauccuaucggaacagugugagaauagauccuaguuaggaaaguuuccaguuccaaagcaagcacuuagcggagcugaacugagacagaagcucucucugguguacacucauauuuguauuuuaguacccucaccaaauuaagcauuccugauucuuugagaaguauaguagagggacuggggaaauaucucagugggaaacaugcuuuuuuuucuuuuucuagaccgggcuucucuguguagcccuggcuguccuggaacucuguagaccaggcuggccucaaacucagaaauccuccuuccucugccuucugagugcugggauuaaagguguucgccaccacgcccagcuccuggaaacaugcuuuugaagaccugauuuuaaucccuaaaacccaugugagggggaaaaaaccugucaccuacauguaguuccaggucuggcgagguguagagacaaacagauuaugggggcucacuguccauccuucugaccaagcacaauuggucagccagugagagacccuguuucaaaaaaaucaaauggacggugcuggagaaacaucucagcauccuccggucaucauaagcauguuugcacacaaacacaguaagaucuggugugucagugccuuuaaucccaccauucaggaggcagaggcaggcaaaucuugaguuugaagccagccuggucuacaguaugauuuccaggccagccaaggcugcauagagaaaccuugucuucagcagcaacaaaguacaauagagcuggauguaguuggcuuacaucuauaauccaagcaucugagcagccaaaacaagagguucaccacaaguauaagucuaucuuguucccaaaaauguuucaaacaaaauacaguggagggagaccaagugacauguuguaugucuguaaucccagcacauugaagacaaaagcaaaugaguaaaaguuugaguugaagaccaaccuaggcuacacagccacagccaaaaaaaauaaaauaaaauaaaaaauaauaauaauaaggaaggaaggaaggcaagcaagcauggugauauaaaagggggcagagauacuacuguccagcugucuauacugaaugccugaaaguuaacuaacuuuaugagccuguuuucucaccuguaaaguagaaauggaguauuugacauauggacuggcuuuuugcugacugaccuuacagggcugacauuugagacuggacagagugugguggccauguacugggaacucuguuuacugacagaugauagaucuccagaaguuuuccauagauguaguguacugaguugaagcaaguuauggggaauaacgaaggacugcagucucccucuaguuggggcugacaggcuaacaaacccuuccuguuauuuggacuuugcaguggugcuuggagaacauccucuugugucccugcccaguggggugaccuguggacagaccucaguccucucaaguuagcagguguuuccuaagcugcuccugucugugaggcugcccuuucuuuuugaucuugcaguguaacuuuggcugggcaagaacucaguaggcuagguugacugucaacuuuuauguuuucagacaaggucucacuacccuugacugaaaaagaguccucucuccaggaaggcuguuuguucuuuagaaggaacaaaccauuagcuguguagaaggaaggugacacccagcuagccagccacagccaaaucaacccucaagguuacagucagauugcuguuacuuuuuuuuuuuuuuuuuuuuuuuaauuuaaguggaucauuugcccauugucaacucuuaguugaaaaaaaaaaaaucagcugggaaugcuggugaagaccugugucagcacuuagguaccugaggcagggcagcuugggcuacagcuacaaggcucuauaauuuuaguaccaagguugagggcucuucuggucccugggaugcucuguauuaaguucuaaccuaaacaucuaaaaguguuuuaguagcccugauagcuauaggcuggccagagacagcuucauuccaccccucugauuucaagaucauuacuguuauagagcccacaguuugagaaacacugcacaguugguaaagaagcaaaauaguugugauuugcaggaauaguuuucagauuucuuggacaauuguguaugguguccauauguauagauguacacacauacacaugaaggagccagacuaguuuggaacuuacuguguagaccagccgggucucaaacucaagagagucaccugugucugccuccuaauaugugucuccaauaucacacccagccagagugugagucuuuagaacaguagcaggaaggcagcaagauggcucagcagguaaggauacuuguccaucucuggaacccauauuguaggaggagagagcaagcucuugcagcugucuucugaccuccacacacacauaaacuuagugguacuguaagucagggcuauuaggacuguugguguaguguccacagggcacagucaucugugagucccaugaucacugcuucaacccucugcuaauccuuuuuacccucaccuucauucccguuucuuuuuucauaucuugggugcuuugcaggaauauaguaauaauuaauauauguaaauguuaaauauaaauaugggguagcaucaagagaccagaaaaaaaaaaucauaguauggugcucaggaccugaaauucuaucagauggaggccagccuaggcuacauauuaagcaucaagccaacuauguagugagaucuuaucuaagaaaacuaagggcuugguauucaaaauacuugccugccuagcuugugaaaauccucagaaccauccagucaaccaauaaaucaaucaguaagaggaggagaaaacacacacacacacacacacacacacacacacacaccaguugcauacuaguguaccugugguuggacaggccagcuaaaguuugccgugauucaggggaaaacuuugaagaugugucagggauuuaagacuccuuuucagucuccauuucagcucccuugcuagucauacucuggaagagcaaucuuuauugcagaugcaguucuuuguguguauagaugauugggaggacuagacagggugggccuuaagcuagugauggauccuccugccuagccuccugaaugcugggauugcagguacauagcaccacacuugcccagaagcaguucuuguuuugcucuuuaccacucucacugaaggucagcuguguaggaccuuaucagaagugugaguaaccuuucaaugugguauaguuaauuaccagagccaaguuuuagaaacaaggaaaugagauucuguucuuguucuaaaaagugauugugcacaccuguaaccauagcacucagaggacgaggcagggagaucacuguaauuucaaggcuagccuggucuacaugguaaguuccaggccagccacuacuauucaaugagacguugucucagaaaaccagaauaaacuuggcauaaaauccaugugggcuugccggucuagcacuucagugggagugggugaaggcagaagaaucaggaguucaagucacucugagcuaucuagacccuguuaaagaaaccuuauugaguuuggugguccuugccucugauccuagcacuugggaagcugaggcaggaaaauugucacagguuuaaagccaaccuggacuauauaccaaaauuuuuagaccaucucauaaaacaaaacaaaaaauguuuuuuuaaaaaaugaaguuuagccgggcagugguggugcacgccuuuaauuccagcacucaggaggcagaguaaggcggauuucugaguucaaggcuagccuggucuacaaagugaauuccaggacagccagggcuauacagagaaacccuguguugaaaaaccaaaaaaaaaaaaaaaaaaaaaaaaaaaugcaguuucaauggaacugugucuaauuucaucuauuuuuuucuuuacaggacuguugaggccuggaagucccuccccuuccccuucccccuuugccgcuuuguggcauuccccucccucuaccuucuccuacuuugauaaccuggcuaugacuagcagaaguacagccaggcccaaugggcaaccccaggccagcaaaauaugccaguucaaauugguccugcugggagagucugcaguggggaagucuagccugguguuacguuuugucaaaggacaguuccaugaauaccaggaaagcaccauuggaggugagugcuuaguaggaagguucaacacuuaguaggucuugaaaagaacaucugggacaugauuuuagaacugacucucaggauggguuuuuaaucccagacaugaaaaaugcaggaagauuaggcauucaaggccauucuuaacaauagaguuugacaaggccagccuggccuaugugaggcccuauuacaauuaaaaagcaaaaucaggcugagcauggugaugcacgccuuuaauuccagcacucuggguguuugagaccagccuggucuauagaaugaaauccagaacagccagggcaacagagaaacccuguuuuuaaaaagaaaaaaagagagagagaaagcagggugaggcgcuucuuuccuaaacauggaaacacucuggaagcaaaggcaggggacugcuucaaguucucggacaguccaaggcugacacucaggaacuggagagauggcugagaaguuagaaacacauacugaacuuguagggacacacacagacacacacccaaguuugguucugagcaaaccucagguggcucacaacuaccugugacuccagcgagggggagguuggggggcaguuugcgaggaggguggucugacacauuuggccuacuagcacacaauaacuuguaauuuaaaaaauaauaauauaaauacuuaaaaaacaaauauauacauaacuaaaaaauuuuaaaaacaaauguucaggcccauugacacaggccugcuaucuuagauacuugguaauugaagguguggggaucuuaugugugcaacagagugaguuccaucagucuucauuacaaaccagauccugacuaaacaaaaaaggacuaggaauauaguucaguggguagaguacuuguuuaguaugcaaaaggccucuuguucaauccccaguucuauccccccagaauuguguugcuguaauggagcagugauucauauucagaugagucccuugguaaucaaucucacacccacccuuacggugcagcugcuugucagugagcaccgcucacuuaaugccuugcuuaagucuggguuggaaccuugcuaaagguuuuccuggggaugcuggagauggcucagugguuaagggagugugcugucccuuuagaggaccugaauuccuaguguccucagaaggugggcagcgcagaacuaccuauaaucccagaagucaaaccacggcaucccacaccucuucuggcuucuguagguaucugcauucacaugcaugcacccauacacagcauacaaauauaugguaaaucuuuucuuuuugauaaaauuuaucauuuuacuggaaaaaaauaugagucaaugagauggcuuacaaguuaaggugcuugcuguacuaaccugaagauguggaaggagagagccaguuccacagaguuguucucugaccuccacaugugcaucuuggaagugugucauucuaguaccugccaucagguuuuaaaauccugugggguugguuuguuugagauggagacuugaguaggccagacugguauagcaagaaugaauguccuugucuuucuuucuuuucuuuuaauuauuuauuuauuuguaugguauguauguauguauauauguaugugaguacaccacagcuguacagaugguugugagccuucaugugguugaugggaauugaauuuuuaggaccucugcuugcucuggucagccucagcuagcuccagucaacuucacucgcucagucccugcuugcucuggcccauaaguacauaaguacacuauagcugacuucagacgcaccagaagagggcaucagaucucauuaccagugguugugagccaccaugugguugcugggauuugaacucaggaccuucggaagagcagucagugcucuuacccgcagagccaucucuccagccccggccuugucuuucugauucuccuuccuccaccugccaauugcuagacguacagguguguugggcccugaaaaucuaauuuuuaaaaguuacuguuuuuauuacuuauuuaacuuuuuauauauaauuuauauuuuuauguguuuugacugugugagcauguuggauccccuggaacuggacuuauagauagucguaagccgccucagggguauugggaauugagcccagguccuaugguagagcagccagugcuccuuaccucugugccaucucucuaggccuuauucaacuuuuaagaaagauuccuuucuuuguguguguguguuugugugugugugugugugugugugugugugagagagagagagagagagagagagagagagagagagaguguuuugccugcauguauguauguauguguaccauaugugugccuggugcuugcagaggacaucagaucccuggauuuggaaugauggaugguugugagccgccauguggggacuggcaacugaaacuugguccuguguaagaaccagugcucuugaccacugacucauccugacagagaucuaccugccucgaccucccucguguugggauuaaagacacaacaccaccaugccugucuccuuguaauucuuuuuguuugucuguuugaauguuuuuuaugguuauagauuuauuauuugggguauaugaauauuuugcucaguugcguauuugugcacuguuagugcuagguuagaagaggauauuggauucccuggaagaugaauugcauguugugagccacaguguaggugcuuggaaucaaacucugacaaaacaacaagugcucuugacugcugagccaacucuccacuuucuccuccuacuucuugacguacucuuauacuuacugccuccuuuuuuuuuuuuauaaagauaggguuucuuuauguagcccuggcuguccuggaacucacuauguagaccaggcuacccucaaacuuaaagagauccgccuaccucugccuuucuagugcugggauuaaaggagugugccaucaccacccagcuuggagacuuuuuuuuaauuaauuaauuuauuuuaauuagauauuuucuucauuuacauuuccaaugcuaucccaaaagucccccauaccuuccuccuccccccccccccccagcucggagacucuuaagugaauaaaugaacaaauaaaucuaaggguuccuuuggcccagccuggcuuuaaacuugcuaaauagucaagugagaccuugaacucuugagccuccugccuguacucaaacauucagaagccaucuugcuccuguuucaaaaguuacaugaauggaggacacuaacccuguagcuggugggccuugguggcaacuggucuuaggaugugcagagguaacaugaaggggagugggaucuucccacccuuugucccacuuacaacuuguucauuuucuccuucauagcggccuuccucacccaauccguguguuuagaugacacaacagucaaguuugagaucugggacacugcugggcaggagcgauaccacaguuuagccccuauguacuacaggggugcccaggcugcaaucguggucuaugauauuacuaaucagguaagugggcuaagaaaacuguucacugagcuucauagauauuaaguuagguaggagaggaaagaguucuuaaauagcaagaaagaaguaccaacuaugcuuccaagcacuaagccggaggugcagguugucagagaccuaugauuucagggaagaaagggcaccugaagaggagagguguggggcugagaaagugaugauuguggacuggcacucauuccagcacauucucucucauguuuucccaggaaacguuugcucgggcaaagacauggguaaaggaacuacagcggcaagccagcccuagcauuguuauugccuuggcagggaacaaagcugaccuugccaacaagcgcaugguggaguaugaaguaagguggccuacagaaucccuagcacacuuggucuguaugugggaccucuuuuucccagucuccugaaauuuucaugugaggcuuucguugucuccuucccuaguuguauaccagauuagauacagcaacagugugaccaaauggcagccaacagauuuuaaaggaaucagaagaaaguuccagauuagagggguagggaaauagcaguuguaggguaccagggugaaaacaggaagcaggaaauaguuagauuugagguaaggaacuauugacauaccauagcccaaagaccccugucaguuuacccugcuccauguuaagauucuucacccugggguaaauugcuuguguggaaggggggaggcuuggauucccagcaucaauuaaaaaggcguggugaggcugcaccugccugcacucucagugcuugggaugucucuggggcuuacuggccagcuacucuagcuaaaacagaguagcuguuucaaguucagugagagagguugucuuaaaaggcaauaagguagggguuaguaagauaucuacagguaaagguggggccuaaguucaguccuuggaguccaaauaaagaaggaaggagagaacgacuuccgucauugacucugaccuccauaagcauaccauggcuuucagccaugcacacacauacacauguguacauauaugcaaauaguuguuaucugugccuuggaccacccgcugccugacccuaccugcccuuggguauuggaagugaggugguguggaaucaacaacacggacugagacuucagcagcacgcucaucugaacugcugcaagcuccuuuaauacccucuacucgugccccauugguccccaaaacagcaguuuggcugacauuguuuacauaaauaauccuuggucucaagcaguccucaauuagguccuccugcaggagaugccuuugcagcuguguggccccaauauuuauacagagguggcugugccugugccuuuccuccuacaaacaauaaauugaaaagaaaaaaaaaagaaaacaaauaagaugagcaguaguuaaggaagauacccaaagucaaccucuguccucuaccugcacaucuggauauguguacacacagagauuccugacaucucuguugaauuuaguggcacggguuuaucuugaugggaaucauuacuauauuauggguccagggcuauauauaaaguauguauuauauauuauauaccagggucccuauauaaaaggucauuaagaggagagaacauaaaauauucuuucaugcuagaguacuacuugagaauauaaaagcaaugcuacuuucaucccuuuuaggaggcucaggcauaugcagaugacaacagcuuauuauuuauggagacuucagcuaagacugcuaugaacgugaaugaucucuuccuggcaauagguaaggucagaguggucugaagucuucuuucucuccuuguagguaaagcugucauuaacccaaaaccaaggauaggguuuuauaaauuacuguagguauggggcuggagauguaguacaguuguacaauacuuacauaggagauggaaggcccaacacugccaagaagcaaaacaagaaaaacuuaauccuaaaguuagacaugguucugcaugcuuaucauccaguacuugggaggccaaaacaggaggauugccauaagucugaaacuaauugcacuacauaauaaguauuaggccagugguucucaaucuuccuaauucugcaacccuuuaauauauuucaucauguugugauggccucaaaccuuaaaaugauguuguugcaacuugggcagcagaagcuaauagaucgaucgcuugugaguucgaggccagcugggucguuguaaugaauuccuggucagauagagagacccugucuuaggaaaaaagaaagggggcuggcgagauggcuaagcggguaagagcacugacugcucuucugaagguccugaguuuaaaucccagcaaucacauggugacucacaaccaccuguaauaagaucugacucccucuucugaagugucugaagacaacuacuauguacuuauguauaauaauaaauaaaucuuugggcuggagcaagcagggacugagcaagcagaguugaccagagugagcggggguccaacaagagcaagcaaaggcuuuaaaaauucaauuucuaacaacuucaugaaggcucacaaccucaucuguacagcuacaguguacccauauacauaaaauaaauaaauaaaucuuaaaaaaagaaaagaaaagaaaaggacgaaaaauacagccagggcuagcuauguguugaaacuugugucaaaacaaaaggcaaaacccaaacccuucacucuggcaccguaaugcauacgcagaaucucaccagucagggcagugggcuaacacugaaagauugcagccuaaacucuuuggcaagauucauugaagcacaccuauaaucauaauacuugggacuuagagacaagaggaucaagguugucuuuggcuauuuaguaaguuugaggucaaccugggcuacauaaaaccugauuucaaaacaaaccaaaagugggccggagagauggcucagugauuuaagaguacauacuguucuugcagagaacccacuuuuguuuccaaguacucacaucagguggcucacaaccaccugcaacucuagcuccaagggguaugacaccucugaccucugagggcaccugcaucugugugcaccuagccacucauacacacauguaguuaaaaacuacaaaagaaaccaaaaaaaaccaaaguggcauaguggugaacaccuguaauccugccauucaggaggcggaguccagaggaucaagaauuugaagcuaaucuggacuacagaaagaaaccaaagucagagguuuaacaguggguucagucccuagcaccucagacaaaaaaaucuucaguguagaaacagcuucacuugcuugguaacguccauccuuggguggcagcuuuagcucucuguguucagugagguuugcaaaaacuugggcccucuucaaaucauuguuuuaaucucucuuauccccucucaauagucgucuuguuuggggugggaaguguauaugaguaaaaucuaccauacuuuguucuguuuuauuuuuagcaaagaaguugccaaagagcgaaccccagaaucuggggggugcggcaggccgaagucgggguguggaucuucaugagcagucccagcagaacaagagccaguguuguagcaacugagggguggcucgaagcaaauauguauggaguuagcacgagagcuaagaaauaaccuccauccccaccccucagcacacagucccuacgguaacagcacacugagcccuggcucccaagggcugccuccugacagcuccgucauggcacuuuuuaaugcuucagcaaccaacaccaggcagcuguugccacuacuaugcccuaccuggggcuuggggucacaucuccccaggaccuuccuuccaaaacaaacuucuucacuucguguucuaggugcaagacagugaccuucucauugucccccacccccguguuuuuccaguguuucagagaagacuucugucuccugccucacaucccaccuuucaucauuacucccucuucuugauccuguuucuccucuuuacaagaugaugaaggguaaucccagggacugagaagggagggauauacuuuuaguuacauuaaagaccuuguggggagaguaaggcucgcagcaggagggagugaggaaacauugcuuucccauuuuauuuaucugguaagaguuucuugucuaugaaacacugcggcaccaaugaguaggacuuguggagggcguuccuagguaggagugagaacagggagucaagcucgcaggcacugaaugggaguuuauuaguaggacaaagguugaggugcagugucauccguggcucuggaacuugccccgaggcugguuucccuuuuguccccauccacucaccccacucgaguguggggauuggaccucagagugcuccaaagaaucuucacugguugccugcaccuuuagcucugcugugaucuaauuggaggagguacucugauaccguccucugaggccuauguauacauaggcauuuccccuacccuggccuugagauggccuuaaccccagacaccaugccccugcaguuugcacuuuaauugaugguaguucagucaagauacagguuuuuuuguguguggggggggggggguugauugauuuaccuauccuucaaccguuuuaauuaaauggaaucuacaaugaaugagguuuggcccuauagaagacaguagcaguggcagcuacucacacccagucuccacugcuagcuuccugacugauucauaccucuauucuuggguauagguuugucugagcaacuggggaguggccucagaauagcaugggccaugguaguggaguaaagaaaggucaggcaaaaggaguguucuaucuucccaggguucacauucaguuugcuaugucuuaccaugucuuuucuacuucccuguaaauacguauaagucuuuauucucuguacagucugcucugccuccuggcucccauuagccuucuuuucuucuccuuuuguuaauaucuuggguuuaguuccuccuucauucccccacuuacucuuacuuaauccguguaccacuaggggcuccuaccacaaaggcugcuuguccaaugacagggcagcuagaacugaaggugccucacaacugccuuguaucaucagagggcuuugguccuuccuaagucucuggccucucuacguccuauauuagguguuugagggugucugugggaagccaucaaagcaagaggaaacuugguauuuuagccagaguuugggagaaacaugcagaagaaaggaaaagaccacgguaaccucgaguugagccuuucugccccuugggcucagagacugacuuguguuccagagcagcugaggaauccaugaggccaagauucucaaggacccaacuuagguuccuccacuuaggacucaauucucuuccuuuuccaggggcagccuuaguucucauggcccugaaacauauauuuacuuuccuagaaccuguucaucugcaaaauauccaggcacauccuuuuuacaaguggagacucgagggaagcucuccaagucucuuagaaacuuaauuccuucucugcaaaagugaagauguuuuauugccuuggggcugggaaaccauuucccuaggcuuucccucccucccuccuucccucccucccccccucucuuaggaacaguauuggccuuaguuccuggccuaccugcugccuucccucuccuccugccagcucuccugccuucgcuggagcucuguugggcuugagggguuuuguucucucccuccccucccccguuaccuuuuuucuuuugaucaguuuuuagggggagggcucaacauuuuugccuuuauauuucuuuccuaaggaagcauuu

SEQ ID NO: 5831 - RNA, 856 nt, Mus musculus
ugggaauagaaaggagugggagagcagacugcuuguuggaaauguguguauauauucggguccagugagggucagagagagagagagaagaaaaaaaaagaagagaaaggaaaagaaaagaaaaaaaaaaaaccgaaagaaacaaaaggcccucuaguggaaacagaaguaaguagucuucaaguauuuggagacaaagcuguugaagcaacucucuagaguagugggguuugcugcugcuguuguuauuuaaacuuuagauucagaucgggagucggagagugaccugucucuguucugcuguccuuuucagguuuguucugguuugcuugcauccugacccuucacugcuuuguuuuuguuuucauuuuuccucuuccuccuccaucacugucaccaccaugcugcagaugagcuucagugccuggaacgugcuucuccggugcugcaccacggaucuauaccgcuaccccacacccuucuucuuaacaguauaugcgucaccguuagcaaagucuaucuccccuuccuacaucgccuccuuacucacaguccaacaaacgauuuuuuuccugagacaagauuuuaguauguacauagccuaggcuggcagugaaauugccauccugguucaaccucucaagagcuggguuuaccggguuuauuggugugugccacuccugcuaucaacagacacuuuugaaggucucuuuauaccugaucuuguucuuaguucuuucuguaggauaagcaaaaacacaaacugaagcaagugccuagaugucuguaaagcuuccuagcucuugaucaccguaaacaaagauucuguuuaaauaacacuugugucccaaacuac

SEQ ID NO: 5832 - RNA, 11843 nt, Mus musculus
uggccuuggaaggaaacaguggagcugcaaagaagccuggcuucacuucaugugaaggcacaggggucuccucccagcucaucuuccacugccgaccccccucugccuugaaguguugacuuuccaaguuaugauuggugcuauggugguaaaguacauaagaaauaaauuuuagccgggcgugguggcgcaugccuuuaaucccagcacuugggaggcagaggcaggcagauuucugaguuugaggccaaccuggucuauagagugaguuccaggacagccagggcuacacagagcaacccugucucgaaaaacaaaacaaacaaaaaagaaagaaauuguaccuuauuuauuuauuuagacaggguuuuucuguauagcccuggcuguccuggaacucucucuguagaccaggugcuauggugguaaaguacauaagaaauaaauuuuaccuuauuuauuuauuuagucaggguuuuucuguauagcccuggcuguccuggaacucucucuguagaccaggcuggccuugaacucacagagaucugucugccucugcugggaguagaggugagcaccaccaagcuagacaaggcuguguuucuccuguuucugcugagucauagauuagcuggccugugaggcugugggcaauucuucugucuccaccuuccauuuuaccaugagugcugggauugugggugcuuaccacugagaauuauuuuguuuucuuuagacugggucucucuguauagcuuuggcuguucugaaacucacucuguagacugggcuggccucaaacucacggauaucugcuugcuucagcuuccugaguacugggacugaagguguucacuaacuacuacugccuggcaagaaagacuuauuuuuuuuuaaaagauucacuucuuuauuuuauguauaugaauacacuguagcuguacagaugugccuuuauguggcugcugggaauugaacucaggaccucugcuugcucuggcccaaagauuuauaauuauauguaaguacacuguagaugucuucagacacaccagaagagggagucagaucucaauacauauguuugugagccaccaugugguugcugggauuugaacucuggaccuucggaagagcagucagcgcucuuaaccacugagccaucucuccagcccccaagaaugacuuuuuacugcguuuuugugcuggaauucaagucaccaggcucaugugucaaggcucuucccugcugagccaucuguuuggcucacuuuaaguaaucuuaagguagaguuaaguggcauuaaaguaauucauauuucauagccacuaccaucucugaccuccagaaguaagaaaaauguauuuauuuuauguauagauauauagauggguccugaaugugugcaucuguacugugugugugguguguguaaugcccugggaguucagaagaggcuguagauccuuagaugauugugagcuuuuauauggguucugggaaacaagucugggcucacuugagagcagccagugggcuuaacugcugagccaucucuuuagcuccagucuucugcgguuuuccaucuguaagcgcacuuccucuacccucguacccagcuugucacaaugccaucagaguaccaucuuauuguguaggaguuuuacucaguagucugaccagccuguccuuccccuccaguucucugccucccuggcuuucuccuguuuccccaaccucugccacuacugugccucugcugcagcccuggcccucccucccuuuggcauucccccuggguggugguaacucucucaucugcaugccagcucuccuucugcucauucaguuauguccacuucuucucuugcuccuggaccccaggacauagugcaggagaccacaccaccugaacugaccuuuccaaacugcuuaggacuuguggcucuugcuggucuguaagcuucacuuuucccuucccuuuccuuuuuuuuuuuuuuuuuuuuuuuucuuuugguuuuucgagccaggguuucccuguguagcccuggcuguccuggaacucacucuguagacuaggcuggccucgaacucagaaauccgccugccucugccucccaagugcugaaggugugcgccaccaggcuccgcuucccuuccuuuucuuguuuucuuuuacaggucuccagugaguggggaaaaagcacgggcuuuagaguuuuacaucucugauucuuuuucuuuuuuuuaaaaaaauacuuauuuauuuuauguauaaugaguacaccguagcuguguuaagacacaccagaagagggcaucagauuccuuuacagaugguugugagccaccacauggcugcugggaacugaacucaggaccucuggaagagcagucagugcucuuagccacugagccaucucuccagcucccacaucucugauucuuuguaggguguaugcacugccuggcugucuugugcuuccuaccuugggugccugucuccuuucuugggugauacucccauccuccucuugugaaugaucugggcuuacauucgaagacaggcaggguguggcagucuccuuuagucccagcacucaagaggcagagucauuguguggucauuguuaguguggucuacauagugaguuccaggacugccagagcuacauagagauaccuugucuaagacaaagaaaaaaaaaaguaaucaaacaaaaaaaauucuaagacuguccuaacuggcucugggaauguuacucuacagugucaagccaguuuccuuaucuguaagacagaaaagaggccagcaggugagggcauuugccucuaggccugaagucuuucgaucccuggaacccacaugguggaaggagagaacagacuccugaaguccguuguccucugaccuccacccacagaauauaaauaaaacaggaaugauaacauugacaucacgggaggaggaguaacccugggugaacugaggaaggaucuacacaaucuccuguguagccucuuuacucccuacuucagguucucuuucuuuuguugugugcauauggguguggagaagcaccaagcacuuuacugaccaagcugucucuccagccucuccuugaauuaacuaauuaaaucauaauuauuaggguugauauguuauccaggcuggcucugaaaugcuggacucaggugauucuccugccuuggccuucugaguagcauggccauaccuccauaucucuaaguucugguaggguguagccuccuggacgaaugccagucgugagcuuccuagguuaggugacuauuuccuuuccugggugaugccuccguccucucucuuauggacaacgacugccaucucagugucuuccagguguccggauguuuagucacuuagugcuucaccuucucagaggcuccagcaccuaccuuccuuccuuccuuccuuccuuccuuccuuccuuccuucucaccaucucugcuuguggaaaagugucgucuucuagaccucaccauucugcuucuaaccaucuuuugcuucauuuauuguuuagaagaauuccagacacauuacaggcaugacaugcccuucagugugcaccuuuaaagaacgugcauaauuuuccugccuuaucuuuugguuuuuccagacaggguuucucuguauagcccuggcuguccuggaacucacucuguagaccaggcuggccuugaacucagaaaucugccugccucugccucccaagugcugggauuaaaggcgugugccaccaccgcccggcuuccugccuuaucuuaccacuaucaaagccagcaaacuuuauuuuacuuuguuguuguuguuguuguuguugcauugguagagauagaauccaggacugcacauaauaaacaaauguucuaccacugagaucauccccuucaagccuaauaaacuguugucaagucuaauucucccucccuaucccugaagacaagaauuugcccguggccaaagguugccuuggggaagacgguccaccucggaggaauccacucccucccugaacuccuguggcucuccaggaguuucugcccuucaguucagauagaauauggaucuaccuucuggcaggggcccucucuuucucuccuugcuaucuggcaucuggcgacaacacaauaagaaaagucaugaggccagguagugguggcacacgccuuuaaucucagaggcaggcggauuucugaguucgaggccagccuguucaacagagugaguuccaggacagccagggcuacacagagaaacccugucuugaaaaaaaaaaaaaaaaaaccaaaacaaaacaccccccccaaaacaaauaaacaaacaaacaaaaaaacccccaaaacaacaacaacaaaaacaaagaaagaaagaaagaaagaaagaaagaaagaaagaaagaaagaaagaaagaaagaaagaaaagucaugaauacucuuuucuuuggcauuuugacuucuuacccauauccugccagguccaggaugugccuagaguauuccgcugggaggacauaauucauaaaacugcuucuuagcuuaggugauugccugaucuuugcauuuucuuuuauagaagauuuacaucucgugggaagugaagugaguguguaaggggcagaugagguacugaauaauguguauuauugacaugggcacacccguggcuuuuuuguuuguuuguuuuuguuuuuuuuuuuccuugaaccagggacucuauguagccuuuguugauuuggaauuccaggcuggccuggaacucagagcuccaccugccucugccuccuguugcugggauuaaaggugugcacaacuaucuccuggauuuaucacaacguugggacuaguggcuuauuuaacauaccaaauggaccugggcuccacauucucccgcucucccucagucucuaccuauuauaggcugggaugcccggcccucuaugugaaacuuuccaacccaggggcugggcuuccucucgcccauccgagugugugugugugugugugucucccucuccccucugucucucugucucucuuucucucugugugugcuugaguucucuuccucuuccccuucccuuuugucucccccaagagcuacccccacaaaccugcuuucauacuuuaauuuggcuuaaauuggcucauuucguuggcagagaguaaccuaucacaugacauuuccauacaugaauauuuacccuguuuuuccuuuuccuauucauccccuguucucuuuucccucccacgucacuaauaauaauucuccauuuacuuucauguccuuuuaaaaagccguuccggaguccacaugugagagaaaacaugugaugucugucuuugugaccacggugaccucugguuccguuuguuuucaugcaugcuacaucucucuggaugugugguguuugucuaugugugugagguuagagaaggaaguuagguggccagcuuuaucaucuuccaccuuggucccuugagacuggacuuggagcuaggcugauggccagcaagucccagugauccccuugucucaguucugagaugcuuguggagcuacaccugauuuuuaaaaaaauguaauuuuauuuauuuuguuuuuguauuuuggaauauuuauuuauuauuugcuuauguauuuaaauuacuuuuauucuuuuacaauccucccauucccuuccuguucucacccccacaguugcucaucccguuccuccucccaucuccaaaaggauguccccaccaccaccauaauuuuauuuuuugcuuauucacuuuacauccugcucgcuggucaccccuguccacauaguccuugcccuucccccuccccuucuccucugagugguggaggcccccccaccauauccugccacccacacaccugauuuuuuuuuuuuuuuuuuaugugggugcuuggaucagaacucagguccuuauguuugugcaagugcucuuaccuacugagugaucuuuccaacccuuaggauacauaauuuuaagaauauaugcguguauaugugcguguauauuuugccugcauguauauauguguaauauauauauauauauauauauauauauauauauauauaugugugugugugucugauauaugcccaagaaggcaagaaaauggcaucauauccacuggaauuggaguuacagaggucauaggccaccauguguaugcugggaauugaagucaggcacucuguaagagcaagugcucuaaacaacugagccaucuaucuccccagcccuuucuccuccucuucccccucuuccuccuuccccucuuccuccuccuuuucuuuuucuuccuccuccuuuuucuuuucuuccucuuccucuuucuccuuucuccucuucugccuccucuuccuccucuuucuuuucuuuuuccuccucuucguucuccuuuuccucuucuucuucuuccucuuucccuuccucuucuuccucuuuuuucuuuuuccucuucuuccuucuccuuuuccucuucuucuuccuccucuuucucuucuuccuccuccucuuccuccucuuucauuucuuuuuccuccucuuccuucuccuuuuccuuuucuucuuccuuuucuuucucuuccucuuccuccuccuccuuuuugagacagggucccagcauauggcccaagcuggccuguaagucaugauugcucuacuucagccugaguauggaaauaauaaacaugugcuaucacgccaagguucuucauuuaucugguacugauuuauuauucgauuauuuacucauauuuggagacaaggacuaauuccuuagacuggccucaaacuccuuagguagccaaggaugaucuugaauucaugagacuuaugccucuaccucaugaguucuggaauaauaagcacauaccacaaccaugccugguucaugaggugcuaagaauacaagcccaggcugucugcauauuaagcaagcacuuuaccaacugaacuacguccucagcucagguuuauucuuguuuuuuuugagauggggucucgagucguagcucauucuggccuugaacuuugaaugaccaagggauccucccguuucagucucccaaaugcuauacuuauagguguauaccacugauuuuguuuugguuggauugagacaagguguuguuguguagcccaggauggccuguaaccuucagccauccugccuucaccuccauagugcugggaaggacaggccucaccaucaugccuagacuucuuuguagccugggaacugagccugaguucgugacacaugcucuaccauagaucugcaugcauuuccauucgccauuuugaacuauagucucacuagcacuggguauacagcuuagcugguagagugcuugccuaguaggcacaaaauccugggucuggugccagaacugcauaaacuagaugcacuugugcacaccgguggugccagcacuuguggaggcaaaaugaccugcaguucaggguuauccucagcuacauauggaauuccaggccagccugggcuacaugagacccugauuccaaagagauagguguguguguguguggugucucacuaaacuguccagaguggcuuugaauuuuugauuuucuugugccagguguggugucauggacuuuuagugucuggaggcugaggcaggcagaucucugaguuugaggccagccuggucuacagauagaguuccagggcagccgggucuacacagagaaacccuaucgagagagagagagagagagagagagagagagagagagagagagagagagaauaugaaagugcugggauuacauaugugugccaccagcuggccuuuguuuuaauuguuucuuuauauacagucccuucccuucagauucaguaagcaacucaaggcagaaggagcugcggagaaaaggacaaaguucagguuaggaguguaaggccggucgguccuaucugagcuuuuuacaacaguuccuucugugaaccaccagcggcacacgggagaaagguauuucuaacucucgccuuuaccugguuuugccaucucugaugaaaagaggaauaagauacggaaguccaugcuauugccucgccggccuuaguguccuuucucacaucuccauuaaccacuggcuaauccaggagcaagggagcucuaaggcuuuguuaaucuuuucccaggagggcccaggcucugacguguuaugauugacgcauggaaacgggguucuagacaagggcuuccucaaaggguuuucucagcucaggaguucuagaaaauggagaagcuggggccauaaaacccuaguccagaauguugggagacuucuaggaugggaagcuaggggcuuucuggaaguguuuauucugacuucacccagugccacucaacccacaccuucugcggguggcucgggaauggggcggggggcagggccuugaacaaggacggagagggagcugcgugguggguacucgguggguugaggucugcagaugaccguuuugauacuuuggcucaguucugucuuugggcaacucugagccgccgugcguccucuggacucugacucgccuacuccugaaccagagagaaccagacggcgccuggguugcagagggcuccgggaacccugagguccggcuccuggcucgagccuuccaggcagcggccacguggccuuguccuggcggggggcucaccucccccugcuagccuggugacucaggccgcagcuguucccgugucacaugagagagagagggagggagggaagaaggcggccacccugcgggggaggggggcggccggagccggggcggggccgugcagcaggcggggcgcgggcagggggcacgggagacggcggcugagccgcggcaggagaguacugagaagcgucggggagcgcaggugagccgggcccggggacccgggggacguccgugggggcaacuuugccucgaaguucgcggggcgccauccgcgccgcacccgaggggaggcucgcgcccaggggcuggcgagggucucgggucgcggccugucgggaucggggaucgggaaucggcgcugugcagcggcgggcggagaucuaccuggaguccggccgcgcccuccgugcgucccgggaucccgagaucccgaggccccgcugcguggcgcgccccaguccggccggcgagcggggagggcugggagacgugggucugaccgcggguuucugggugggagggcagcgaugggggccgcgcagggaaggcugcgaaggccggcggggagcugcggauguggcggccccucggccugcucuaccugcucuaauccuugguguucuccgcggccccaggcccaacagccauggcgguggaaggaggaaugaagugugucaaguuuuugcucuacguucuccugcuggccuucugcgugaguagugcggggagagcgacggggcgcccgggcggggugcgggggggggagucuuggagcgggagccgugaagggugagggacccagagaugaaggcagcuggaggccagauguggaaggaaagcccagggaaaagggccaaaggcagaacguguccgcgcuaccucccuuccccaucccccacgcgcagcuuuccgggaccucugaguaaaguuuggaccgagaauugccauccuagacggggagcacccccaaccaacccccuccuggcccuuccugucuggugacccaaccauucgugguacggggugguggggcaaccugccaacggucugaugguaucgccaaggggcugucuccacuccucacaccguugauuccucuccauucucuuagcccucucauuuacuuggggguaggaaaggcucugcccuccuucauuugcuccucccuguguguucugaaaggggccacucuuuuuuuguuuguuuguuuuucgagacaggguuucucuguauagcccuggcuguccuggaccucauuuuguagaccaggcugaccucgaacucagaaauccgccugccucugccucccgagugcugggauuaaaggcgugcgccaccacgcccggcccgaaaggggccacucuuacccccuccuccgcccuagccuagcuggcccuaggaccugagucacuggagugaggggguaguucugggagagacucuagcugggaguccauagaaaguaacccauauccugugccgaagcgcuguuuaaaggcagcaugacaccucccgauucccuucuccuugugugccuuaaacaacuucccagccuucauuguggggcaaggaugggcagaccuugucuacagccaguguuuccuggagguguaggaucuaucuucugggugggggucgggugcgagggcuacuggacugaggaucugaccuaacucucgccuuuuuccucaggccugugcagugggauugaucgccauugguguagcgguucagguugucuugaagcaggccauuacccaugagacuacugcuggcucgcuguugccuguggucaucauugcagugggugccuuccucuuccugguggccuuugugggcugcuguggggccugcaaggagaacuacugucucaugauuacagugaguggggugugggagcucuugggggcuaccggaagccuuuucuguggugaagguggguggauggagaacaccaggaaagucucaguaauugaccgggucagagcaagcccuuuaaauccagacuucaaacccaacuccuguccucccacaguuugccaucuuccugucucuuaucaugcuuguggagguggcuguggccauugcuggcuauguguuuagagaccagguaagcagggaauggggggggggggacccaucucagguugcucugggaaucuggggccggaagucuguucucuacagcacccacuucucugcucuuaggugaagucagaguuuaauaaaagcuuccagcagcagaugcagaauuaccuuaaagacaacaaaacagccacuauuuuggacaaauugcagaaagaagugagugggauggccgggaggaggguuagccgggauagaagauucucaacucugaauuaaaguggagguuucccucccaucccucuucccuuccuagaauaacugcuguggagcuucuaacuacacagacugggaaaacauccccggcauggccaaggacagaguccccgauucuugcugcaucaacauaacugugggcugugggaaugauuucaaggaauccacuauccauacccagguagggagaaggagacaggagaugcuuacgggaucagaguugggggaugagaucuggggauagggguugggagaaagggacaggaggagggagguagaaguuucuguugguauucaugccugccccuucccuucagggcugcguggagacuauagcaauauggcuaaggaagaacauacugcugguggcugcagcggcccugggcauugcuuuuguggaggugaagaaugcugugggcuggggggggggggucugaaucagcccagggcaucuggggagcaggaggcaccggccugggaacaguggcuguuggauggguuuggggaagcuugcccugccuccucuccacccucauuuccaucuuuccuuucaggucuugggaauuaucuucuccugcugucuggugaagaguauucgaaguggcuaugaaguaauguagggguggggggcguuuggucuuuucauggaguggauucuccagguuuuucaauuaaacggauuauuuuuucagaccuaaaaaaggagaugg

SEQ ID NO: 5833 - RNA, 1467 nt, Mus musculus
ucuauauuugaacauucucuuucuucauugagauaauggcaaucuuuuugaaggaaucacugaaggcuugucuaaccugcuuauuucucagaguauaaauaaauggguucaacaugggagcaaucgaugucaucagaacagccacaccuuuauugauggccaccgauuccuuugccgaaggguugauguaaaugaaaauacagcuuccauaggugauugaaacuacaaucaugugagaagaacagguagaaaaggccuuuuuccuuugcugggcagaggggaaucucagaauggucuugaugauauguacguaggacagaguaacacacacaagggucagaaugaaggucagcacugcacagacaaucaccagcugcucuaugagccaagugucugagcaggaaaucuucaagauaggagaugcaucgcagaagaaauaaucaauaacauuugagucacagaaucucaaguuuaggaacagagugaguggugggaguaugaugagcaagccagccgaccaacagcagagaacaagcgucugacacaccuugcugcucaugaugguuacauaauguagggguuugcagauggccacauaucgaucguaggacauaauggccagaagaaaaaauucaauuacuccaaaaacaucaguaaaaaacacuugaaugacacaaacauuauaagugauugaccugucuccgguugcuauguuguacaaauaucgaggaauacaagcagauguaaaugaaauuucuaauauggagaaauuuuguagaaaaaaguacauggguguuuuaaggugggagucuaauauagugagggauaugauagucagauucccaguuaugcugagcauguaggcaaaaaauagaaacacaaaaauuggaaucugaaguugaggaucaucuguuagucccagcagaaugaaggugguuauuguguuguuuuucaucacuaacuacugaauuauucaacccucacaaaaaaaguagcgaugucuuauuugaaaaguaguggagccagagagcgguaaacagugaauguuauagugaauuuauuccuguguaguuucuucugcaaguggaagaugauacuguugauagucuugaguguuuagcuauucaauacuuuaguuuauuggcuucccaguuugugauauaucuuaaagaucaucuuaaauguuaugacauucauauucauuuuauacuuguaaucuauaucuaauugggcuuucuuguggcauuagacuugaauaacaauguguucugauucaauaaaauuauucuucauaugucuaauauuucuuuuguauuugaaaggugcacauuuaaaugccuuuccuggaauaucugguccgcaauaaaauauaagcauguaacaacucaucuggauuuugugagcaaguucucuugcuuuagcuguaacuuguaguuuacauuuugccacgauugauuaaacaugcau

SEQ ID NO: 5834 - RNA, 1014 nt, Mus musculus
auguguguuuuaucugucaccuuucuuuguaauuuugagacacuugcugaugccuuuauguaguuaguccuuuguauuauuauuugucaacaaaacucuauuaaucuugaucuuuuaaucucuagaaaugauuacuccuguaucagucauguaacugaguauaccugaaagaaaaguacaaaaugaaacacuugaugcauauaccuaauucuauuuuauuuuguaucuuuuaaucaaaccaguauguuauaacugguaaacuucacuacagguuucauacugagacaagcaauuggcuuaacuaucaggaauagucuuccuccaaagcucuuuguuuccaguucuauuccugauccucaguccaccauuucacaaauuucuagagaacuacauguagauacuuuuucacaguucucaaauuauccaguuuuuagaugaugaccucuuacuccuuguugcauuuuucuucugguaaccagggucugcauaaguuaugcaaggaccacugaaauacagccucaguuuuuauugaugcuuaauauaacuuuauuaauaccuaugcuauauccaguaacauaacacucuaaagugauauauucuaguuuccacccauaaucuuaauacagucugugaagacuuuuuaacuagaggaaugugggaccugagugucaaaaaagaaccuauaauugaaaggucagaauucauuauacucacauuucuuacaguuguucacagcccuuccucuuagauguuuaaccaaugauucuuguaaauauaauguaaaauaauuaugccugguggccauugauuaaauauaaucaugcgauauaugcauaguagucugaaugcauuacauuuucuguuuuuaaucauuuggcucaacuuucucauugaggauacagaaccaucauaagaaaauaacuuucuuuacuuuuuccagcccugaaaaauaaguuugaaggaaugauugguaguuuaggaagaggagauauucugaacucuuugcucagaaga

SEQ ID NO: 5835 - RNA, 947 nt, Mus musculus
aaugaaaaaucagucaauggaacuugacuucauucuuuugggauugacagaugacccacaguugcaaauugugguuuuucuguuucucuuucucaauuacaugaugagcuugguggggaacuuaaucauugugcuucucacccugcuggacccucgccucaaaaccccaauguauuucuuucuccguaauuucuccuaucuggaaaucauguucacaacaguguguauucccaaauucuugacagccauugugacuggagacaaaacuguuucuuauaauaauugugcaacucaauuguuuuucuaucuuuugcugggagucacagaauuuuaucuccuggcugccauguccuaugaccgcuauguugccaucugcagaccacugcacuacccuaucaucaugaacagcaaagugugccaccaacucguccucagcuccugggugacuggauucuugaucaucuuucccccauuggccaugggucugaagcuggauuucugugauuccaggauaauugaucauuuuaugugugaaacuucuccuauuuuacagaucuccugcacagacacucaugucauagaaaugauguccuuugucuuagcaguggugacacuuguagucacacugguacuagugagucucucuuauucuuucaucauuaagacuauuaugaguuucccuucugcacagcaaagaaccaaagccuucuccaccugcacuucccacaugauuguugucuccauaacauauggaaguuguaucuucauguauauuaaaccaucugcaagggagagagugucugugucuaaagguguagcucugcuguauacuucaaucgccccucuccugaauccuuucauuuauacacuaagaaaccagcaggugaaagaagucuucugggauauauuacgaaagacuuugggcuuuuuaaaaaacaaaguuuaaa

SEQ ID NO: 5836 - RNA, 2118 nt, Mus musculus
gaggauuauaaacugaggagcccggagcugccaccgggggaucggggcugggggcaccggggaagccgccgccuggcccgcccgcccucugugcaggccgccucccuucccggcccggggaggaaacgcgagggggaugugaacagcugcgggagucggagucucgggagccggagcccgacgggcccccgcccaggccccccagcccagcccgcccgcgcgucuucccgcccagccagcccgggcccgcgggauuguuagauggaacacggcuccaucaucacccaggcgcggagggaagacgcccuggugcucaccaagcaaggccuagucuccaaguccucgccuaagaagccccguggccgcagcaucuucaaggcccucuugugcuguuuccacacacagcauguuguccaguccagcucuuccacugagcucacacacaaggaggaggccaacaccaucgccaaguccgaucugcuccagugucuccaguaccaguuuuaucagaucccugggaccugccugcuccccgaggugacagagcaagaucaaggcaggaucugcguggucauugaccuggaugagacccuugugcacaguuccuuuaagccgaucaacaaugcugacuucauagugccuguagagauugaggggaccacgcaccagguguaugugcucaagaggccuuacgucggaugaguuccugagacggaugggggagcucuucgaauguguucucuucacugccagcuuggccaaguaugcugacccugugacugaucuccuggaccggugcgggguguuccgggcccgccuguuccgagaggcuuguguguuccaccagggcugcuaugucaaggaccucagccgccugggaagggaccugaggaaaacugucauccuggacaacuccccugcaucuuacaucuuccacccagaaaaugcagugccugugcaguccugguuugaugacauggcagauacagaguugcugaaccugauuccagucuucgaggagcuaaguggaacugaugaugucuacaccagccuugggcagcugcgggccccuuagccuuccugcuccaagaaacggccaucccaacaggggacucugcuacacugugccuuuguggucagccucacugacagggucugcaaguagccagggcgugugggacaaaagcaggucacacgcagagcaggaaaucagaccaagacccagagcucucugcaccccgugcucaguucccaggugguugugugggugugugugcgugcaugugcccguccgguaaacuaugguccugggugcccaguugugcaguagggggagaagcugaaagauaaggacucaacccaagucauuugucuucuuuccugcuaugcugugagcuacugagcuuuacagccaugaaaacuauuguaggcucccucgccaaaccauggcuuucccucagcaucaagaccugugccaaggagaagggagaggccggaggcugcuuuggaugcccagacacacaucuuucagaaaacacagaaaccuagccagcagcugcagacauguuugggaauaugagagcauguucgcagacccaccagguucuguguccuaugggcuacaccuggcuccagcaagaaugccugccaugggcacuucucuguacccgggcuccagugccaggccagccucucacucccaagccauaguccuacucccaugggaaaggaggucuucucucugcccuggaggaggacauauagcugauuucuguucuuuuaacucuuaaaaaucucuuucuaaacuuggagugguuuauauucgcccgagcuccaguccugggccugagguuugugugggaagcgcugggguacaaagaaaaugcaaauguucaaaaaaaaaaaaagaagaggauuaagaaugcagagauaugaaacuaaggagaaagauagaaagaaaaaagacuauaaguuagaguuuuuuaaagggaaccugugguauguuuguuuuaauuccaguguccuugaaugagagaacaaauuuucuaauaguuccagaaaauucuagaagccaccaagcuuucuagucuaaugcucaccauuaaaaaaaaaaaaaaa

SEQ ID NO: 5837 - RNA, 2118 nt, Mus musculus
uuuuuuuuuuuuuuuaauggugagcauuagacuagaaagcuugguggcuucuagaauuuucuggaacuauuagaaaauuuguucucucauucaaggacacuggaauuaaaacaaacauaccacagguucccuuuaaaaaacucuaacuuauagucuuuuuucuuucuaucuuucuccuuaguuucauaucucugcauucuuaauccucuucuuuuuuuuuuuuugaacauuugcauuuucuuuguaccccagcgcuucccacacaaaccucaggcccaggacuggagcucgggcgaauauaaaccacuccaaguuuagaaagagauuuuuaagaguuaaaagaacagaaaucagcuauauguccuccuccagggcagagagaagaccuccuuucccaugggaguaggacuauggcuugggagugagaggcuggccuggcacuggagcccggguacagagaagugcccauggcaggcauucuugcuggagccagguguagcccauaggacacagaaccuggugggucugcgaacaugcucucauauucccaaacaugucugcagcugcuggcuagguuucuguguuuucugaaagaugugugucugggcauccaaagcagccuccggccucucccuucuccuuggcacaggucuugaugcugagggaaagccaugguuuggcgagggagccuacaauaguuuucauggcuguaaagcucaguagcucacagcauagcaggaaagaagacaaaugacuuggguugaguccuuaucuuucagcuucucccccuacugcacaacugggcacccaggaccauaguuuaccggacgggcacaugcacgcacacacacccacacaaccaccugggaacugagcacggggugcagagagcucugggucuuggucugauuuccugcucugcgugugaccugcuuuugucccacacgcccuggcuacuugcagacccugucagugaggcugaccacaaaggcacaguguagcagaguccccuguugggauggccguuucuuggagcaggaaggcuaaggggcccgcagcugcccaaggcugguguagacaucaucaguuccacuuagcuccucgaagacuggaaucagguucagcaacucuguaucugccaugucaucaaaccaggacugcacaggcacugcauuuucuggguggaagauguaagaugcaggggaguuguccaggaugacaguuuuccucaggucccuucccaggcggcugagguccuugacauagcagcccugguggaacacacaagccucucggaacaggcgggcccggaacaccccgcaccgguccaggagaucagucacagggucagcauacuuggccaagcuggcagugaagagaacacauucgaagagcucccccauccgucucaggaacucauccgacguaaggccucuugagcacauacaccuggugcgugguccccucaaucucuacaggcacuaugaagucagcauuguugaucggcuuaaaggaacugugcacaagggucucauccaggucaaugaccacgcagauccugccuugaucuugcucugucaccucggggagcaggcaggucccagggaucugauaaaacugguacuggagacacuggagcagaucggacuuggcgaugguguuggccuccuccuugugugugagcucaguggaagagcuggacuggacaacaugcuguguguggaaacagcacaagagggccuugaagaugcugcggccacggggcuucuuaggcgaggacuuggagacuaggccuugcuuggugagcaccagggcgucuucccuccgcgccugggugaugauggagccguguuccaucuaacaaucccgcgggcccgggcuggcugggcgggaagacgcgcgggcgggcugggcuggggggccugggcgggggcccgucgggcuccggcucccgagacuccgacucccgcagcuguucacaucccccucgcguuuccuccccgggccgggaagggaggcggccugcacagagggcgggcgggccaggcggcggcuuccccggugcccccagccccgaucccccgguggcagcuccgggcuccucaguuuauaauccuc

SEQ ID NO: 5838 - RNA, 1232 nt, Mus musculus
cagcggagcucuccaccagggggagaaggaugcauagacccugcagaaacagcgcgagugcagccgugacugcgagcgaccuuacgcacgcccugcucgcacuuccacgcauggaccagagccuuguggguaggcagcaucuccugcacuucuacagaagaaagcagaagccccgaccaagccguuccaggacaaaguuccuaggaacgcgcgcuccgccaacuucaaaacgcaagggcgagccagucaaaagcuggaggcgcuaggccgggccucguaccugagggaggugacuccucagcagacgcuagacagaggugguagcaaagggccccagcccagaguuuccggcccugcgccgacggcggcuccucccccgucuccacggcaacgcgacccgcgccggaagcugcucuguccagcuuagugcgcucugucuuccaggaaacagagacuucucucuaagcucggcuuccuacgguuuucuugcccugaaguuucugcgcuucugagaagcgggucacuaguuacaacuccugcaugggaccggugugagacggaaaagugucucuuuucauugcgugguggcucacgucgguaaucuccgcaucaaacagccgaaucuuuaaagagaacuuucagaacaaaguaugaaguuucauacuaagaacagugaaaacuagugggugggugucugaagacgaaaaccaaggggcaggagauaugacucaccaguuaaaugcacuuuucauucauccagacucccaauacccacacgguggcucuuaaaacagccgugacucccaagucgcgcucccguuugaccuauaugcaagcaaaacauucauacucaaaauuuuuaaaaagauuaaacccaagaaauauggguuuugcccuuuuacaaaugguaauuuuguaauccaaagauuuaaaagcaauuauugguaacagucauuugugggaggcugaggcagggggaucccugcaguuaaagaaaaccuggccuaaugagugaauuccaguaccgccugagcuagaaugagacucagaauggacaagaaaaguguuuaaauccagucugcugaaaugacaagauggcuccugaguccuaggaccugagcucaaucuccaguauuccuauggcaaaagagaacucgcucuuagaagccauccuuugaccucuagccacaagccaugaccauccaugcacacaaaaaauaaagauaauggga

SEQ ID NO: 5839 - RNA, 1232 nt, Mus musculus
ucccauuaucuuuauuuuuugugugcauggauggucauggcuuguggcuagaggucaaaggauggcuucuaagagcgaguucucuuuugccauaggaauacuggagauugagcucagguccuaggacucaggagccaucuugucauuucagcagacuggauuuaaacacuuuucuuguccauucugagucucauucuagcucaggcgguacuggaauucacucauuaggccagguuuucuuuaacugcagggaucccccugccucagccucccacaaaugacuguuaccaauaauugcuuuuaaaucuuuggauuacaaaauuaccauuuguaaaagggcaaaacccauauuucuuggguuuaaucuuuuuaaaaauuuugaguaugaauguuuugcuugcauauaggucaaacgggagcgcgacuugggagucacggcuguuuuaagagccaccguguggguauugggagucuggaugaaugaaaagugcauuuaacuggugagucauaucuccugccccuugguuuucgucuucagacacccacccacuaguuuucacuguucuuaguaugaaacuucauacuuuguucugaaaguucucuuuaaagauucggcuguuugaugcggagauuaccgacgugagccaccacgcaaugaaaagagacacuuuuccgucucacaccggucccaugcaggaguuguaacuagugacccgcuucucagaagcgcagaaacuucagggcaagaaaaccguaggaagccgagcuuagagagaagucucuguuuccuggaagacagagcgcacuaagcuggacagagcagcuuccggcgcgggucgcguugccguggagacgggggaggagccgccgucggcgcagggccggaaacucugggcuggggcccuuugcuaccaccucugucuagcgucugcugaggagucaccucccucagguacgaggcccggccuagcgccuccagcuuuugacuggcucgcccuugcguuuugaaguuggcggagcgcgcguuccuaggaacuuuguccuggaacggcuuggucggggcuucugcuuucuucuguagaagugcaggagaugcugccuacccacaaggcucugguccaugcguggaagugcgagcagggcgugcguaaggucgcucgcagucacggcugcacucgcgcuguuucugcagggucuaugcauccuucucccccugguggagagcuccgcug

SEQ ID NO: 5840 - RNA, 34076 nt, Mus musculus
agggacaaugcgcucuagccuggccgcacgguccguggucaaaguggccggcauuuugccgggcggcaagggcuaauaagcaagcuucuggcuuggggaagaucgagggggcuucuugaucucuggauucccuaguuuucuuacaaaacugcugggacaugcaggggucguugauuuuguccaucgccaucauacugucccuucucugagcuggcuugugacuucacgcucccuggggcacaaagcccaaguagcuguggguggggaaaacgaccuaucucuaguuauccaggcgugccgggcauuugccucggucagugugaggcaggcagaagguuccgccugcgucggaucgggaucccgucuccuuccuagggcagcagagcgggaggucucagccgacuucuagggauuucggccaucaaaggagaacuaggcagggugcugaugcccguccgaccugcgggugcgcaagguaggcuggggggcucagauccacaggcucuggcugcccaucccgcacgcucgccuacacucugggcgggcagcggaggggcggcuguagcugguuugcuggcucggcgcucagaucguauuggccggggucgggggggggguggugguguguggggggugguugaggcugcagccccgggccccgcgggcgggguggggaggcggaggaucaggcugcgcuagcauuggcggagcuggggagugggggcaggaagcgagcggagcggagcugcagggggggggguuguauaaauagggaaugggggacgugcauccuccgcugggugaggggggggggcguucggcacaaagaaaguggaaaguuugcagcgcuaggcggcccaagcuagggagccggaugcgcacgugcugagucggggcgaccgagaccccccacgccgagcucgcugcuuuuuuuucuuucugcaagcuggggggggggguguuguugguaucgcccccuccuucuccuccccccaggggugaaagugcaagaggaagugcagccgcugccaucuuuccuccguuccgaacgcacggagccuggggccgcagcgccgccgccacucgugccuggcuugggaaagggcccacccugcuacugccacccgcucgcuucggccgccgccuucgccgggcuccaagacucggccuacgccaccgccccugugcgcgcggaccgccgccuucgccuucgccuuuuguuuccuuugcuccggcgcccccaccccggcucgcgcuuugcaggggacgcagcgcgcgcccccagugggcccgggaaaagccucggagcgcgcgcuugcgcuugcgcggcggaccccuccuccuccccgcgcgcgcgcgcgcgccuuuuggccgcgcgccggcgccgccuggcgggcgggaggggagguggcagcugcguuugcaggaggggcgcaccucuucgcucguuuaccccuggaagguagaccuagagagggaggcgggcaggcggagagggagugcuacgcggguccggcggagguuaagggcggcaauguggggggcagugccccgcugggucuagcccuuuuuauuagagcagggggcgugugcgcugggcgcaccugagaguacuaccgagcccugggccgcacgugcggggagugugagugguccgcugcaaaaggcgucucgcugccuaagggaagggaccagggacuggcgggugcccggcccggcgaguggggaaggggcagcgaccauggagcgggucaacgacgcuucuugcgguccgucgggcugcuacaccuaccaggugagcagacacaguacggagaugcugcacaaccugaaccaacaacgcaaaaacggcgggcgcuuuugcgacgugcuccuacgaguaggcgacgagagcuucccagcgcaccgcgccguacuggcugccugcagcgaguacuuugagucuguguucagcgcccaguuaggcgacggcggagcugcagauggugguccugcugaugugggaggcgcggcggcggcuccaggcggcggagcuggaggcagccgcgaacuggagaugcacaccaucaguuccaaaguguucggagacauccuggacuucgcuuauacgucccgaaucguugugcgccuagagagcuuccccgagcucaugacggccgccaaguuccugcugaugaggucggucaucgagaucugccaggaaguaaucaaacaguccaacgugcagauccucgugcccccugcccgggcugauaucaugcucuuucgcccaccugggacuucugacuugggcuucccuuuggacaugaccaacggggcagccauggcagccaacaguaacgguauugcuggcaguaugcagcccgaggaggaggcugccagggccacaggugcugcuauugcgggccaagcuucucugccuguguuacccgggguggacagauugcccaugguggcuggaccccuauccccccaacuacugacuucuccguucccuaauguggcauccagugcaccuccacuaacuagcaagcgaggccggggacgccccaggaaggccaaccugcuggacuccauguuugggucuccagggggcuugagggaagcaggcauccuuccauguggccugugcgggaagguguucacugacgccaaccggcuccggcaacaugaggcccagcacggcgucacaagccuccaguugggcuauaucgaucuuccuccuccaaggcugggugagaauggguuacccaucuccgaggaccccgauggccccagaaaaaggagccggaccaggaagcaaguggcuugugagaucuguggcaagaucuuucgugacguauaccaucucaaccggcauaagcuuucccacucgggggagaagccguacucgugcccgguguguggucugcgguucaagagaaaagaccgaaugucguaccaugugaggucccaugaugggucagugggcaaaccguacaucugccagagcugugggaaagguuucuccaggugaggauggcacccucccccacucccugcuguguauuaucuuaguucugucucgagacagauccuucccaggaucuggggauguggaucuuguggggguagagggucacuggaccuuaauagaacauaacauguuuaaauguuuuaagaucuccaacuuugaugguguggccaagagcugcaucuaugccuucaggcaaguucucuggcaccagggugcuuacuagcuucacccucccaggggccuuguaggaaggggccggauuccuuaggccagagccauugggccuccccauucuucuccccugguucccuuuguguuuccggcaccaggcguggggcccccucugggggcgggaggcugggcuccucccucgacuuuccccgccugaauggcuucggagggaagaacugaacaagugugucuaggacuccuuacacucccgaggccuagauccuccaccaguuugaacaggcuggccugcagcaguagguuccagcuuugccccucaugugacccuagguuugagagacauaaaagccggcuacgcagggcuguuuugcaguaguaauacuggaaucugaugcgcucugacgugguggcuucagaauccaguggacccacaggucgucuguuuguucucaggacagaccuucuuuucaacuuucagagagccuucuugggaacugaagacuugccugggagcagagggcugguuuuguuuuuguuuuucucccaguuugagaauauugaauaaaaggcugauuuuaacugaaaucccaaggauuuucaguaugugugagagcuuagagacagaauucccccagagaggccccaaguaggaaccagucuuaccggucagacagccccugcccaccugcucuggcgggcaucuggcuugccaguccagcuggggacuuaaagcuccaucccuggccucuggggacugaauuccauccggguggcauucauuggcugcuguggccauuggcugcuguggcgggagaggcuggggggaggggaacgcagugcuucuaaggggcuuuagucuggacaaugagucccacacccaccccucccugaaaggcugggcaaggcauccccgugucauucuaaagcugcugccucagguccuaggaauccuugaauuucugcggaggaggggggaugugggggguggguuaguuagaucagagggaaacauuugcuccccucccaaggcggguguguggcugagaugcuugggccccuggagcuagagcuggguggugacuuugucuuugucuugcugggguggaguucucccuggggugguggugguggagggaggcuggccaaguuuggcccaucucuuuugaugucuuguuuuuaaagucuguugaucucuuuuccaggccagaucacuugaauggacauaucaagcaggugcacacuucugagcgaccucacaagugucagguagggacugggccagggaacaguuggguggaaagaugcugcuguccuccagccuuggccugagcacugcuuugcaccccaccccccaccccuggucgcccuguccuuucucuggccuccuuuguucuauacccagcuuccucuguuuccccagggcuaugagacucuuuguucacuuguuucgucuccacagccuuucccuccuuucuguugcuuagcuuuccuguccuggcauuuuugggcauuggcuggugggccacacuacacaaguguuuucaugguggaucugacaccuagcugggccuggcugcugguucccaguaauuuguaugaacuguagggguuucaaaagggcuuccgguggcccagccaauaacccuuccucugguuugagccgagugggaacuuguggguuccuucaguggagaaagcguggcagaagaggcuguagguagggagaggauggucucaucucccaacacaaacagcaagggcaaggcaaggcaaggcaaggcauucucuucuaguguggaaucacguaggggaggcuggacuggauuuucuccugucugcuugaacucucuggggacucugcugggaccuagaaaaugaguuuucuuucuuggccucugagcauuuuuuuuucagugugaugcaaaguacaccacugucuucuugguuaucucccuucugcuguggcaagugcguucaacugaugucaaagcagugacaugagcuauccuacagccucugucaggggaucccugcuucuccuaaccugcuggcacggguggguucaggagaauauagggaggaauggccuugugcagcagcacagagcuuccaggacuagggcuucgcugcucacagaugcucagccgggagccuggcagccgcucccaaggaugcugacuccagauaggccugcuggaaucugucuuugccuugcugcuuucugccgcuccaucucugauuuugguugccacagagcacauucugacucccagguagugugcugagcagccccagacaggauaggagaaacccagagggcagugggggugugcccgguggccuggggggguaaccugcacucucugcccuuuuuccagguguggguugggagcagcagcggccugccgccccuggaaccucuuccuagcgaccugccaucaugggacuuugcccagccugcuuuguggaggucgucccauucaguuccugauaccgccuuuucccuuucucuaaaaaaguccuuuccagcccuugaaaaccugaguccagcacacuccagcaaugcgcucuucugcucagccccaccaggauaccugagacagggauggacagccccugagggcagccuggcuuuuacucaguggccuguaggcuaaccugggucccucuggagagguggaggcaaugauggcuggcuggagacuccugcuuuuggcagaggauagcuagcaagaugguuccugcccagcacucucagauccuuccaagauguccuaacauuuuucccagcucaaagcucucaaguagagauaggaaggaccaccuuucugaaggccccuccccuguaggcgccauguuccuuucugaaugcucuccucuccccuccccuaccucaacagggcugccaacuuuggggaaucuagaaguugggaauucuagggaguuaagccccagcuucugugucccuuccccuggucucacuuuucacacugacuggggcucccagucacccuccucuuaauugggcgggagggggaaucacccuacuuccagagaaguguccgguccgguacagcuuccgguacagcuucaacuagguucaacugugcagcugaacucuuaaugucucacaagggccugcuuucaggucuggcuagugaguucucauggcugagguuuuuuaaagcgggucugcucagaacuaaacuaaccaguauuguauugugauacauggcuuuagggacugacagagcagguagacacucccucccccagggccccuuggugugucccuuagccccugcagacugccuggagaucaggaucgaugauaaaaguuuucauucuaacauuugaggcuuuguguguuuuguccuuggucugucagugacaacuggcaccauugucccuugguguaugagccagcuccugcccugccucugcccuucagcacacaauuucacagaccugacccuguagccagagccuuauaaagaagauccagcaaggggugugcuggcugucauucugccauagaggauaaaagggggccaguuacucagacugauagaaaagccuuugcaagguaaggagccgggagcuucaggcuugagucucccuuaccuggucuaacaagcccuagccauugacuggaccuggaauuuagccagaguugagagacuggaguuucucagccaucucccauugcuucugguagccccaugucugagacugguuaaauaagggugagcugagggugcacaaagggguuagagccaguggagcuggacuuucauguguugcucuuagauuuuuuuccuggcuguaggaggcuuugcaaaaugcacccuguugcuuucagacugccaaggcugccugggcuugggacgcacuaguauucuugggguuccacucagaacugaaagcuuuagggaaugugggaagagcggcagcaaguaguguuaggaugcauacuaacagcagccgacugugugaaccuuggcugugggcacaguaggcacuuaaagccaacaggcagucccacugugccauuggccggcuggcuuccuuucgaggcccuuuuguuuacucccugucuacaggauggggaguucuggaacucagguucuggguggccuuuuugaggccugucucccucagcccuucgagucucuccugagucaugugaccauccuguuuugugcuguguguuagucugaaguuuugguugguccaggcuuggacuuaacacaggaaaaccuggggacuccagucacaggauugcuugaacagggacaccaacaacuacuuuacguuggcuuugugacaaggugguuauuucuguuguggcuucuuuaccccagcagaagucccuaauuauguuugcuccggauuccuuaagagauaaucaguggaggacaggguaggggacacuagcugcaucugugguuuugacuuugcuuaguuaacccccaaauauuuaauucaguuggggauaauggaggauuggcuguccauuaucuugggaaccaaaguauuacagggcaaaaccuuucuaggaaagaucccaaguaguugguaaagaagcagagucucuuuccugcccugggcuuccucccucuggaaagggaagaggccugguuaguuccaccugguucaugucaguuccuuagaguucugaggcuuuaaacuuucuuggugguugagguggugcacgccucuaaucccagcacucaggaggcagaggcagaggcagaggcagaggcagguagaucucuugaguucaaggguggcccggucuacagagugaguuauaggacagccagggcuacaugauaagaccuugucucaaaacaacaacaucaacaaaaagccugcccccacucaauagcugcaggguuaggguaguuuuuggaucuuuggcagagccagcuccuuguccuuggauaaaugagcauguucacggucucccgaaguauuuauaagaacccuuuccacgguuuacagauugcaggcuaguuggaaguuugaauucccugucacuguggccucucacugugucaugagaugccugaguuggguccuccugaugccucuggguugcucaggugcuggacuuugccugcacugucugccccaggacagaacuggauaccaaguccauagggccagggcugccuccugucuuucauagaauggaccuguauugacuucagaaaugcuaagggcauagauuugacgccuguucucaacucagucauccuacauucucauagggcaugugucugcccagcuguaaauugaucaauaccaagagcccccuguuuagcugggaagacugcuggaagacugguccagaugcuaagacuguuccuuucucuaguaccggaguccugugucucgggcaaguuuacuuucaaaguuaagguuccuuugucacaagauuaaagcuaaagcauaaaagcagagauucaccggacgaguugucugguuuaaguuaguauuguuuaccugugacauggggaaaccgggaagcgugagaugcacauaucugggguugaggcaaacuguggcaucuucugccuucacagcacugcugucgaccuugugcuugaaccacagaguaagauaaauggugugugcaugcaugcgcgugcccacccgcccgcaagagugucaaugguguucugacacuacacaccuugaggucucagguuaucgagauccacuucuaaccaggaaguagaggcagcugcauucuagcaaguuaauggaguggcuccucuucucucagaugugaaagcugcuuucacucacaguccuagagcugagagcacacacagaagagaaauaaguccaguuugacguuagccccugaggcaucccuauggaaccaaaauagcuuaaaagccacuagauccgccuuuguuacuuucuguguuccccaaggccuuugcaugcccuggcagaggaagggauguuggggagagauaauggcuagggagcuagacccucauccucagggugaauagcuguguggccuggccaugagucgugcuggguugugccuuucaguggcuacacauuccuggagugugagggcugcucuguggaugaacuacacaaggcaaaugucucucucagucuguacucagagccugcucaguguugcaggcaggcccuguccuuguccuuaccaccacuuccccacagugacaacgcacggaugcucugaugccugcagucugcuucuccauucucacuucagcagaacugacauucauuuauuucauaugcugcuuuuuuauucacguuacaagaauauuaggaaguguuaucuuuguacuuuuguccugccguuuccauuucccuguggccaacacgaaugccauauuugaaugaaauggguacauuggauucuuuggauaaggcaguaaggggaacccagagguggagaacaggaagccugacuuuuaugcuguaacucaauuauggccagugcuccuaaaguaagugcuuugugguuaagagugaauagugguggaggugaacaccugcgauccuagcccucugcagaaggagcugcaguucaaccucaacuucagcuacguaagagucagguuagccuggguugcaugagaccuugucucaaaaacuaaggagcaggggggggaaaugaauaaacacuuaacucuccacucaguaaaagcacacaggccuuggguggccauguuuugagcuugccugugguaaagaaccaguaaguccgacucagauaccccauuagaaggcacugugggaaggaggggcagccacucggcauggcuaguagagccguguagagccauguugcaguguucagccuccugaaggcacuguuuucacaggccggccgggccugcuuggucacgggcagucgguccuguucuucaugcuguucuccuuucugcacgcagaccugcaaugccuccuuugcgacucgagaccgccugcgcucccaccuggccugucaugaagacaaggugcccugccagguguguggaaaguacuugcgggccgcauacauggcagaccaccugaagaagcacagugaggggcccagcaacuucuguagcaucuguaaccgagguaauuuccccacuguuuccucacuccagagaaugagccugcucuugaggggagcccguccucucuucugaaugggaaaugcccucacgaggcuuugaccacaucacucagcuaguuguuugaaaccucuuccuuuccaagagacuuagaugaugggaacagacggagagacucacucgguucccaagcucagggucagauacaccugcucaaguggcaggaugcaugccuucacaaagagacuuaacaggauuggccugaaugggcuauaaaccuggccacucacuggcaaagaggcuggcucuaggauggacaagagacaaaagcuuucuaguauaaauguuuaaagagauuccaaguggauuguggcccugcagaaaggcagaagcggacagaguucugaguagggcaguuugcgggcagggcagugugccugagcccaaggcuugcugacacauugucgagcccaccagggcugcaguuuuguguugggugaucucuguccggcaugucugaggaucugcuggguugagucggcuguuggaagugcugugacuuuguuuguaagcacagugucugugcuaaggaggcuggggccgccguugugggagccagagacugcuucuuucaccuccuaugguugcuuuggccagaugggcauguggcuuguuuuccugggcacucuuguguugguauuuuuguaagucuagucuauggcagggugagcgucgaaucaggaugaggagacuugugguuuaguuccagccccuuuccagguagcuuugggcuuuccuuccuugcucagaagugauuagacucuuccccgcuucccucucaugggguugcuguuaggucccuaagaggagguggcugauagcucccuggauccagaguuguaccuucagggugccugugcuuacacugugaaaugguaaaaugguuccguaaugcuccgucauagugugguauggacgggugcugucuccacaggucccaaaguucuugauggagguauucuugcuggguggaugguuuuauuggagucuuggaaccaggugcuguucaaagacuacauacaccuaccucagauuugccuugaugccacugauaacugcugcucguuccacuaagaaaccugcugugaaugccagcacaagggcucuagcagcuucugcugcuucuuguuucccucuaggggcaaacggugaggacaaggaguguugugggacagcgucucuuggggaugcuccggucuuagacagcuggcuuuuuuuaaccuugcuucauccuaacccagcuuccagagaguacuuccuaguaacgcuaaacuuucuacagugcaccaucugcaggacuuugucaaguuuccuauaguuaccaguuccagaacuggcucagugggcagagcugagagcuacuaaaaguagugaaggauauuaaugauaaaagcagaaagucgccgggcagugguggcgcacuccuuuaauuccagcauuugggaggcagaggcaggcagauuuuugaguucgaggccagccuggucuacagagugaguuccaggacagccagggcuacacagagaaacccugucucgaaaaccaaaaccaaccaaccaaccaaacaaacaaacaaaagaaguaaaaacaaaaccagaaaguuaaaaaaaaagaaaaauaaauaaaauaaaaagaauccuccaaaccagacaguccugcccagaugauggaauagagcaaggaacugauacaggacagcagacucagggccaugaggaagcccaagugagggcagcagggaaguuagcccaccacaauaagguguuccucaagaucugcaaagaggacuugaacagcagccacaagccaugugaccaggguguggggauaacccgccaaagugcaguccacugcaggaagacccauucuuccaagucuagcucacacuggguacccggaggagcggagcacugagaggaggacuguagccuuuguggaagaguaccucuggacucauucuucagcagaaauaccaacuagcaacagcaggacaccgaugcaaacaaaaccaacaagaggguggaagaggaugacggggcuuugccaggcuuacauaaaugaguguucugagagcugggguugugacucagugguggcacaugccugguauguccaaacuuuauggucagucccaggcacacagcccaaguauucucaguaaagacuaaaucagauaucuuacaagugucuuuugaaagcuuuccaucccaauaaugcuuuauuuuuuaauauauguguauauguguauguacgaguguauguauguguccaugugugugcaggaacccauggaagccauuggaucgccuagaacuggaguuauagguggucaugagcugugaugugggugcugggaaccaaaucuggguguuuuacaaaggagugcucuuaaccacugagccauccuuccagccuugccauaaagaccaggcuggcuucaaaguuguccucuugcuuguagucuuugcauuugggagucuaaggugagaagacagcucaaauuccaagcuaagcaagacugcacaggugagaccuuguuacagaggagaaagggcuuaguggccuacuccuguggcacuuggaaggcagagacaguauucuuuuuuuuauuuuuuauuuuuuuauuuuuugguuuuucaagacaggguuucucuguauagcccugcuggcuguccuggaccucacucuauagaccaggcuggccucgaauucagaaauccgccugccucugccucccaagugcugggauuaaaggcgugggccacuaccgccuggcggaggcaguauucuuaugaauucaggucucaccuggacuaaauaucaaguaccaggccagccaggaccuucuaucauaaaacaaaacaacaacaaccaaaacuacacaaaggaaacgucuuccugucagaugaccacacaguaacgagguagugcugugccuuucuccugcaucucaggugcacugguggagcugagcccuuccaguuuggacacagagaaagcauuccucaaucucugcauggacaaggacuaggaauugcauagauaccacagggcaagaaaaucuaacugaagaacagugacuuuuggcauuaccaaacuucauuucuggacacggagggaccugcugaugugggcacaaugcuuccuucagcucccauaucacaucauggaggccucuuuagcucuuggucaaagagagaguaggugagcucagaauuucagcuaaauacaucuggccucaaaaauguguucugcucagaaacucagcuucugugucaucccagcacuugacuugcugaacggcuguguuuaagcugugggcuuuaaguggcagcuguggauccagucuugccaagugaguuugcuauagauaguacaaucugcaaccgaggaaagucaggaggauccagcuaccguugccuuagaauaugcagggcguuuuuacuguguaccugcuguauuuuggagguagagagcucucacugcacaguggauauaguaauuccuggugcuuuuucccauucacuuggauugugguggaccugcccuggcuugcagugagaagggcuucauaccgcuucagaggccaaaaaggaaugaacaccaaaggaaaauuccccugugaagugccagccagcauuguguccucacaaaguucucauguccugugcggguuucuggggccacuagaccuuguuggcuuguguugaaagggcuaagagccuggaucucuuccccuuagccuugccugcccauuccugacugcaaccugcuucuuaggaaugucuggccccaagccaaauacuuaaguacagcacaagacagcuuuccagggaggcuagaaagcuagcaccugauccaggucgaucuuuaaaguagcuguguuaagaaggaaaugcuguccugaccccaguuugccuccgugaccacugccaccaccugcuguccucaaggcugucugcuggcagccuacucuaacacauuuaucaucacacaguaguggugauaauaauccuacaaguccagaggacauuuuuguuguuuguuuugaagcucaagggcaauuuuauuagaguuugaaagaaaaaugucagggccuaucaguccaguucucuugagggacagaacugauagaaugugaaaaaguagauacaugaaaaggggauuuauuagaaugcuuuucaaggcugugguccagcuaguccaacaacaguugucugccaacagaagguccaagaacaagaaguugcucaguccauggggcuggauguucagcuggucuucaguauacaacagaauuccaaagaaguaggcgcaaaugccaaggaggaauggacuugccauggagagcaagagcagacaggcagagagagagcuuccuucuuccauggccauuauauauacaggcugcuagccaaagggcgacccacaugaaaauuguaucuucccaccucaaaagacccagauuaaaauuauuuauuuccacuucaaauuauuuaauuaagaaaaaaaauaucucccagguguacccagccacuugggauuuaguuaauuccagggguagccaggcugacaaucaagaucaaccaucacauaggaaaacaagcuguaaaucucaguagcuugcugggagaagagagaugcagaagagaaaggucuugccuuuuaaauuaggaaugaaugaaugucaauucugaaaaaaaugauagaaaggaaaauaaaaaguuacacuauuuugaguuagaacccagaaaagugggcaggcuuagcugcaaagguaugaaagaacugucccagagggcuuuuuauggcuggguaaagacagagacccauucaggagaccagugguuaagggccaaguucugauaguguggauuucuaggguuccuggaaugaggucagcuucugcugguugguggccauacauguuacaugcaugaaaauuaccacuauagccuuuucucuauucguuggcaaaauggguaaaguaauaauuuacaguggguauaaaguuuggggaacucuguagacuauguaguguaacauguuggguuccaggacaccaucagcauuuaaaaaugaaacuuggaggugggcaguggugaugcaagaagagacaggcgaaucugaguucucugucaggcuggucuacagagugaguucuccaggagagccagggauacacaaugucuggaaaaacuuuuaaaaaaaaaagaaaaaaaaaaccuuuauuuaaaaaaaaaaaaaaaaagagugaaccuuugucacacuuuaagcaguguucaaaaaaacucucugugcuuggggagccugggugggaggaagccacggcccacggccucaggaaagccugggccacacaaacaacaaaacaacaaccagaaaaugagugaauguaugaauacuauagcaauucaagcuuuuuugauuuguuuguugagacagguuuucucuguguaaccccgacuguccugggacucuagaccagagagacccagcugccucugccucccaagugcuggaaagcuccacccugcaguucacacuuuuuaaaaaguuugaugcagaaaucacacaauacauuuccaucucugagccuuuagcagggcaaucucacuguggcuauaguuuuaaaagggaacaaggggcaaacaagauggcucaguggguaaaggcacuugccaccaagacugaagaccugaauuuaaugcugggggcucacaugguaggagaaaaccaacuuuaacaaauuaucaucugaccuccaccuccucccgccccaguaaauaaauacauguaauaaaacaaacggaagugcaagugccugaggaaugugcuggacagaucuagaguggacuaaaggaacaagaguagagccaggcgugguggcacacgccuuuaaucccagcacucgggaggcagaggcaggcggaucucugaguucgaggccagccuggucuacagagugaguuccaggaccgcuggggcuacacagagaaacccuguuuaaaaaaaaaaacaaaacaaaacaaaaaggaacaagaguagggcacugacccacccccacccccagugacccuuacaauauuaaaacgcuuugguuccugcuaaagguacuuucugauccuucacuauggugagauucaauggcacacuucuuucuugugaaacaagucauuuuauugccugauuuuguggcugucauccuccaaaggccuugugacauuuguggaaauggcccaagaucugcgcuucaaacuugagauacuuacgccuuaaacugaccaaagcaugagugagguguaaaguggagacuacuucaagauggcgagagaucauucuggguguacucgauggauuuuccaaaaccaaacugaaaagaccaccauggauaagggaugaccaugaugucacacaagcugccuccguucuucaaaggguggaaucggcucuuaagucauuguucugaaggcggaaaaguuaaaauaaaguaugcuccaacagguagaagaaaggggacccccuggaagcauucauuccuuggagacuucacuugucuccaucugguuuuccuuuauauuauaagcaggcuucugcuggcuggaguaccauauacuugucugaucacauuucuagccacggucucugcagcugacaugggccugugggacaucuacucaaaccaccugguacuguggcaccaagcgagccaagauggcuggccugggcccuucaauguagccuuggcagagaagcugacugacucauggacaguggagcucuccguucugaaccucauggccucaugugaugauugcagaugcuuuugagccaaggagagaaccccuuccaggugcagcugaccagggaaugcuagccagagcugccaaagaaaaggcguggggagcagagagcuaucucuugcuggcugugggaucucaucuccuuuugucuuguuuagguuucuccucugccuccuacuuaaagguccauguuaaaacccaccacgguguuccccuuccccaggucuccaggcaccaggaacccauccugaaugggggagcagcguuccacugcgccaggaccuauggcaacaaaggcaagcgaccccuugcucugcacuuugcuucucugcgcagacuguguugugggggcgcugggccgggugguggggaggcaagaaucgcagugcucucuaggacaaaguuugccacggguuucucacuccaggacagugagugaggcuuuaggguacugcugauccagccugccuccucuuccccagccuucuuccuuccucuuggcuagcccccauugacuggagcccuacaggguugcccuagggcaggaagaggagcacugcaugaccaguuacucugggcuuagauacugccuauugcccuguaggaccuguguggaccuggugcugaaugcuuucuucuugguugaucuugugggugggugggagccagcggcuggcuuaucuaugauaucgguggucgguugucauuugugagacgcauggcaguaaaugagcuaccugauugccucugguuugggauuggugugacaagaguuuccaggcucauuguuaacuuguugguucaugguguuuggggugucauguuguugccuuuugccaggacguggcggaugguagagauggcaugccccgugcucccaucacagaccucccaucuuggaauggcucucuggacccaggcaggaagcugguaguugguaguagaccccagugugggccaggcaagguagggcaguaaggaacauccaugucuuggucuagaugggcuccccagcugacagagcuguucagaguugcuuuucaucugugugcuuuggcuguauggcccuggaaagggcuuugcagaaauggaaauguagaccuuguauaagcguugguugccgugugagccaucaguaggaucuagccgaguagaggaacucaugguucucguucggccugcuuugugaagguagccacugguguagcgcagggacaagccaacgaccccugcucaucauaaccagaacaguuuugcaccuggaggcaccuggagauuggggaucucuggguuguucugggcagaaguaagggggaucccuccuuggccuuccgcccuugaagcaggcugaggugauggugaagucuacacacacauccucauuuagagcuuauagugagggaggcugguggcuccagggcacugucaucuugccccuacaggcauuccaugcuccuacucagaccagccaaaccuccauggguucugccagguuagugacugagcuggccugucauggucccuccaggagggaauggcucuaaugccuggccucaucucugcccucuuuuguuuugccauagaaggccagaaaugcucacaucaggaucugauugagagcuccgacuccuacggugaccucuccgacgccagcgaccugaagacgccagagaaacagagugccaacggcuccuucuccugcgacguggcagucccuaaaaacaaaauggagucugacggggagaagaaguacccaugcccugaaugugggagcuucuuccguucuaaguccuacuugaacaaacacauccagaaggugcauguccgugcccuugggggucccuugggggaccugggcccugcccuugguucaccuuucucuccccagcagaacaugucucuucuugaguccuuuggauuucagauuguucagucagcguuugcaucaucuuuaguggauccugagguggaccagcagcccauggggccugaagggaagugagacaugcuguguccccacagaacagccgcuggggacugcugagcaaugcugugaaugcagagggaagugaugucuuuggguucuguagcugagagauuuuuauucauuuuuaaaccccaucccugccccucccucccuccauuaaccccaccugcuguggucuuagaaacagacucucaucugauacucucuguagaaauacugagagacccaauauggggcaagggcagaaagcacuacaucggccucugaggcaguaccaguucugguuucucuaguggucugaagccagaauuucuggugcucaguuauugguguccucaccccaacucuaaggcacucuugggccucgcuugguaguuuuggucccucccacuucuuucauuccucaccccccugccucuguccucaaaagaaguuaaguagggucucuacccucuuauggccaacuauuuuuaaggaagccagaaaccuacagcaucccauggaccauacaaagaguguccucugagguuggcccuggucuucucgagcugcuggaagcuaacauuucacugccaggacaagcucaccuacugaggacacuucuaccccaaauuccaguucuuacuugaguuuaaccauucagcuugcuguuggguuuugauucucuaauucuuauuauuguuauuuuuaggaccaguuguagugaauugcuacugaaagcuaccccaggugacacagcucuuuguaaaccgcagucacacauuaggguuaguauuaaacuuuguuuagguguaccauaauuaacuuggcuaguuguuugaagucuauggaagaaauaguuuuaugcaaaauuuuaaaaaaaaaauuccaguuugaucaggaagaggguuccguggugcugagagccaggaaggugggagaaccucagguagagacaucgaguaccuugauugucuuacacuugagcagcccagguugaccuugugaugugaauugaccugaucagacuuuauuaaaaacguuaguaugauaucucugccugcucccccgaguccacuuuuucagcagugucuucggaaccuggaaucagccgucuauacccacugcccaggaggggccgugaggguuccggagagaccuuguuucuucucugcugcaccuguucauugugccuggcagaacacuggguagauguucccaccaaaggacuuaaguuccaggacucauuaacgcaacacauacuaagccuauauuuucacugcuguguaccagguauguuucagggucuguaaugaacaaaauaacccuuggacuuaauuggagacagaguuaacaagcagauuuggaucuggcuucuggauaaugagaaaugcaagaagaaagacagcagaaguggugggucagugacagcagaagaccacaguagguaggguggucuaggaagguuugaggcaaggggauucaaggccgucaucugcuauggagggacauggcagggaaaagaaaugacuuguauauauguagccacuugagguccgcucccccauguuaucuagcuugcuuugcuacuuguuacuugugaaugaaugaagaaaagacauauuucuuuuuucuuuuucuuuuuuuuuuuuuuuugguuuuuuccagacaggguuucucuguguagcccuggcuguccuggaacucacuugguagaccaggcuggccucaaacccagaaauccaccugccucugcuucccaaguuugguuuuggcuuugguuuugguuugaaaagacauuccuuauaaagauauacuuaguucugaggguggagguaggaguagcaagcaacacacaggacagggaaguaugucuguccgucugucugucugucugucugucugugugugcaugccugcuaaugucugucugugugugugcgugcuugcacauguggcugucaaagggcaguccccaguuccccagugcuguucuacaggagucaucuuuuuuuuuuuuuuuuuuuaauguucacugauguuugccuguguguauggcugugaugacgucaggaacucuggaacuacagcuacaaggcaggugugaggugccaugugguugcagggaaaugaaugugggucccccggaagagcacccaugcuuuuaaccucugagccaccucuccagcccccaucuuauuuucugaggagcucuuucacugccccaggguucacuaagcaggcuaugcuggccagccuccggaccccugggauuacuggucucccaguucugggguugcaagugcacuucacugugcuuggcacuuuuuucuuuuuaaacgugaguuucuucuggggcucauacgcagguuauguuuucaaggcaagcacuucacugacugaacuaucuuccagccccacagaggcuuaaugggaacaaaaccaaucgccagagggacuggcaaacuuaaagcacuuccaaggaucuugagaaaucaagaucaaaugaauagaaauagucuuucaucuccaaacagaaaaaaaagaaacaaucacugaugaagagaaagagacaagaccagaagggacaaagcacaacuucccuuagccccgaguuaauacugauuaauuacauugcuguucugcuauaaaggcagagccuucaagccaugcauuuacaugagcucuugggugaccugcugggugggcucuggccauuugcucugacuuagcaagcaggaugauguagcaugcucaaguucuauagacucagcuuugugaccauuacagaguuugcaacugaucauacuuguguugaaguguaggccuggccuugagccaaggacuugaugaaguugcugaguccuuccaaagauuuucuuaguucugugcuuagaaccccugacacugccuuggacagguggggacuguauuuauuucugucacuguccuauggcaggaaaugaacaacaaagcaagcaggugcguuugccugccccaacagccuguauccuccaugccauagacagaagcuguggagaucaugaugcagagagggugauggccuccauagcugcccaggauuugcuucugcaaauuuccaaaggucagucucccaucaguagacagagggaggcugaaagaccgccaucacaagcuaaggguguacccaugcuuagagugacccuccguaucuacugggaccacaccccaaacuucccugggcuuuacuaaaguaaagguagaugugucugcgagcgcaccacagagcuagcccagcgcugcuggaggggaaauuugaucaccagaacauagaagccggaggccuagucagguggguuuacggcaguuguagaacacauuugagaugcuuuaugcaacucuggccugauguuugcuuguaaugugggaaacaggacugcuggggaggguguaguaaagcuguuaagacuguuaucaacaggguaugaaagcagccuccugugggaaugaguaacggcucuuggcuuccuguuccuuuucucuuuuuuuuuuuuuuugguuuuucgagacaggguuucucuguguagccuuggcuguccuggaacucacuuuguagaccaggcuggccucgaacucagagauccaccugccucugccucccgagugcugggauuaaaggcgugugccaccacgcacagccuguuccuuuucuuagcagcccucccccaacccacccccaaaaaacaauuguguagcucaccucugaauuccccaggcuggauuugcuuccuacuugguauuuccugaacacaaguccacacuuguaggucuuuuuguuuuuuaaacgugucagccuuuaugauuuccagucauaugcuguuccaaauaaauacacuagccauuaguaguaaugacacacuaaaggugccaacuaccugucuaacuaucacauauaucaauucauagucacucagaauaaggagugacuaauuuaacaaccaacaggcuugaucccaacacagccaaagcaagcagugagaauggaucccacagugcaaccugagcugcuucugugccaucccccagugggacuguuaggacuuuaccacagccgucccguccagcuagugucuacagagagcucucaagcuuagagccugagucacccccagccuugugccucuugcucuaccccaccaaguagcuuucacuacaagucccccacucauccccgucuguaugccugcaucuuccacgacccacaaccaccuugaacugcugcugcucuaagcacagucucuucucugggcaaucgucacugugcccugguucaugcucauccaggagacagagagccugguucagacccuccaggaacuucuuucagaaugaugugggccuguuuccucaccaaaaccuacgauaacaaaaaagcaguuuuuccagggcugcuaggagaacaaaguagcugaucccuaccuaguaaagcacauuaggaaacacgcaaaacuccuuucagguuaccucaaccaucuuugcucaaaccccuucacuguaauggagacagugagcaagaacaggacuagcaaacaauuucugugcagugccaacagguaagcauuuuugucauuaaaagagggagaauuuguuuuauguauuuugaccauuuuaaacugcagguuggguauugcucuuuuauaauaaucccaggacuucccaggagguagaggcaggaagaucaggaguucaaggccagccucagccacauagggaguucaagaccagcuugcuugggcuguguucaaagaaaguaaagcacuuagcuguaaauaaaauugaaggaagucaaugacugugaggccaggcuuggguuaggcuuccagcugccaguguauauuuugcgaggccucguccuggcuuagagggucuagccuccugcuggacggcucugggguccuggucugcugugcagugccuuaucuuccaggaaggcuguacugaggcagucuauucaaggagguccaaugugcuuauugccacggcugccuaaccaguucacuuucuacccuguuuuuugagacaggguuucucuguguagcccuggcuguccuggaacucacucuagaccagacuggccucgaacucagagaucuaucuacucuuugccuccugagugcugggauuaaaguacaacacacccaguuuacaggaaccucuuuagaguuugauuuuccacuguggauccaacagauccaacucaaagauuuugcagaaagcacuuuaccuuuuugggggggagggacuuagaagugggggaggcagggucccaugcuaugcacuggagcccugagcccuuucaccucacagcuccuguuuauuugcuuguguaagcugcuuccucugccuguaaaguucuuaucuuuuuaucugccugagaaacuccagaggcccauaucugauugcugcugucuacaguuuucccugcccccaccucugcuguaagacagcuagcuggcacacuugcugggugccaggcacagugccccauaaggaaaauauucuacuugaagguucagagaagucuagugacugcuuaugucugaagaugugaagggcaaggugagggcucagaucugagcugugugucacuucuguacacuucccuguucugcacgguucccacuugugcguggucugucccuuaugauacucaggcucaaaugaacaagcacacuagacaagaguaaaagaccaagccgagaugcaggggagagguggaagcccgggacagguagacauccccacaacuugggacccuucccaggauaccuuccccuccaguucuuggaaacaucuuaaaugcuuuaagcuguaaaaggcacccaggaacuccaaauaggucaucuuugucucuugugacaaggacuuggacucggcccuccaauucacccuaccccaacaaggagauuacucuucauaccaauaacugaaaccaaaaugcuuugguccaucccacaaggaacacugacaaggaacccuuaaagaugagcccuuccuccuccagcaucagcucagaccugcaaccuauaccuucuccuuuacuuuguucuaaaucaguacguguucagauguggacacagguucaagggaacagaggguuugagauacagauacaccuacuucaggccuuccaugauuccagccacagggaacacgucccugacugcccccuaguggcucacucuuccucucccuugcugccuuccucuauuagcuccccuccuuuuuuccuucauccugggccaacccuuacucucagggacucagaacuccucccacuguuuugcagaguacauucucccuuuguggggugggggaaagcaaaagaauaccaaugauaagaagaaugggcggggguugggggguguauaguucuggugguagagugcuugccuaaucugcaugaagccuaguacucuaucuuacagaguauacaccacaguaaauagguguggugcauagcaguuagaagguucaagagaaguucaaagucguacuuagcuauauagcaaguuugagaccagccuggguuauacaagacucucaaaaacaaaaacaaaaaaauugucaagccgggcgugguggcgcacgccuuuaaucccagcacucgggaggcagaggcaggcagauuucugaguucgaggccagccuggucuacaaagugagcuccaggacagccagggcuacacagagaaacccugucuugaaaaaacccaaaaaaaaaaaaaaaaaaaugucaacaaccuuuaaaauauccccuuuaaauuaggaauuccacucuucgaagcuauacaacaaagcaacucuaaagaucuuauuguccaaaacucaugcaaaauguccaucaguuagcucauauauaaagaucauuucaaaacauuugauaccaugagagaaaaaggcuuauguuaaaagcuguuaugguuugggugguggugguacaugccuuuaaucccagcacuugggaggcagaggcaggcggauuucugaauucgaaaccagccuggucuacagagugaguuccaggacagcuagggcuacacaaagaaaccccaccucaaaaaacacaaaacaaacagccaaaaaaguaauuaugguacaggagacauagcucagcaguuaagaacacuuguugcucuugcagagaaccugaguugguucaagguacucucaugguagaucacagucauccauaacuauaguuccaggagaucuaacacccucuuccaacuuaugcaggcauacauaagagcagacaaaauauuccuacacauaaauaaaauauaaaucuagaaaugauacgaggggcuggggagauggcucaguggcuaaaugugcaugcugcucuucuggagaagggugacuccuagcacguacagaaguuaguucacaacuacuugugacucuagcuccagaggauggaaaagcucuggccucugaggacaccugcacccauguauacccagacacacacacacacacacacacacacacacacaauguuaaggguuacggaaaagcaguuauuagaaagcagcaggcuagccagucgugguggcgcaugccuuuaaucccagcacucgggagacagaggcaggcggauuucugaguucgagaucagccuggucuacaaagugagcuccaggacagccagagcuauaaagagaaacccugucucaaaaaaaaaaaaaaaaaaaagaaagaaagaaagaaagaaaagaaaagaaagcaggcuguaaggaaacaauauugcuuauguuacaagguuuaaacaguuaaauacaggaaauguaauugcagcugguuugcuugagucccucauacuguuaacauaaagauguaaugccaagucaagcccuuucccacugaguagcuugauguguaccaagcaugugcuugggguguuggcucagugcuaagagugcuuggccaggaauaaagucugcguuugacgcgggguaacacaaacaacacagaauuuaaaacuaguaagaagugucucuguugugaagacucauuuugaauguuuacagauacaaaaugauccacuuuggggcuggaaaagggcucagugguucagagguacucuuacaggggaccagaaucaguucccagcacacacauggugacuuauaacuguaacuaauuugaguuccaguguaucugaugccucuucuggccuccacagguaccaggcacacaugugaugcacagacauacaugcaggcaaaacacccauaaguauaaaauuaaacuuuaaaacaacaaaaauauucauuuugauuuuguguuaaugcaggagcuugcucaugcuaggcaaagacacuacugucagacuacaaucccaguucuaguauuuauuuauuuuaguuuuuuaagacaggguuucucuguguaguccuggcuguccuggaacucacuuuguugaccaggcuggccucgaacucagaaauccgccugccucugccuccagaaugcugggauuaaaggcgugcgcgaccaugcccggcccuaguauuuauuuuuaagaugucucucucaagcuucccuuuccuggugacucauguggaaggcagauguuauaguucagaccuagaauguccuccaaaagccugccuguguauuaaaggcuugguccccaguuuggcacuauuaguuuugguaaauuugaauaaagcugccauaaacauccauguguaagcuaggugggcggacauaugcuuucaacaacuuuguauaaauaccaaagaacaugcuugcugaaucaugugguaggaacauggcaauuuuuuccuuuguguguguguguguguguguauguaaggcagagauugauacuggguuucuuccucuacccucuaguuucuuuguuuaaagcuggcacccuggugagggugcuccagugcugggauuacacaccugugcgguugagcuuggcuuauguagguacaagagccauuuccacagucuacccucuuucuccucccccuccuccuccccccucuucuuccuccuccguuuuuugagagacaggaucuuauuuaaccuugaacucauaaucagucaaguaggccccaaauuccacauccuucuucuauuucccagguacuggguacagaugcacagcacuacaaacagcucuaauuuuguuuugccuuuugagacagagucucauuacacacuuuacaaagcugguuuugaacucacagagauucuccugccuuuaccucugauugaagcugaaugcuggggauggaggccuagcccucugaaucuuggugagugcccugacacuaagccacaguuuggagagguuguuuuuuauuuuuauuuuuauuuuagcuuauuuugaaaauggguuaaguuuuaagaguauauguugcaggauauuuguucacacugugaaccccaagauuguuauuuacuggggggaaaaaaaaaacuguuucuaguuguggugugguucagcccuuagcgcgcucuuuuaaaaaaaguuguuuuauguauaugaauacauugucccuaucuucagacgcaccagaagagggcaucagaucccaguacagacaguugugagccaccaugugggugcugggaaucaaacuuaggaccugugaaagaacagccagugcucuuaaccgcugagcaucucuccagcccccuagcauauacuuuuaaucuuucuggcuggaaauguagaaggaagcacuccuguuagaaggauuuaacagaauaagauaugcccaguucucagagaagagagggaaacgaagcuacuuaagagagaacggcacaaccgggcgugguggcgcacgccuuuaaucccagcacuugggaggcagaggcaggcggauuucugaguucgagaucagccuggucuacaaagugcggcguuccaggacagccaggguuauacagagaaacccugucucaaaaaaccaaaaaaaaaaaaaaaagagagagagagagagagagagagagagagagagagaacaaacagcacagagaggaaggggaggagccaguuucauugggagaguuuuacagagacaggcugaagagagagcaagauagacacaagugaaaacagaaagccagugaacgagaaaaagcuagauuagaacagauugcuaggggcuggagagaugguucggcggcgguuaagagcacugacugcucuuccagagguccugaguucaaaucccagcaaccacaugguggcucacaaccaucuguaauggaaucggaugcccucuucuggugugucugaaaacagcuaccguguacucacauaaaauaauaaaauaaaaauauagagcagacugcuagaguuagcauggggccaagcacaucaaaagucagaggcugagggugaagccagauugaaugagucagcuuggagaggacuucgaggcagaacagcugaguugaaccaaccugucagaguucagaaagaacaaggaagggugagcuuagucagcagcaagccucagaggcugaaaacauuuugagcaauauaagauuguauggaggcuagaagcuuccaggacuaugccuaaguuagcagacugaggcaguaagccucagagaugacaauuacaacaggcaaauaaaaguucuguaacaaguauagcuuaguguauagcguaguguauaguuuagugcuguauaacacuugucuaaauaaaauaaucuagguuuagugguccauaugcugcaguuaggagacuaaaguaggaggacugcugcuaugaguucaagacgagucugagcaguggaaauccuaucucagcaaacacaaaauuagaagaaaaaaaaaaguauugcaaauaauuaggucaggugugcuggcauucgguauaaggcaggggaauucacaguccugacacaggggcuggacgauggcucagcuuuuaggagcacuuguugcucuuucagaggacccagcaccuauaagguggcucacaaccaucaguaacuccaguuccaggggaaucuuugacaccccccccuucugaccucuguggauaucaggcacacacauggaacacaccucuaccugaaggcaaaauacucauacacauaauuuuuuuaaaaaaucuaucuaucuaucuaucuaucuaucuaucuaucuaucuaucuaucuaucuaucuaucuaucuagggccagaugugguggugcacaacuuuaccagcccucaagacguggaucucugggaguuugaggccagccuggucuacauagugagcuucaggcaaaucaggacugcaauggugagacucugucuccuaaauaaauaaaucuaucuaaaaauuuuuuuaaggaaagaaaaaguuucaggccagccugaguguaguagugaagugguaaguucuggccuggcaguggugguucacaccuuuaguucccagcauuugggaggcaaggaaaguggaucucucagcuugaggucagccuagucuacagagugaguucuaugacagccagggauacacagaacccaucuccaaucccugcccccacagaacaaaaguucuguguauauuugcugaguaguccuccaucacugugucucacacaaguauuuccuuugacuguguuggcucauccucucccucucugacauugucuuucccagagcauacauuuuaguaauuuccauuaaguccauccuaucaguggcuucuuucauugcaucaagccuuuguuauucucucccauaccugucugucugucugucugucugucuaggauguagucugggucagcaucaaaauuguggagugccuucugccucaacuuccugauugcugggauugaccacugugcugauguguugucucuauaaguagucacuaacccacacccucuaaacguuaagaaaaucaugugugugcacaugcaugcucauauuagaugacuacuguuagaguugguucuugucuucuacuguguacauuccagauauuaaacucagguugucaaacauggcaaacauggccuuuauuuacugagccaucucacuggccccucauuuagcucccacacccuuguggaguuacauguuugguuuuacacuuuauaucuuauucuaugauauauuaauuuuugugagauguaugagucuaauuuuuuuauguggcugcauaguuuuucuguaccaacauacuguauugucuuuguuccuuugucaaagaucaguuucccuggaaauaggggcagcauaccuguagccucagcuucuugggaggacaaaggcugacucaggaguucaagauugaucugggcaacauagugaaacccaccuuaaaaaaaucugcuuacaguauuucuuguucuauuugugggcuguauucuugcacugauauacuugucuaguacaugaaguaugugcgucuucugacaauaagaggcugucucaguguaagaagauuuugguuugcauuuauuuauaugcauguguguagcuugaauguggaagucagaggacaacuuucaguugguuguugguugucucuuucuaggauguggguccagggauagaacucaggucgucaugcuugguggcaaguaccauuacccacugagccaucuuggcacccccaccaccauccuguucugagucugaagaccaaagaauuucuguucucaaaguguagccccuuacuucaguguugguuuggcuauucugugucuuuuuccucucuccauguaaacauuaggaaucagucuaucuagaacuacaaauaacuuacugggauuuugggaugguuaugaaccuauaaguuguguuggaaggacucacauaucuuggcagcaucaagucauccuauccauaaacauggacaguguuauuaguuauuugauuuuguucaucagcauuuuauaagcauuucauuaaaucugucuuauguuccauuuuucuucugucucacuuugaguguacugggaagcaacugaguuuuuuauauuuguccuacaugaccauggaagggacugcuuagcaugguucucaccccuggcgaagagucagaagagcaugggccuccaagacuguuuaugguuacuguggucacagggcuugucuguauaauaauguacauauuuuacuuuauguucccccuucaggagauauuuccccugccaugauaauuagaaacaguacaagucugggaguuaaggguguaucuauguuccucagcaaaaaugguaaacacugugacuuucaggacggcccuuaaaacugugggaaagaacucugaacuugaacaugaguucaagaauauauaauuucucaacuaugcaaaauauaaggaugcucuaugaauuguauaaggagcuucacggaccuaaaagaacagaggcagcugcaccaauaaaccagcuugucagaaagauacaaaggugggcagauacuugaguucaaggucaguuugggacagagccaauuuaagucuaggcauggugggaaugauaucaggauggaaccccagccgggcaugguggcacacgccuuuaaucccagcacuugggaggcaggggcagguggaucucugaguucgaggccagccuggucuaccaagugaguuccaggacagccaggaaacccugucucggaaaacaaacaaacaggguggaaccccacccagcuagucugugcuuacaaaggcaugcaaaucucugaauucauuuucuuuucuuuuucuuucuuuuuuuuucuuuuucuuuuuuucucuuuuugauuuuuuugugacaggguaacucuguguaguccuggcuguucuggaacucacuugaauucauuuucaauguuaaaaaaaaaaugcacuugcugucuuuuccuaagaaucaaggugcuuuggucauaaaaugcugauucaugggauaaucaaaaggaaaccuggaguaacuggcuugauauguaaauaaaagacuggguuuugaucuauaagagagaacugcuuggagagugaacacagaucuuuuagaauuauuuuuucuagcaugagagagcugucuugagcagacuacaaagcuaagggcuaucuacagagcugucucaagcagaauacagagcugcccgcuugcaccccaccucauugguguuucuuuugcugaucucagacccccucuucaaucaaggcugauccuuggcauauaucagccuuauauccugcagcguucucugcaaugucuuauuacaaacagguugucuugucugggaagugguggcgcaggccuuuaaccucagcacuugggaggcagaggcagguggaucucugaguuugaggccagccuggucuacaaagguaguuccaggacagccaaggcuacacagagaaacccugucuugaaaaaacaaaacaaaacaaaaaaacaacaacaaagaaacagcuugucugccaguucuuuggguuuucuagagcuccuuacaugaccugugagcacggacaguaucuccccuuccuuucaagcuuuguaccuuuuuauuauuucuuuuuguuguuauauugcauuuacuaggacuucccauacggagagaaaauccuugucuuucuuguuccucaccuuggugaaaaaacucguaaguuaacuauaauguucaaguguuucacagauauuaccacaucaaagaaguuccuguuuauuccuagauuguaauuuuaaaauuauaaauggauauuaaaaaucuuuauuaccuuuuauuuaguguguguacaccauggugguaauguaugcaggucagagaacaacuugcagguacgagugggucccuuccucccaccauuggguccuggaaaaaacucagcuuuggcagaagccgacaccugaauucaaauauuucuuucuuuccuuuuaaaagcuuaaacagugu

SEQ ID NO: 5841 - RNA, 37594 nt, Mus musculus
uaccuggcaacagcgagguaugcccggcuuacuauaaaaggggcuguucgcccccuccucucccuuacucuuugcccccuucccccuccgcccucucucuucacgcguuccuggccggccucucucccuucuccucauucucuacucccuuuccuacuccacuucccaugccuccuccuccuguucuucuucuuuauaaaacagaacaaccacugaccuuacuuucuuguacaaggcauuccaaacugguauuucuagaacuggcuuuuucauccgcccauuauuuuugcgacacggucccauguaucccaagccugcuucgaaaacgacauugaaguucugacccaucacccgaaugaaugcuaugauuagcuggcggguacgcacauauuuauucccacgucuucacgcgggcgaggcgagcucgcccauccaccgagcugccuucccuccucuuccagcgcuaggaaacccuacggaaagaccagacgcccuccccuuccugucccggggcggaacuuaccagccgggcgccugggccggagagcagcgcugcacaccagccuuuuccggcuggaaccggaaguuguucuacuagaggcggcuccgcgucaggugaccaaguucccgguaggaggggucggagguucaaucuuucugacugacgcgucucuaagacuggcucggcuacuccgggacgggggaacggacagcuggcgucgcuggcgcucgcucuaccgcggcggcagguaggugacgagcugggacggcgggcccgggaggcaugggacccccuucccaggcucagggaucugaagccaagggccaggagucauccagucuggcucuguccaggucccagaaggaaggucagacuggcauccguggguacagauugggcaaacuaaggccccagaaaagggaaagaagggugcgcacaagcuccccuuccagacggggcucguccugacucccguagccucgggggcgggaccgccucucucguggguggcgauuugguggaguggaaagaugaggaaugcggugaacagauuuggggugaagcguaggagaccuggacuugaguucgcugccugcagcucacugugcguucgaggccaagucuuugaccucccugaaccuaguucccacagcuguacaaccgggcacagcugucucaaaagcgugggccuccacagcaccugcuccgaaacccuccgggaugccggcucuccagcccugggcuuuucccacagcuuguuucgaaucugggucuggauccuaggaaaccuuauuuugaacguucuccucuggaguccuacucguguuugaagccugcucauccgaagugcggucccgcugugaaugcgguacucgauucgaggcagcuggagccggcucgauucuaugaaacuucuagcuuaggaaagaacgccggaggagaauaacuaacuaucuuuaaaagcuggcgcgggguggggguggggguugggugggggaguuauggcaaagaggccuccugcuugaucuuuguagcugaaagagguacagcuacgauuaauagguagguucuagggggaagacacauguguacuuacuauuaagaauuuaacggaagaauuaucagaggugacgacugauggggauugacugucuccuugggaaaggaaguauacaggaggcggcccuuuccaauuuaaaaggcucguauuaguauuuauugugacucuuaccucuccacugauaacucugucuucagaguguaugugauacuucuuuuguggucugagacagggucucagggaucucaggcuguccucaagcuccuuuuguaguuggccuugaacccggauccugcuguuucagucuuaaagagugccaggaucacucguuacuuaguaccauuaugccuacagaaugugacauuucuuugucuucccuucuggacucuccucccuaguuuauaucuccuaucaauaaggccagcacacuugaucuuauguaaucuuuuacugguugucacauuugucauccuucuuuucaucauccuuuuuggaaugauccauuaucugauaaaaauuauccaaaguauauguuguauuaauaaacaggaaauaaaaauuaauuaacuaaaauuaauacauuggucaguuaguaauuuuuguuuuacauuuaaguuuuuaaaauuuauuuuaagucggggucucacucugacauucagcucaggcugagaacaauuuagaaagucagucucugucugucuuaucugugucucucugucuuuuucucugucuaucucugcucucuuccucucugccuccaucccucucuuccuuuuccagaguauuauuauguagcccagggugacuucaaacuggucccccugccuuagccucccaaaugcugggauugcuuguuuugcccaaggcuuugcuugccagugggcucugauuacagaauggaaggccaauucaguuguuugggucagucuucucucugguuuauaaacugaacuuuaauucuuugucuagcaguguguguauaggugugagagugucugcaguuuuuaagcuagcuuucuggaugcccagcacauaugaccaauucuuuuaugguccugacuugcauaccuauagcuuuguaaucuaacuuuagauuuccuuauuuugcacuuuaccagacacuaaguagauaacuuuuccaucucccauuagaguacuuaagaaugcuuauguugucuggagaagcaaagauuccauauuaugacccaauucugcugacacuuccuccacaaaacaaaagguugggguugaaccaaaaguuccugccuguuuuccuguuguuuauguuucucaagauuaaaaaaaaaaaacaguugugaaauggucauucaguuguuaccuaacauucgagaugguuuggccuuagacucuauugucaucucggugguaaggaaaaugcucuuaauuuguuggauuuuuaaaaacuuacuaauuuggggguuucuuuuaaagggauacuugauugauguaaauguguucugcuggccugugaaaaauaaauuugaugguaaaaauaaguuuaggaaaagcuacuggccguuacccuuucuuuuuguuguuguuguuguuuuccaagacaggguuucucuguguagcccugacuguccuggaacucacucuguagaccaggcuggccucgaacucagaaaucaccugccucugccucccgagugcuggaauuaaaggcgugugccaccacgcccggcaccauuacccuuucuuaguguuguaaugcaaguuagaguucucacaauaaaaauucaggcuuuauaguaagcuggcauaauguuuugcuugcuugguguuaccaaacuuauuugguauaaaaccucuuuuuuuuuuuuuuuuuuuuuuaaauccuuaacacagggccuuucucuguaguguccaggguggcuuuaaacuuucucuccugccccagccuuccguacugggauuacugugcuccugcucaggguuauuuuuauguuuuguuguguuuugcuuugcuuuguuucguguguguguguguguguguguguguguguguguguguuccaggccgaguuucucuauguaacagcccuugcuguucuggaacucuuuguagaccagacuagccucaaacccaucaagaucuguuuaucucugucucaccaacaccaggauaaaaagcauaugcucuguaguuuuaauugaaaaacaaauuggcaaauucugauccgaaacuuaggcuuguaggccaaaucuaccccauggcuguuuuuuugcauagccucagagcuaagaaucacagcacacacccccaacuccuauccccccacaccccuaccucauucccacuccccauccaggcugaucucaaauuugugguuauccucuuguccaagugcuaagauuacaggcauauaucaugcuugucuggcuuuaaauuucuuguguuugaaggaggcuguguauguguguacaggcauuuguuugcuuucugauuuauuuacuuauuugcuuuuuuauuuugagccagagucgcucguugagcccagcgaggcuggccggccagcaagcucccaggaucuaucugucucuucucccaguccucagugcuaagguuacagauaugugcugcagggcccaacauuuaccugugugcugggaaucugaacucagaucuaaaacuugugccguaccacagcacuuaccauugagccaucuucccauccuggcuucacauuucuaaauggagaucuaaaucuaaauauuaaucccaaaccggcaguaguggcccaugccuuuaaucucagcacuugggaggcagaggcagguggauuucuagaggccagucugaucuuuugaguuucagggcagccagaacuacauagugaaacccuguuucaaaaucucaaaaccaaccaaccaaccaaaacauacauacauacauauauauaugugugcauguacccucucauguuuuugauauacauuucccucaagacugacaguauugagcauauuuucaugcuugccaucaucugaacaucuuguaaguuuuguacauuuuauuguuuguuuuuguuuguguauauccauguggcacagugcagguguggaggucggaagauaacuuguagaaucaguucucuccugacauuuggguuuaugaggauugaacucaaguugugaggcaugacagcaagcaccguuagcugcuaagcugucucucggaccugcucaucuguauaucugugugagagaauauucaugcaguuccuguucucauucuguaauugggcuauuuauccacagcuauagauggggucccugagaucccuagaaguaacucggaaugagcugaacggcacaaugggacaugccagcaacuuucuuagcuccaugaaacuggauuuagacaugcuaaagcacacaauaauguguccacuuuagacugcugaucauuuagaguuagcauaaccccaaccacugcuaaugugagcagccauguuccugcaaaagggguacuacuugugccccgaaaacaguaucaucgaagaugugguuagagcguguggagaucuuugugucugggagaacuuguugcuugucugucaugggcagagaagagagggugcuuggcauuguagaguauuuugggugaguguaggcucaggguuacagaacugcuggcucaccgugcugcuucugacugccucugaccuuaaccacaacaucuuaaauucccccacccccacccccacaccccgagacagaguuuguuuguguagccuuagcuguuccuagaacuaggaacagcuuguguagaccaggcuggccuugaacucagagagauccaccugccucugccucccaaguacugggauuaaaggcacgugccaccacuguccagcugcaccauuuugaauauuaaaacaaauaccccagucuuuuaaauuguuaaagauuacuuucuuuggaaaauuuagaaaaguaucccucuuacccacccuguuaucucuguauuaacacaagagaaccuuugauauaguuguucuuaauuccuuguuucuugucaguggguacagggcagguguguguguauguguguguguguaucugucugugagagacaaagugugcaugccaagugugcauguggagaucagaggacaaccugugucaguucucuccuugauaccuugcuuguuucccacuaucuaugucaggcuagguguucucccucccaguaacuucuaguauccugucugucuuuaugaaguugguuguuucaggcauuuccuguucacacaaugagugacuuuucauggaaauagaaauauuucccugaguucugggauuauagacauauaccaccauucuugguuuaugcaaugccagggccugaguuuucagaaauccuccugucuuugccuccuaucucccuguaaaagugcuaggauuuuggacacuuuccuuacaaugucugaucuucccuggguucuagggauucaaauuuggguuguagugcuuacucagcaaagacuuuuaccuguuuagcaaucuucauaacucacccuuaugguugaaccaguugguauacauagugcuguauuucacuuuuuuccuuaucauuuuuugagauugggucuuaauagguugucuagacuaguuacaaacuccugaccuuaauggaucuuccugcuucagucucccaaguagcugggauuacugguaccugccauuagcagguagccuguuaacauauuaauguuaaugucuuuuuguucuggccaguuuuuuuuuuuuuuuuguaagcaucaguuguaaugugugaaugaauuuccauuuucuuaacuguucaguuaagucaguaaaaacagacauaaugacugugauaaccacucagcaugcaaucaguaggguaggacaauaacagauuuguuuguuuugagauaggccucuuagccaaggauggccuugaacuccuuauucuucugccucuucccaagugcugggauuacagguaugcuccgccacaccuaacagguuucuuuuuaaaagacuucuuuuuacuauuagcaauaauaaauguguguguguguguguguguguguguguguguguguguguguguguacuugccuacacgcagugccucugggaguuguaugugguugguuaugauccacccaucaugggugcugggaacugaccccaggucuuuugcaagaauaguguauuccugagcaaugucuccaauccuaaaaacaaauuaaaacaaaaucucuuuugaauugugguuauagauauauauauguaauauuauauacauauauuauauaauauauauuuaguaaccauuuuauuggcuuugagguaucuaaguuauugcuauuaaguaccuuuaugauuuuuuuauaguuuuuguuguuguuuuguuuuuugaguuuuucgagacaggguuuugccauguagcccuggcuguccuggaacucauucuauagaccaggcuagacucgaacucagaaauccaccugcuuuugccucccaaguucugggauuaaaggcaugcgccaccacugccugacucccuguauaauauuaugugacaccuaucacuauagaucucuaaagcuuagucaacucacauagaaguugugcucacugagcugcaacugcaguguucucccuccuaauacuuccuguauccugucugucucuaggaguuugguuguuucagguauuuccuauucauaugagugaccuuucguggaaauauaaguauuucccugagugcuggaauuauagacauauaccaccauucuugauuuaugcaaugccaggcgcugaaccaagcacuacacaugccuagccccagcuuuuuuuuuuaaaaucauacuaagacacauuuaauaaaauuaccaucucagucauuuuuaagaacauugauacucuagaagcaucaucucuguuuucuccaggacuucacuuuccacacagaccugcuucugcuuuuucacaucuggaugagacaugggcccaccucucgauuuuguugaugcacacauaguacuugaguguuugaguguugagguuugucuuccagguaaccuugggacacauggaaguguccuuucugugguuauugauuggagcuggcuguucuauucuaggaccagcugccagguugauuccugcggugguaucuguaucagucgacagguugauuccugcggugguaucuguagcagucgacagguaguucccacuccaccagcuguucuucagaaguaucuggcgacauggguguaguuggccuguacaguacagauaggcagcucuugcaauaugaaaaccguccaagaugcauuguggugugaggaaauuuguuacugcuacgcaacaguugacuucugacuuggccguaaacucuauggagccaggaaacagaucuccucauguuuaucuuucaucagggggccuaguuggcauuuucuaaauguuugauaaguggcagcaguaaaacacagugauugaggagcuuuagggugcaagccugguuuguaaaaguuguuguuagagacuuuccaagugaugccuggcauuauuuuguguauguguguauaugccuaugugcacaggugcucauguacaucuguguuugaaggccagagggcaacugagggaccacuccucagcugccauuaccuguuuucuuugagacagucucacugaccugugacuuaccauguagacaaagcaggggagccagugugcccugggauuugucauucugccucuacauggcaccuuuuggaggaggagauuaggagaguauuucuggggauuuaaccuggauccucacuuuaccaacugaucugucuucucaucucuggccuuauuguuuuugaucacaguuccucaagaacuacuauugaaauaaaaaaaugagaucauuauuuugucacguaucugcuguguuguauuaaacucuuagaaagucuucuuaauuggcuaauucuugucagcccuacucauucuucuuuaauaguuuggaguauuuuagaggccuuuaacucaacccagggaaaaucugaauuaaugaaguucugcugacuuguuuaacacucccuuauuuuauaaagcaagaggagggcaggcacaguaaucacuguuugcaggagaggagcacuaacugagugaguggggaagaugggccucagcccacgcccauuaggcuaauuggguuuuuuuuuccuccuuucuuccuuucuuccuuucuuucuucccuuccuuccuuucuuucuuucuuucuuucuuccuuccuuucuuucuuucuuucuuucuuucuuucucucuuucucucuuucucucuuucucucuuucucucuuucucucuuucucucuuucucucuuucuuucuuucucuuucucucucuuuuuuuuaaauuguguuuuacuugagaaugacagcucuuaccugggaucucucccaaguuaaagagcuuuccccuugugcagcauugcccacuaaauugauuugaguuaaaguugccaaauuccuauuauucauucacauacauuaucugcuauccccucccugucacguuugcugcugaacuuguaaguuggaucuuaaaagaauacaauaaacugcauagucagucuugaguaugaacacacaaauucucacucacacacacacacaccagucauaaaucauaaaugccaaccugaacuguuuucugguuguagaucuaugaaaucccuuuuucugucuccuguaccuacuccuuuuucauuuagagacuggacugaagcuggggauauggcuugugggaguacuugucuaccuuuuugagucucuugaguuccauccccagcaccucccaccccuaccaaaaccuuuugaagcaacauuucuugaaaaccaaggaaugagucagcuguauaauuguucuaggucucaaaaacagccacugcucuuguagaauacugguuuuccaaaacuugaguugacuagauugacuuguguuuaguagugcaguuuguaugcucuuggaugucagcuuugaggugcuccuagggugccaagccuuguucugaguaaugugucuggaagcuaggacagaugugaguaaacacccaagcacaagucacugaaguaccagcuguuaugcacaugaccugggaugugaagcuuugccacugacuggcucugugaccaaucauggcaugagcgagugacguaacuacucagccuaauuuaacaucccaggguaugcuaacaguguuguaguaauuuuuaccucaaggcaagcagggaauauuaaaugaaauaauucauacagaaaagauuagcaggguguuagaagauguuaugguaagaaaugcaaaugcccuugacuucagcacuuuagguagaaaucuuaauucucugggucaagcuuuguuccauacuacauuuccuaccagugcauaguuacccaggcugccuucaaggaagaaugcucauucagaaagggacguaaugacucauuugcaguguaaccacgugcugauuucguugcucucugggggaauauaaggaguacuguuccugaauacuuaccuggauggagccucgguacuguuuucugucagauugugacagcuauuguguauagagauaaugacccauucuacagacaagcauggagaggagauaacuugggcaaaauuacacaauaagugagaacugaaauucacacuuagaguaucagauaucucugugccaugcuuuugguaaaauuauauuuaugggcuagagagauggcucagugguuaagagcacuacugcucuuccagagguccugaguucaauucccagcaaccacaugguagcucgcagcuaucuguaaugggauccagugcccuuuucuggugugucugaagagaucaacugugugcucacauacauaauauaaauaagucuuuaaauaaaucucuaaaaauuguauuuauuuauuuacuuacuuuacaauacaggguauugaacaccucucuaccauugagcuauucuccagccauuuuuuuucuuucaauuaaaaaaaauacuuuggggccuggagagauggcucugcaguuaagagcacuugaucuugcagagaaccugggcuugauucccagaagucacaugguggcuuacagccaucuguaacucuaguccuagagaaucugacacacucuuuugaucuccuugggcaccagaugcacauacaguacaaggacauaugugcaggcaaaacacucauauaauuaaucuaaaaaaauauauguauggguguugucuuaguuaggguuucugugagaaauaccaugucaaaagcaacuuggggagggaggguuuuauuuuaguuuguaacucugaggucaccccccaucacugagggaaaucagggcaagaacucaagcagggcaggagccauggagaagugcugcucugacuuguucagccugcuuucuuauacuauccaggaccacuugcccagaguuggcacugcccccagcaggcuaggccaucaaacaucagucauuaaucaaggaaugucccacagacuugccauaggccagugugauggauuguauaugcuuagcccagggaguggcacuguuaguagguuugucaugguggaucugggcuuuaagacccucauccuggcugccuggaagccagucuucuagcagccaucagaugaagauguagaacucucagcuucuccugcaccaugccuaccuggaugcugccauguucccaccuugaugauacuagacugaaccucugaaccucagccucaauuaaaugcuguacuuauaagagguucccucuuaaaugacucuaacuugugucaaguugacaaaacuccagccaguaauagaaauuuugugcaugcagagguagguguguguguguguguguguguguguaaguguaaagugcuaaaauuuuacccaauguagcucaugccuuuaaucuuagacaggcagaucucuaugagagacuagauuuagucugguccauuuaguuaguuccaggccagccagggcuacauagaccugucuuaaaaaacaaacaacagggggcuggagagauggcucagcuguuaagagcacugacuguucuuccagagguccugaguucaaaucccagcaaccacaugguggcucacaaccauccauaaugagaucugacucccuauucuggaguaucugaagacagcuacaguguacuuacauauaauaaauaaauaaauauuaaaacaacaacaacaaaaucucuaaaauuuccaccacaauuucaugugaaugauucuuagucugcuugcuuccuuuuuguccuuuguugaaauaugaagauauagaacuugggggcuggagagauggcucagugguuaagagcuuugacuguuucuccagaaguccugaguucaaaucccagcaaccacaugguggcucacaaccgucuguaaugagauuugacacucucuucuagugugucugaagacagcuacaguguacuuacauauaauaaauaaaucuuuaaaaaaaaaagaagauauagaacuuugaacaaauucccuuauuuuucugaauauuaguaagugagcuguugagaugggucaguggguaaaagugccuacugccaagcuuaugaccuggauccaauccccagggucccuaugauggaggaggaaaauaccaaccuccacaagucacuuguggcagguguacccacacacucacauacaucuuaaguaaauaaauauaaccaaaaauucaaauauaguauuuacuguggacaaaguggaaaguacaagugaguggggugggggcauccugugaccaucaagaugacccagcuggcaaaggcaucugucgccacuccugaugaccugaguucaauccuccacaccuuugugguaaaaggaaagaacuggcucccaaaagucgucuucugacuucccccugcaugcuauggcauggacuuccauacacaugcauaaaauaagcaguguaaguuuaaaaaacuuucacuaggugaaacauacuaguacacaccuuuuauucuagcacuugggaggcagaggcaugugaaguucuaugaguucaaggccagcuagggcuacaauagugagauccuguuucgcuuuuuuuugaguuuuuaucuuauguguaugaguguuugcccacauguaugucuguguaccacauguaugcagugucuucagaggucaaaaaaaaaaaaaagcacaggauccucugagccaguauaugguacugggaaucgaaccucugacucuuagagaacagccaguguuuuaguagcuaaaacaucucuuuagcauaccaauuuuuuuuuuagaagcuuaggcauuuugacuguaguucuuuuuuggaccaccauggguaauauuuuugucauuucaccuuuucuaaacaugaguauguucaacuuuguauacaggguuccuuuggauuuuauuuugagacaggaccucauguugaggguuggccucaaacuugcuuuguaguugaagauaaucuugaaaaaaaaugcuucuaccuuuuaagagcugugagguuacagguauaugccaccauuccugacuuuuauauacaguuuugcuuuaugacaaagcguuuugucuaggcuggcuucagaccuaggcuucugccuccuuaguguugagcuuauaggcuuauucuuccacaccaagucuguguguuuuguuuuguuuuaaucauuuauuuucacuuuguguucauugguguuuugccagcauuuaugucugugugaggauggcagauucccuggaacuguaguuauaggcuguaacuguagugugguugcugggaauugaacccagguccucuagaagaacagccagugcucuuuuacugagccaucucuccagccccacgccagcucuucguauacaguuuugcaucuuacuuuucacuuacuauuauaucauauaaguaaaauucucguguaauuaaaaucucugugggaauauaaucuaugucuaacagacuggaaucauauagggagggcuaggaguucagugacagaguacuuuuuuccaugugugaggcucuaggucggugacccugggugaagcccagcaucauaaaauaaaauuguuugguuuuaguguucauggaugugugcauauccauuugcaugacccuggguguguagguguauaugcuugcauauggaggucagauaacggccuugggugucauucucaggaauaucacccacugccuuuuauaaggggacucucaucaaccuggagcucaccacguaggcuagacuaacuggccagagagccucagggacccuucugucuagacuuguucaguguaggaauuacauguguauaauaccacuaugcccaacauuuuuauguaguuuuuagggaucaaacuaagguccucaaauuugugaagcaaacacugucaauugagguacuccugagaugccccucacucaccuccucuuuaaauaaagugugauaggcugcucuggugacauaugcuuauaauucuaguacucaagaggcaaggagccaggcagugguggcgcacaccuuuaaucccagcacuugggaggcagaggcaggcggauuucuaaguucgaggccagccuggucuauagugaguuccaggacagccagggcuacacaggaaacccugucucgaaaaaacaaaacaaaacaaaacaaaaaaagaagcaaggacaggaggaucacugcaauuucuaggcuagacaggugacauagcaaggcccugucucaaacaaaagaaaagaaaagauaauguaauggacaguguuccaucacaugguauacucuaccauuggaauguaccccuuuacauagcuagagagugggaaggaacuagauggggagagaaucauuaaaaucaugggcacuuuggaagguugggugggggguucaggcuaugaacuccaguuuagaguaugagcaagcaggccaagggggaaggagucugaggucuuuuucccugcucuucuugguuccucaccauucccuaggcuccuccuacgcugacuuuuggcucagugacuucaacaccugccuguugugcuguauguguauccuccucugcccucacauguucugcagaccuaucaaucaacgccaagcagacugggugagaucuuuuuuauaaaucugacaagguagaguagguugacuacauagggagccuauaaggacucaagaacaggaccagugcauccccgggaaaagaaagcauccucucagacuccucuauccuucuggaccuaaaaaagaucaugcaugucuuuaguccuauauuugagaccaggucuccugaggacuauuuaggacuuaaacaucauuuagacucuugaauuuuacagcugguuaauguguaucccagauuccacucaaccuacuuauuucuucucacugcagccuuucaugcaugugauauagacauucuuggaaugugagucucaucucugucuccauuuggucuaucagcaguguagacaggcucagacaugccaagguugguugcugcaaggauauucaacucugaaauucucucacuguucaguuucuggggugaacagaugagaacuguucggcuuggucaccuuuaagcucugcauuccuaacuaaauugcagaucugccuuagucucaaagcaccacuugugucacccuagacaucuccaacugaggaaugcuuuucuaacacuuuuuuuuuaaagauuuauuuauuuuauguauaugacacaccagaagagggcauuggauucgauuauagauggcugugagccaccaugugguugcugggaaucgaacuaagguccucuggaauaguagucggugcucuuaaccacugagccaucucuccagcccaaggagugcuuuucuaaaugugcuguauacucguaauaaaugaucauuuggggaaagguucuugguucagguuucuuugguugugaugaccaccaugaccaaaagcaacuuggaaaguaagaggguuuuuagacucacuuccacaucccagcucaucacugaaggaaauugagggagcaucaaucacuaauuaggaaaaugcccuacaggguugucuacagucuguuacaggagcauuuucucaauuuagguucucuuugauuaaaugacucuaguuugucaaauuaacauuaaaauaagccaacaagcaaacaaacaaaaacagccagcagagaggugcugaguguuauuguuguuauuuuguuuuuguuauuguugaguuuuauuuguuuuaagaaaaacaguauaacucgggugauucugauagaguccuuacaaaaaggauucuuacaauuuaacgugaacuuuuagcucggcugcuaaauuccagagccucaucuugguacugcucuucuuuguguaaccuccacucagcagcaauaaauguggccugcaguugucaguggagaauugugcgcugcaugagugggugaaugaaugaugaguuugcuccauacuucauuaaggaagcacaaaacuuauagcaaugaguuugggggcaaagacugcacaucucucauaaagcuacauguuagugagguagcauaaaacuguagaguggaacauagaugguucagugguuaagagcacuggccucucuuccagaggaccucagcuugauucccuacuacccauauggcagcucaugcaugcccucuucuguccucugcaagcaccaggcagacagacauauaugcaggcaaaauacauacaugaaauaaaacuuaaauguaaauguagaguggacuuggagaggugucucugugguuaauaguacuugcuguucuuccagaagacccagauuugguucccagcacccaauacugcagcucacaaccaucuguaagaauagagacuguguuucuaguguacuggagacucugaaucuggcacugugugguagccgggcuuuaggcaaguccuuuaacuucccuggccugaugcucuuaucuguaaaauggagugagggucagaagcaguaauagcuuugaacccgcaguaugcuucaggugaagaauaaagaauggcuggguacgggcuguagagauggcucagcccauaagaacacugacuguucuuccaaagguccugaguucaaaucccagcaaccauaugguggcucacaaccauccguaaugagaucugacucccucuucugcugugucugaagacagcuacaguguacuuauuuauaauaacaaauaaaucuuuaaaaaaaaaaaaaagaauggcuggguacaguggcacaggccuuuagucccagcacugaggaagugaaguagaaugauuaccuaggcccagaaguuccagaccagccacagugagguugcuguauugguaagaucagagucuguaggcucuauaaggaccaagauugacuuuagcagcucagcaagggucaggcccuauuuucuucuaauucuagguagaagucuaguguccgagucaaccaggaccuauauuaucuggccacuguccuaguccuacaagucccaugaggcuguggcuacauuuuuuugcucuguaggugcucagcugauagccccaaagcgaugcugcucaucucucuuugcacaugggguuggggaggagguagagaagaggcuucauagaugaguauauggcuuuggaacccagacuugcaaagggguuugugagcaggcagccuggcgguugaccguaaccagucaugcgcacuuguacucacucauucagcaguuaucugagcgccuacuuggaugaggccuggagaagggagucaggauaagaguggugugggauguucagaguugucaugucccaguauuugggucgcugcauggcuauuauacccugcaaacucucagcuggccuuuugcugucuccugacuauuccuaccuuaacaccucucuuuaccccaguuuuugcaacaugccugugagugguagcaugagccaugcagagccuuguuggaucggguaggauggguugauuguaaguauugcauauguggcaguagccccuccuacauagguuugcccuagaucacugaucuggguagcccagugcuuacuuuucaggggauaaacgaaauuaguuaguuuauauaaccuggguugaccucagauuuacauguagccaagaaugucuuugaacuucauucagauccuccugcuucuaccucuuuuuuuuuuuuuuuuuuuuugagacaggguuucucuguguaacucuggcuauccuggaacucacuuuguagaucaggcuggccuugaacucagacauccuccugccucugccucccaagugcugggauuacaggcaugagccaccacugcccgaccugcuucuaccuuuuaaguuuugagauuauagguaaaugccacugugccuuauuuuaaguggugcuggaaauccaguuguuuuaugcaugcuuggcagacucucugcaaacugugcuacauccccguugcagagaaaagaaauuuaaaccauggucagucaguauuagagucgaauuugaauuuagagcuuuucaggauugaggaaaauguagacauuauagguacugcuauacuagccugauuucaaaagcaguauauuaaaaaugugaugcaucaggacauggugauauauaccuuuaaucccagcugaggaggcaggagcaggugggucugugaguuugaggcuggccuggucuacaucaugugggugcugggaacccagguuuagaucuucacauuuaaacaagaagcauuuuacugacugaaccaucccccuagccuuauucuggaauauuuuaaaguaaauuccaaacauccuauucuuuaauuaaaaaaaaaaaucucuguauaugcgugugcauguauaacuaugugaguguccuuccucuggagugaucuaccuuguuuuuugauuaagucucucauugauuggcccagaguuggccugacuuaaaguuacaugauaagauuauaacccaacaaaauuaacaguaauucugccaauguuaaacaaaacagaugagcguuaguaguacacauaaaaugaaguagaucucagaagggagcacuggggcuuguggaucuguauagugauggagugcucaguguugaacuagcauuguaagggccuacauuuacucccuaguaauacacacacacacacacacacacacacacacacacgguuauaaagaggaaaaggaggaaacucuagaccaugaagaaggucuuggaacugaggcuagcaagacacugcuaccgucagcaaccagcugcccuucugggacaucacguaaaaugauguaacugagugaaaaaguggcagagaccuggucucucucccugcccuagucgcuaagcugcaguuguagugagaguugcucaugagccccaagcucuaaaucuguccugugaaggugcaggggaaggcuucuuggucugagaaaaccagcuguggggacuugauuuuuuuuuuuauuuggaagcugaagucaaggugaucugauaccccaguggugaguccucauuuuauaccugagaaaagcauggccaggaaaagugugguuccuagcaggcuggaggcugggcagagucuuuaggucucuaugguagccacccaguauuucugcuucuaauuccugaacuaaugaggguagccauaugaagcuccugacaggcucuuauugugcacucagaauuccuggauaugccuuguaugggucucuuugucuuugcuugcuuucuuugauuuggaagugguggucaauaaugauauguuuuucacuggcaguuggugaccagccuuagcuauggugauguggugauuugaauacaaauaguguaccaugaguccuggucucaaacccacacuaaucacucagccagcuaacucagucuuccugaagugaccaggacugccuagagcaugagugucccagaugacuuugggauguaugggauggacaacuuuuccuucacuggcauaaauuccuuuuuaaguguguugauauauuuagacaaaauaagguaagugguauccagcuggcagaaaguaccaaagaucaucaucggcugcuucaagcuucccaaucuuucccagucacaggaauuucuuuauauucugccauauaucagucauaaucuugaguagauucuguucuccuagucaacauaaauuguccaaaauuaaaagauagcuuggccgggcagugguggcgcaugccuuuaaucccagcacuugggaggaagaggcagguggauuucugaguucgaggccagccuggucuacagagugaguuccaggacagccagggcuacacaagagaaacccugucucaaaaacaaaaacaaaaacaaacaaacaaaaaaagauaccuuggcaguucaauuuaauauuuaauggagaauaauacuuauuaccugcugugguuaauccaggaaauauaaaugggaaagcuguguugagaacuuucuagagguugcucugcauuuuugcaguuuguguuuuaugagauguguucuugggccauuuccaucagcaacucaugaggagugcaugagcuucugucccugccgcccucugggaagucagcucccaguucaaucauaguuagaguuuauagcugagagaagaugagguauuggcuuggaaguugagggaaguaggcugcagcaauggacaaucaagugcuuucugccuuccaggauugucuugagaaucuucccuggaagcuuugcuggcaagcagccauggcaaguaaagggccuucggccucugcauccacugagaauuccaaugcaggggggcccaguggcagcagcaauggcacuggugagaguggagggcaggacagcaccuuugagugcaacauaugccuggacacagccaaggaugcugucaucagccuguguggccaccucuucuggugaguacccuuccugccaucucuguggacacccuaccaaguuugaaagcccgugacccuaggcagauguuucacuuuggacagaagauguuugggguagaugucucacucauuuugauucuugaugcucucagacccaagggacaagaagcuucaguuuccaucccagcuguacugcugaaggucuggguaaccuugggcaaauccuguuuuuacccuggccagcuucccaucucgccagaaguaaggccauuuugugagcguguacugccacuugagcaaggcucgcuugcugugcugagucuacauucaggauugcguggugguuuugagcaaggacugugcagccagacuuugucuucucagaucuugacucugccacuucccuaguggaugaccuuagacagggaguguacaugcauucugucuuauuuuacagacuuauuucuauuaaauggccccaaauagugagcauguugaauuaccacauagcgugugcuggcuuugauuguaauuguucuguauucuauguguauguugugaaaugaagcagcaagaucaguguccuagucucagugccuaagagaccccugcugucucugagaacuuagguggauguggaguaguggggaguugauggcaaauacaguccagggcccaugccaccccagagcaggcgguuucuagagaugggcauguauggugucagcucaugugaaucccuaaggcaguugucccccucucgacaaaaacaaaacccuggaugggauguuaggaaacaagaauagcuguggagggaugggccagauuaucaaacccaggggacauagaccccauuaauauuuuuguguaggaauauggugaagaaagugguauuugagagaguuuaaauucucagcaauauaaaaguuaaauuuauugaugaacuaauagacuaaagcaaagguuuuugauuuugagauuuuuuuugcacuaauuguuguuuuguauagacgaaagugagaauuaagagaggcagagugaugcugaaaagaacagauuuaaagcaguaugugucuagacugcagugugucuuuaacaaauccauuuguucucugcaugucagcuuccucugucccauagagaugguuaugccuccuggugccauccagugacaagaaaaaguaaaaagcaacucagccacucugacacauaguaauugcuucauagggaggaaucuucaucauuauuuuuguuuguuuggguuuugagacagggucacuauguagaccaggcugaccuuaaaguuucaacacuuuucuugccucugccucuggaauccugccuuuauuacaauccuaaggcuuguccugaagguuacacuuuuaaccuacagcauuugagcgaacucuaguggaguccuguuguuauuugagaugcccucuagagaggucacaguggccccagaagcucagugcuggguucagauuugagcauuuauuuccuguauuuaagacccugcauugccaggugaugguggugcaugccuuuaaucccagcacucaggaggcagaggcagaggcagaggcagaggcagaggcagaggcagaggcagaggcagaggcagaggcagaggcagguggauuucuaaguuugaggccagccuggucuacagagugaguuccaggacagccagggcuauacagagaaacccuguuucgaaaaaacaaaccaaaaaaaaaaaaaaaagaaaaagaaaaagaaaaagaaaaagaagaagaaaaagagagacccuucauuuguaugugaagcuagccuuguucagggauugcaagaaucacugucuccuuaggccauggggguuuuuuguuuguuuguuuguuuuuguuuuguuguuguuugcuuuggguuuuuuuuuguuuuuuguuuuuuguuuuguuuuuuugagaaaggguuucucuguguagcccuggcaguccuggaacucacuguagaccaggcuggccucaaacucagagaucugccuccccugccuuccaagugcugggauuaaaggcaugagccauuacugccuggcuuaggccaugguuuuauucauuuggaaaagacacaugaugugugagaggugccaugacugccacauaguaaguuguaguagauuuuuguugacuuucuuaauaagaaagcaaagaaauacuaaaaaucugggauugaauacuuuuccuuuagugcucuaaugccauguuuuuaaugcagcaauagauauugaaaagacaguagagaguuuucaguccugauguaaguuacauguuucugaaccuuggcuuccuccuuugaaaaacaagacacuggaaccagggguaugguuccaucuguaauccuagcacccaagaggaagcuaaggagguaacuuaaugguuaggagcacuacuugcucuuccagcggacccagguuugauccuuagaacccacaauagcagcuuagaacuaucuguaacuccaguuccagggaaugcaacaaccuauggcuuccgugggcaacaugugguccauagacauacauguaagaaacacucaugcccguaaaauaaacaaauaaauggaauacccugaagccugagguagaggauuaggagucugaagccaguuugggcuacaugguaaaacucuguauuuaaauaaauuaauuaauuaauuuaaaaagaaaaaaaaaggaaguaguguugggcagcagcucuauaagguggagguagccuuucccaaguagcuucucugucuuucccauuacaaagauguuuugaauaggccuggccuuucaaaccacuuccugcuaggagggcaguuuguuaaauuggauuugaaauaauagaaaauccauauaucacuugugagccuaaggaggcuguaaacccaucugauacagugcauauuuugugugugugcgcgcuuuuauauugucauguguuacaugacagugcugacuuuucaugcagagauuauuuggcguauauuagauuccuucagaaccuauaauaucugaaagauuaaccuauggauaagcugugauugguuggccugguuuguuuguuuguuuguuuguuuguuuguuuguuuguuuuagggggguucaggcugaagacuggagucaugucucucuauucuauuguuuuuccugcgaguuuagcuuuuucuugucuguuuuguucuuucauuuuguuguuuuaagacagggucuucuauagccuaggcuguaaacagucucccuguguaguugagggugaccuugaacuccugauccucuccugccccugccucccaagugcaggauuacggaugugugccuccaacccuuuuucuauacgugaucccccugauuggugugaagccucacugggguugcaguacuccaguucccccuucugaugucccuucccuacucguggaguguuucugcuaaugaaagcauuuuucuccuucccgcuuuccuuccugaugauuggccgcccuggggacucuaguuggccguguuuacaucagguaagauguacuucauuuugcuuugucuuucaucagcuagaguugcacaagacagcccuuaucucaggggacuacugucagaaacugcaaucucccuugcuucugggcucaguugcccuuuuuauacacgcccgcugaccgauauuugaugugauagagaggucuuuucaugucugaauuaguccugguucugccaauacuagccauaugggccuagaugaccauuuacagauugauuggacuugauaauguuagcucccuuuuuguuuuguuuuuuguuuguuucaagacaagaucagguguaucccaagcuauauccucaaacucacuauguaguugaagaugaccuugaaauccuccugccucaaagugcugggguuauaggugugcaucacaaugccugcuucauguaaugcuggaaaccuaggaugucuugcuuucuaagcaguugaucuguuaacuaagucacauccucaccuauuagaucauuuucuuguuuguuucugagcucuuauauuuauaaaagauaacuagauaacuucugggcuagagagacagcucagagguuaggaauguuugcugcuuuugcaaagggccaauuucaguuccuaacaccuguaacucuagcuccaggggggguacaaacacacacacacacacacacacacaccccgagauaaaaauaaaucuugaagaaauacaaagguagcuccuuugcuaucagugcaccucuuuucuaaaagguucugagauuguugagaagagguagcuuuugcagaggaggaaagucuuguuuuaauuuauucugaaaccuaguuaguguucacuaagaacugagccuggcguuggcaacuggaugugaccagucacagccagguaguauuuccaugggugccagaaguacagcaucucacuggugguggcuuagagggugcugggggaggacagggacuagacugcucuguuuccuccuagagaaagaagaaggaacuaggaaugagcagucugacucacaugaacuugaaagaauagacuuagcagaauguauuagugugagcuucaggagaugauguaauuuggguuuuagagcuauuggcagcuagggaauguaggauauaaagucaugaaaugcugcuacuuccguaucucugaagucuuuggcucauauucauuuaguacacuuuuuaucuucguacuagagaugcaguuuacauccaaaaauaauauugaggggcugggucauaguucauucauaguauauauacugaugaugugcaaggcucugaguuuaaucccuaguacuagaaauaaguaaagguugagaaaauauacaucagaaauccucgaguacccaaaaagaggucacaaguuaggugggguggcauacuucuguaauccuuauacuuaggaagcaaaggaccugaggacuaagaguucagcaucaucuucagauacgugagacucugcuucaaaaagaaaagaaaaaaaauacaguauaacacuuuaaaaauaaaguuuagguaauccgcaaacucuaucccuuaacacaauaucaagugacccaaaaaugaugaucacaucuagguauugaugucagguuauaccguuuugggggaauaugauguaaaaaugagaaauuggggauggagguacagcucagcauguacugcacuuccaaagggacccaaguucaguucgcaguacccauguucacaccaccuaugauuccagcucuagcuuccuccuccggccucugaggcacauguauuuguuugcauauacccucucccuccacuaacaaauacauaauuaaaaacaagauauguauuuuaagaaaacagagaaaucacagaaagaaaaaugagauaauggauaauuugauugauccugaaaguaagguucuguucauaccaggagccugccaggaggccucaggccuguagcuccuucuuacugucccuggagaguaacagagaaagaagccgguuuaauuacugguauuuaaaggcaauuuugauuuuauccccaguaaauauuuuucaaugcuagaaacagacauuagauuaugguuccuaaauguucccagcucaggcuacuccaguugguguuucccacacuaaggacuguggcuucacagucagaugcugcacuugacuaauggcagggcagcuucgguucauucuuauguuuuucucucacuuguagugguuggagacuaggccuaacagacaaguguguccagucugcaaagcuggcaucagccgagacaaagucaucccccucuauggcagaggcagcacuggacagcaggaucccagguaaagacuugcuuuaucugauacccauauccccacuuggaugggcuguuauucgcaucuacuuagcccucuaacccuacuuuuagcuugguguuuguugauggcugccugauuuugaggcauuuugauggagaugagagucaccugggaaggguggggccugagaguagaagagccaggcucccacuugcuggcccaucuucaguaggugcucaaugucgucugccagcaggcaaacaguugugcaguauugugaaagcacuuccugcagcccgggaagcaggagugugcccaaggacuggguuugcugcaccugugaauaggagucuagagagggagggaauuggaaaucugauggcuuuguggggacgggauuucagaaaugaagaugcccuuuugaccuggcaccuggaccuuuccagaacaaugucucacugucuggcauuucaccugauuccauaauuccugucuauuaacagacagaacuucuccuaaagaguguuuucugucacacuugucacacuuguguuugcucugagggcagaaguacucucccuuguccuacucagucuacacccugcuuccugcagccuuuucuugauuccugcccuuauuuuaugaaagccucaaaguacaccccaccccccacccccugcaggugaucuuuccacccuauauugugacuacuuguaucucucuugaaaucaucaucaucucaagaguggaaacugucgcagugucaguacugauugcauccugccucaugccgaugugcaauaaacauucaucaaaucauugggcgggucugaggccuagcagcaaaaguaagauagauagcaugggguacuagccuaagaguaauggaggccaaacugaaauuaguaggggagauuagacagaccuugaaccuuaacucuaucaaagaaacuauccuugguuuuagucuggcuuagaauuucugguacccaugagcucauaucaugcaggccuaaggaaggcaaaacuggccauuuuucauaaccauggaccaaaaucucuauugcaagguaggcugugcaaucugauagcucucuuagaacaagcugguuuuccugauuugagguagaaugguguuagaauuuuguuaagccaacacaguuuuguguugaacaggagagugaccucuugcucaguccucaaggggaacaacuaacaacauuuagugauggccuuacuuuguuucuuuucagagagaagacuccuccucguccucaaggccagaggccagagccagaaaauagagggguaaggagcauucuaggaaacccuuguagaagugugccuguggcuuugaaacuuuccuggugaccuuccaguuuuaacccucauccuuuaaguaaaggaaaauuuauaaaauucaaaaagaagauaagcagggaaaaauccuagaaccacucauccagagauugccauugggagcauuugggccugucuucucaucuuccuuuacucugugugugucugucuguguguguuauuaauuuauacauguauguuuauugauuaugcacuuacauauuucauauauuuuaaaauuuauucuuuauuauuguguauauaugguggagagucuauguauagaugugagaggacacucuggggagucagcuccucuuccagcauggacccuggagaugacacuuagcauguuaggcuucaugcccagccccuuuagugcccgauugucuuuccagccugauuucuuggguuuuugagauagggucucacuaugcaucccaggcugaucuggaacucaugaucuuccucucucagucuucuacugcugauauuauagacauaggcuuccaugccuagauaauccucuugccucagacuuccuaaugcuggcauuaagaagacauaggccaccaugccuggcuuaauuuuguuuuuuacuuuuuuacaguauguggcucuuguuuuguaauucuuaaauuuucaucuauucugcagauaccacguuccuuaaugugcucugguaauuacuauagcagugguaauuuaacagcuaaccuagcaaauggucucugcuucauggaauguacccaugagaauuggaaaauuucaacagugcaguuuaagauguugcugagacccaugaucaugacauuuaacgguggcuguugagucguacagaccuaauguaauagcauccauuguauuauagggcacuuaccuacuaccuuugcugucugaaacauacucacaguugugugcagaaguacaauuauuucauuaugauaaauucuuagaaucacuggaucaaaguauguacauauucaaguaaaauauuagucuuuuuuuucaaguagcaaguuuuuauuaauaaggccugagaauguagcuccugaccaggaacauaggcaggcauggugcuggagcaguaacuuuuagcuuauaucauuaccuacaagcagaaaacagagagagcuaacuggaaaugucuuaagucuuuugaaaccucaaagcuuacccccagugacacaccuccuccagcaaggccacaccuccuaauccuucccaaacaguuccaccaacuggaaacgaagcacucaaacaugaaccuauagcacccauucuuuuuuuuuuuuuuuaauuuauuuauuauuauaccuaaguacacuguagcugucuucagacacaccagaagagggcaucagaucucauugcggaugguugugagccaccaugugguugcugggauuugaacucaggaccuucagaagagcagucagugcucuuaccugcuaagccaucucaccagcccauagcacccauucuuauucaaaccgcuaccaaaugaauucagugccaguuuggacuauaugaaacuguuucaaauuaauuaaaaaauuuaaaaauauacauuaaugaaauuuaccugaacggucagaaucuugaaucaaauauaugcuaauuucugcaguucucuucauuuguauaccauacauuauuuuuaauucuauuggaaauuauguguguguguuugcagugugugaacucagcuaugcaugauuguaagaagcuagagguaucauacuccauugaagccuaaguggaaggcaguucugagcuacacaacguggugcugggaacugaacgcagguccucugaggaacaguguccucuuaaucauggagucauggcuccagcuauauauucuuauuuuaugucccucucacucuuugguuaacugguuucaaauuaaacuuggggaguauauuucaugauaugcuaagcaaaguaucuuuaaaaugucguuguguuaucuuuuuaauguuguguuuuagagggguguuuguucauauucuagcuuuuuauuguuuuaucauuuauuuauguauaugugugggugcucccuguggaagccagaaucucuggaaucuggaguuacaaguauugugagcugccugauugggugcuggggacugagcucuggccucugaaagaacuagaaaugcucuuaacuauuaagccaucucucuaggccauucuuuuauuuuugagaaaggaucuccaccuauagccaugugcagggggccuugaacucagcucucaagugcuugagcuguaaacaugugccaccacucuuggcuucuuuuuuguugucuauucuuuugcuuuccuuuauuuuauacuuuuaagucagauucucacauaucucgcgucaucauagccuggcaauaggaagcacuucuugaaugacauuauaguagaauuauauaguaagaguuuugccaggugguggugauguacaccuuugaccccagcauucaggaggcagaggcagguggaucucuaaauuuaaggccaauauggucuacauagugaauuccaggacagccagggcuacacagagaaacccagucucauaacaaacaaagaaacagaguuuugugugcccaaucuccuuuaagcuucauauaaauccaugcagagggcauaguugagagacagauauauguaguguccaggggcacaaacagaaccgaaacccaaucugggugcuacugaaguccugcucuugacugcuagauagucucccuuuaucuucuuacgcucugcuugcucaaccagcauuagcaagcaacagaaauccgaggccucaggaagccagaggcuuuggccuugguggcugagggcacuccucuggauccuaagcaccggcagcugcuacuaaucuaguuugcuugcuugcuuguguguuuccuuucuuccuccuaauuucuuucuuucuuucuuucuuucuuucuuucuuucuuucuuucuuucuuucuuucuuucauuuuucuuuugauggcuuuauuucagggaauuucuggcuuauuaaucagcgacugaccaacucuuccucguuccaguuugcaacggcuagugcccuaagcacauugaaagcacauaguuccuuaauuucuuucuucucauuaugaauuugcuagccagugcucgauauauaaauuaggguggcagugcugggauuaaagguguaugccaccaugccugccugcccuccaccccaaucuuuccauuauuucaucauuuguucuaaagaacucaccagagguucaaaggauggagaagaauuuguaagcugugcacagugauuaagaguaugaguguucagggucaucaaguugguucuauggguaaaggcucuuuucacgcaagccuggugaccuuuguucaauccccacaacuuacagagguaaaaagagaacugacuccacaaaguuggccucuaaccacauauguucuaugacacauguguaauauacauaggaacaccuacaugcaauaauaauacauuuuuauuaaaguuugaauuuucagauuacauuggccaaauuuagucuuccguaaaauguuaaugcaagaauuaaacauaagcugccacucuuggauguacuuaucuguaauuccagcagucaggagucugaggcaggagcauugcaaauuugaggccagccuaagcuaccuagugagauccugucagaauagggagaggguguuugugucuuaugugcagaccuugcacucagaggagcugcuuacuaacagagcuacaguucugcuaaguccacuccugggaaagacaauggguaggaacauauuuggggagaaaccaagguuggagugcaaacugccaacaguggcuauuuggaaagauuucugacuuuuuuuuuuaaaagauagauuuauuuauuuauuuauuuauuuauuuauuauauguaaguacauaauagcugucuucagaugcaccagaagagggcgucagaucucauuaugggugguugugagccaccaugugguugcugggauuugaacuucggaccuucggaagaacagucgggugcucuuacccacugagccaucucaccagccccugacuuauuuucuaaugacaaauauauauuacucucuuuuuccuuuucuuucuccuccuccuguccccauuucccaagagcugggaccacaguaccauacccaguuuuauaguaaucugaagaaauuaaauuguuuuaaauauucagaauuuuaugugacuugaaaaauuuauauguguauguuuuguuucuguuuuuauuuggguuuguguuuguuuuugagagucuuguuggaagucuuguuauauagaccagacugauggagagcuaauuauccaacuaccaccacuuagcuacuaaauuaaugcagugcuuuggaccaaacucagagcuucuugaauacucggcaggugcucagccagcucagccauccacagccccugaagccuuuaggagaauacucauuuuuuuuuuuuuuuuuuugguuuuucgagccaggguuucucuguguggcccuggcucuccugguacucacuuuguagaccaggcuggccucgaacucagaaaucugccugccucugccucccgagugcugggauuaaaaggcgugugccaccaugaccggcggaauacucauaucuugacaagauauuuauauauuaucauuguacaggagcuuaaacaguuugacauucuaagucauaacagguuuucugucuguuugcauaaaugugcaccagguuccuuagagaacauguuacaagauuuuguuugacugauguauugaugagucagaguccauauuguuuuguuauugcagauagucuguauccuauuaugauguuccuuugcauuuggccauaggacugauggccagcguuguguaauagauaauauguaggaaauuuuacuggcuaauauggaacccuggaaaaugaucuaacauuguauauaaacccugagagcaguguuuuucgcuuuuggucagagcuguaucuuuuuggaccaguuauagccccuuagcuauacgccaaggguagaaggucagaggugccuccagaguuccuuugcuuugugguguggcugggaggaagagccaaggccuuaguuuguggcagagggacaagaagaaacaugaggaccauauuugugcugugauguaagacacugagagauggugauuaaaucugcuuauuuuucuuaauugcuuuucuucuccauagggauuucaaggauuuggauuuggagaugguggcuuucagaugucuuuuggaauuggagcauuuccauuugggauauuugccacagcauuuaacauaaaugauggacggccuccuccagguaagcccacuuuccuuaaaucaggaauauauccugcuagaaagcugccuagaauucagcaauauagaaguugcagauuauuaucacugcaugcauagacuuuccaaaaucccuuaaguucuuugcagauugccacacuuauccaaugaucugagcacuuaccauguauuagguacaugagggauguguucuguucuauuacaaacagagggccucaucaccuguacugcaaguagugauucuaagacauagcccaugaccauaaauuaaaaauuauaaacaauacuuagcuaauaaaagcuuaauccuacacacacacacacacacacacuuugacuauuuuggaucagggaggagugaaauguuaggaccucuuguuccuugggaacuguguuuauaugugucaucugcauuucuccuuuuagccucuuaucuguaagaagacaaacuguauucagaguacagcacagcagcaaggucugugcuuagacuccguuacacucugacacagcccugcuuauaguaauggagccuucugggccuggguacaguaugaggagcagaagugaguaguguagggcuggucaggagcucagugcucugaauaugguaacccauucagaagucaucagagcuuucccugcuucauccaguuccuuggacauagugagcaauaaaccucuugguugcgugccugcaugaguuuaucagagcaaccaaccgugaggggaugacaugcuaccccacaauguacucaggcauugcuucauaucuucgucugccuagaaugucucugcaguucacacauuguuuucucagaggaaggggaccccaaagacaggaugugauuugucuuaaaggaaagacagauuccuguagaagcagcaggaacuuccgacuagcuugcugcuuuccacccugguccagcuuucagacuggaucuccuccaguucauuccacagccaggcugggcuccugaucaguuuuccuuugucaugcuugguacgguuugcacagcugagagguggauucaguugccuuccugccuuacaauacucugacuagcuuuccuaaaagcagagcuucuuacuuagucaguucccccucucccuugacaugugauuucugggcccugguucugggaagagcaggcauacaagauagguuuagagccaucuggagcaguguucagagaggcaggagaguaacaguguucauguacgggcccuuauggucucagaaggcuuauacucuacuucugauacugcuuuuuaaaaaugagacccaccagccgggggugguggcgugggccuuuaaucccagcacuugggaagcagaggcaggcgauuucugaguucaaggccagccuggucuacagagugaguuccaggacagccagggcuacacagagaaacucuguuuugaaaaaccaaaaaaaaaaaaaaagagagagagagagagacccacugaggaguaccaugcauguggcacaguguagggaagacaggggcucucucccuguguguuucuccugauaguccacuggcucauuugcauauguaggacagcucuuuugaagaucaaagccucauuguaguauuuugcuuauauuugcuuugguuccuuuuauuugaaguuugggagucuuuuuauugagcaggauuauaaagaguuguauaaagaaaugaagauucguccucucugguucuggccccaaggggcaacauucacagcuauagccuucuaacaaagucucuuccuccuguuucucuagcugucccugggacaccccaguauguggaugagcaguuccugucacgccucuuccuguuugucgcccuggugaucauguucuggcuccugaucgccuaauacaggacccuguuaacaucuacagcagcgccucuggacuggugauaugccgcacccacuccuguguuugauuuguuuaauccugacccagggaucaagggucagagacacaccaaggaguuggaacucaaaaccaaaggaacccccaauuucaccacugcuguaaacacucuuguauaaccucaggucuugugcugaaucuccucucauggguggcagugugaaguccugcuccagccuucucagcaggucccagcucuacacagggaagagaugggaagaaagaaacaguuucuuuaacaagaacuuuaaauuacaaaaaugaagggaugaaccaaaugguauuuacagaaacuuacuuucaucuuuuuacauacuccuugguaaguggccuccacucccuauccugagagacucccuuccacaucccaguacugcuccucccaccucccgcuuccucagcaaagacauaagaaggucggucgguugcagcagcagaaacugaaaaugcugaugaccuuaccagagacucugguuuuugauuggcucugggccuuguucagugucuugacccuagaaagcagcuuagaugaccugcuggcuuccugguauagauugucccugaugucacugggcucaaauuucccaucagccuucucuagacuucugcugaauucaagacugacuguuaugcuuuagggcugauacaagaauaacaggacagguugcccugcccuaggcuacagaagccugagucauucucucacagaacuugcccagagaaacuggaggcuuucucaggucagcccagcugcauguagaacacuacuacccucagaagccauuguccuuuuuaaaaaagguuacgacgcugacuccaucugauggugaaaacuccuugaaugugugcugagcccagggauacaugaggcuccugagcaagcaaccccucucuggugacauaacacaaggaccucagagauacaguguggucgacauuccuuagucuuccucguguugauuuguucuugaacuuauaagcuguuuccucugaaucugauugugggauuguguugacaggcaggagaauagucaccugcugagacgguucuugcucugcccaucaggccucaucuuagaaaugucaccucucccuggagaccucagcagggcagcaagauaagcgucuacuggacccuuuuguucacuucuccaacacccacugccccagcaauaacaaacugggagaaagccuugccuggugauuuuucuagaugugacucuauauaaucucuggaacccuagaccuugaggauggugaaagagcccuccuccucacagcacaauccuuaccugccaacgccaguguuaguguugaaaugaauacaguaugaguauuguguaggagggugguuuggcaacucuagcuguuaagaauaagccaccaaauuuaugguaugccugacagauuuuaaauauucuuuggcgcuuggaaaucccuggucacggggccccuggagugucucuguucuagagagaauugguaggaucccucaguguagcauagcccuaaguaguagagggaaaacuuaagccaaugaacacaaaggagaugagagagggauugugaguaguggaguaaaccauuuggaaucuggugaaauggaugacccaggugugcagcagcagagucaucgcagggcaugcaguagcacagcugugguggcaugugccccugugaacauuaacauaacagggcuauacaucugccagcagcugaggcuagacagccaacuuggacuuuaugggccauuccucuacaggcucaccacucaucccauggccaaggcagcuuucccuucuguguuuucuguguccucagccuccaccuuucugccacccacauggacaaggacaaugggaacauguaaggccgcauacccugaccagccacugauuuucacuguugugaaagugauuugacuuagaauuaaaugguuuuacauuacugugaguguggagcuugugucuugggauauuaguuggcugggguaugggcacacggguuuggccccuggacaguaccugucuaguaauguuuaugucuuuaaacacccauucagagguccugacaaaugcauggaaccucuacgucaccaagcaccaaacugccaugaugaagcuuagcuugucuugccuugacuaugccauuuagaggagucacagauuacucacuguuucagccuaguaaaggcaguagccaccaagugugacaacuugaccuugaccucagaacccaaaggugaaaagagaacuaacucucaaaaguugugcucugaccuccauuuuuggaccaggucaugugcaugcccugacuacccugccacaucauucaaaauaauacauuuaaaauuuagggacuggagggagggguuagugcuuaggagggauagcagcucuuguagagguccuguuuucagugaccaauacagugacucacaagugucugguuccaggggcuucaacauccuucugugacugcuaagagcauucacguggugcacauggauaugugccagcaaaacauuuauaaacauacagugaaaaucuuuuaaaaauaaacuuu

SEQ ID NO: 5842 - RNA, 710 nt, Mus musculus
cuuuuuuuuuugacuggaugaacauacacuuuaaugagaaugguuuccuuaguaagugcaucugugagcugaagcuguguggcaucaggacgucacuuccugcuccacgggcuucagaugucacugcacgaccaacucccccgugcucuugaggcacgugcuggacauggucucuucugugggaagucccuguggcagcuucaggggcuggaugcguaucaaguguuuaaccacuuucagcuuugcguucaccaaugggauguucuugugaauuugagggcggugugccuucuguaguccgagcaucuugaugguaucuuuuucccaguauggacgccucuuuguacuucuuauucuuguaacaaugugcaguuuaugaggguucuggggguccccaccguacuuuucaugaucuucagguuuaggcugaaacacuuuaucuggaauucuugauuugguaaauuugugacgaaucuauucuguaccaugagagauucugcaccuuucuucacagucugcauggaggccucuggaacacggagcgcagaaccccagccaugggggugggaauucucucuucagaggcuccaccagaagcucagggaugggcaacaccaauggugaucaaagcggacagcacuccagucagggcuacacagugggaacgggcgaccgcuguguccacuccgaacguccccgcagccggaagg

SEQ ID NO: 5843 - RNA, 710 nt, Mus musculus
ccuuccggcugcggggacguucggaguggacacagcggucgcccguucccacuguguagcccugacuggagugcuguccgcuuugaucaccauugguguugcccaucccugagcuucugguggagccucugaagagagaauucccacccccauggcugggguucugcgcuccguguuccagaggccuccaugcagacugugaagaaaggugcagaaucucucaugguacagaauagauucgucacaaauuuaccaaaucaagaauuccagauaaaguguuucagccuaaaccugaagaucaugaaaaguacgguggggacccccagaacccucauaaacugcacauuguuacaagaauaagaaguacaaagaggcguccauacugggaaaaagauaccaucaagaugcucggacuacagaaggcacaccgcccucaaauucacaagaacaucccauuggugaacgcaaagcugaaagugguuaaacacuugauacgcauccagccccugaagcugccacagggacuucccacagaagagaccauguccagcacgugccucaagagcacgggggaguuggucgugcagugacaucugaagcccguggagcaggaagugacguccugaugccacacagcuucagcucacagaugcacuuacuaaggaaaccauucucauuaaaguguauguucauccagucaaaaaaaaaag

SEQ ID NO: 5844 - RNA, 6702 nt, Mus musculus
ccaggcuaaaagcuuuauuaggguccaaacuccggggguggggggaagucuugggauacccagagucaugggaaaggcuagaagaaccuguagagagauagaauguggguccuaauggguucugugaugucuugucugucauuuucuacuuuaagcuuuggcuucuuguaaaagaaaaggggugguguggggggugugauacaaaauauagguugccagcguuagaaaggggugaauugguauggaccugacuuugggauagagacuggguugguccacuccacucaaggucuuccuccucccauacacagaggcagugggccaacacagcagagcaguaauaugcguccaccagcaaggcccugcuguaggccguggggagaggggccacagccccaccaaccagacccugcucucugucaagggcaaaaaauuauauagacuuuacuuuccuuacaagugacccauaccaccaccaauccuuuccccuagaggcagaggcuugagccacuuggucuaauugccuugaccucuccuaugagguuggccuguguguccuggggcaagaaccuuaaccucauccugcaccacugccaagggcagccacuccaggcucucugcugccaggagaugggauugggucuccaaagaugcccaccggucaccuucgccgucccucaagucagagucuucauguuuuccauaggaaaagccacgcugaguguucacgcacucccaucagaccccauucaugcaagguuuggaagcugggaaacgugcuguuagaggagaaacagaagcaguaguugccggacgugcuuccucccagccccgggccugggagcaaaggacaagggagacccaacccugucucgucuccacggccccaggcccacuccagccccgggcuucaccgcgcccgugcgcgccauugcugugccuggagcugugagggucccacccuccggcuucguggcaggaacggucccgggcccggcuccuccccguggggcccggccuuauaugggaaagcugugcccagcugacugggggagccgcaguugcuuccggucccgcucccgcacauuccugaggacgggguggugggcugcacgggacaggggcaccuaaggacaggcacgcugccugugcccccugccacguguuugcacgucugccaccucccguccgggugaccuagggaagcagcuuaggugcugugaaccucccuuccuuugcagaugggacguuaaagccggcgguggcggaggguuuccugccuggcuccuagcugggacgcccggcuggagacuggguggguggggcgugagugagcccugugcugguggcugcagccugcgggcuuuuagcgcccccuggcgaggcauuuccccaauugcuaucaacacagggggcagcucuggucugggacugagggaggaacuacaggagaaucacuuuuugugcaggagggagagccugaaacuaggaacguuggguugaauagaugccccccagcagccggaguagaaagcacccgagccucaguccccucccccuccauccucccaccggaggaggaagcacccucuuuccucccaggagaauuucacuaggcaguuucggaaaccauccccuucccccuggcggacaauaguucuuuguauuuccuucccucccucccgcaguccccuccacacacagugggggugaccgagagggugaggaacucuagacacaguagaaacacuguggucugaccuuugguguuugagagggcguggaacacaggacacagcagggacacuugucagagcuuugcccacagucccaaaaggaaggaugccagggaguggccagcagagugaggcccagccacccccuuccacuuagagaauucauuaggaggauccaaauuuccaaauggagacacugagguacccagggguuguagaaauggccaaguuccuaucuuguauuuuuuuuccuggggguuggaaaugaggacccaugagacaaagucauuguaucucuggaucuugacccuccggaccagucuggaccagcugucuccucaggccaccgaucuccacauguucugugagaagugagcauagaucucuugguuguaauaagguuuccuuugacuuugacauuucuagagcaggcuaaagggggcucugguacaggaccucaaaguuccccaccaugacagagagcccucaacaccacagcuaucuugucucaggcaagccauaaacaagacacucaauucccucuuaucagauaaaaaugauguaucaaaguaauguaucaagaguaggucuggaugggaccaucaguuaauuaagagccuuagcuccucuuccgaaagucccagcacuugguaacucuggcuccagagaccugaugcccucuucuggccuccacagucacccaugugcacauggcauccacucauacagauacaugcaaacacaugaauaaaacuaaaccuugaagggaggacgguagaagcuggcugagaugguguguccgucccuuaacuccaagcauuuggaaggcagaggcaggcaggucucuggguucuaggccagcauggucuacagagcaaguuccagaacagccugggcuacacagagaaacccugucucaaaaaaccaagcaaguggcaaaugggauuuagugcugggucugacacuuugggucacucacuaggggucuagcccuucccacccuaggucuugacuucuuccaugguggcuaggacuaggccauagucaguaaaaggggaaagguaacucacugccaagcagggagcuaggcuacugccucagauucccugucucacaucuuucccggcagggcccugcuacucugacuagguagaucaccuagucagacuucagcuaccugaaucacccuucucguuccuuggacucuugucgguagcucagagaagaagggugacuacacucuuccugcuguggcucccuggucuaaaggguuaaugaaagcccccggagagcagaugucaagucccacaaaggagugccuggcugcuuggcaccuggcuugggucgguggcuacaggcugugcacucacagaagggggcccucggcaucacacugcacagugggcuucucaggaucuuuggugucaugagcgagguugccccuaaaaacccugagugggaggcaggcacguggaaggcuuaggguagagagacuggagacaagccauccauugugccccuggcagagcugugggcaguuggugccaguccuuugccccugacagaaugcccaccccuuacucccaccuacauugcagcuggaggucacugcagaucuggcagaacggcggcggauccgcucagccauccgggagcugcagcgacaggagcuggaacgagaagaggaggcucuggcguccaaacguuuccgugcugagcggcaagacaacaaggagaacuggcuacagugaguggcagagggggcuuggguuuucgagugcagaugugccaaggaucagcucauacugaggcaggugugucugugagccgugagcauuggaaugcacagggcuauguguggguagggagccaguaccagcuguggcugugcagagugcguaacuugugccuguguccaaggauguguagauggauggauggauagauggaugccaggcauguguggauggaugcaugcaugcaugcaugccaggcauguguagaugcaaggauggauggauagauggaugaauggauggauggauggacggaugccaggcaugcauggauggauggauggauggauggauggauggauggauagagauauugauauauauugauauugaugcuugcucagagguucuacauagauagcuccaugucucucugccaguguucaggccucagacccugacccuuuccuugagcccacauccuccagacccugucauucaaugguggucacacucacuaugucucugcagcucucaacagcgagaagcugaacagcaggccgcccucgcacgauuggcagggagacuggaguccaugaaugaugucgaggaguugaccacacugguaaggcucagggcaggcaagggaugggugaagaccuaccuggauuccggcaugcaaccccuguggcccuccugucacccacagcuucggagugccggugaauaugaggagcgcaagcugaucagagcugccauccgccgagugcgagcucaggagauuaaggguaggugccugcccucuguagacucacccuugcccugcaucucauaucucacaucacuuccugacacuugccuugcccuguccuuccagcugccaccuuggcugggagacugugcaguagacuucccaguaguggcccccgagaggacagcaggaggcaggcagcacacacauuggacccugguaagguaaggaguaugggcgugaagggaggaccacccaguggcugaugccuccugaugccaguaauucagggcauaguaccugugugccuuugcucugccgucauuugacugggagcuggccccuggccaguguuugaggaaaccccagggcucauuuguuauacuuaggcaauuccagcuguaugccuuccacuucagaccuucaacucugguuuuucucucaaagcuagccuucaaguuguuguuccuuugcccaugcuauucucauguuuacacuggcgucucuuaccuccaccccuaccccuaccccuacccguaccccuaccccuacccccaccccccagccugugcucagcagucagaaggaucaucuccuggaaaugcaaaucuaguccugguaccgcccuugcuuaaacauaucccaugcuguccuuaccuuccagacagcugccauccuuaccuuggcucuccagggagugccugucaggccccucuaaguaguguucaguguccucucuauucuucagauagcaugagacuuuaagaacauaccauuuccacggauggccagcagaguacgcuaucugccuaguucugcacaacuguacugucugauuagcuagauugaagcuagaguuccggguuggaggguccuuuaggaaugggaguccccagcaaauuuccuguuauggccaaucacuggcauuagacucugguccuuguuaaaccaccuuuggcacugaccagccuuccuuaugcaggugugcccgcgggaagccaugcccagccccucugcuuugcauggccugcucuaucagcuugguccucuguggguggggguagcauucagagucagagaaaccuugguugcguccugugugucuucugcaggugccagagccagagcagcaggaacagcagacagaaguacucgagccaaccccaaccccagaggacaccagccaggaugugaccacagugacacuccugcugagggccccgccugggggcaggcccagcucaccugcuuccccccacaauucacccaccagugccucuccagagccucugcuggagccugcuggagcccaguguccugcuguggaggcuccagucagcucugagccacuuccacacccuucagaagcuccuagcccugagccccccaugucgccgguaccguccagcucucgggggcgggucaucagcaaggugaguugggcgagagguggggaugccagacaggugaguuccuuggccugagagccccuuccuaugugguguuucucuuugcagccccugccuggccccacagagcccucagauaccuuggacuccaucagaggcuucuccaacacuaagagagcaggugaggagcccuguuacagguuaccacaggcuucugccuucuccuguccugucccaucuccccuuucccugccuguagguuggguucugaugcuucucuagccuucucagggccaggcagucccugacacugcccgccacagccccugagguguuccgccccuggccaggcccacuccugccacccauggccagaggccuuccuacagccuugaaaggcaacagaccucaggcacauucuucuccccaauaagggagugcacccaucacccagcuggaucuaugggcaguacuggcagcgggggugggggugggggggugucccuuagucucaucaguagggagaaucuggauaccuuucucuggcccuaacuuacuucuggccccuaagagugcccacgucaccccggggucagugcaggagagaaaggagguccuuguaggagaguuacaacugagugggcaggccucggcagugggugugguaaggaggcuacggagguguugaggagaggugaguggcgugaacaccaucccaccauccacuuuccuuuccucuccccccaucccccuuauggcuaccacauacuuaccaaccugccagacccgucugaaacgaaauccugccaacguucacuaucugugcucaguccccgacaaccaaccccaaaucgagguacuguuuguuuuuuuuuuuaccaucccuagguucugagcagucccuaucccacccagccacugacagcuuucuugucuccuccagagccaaccucacuugcaggaccgucccaguuccgucgaguuggcucugugagagacagaguccaaaaguucacaucugauucucccgugguugccaggcuccaggauggcccaccccgaacagcccu

SEQ ID NO: 5845 - RNA, 41786 nt, Mus musculus
auauaaauguaauggagaaaggcacacacauaccacagcuuucuucacagguguuacaauuguuaaguauauuguuucaugacagcacaaccaagauaaugaaaugcccugugaugguucagaacaaaguagacccauacuggccauucugaaacaauauguucuuggcaaauaauguaaggaaacccaagagggcagauguguagcugggugcccaagauaaauauucugaucuccagggaaaacuuagggaucagguagaagagaguccuuuuuucauguucaggcuuuuguaguauuuaaauucuuaccacguccacccacuguuacuuagcaucuuaaaccccacacuucucccuuagagccagugaaugccuuaucaucaaaauguuccaggucagcuauuccaugauguucccaggaaagacccaacacucagaaaaguugaggcuggauuaguuaaaucuggaaaaguuaaagcuaaaacgaacgguggagcuguaacagaaugaagagaaaagucuugugauucacguaagaauguacugaacgcaggagucucaccaguagaaauuuauaguaacacauuuugauuacauguguaaguaaaaaaaaaaaaaaaucaaaaugaguauuaccugccaauaaaaaugcagggccaaauuccuuuuaaacaguggguuuauggaaaaaaauggaucauacucugccuggauagggucaacagaaaguuggaugggggcagccguggggguaagugcaccaacuuaaaacccaucuauuggagaauguuccagagaagaacuucugaaugcuauccccccuaaacaaccugauggcagaacucaagcaggcacuuccagccauaugugcacaguucccucaccaacacuuccccaucuucugcagagaccccaggacacaagguggcagccuugccuugauggauacaaaucccaaggugguuuggaucaagaguacaaaaucagucuugaacaggagugugaagaguugggacuggaaccagaauucuuccgacagccaucagaugaagcucgugccuuucuggcucugagugguugucugaagcacauggucuguccuccucaccuccagagcaugggaggugcagggcucucuggagcccagagaguacauaguagaaaagcagcagcaaaggcucuccaggaacuagcaccacuguggaagccuucuccuccagagagcuuucacaccugcacacccugagaaucuuuggaguucaacauucagagugcuauccagcccagggaucugaccggucagagcugucuaugcuugagcuuggauagugugguugacucaggaaauggcuccuccaguaacaaaguagguggcauauugggaaauuugagccuuaagaaacaucuccaagcugucuggauacugucacauccaagaugacugacagcugcucaggcagccuacagaccuucacagcccugucuggacaccaggagaucuguuacagggagugucuuucugauacugggccuguuuugaucaccccuugagggucuugcagagcugagucccuggggccauguaucuuucauaucccauuguugauguccuuagagccucuccaacuucaggauggugcuuucuucauccuauguugaggugccaggagcugaaugguucagacucugugcccuuucaagagucacacaaaaaaaaguacggucucacagcaggcauuaacaucuucucuuuuaaaaaauaaauauuuauguaaacuuagggaagaagauucaaagaaucuccuucccaaagcacaaaugucucacaugacucaaaccaagaucaaguccaccaagucacaaaugaacuccccuccccgaagcugcuguguugagggcagguaugagcaggaguuagccucccggcuccucaguccccuuuggugaugagguccucaauguaagcauccagcucaucaucuguguugaugucuauguccuggaacagagugggugggagucagauggggcaggaacacaggcuggagaaugggccugagccagcugucagcuucuguuucuugcuccugcccuacuuccaaauuucaguuaaaucugcaugcccaaaaaaggaugggagcuuucuuauagguuuccugguucuaacccguacaucuucaaacugauuagugucuuauacuaaaaguuggacaaugccacaucaaaccacauauguagaggucucuaaccucuccuacugccuacaacuuccuauuacagcuuagugagcucccagucucaguacaaguaucucuacccugagaacccuaggcaaguagcuucccccaggauuccaucucucauuauuuauuucaguacuaccccauucauagcuccagcuccuucaucagccuguccccagagaucaaucaaguucucagugucuacuaugcagcaaaaauauauaccacaucccuuaggggcaaugucccacuucuacucaagcacaucugggauaucauuuagauaagaauugugcuuauugcuuacaggguucucaaacaaacuauacugccuaggggucugggugggucaaaacccaggcaacucuaucauuucaagcccucugcuuaggacucugagcagccaggguuggaaacaaagauuccuguaaguaguccaguccccucccugagaccaguuaguuugguuccugagagggcugccagcucaccuccugcacuuuuugcaggagugcuacaauguugguccucaacuucuguaacuucuccucugucucacgaagcuuuuucucugaugugcguaagcucuccucugaggcuuuugcccgugaaucagcacggcuuugguaggaauggcacagauucuggagccccaccucauauugcuugaaguauucuuucuguggaaggaaacaugauauggaguaagaggagagagugggcaaugaguucacuuggcuguauuucacuacaaggaaaaagcagccuucuagaaccaggguaaagagaccuuaguggcaguccuuuggggauaccaugaggauaaagacacaugcacugagccaagugcuuaauaaaguggagggaaguuuuaccuuuacacauggaaagaaaaaaagggacugugggagcauucuuccaguucaaacacaccuuucuaacuccaaaauaggacugccauaucuaacaggguuaggaccaagguuagguuauggacugccucuggcaccuaccaauagcaaauauucccagacuuguauaauaaauagucguacuacaauacagccuuuuccuaugaaguaguuaaaacaauuugcauaguauauaccuacugauaaaaggaaucaucuucaugaaggcccugcugcccacugaagucuaaacucuaguacucaucugcuucuaugaagguugcauaaacugcuggguugagggcuucugauugcugcauuugugucuagacuaccuucuuacaccaugauagcaagagaaacuucauucuauauaaaaaaauaccuugguugcacaaaauaaauuuuaagucaaaugaguaucuugaaggcaauuauauuaagcuuuuaauugugaaaauacuaccauuuacacaccaauaaggacaaaaauuaacauuugaaaauugguuuuagcaaucgcaacuagaagauaaaguugugaccuaguacuggcuagcacguuuuuaaaagauuuauuuauuauuauaucuaaguacacuguagcugucuucagccacaccagaagagagcaucagaucucauuagggaugguugugcgcuaccaugugguugcugggauuugaacucaaaagagcagucagugcuuuuaaccacugagcuuauuucuccagcccccugguuagcacuuuugcaaaaacaagcuagauauuauuuuuagacuuggacagucacaagacugacuguuuugggcugaguaacagugccugcugcugagguucugcugugccuuggcuuuugcuuugaauuucacgauuugaugccaaagguaacaaaucaaacuguaagaagaggucuucuccuagaaccucuggaaagccuggucuaaacaagaguaaaagccaaagccuaggcugggcuuacuguguaacaagaauguggugggucuugugccccuguaacagcaaggucagcagacacaaucagcuuauugcauguuucuguaaauaaagcuauugcuugauagacugccucuggcuacuuucaugcuguaauuacagaacuucguaguuagcagauacuagacagccuacaaaccuguuauuuacuaucuggcccucagcauaguucagaucaacaauuccuucagcuccauuuccuacauaaaaaugagguucaagauguaucauuuuccccaacccuuuccagccuauugugcucacaaaagccuccugccccacuucagaguccccugcacuugaagcccuaguggaguuguuugauuguuugguuagguuuuuagauaaggguuuuccuucucuacccaagcugccaagacucucugggcacugccucucagcaacauuucucucagccuuauggccagcuacccagaagcagcaacuccaccucuagcaaacuuuaagaugguggauacagaaaguccacugagcuacccgggcucucaugcucaucucuacaugccguuaaucucucuuuaccucucuccaagucucauguuuuuagguagagagagucuaaucucaucaauguuaccuaggacaggucugagaaagaaguggggaggggaggggugcacuuguaaaggagucucaagcugucuguccuuuuugaacaucaguccuaucgacucagaucgucucucagagagaagggaaguugaugagacagcgauaauaagcauguacaggcacuuagguguaaaaagcaaaaauugggucagacucaccagaggaaaagauauuaguucuucugaauucauaacacucagcuccuucuuggagauggggaaacuuggagguaagaaauaccgcaagcaauuucuaagcaggaagagagggguuggaacucagaauagcaugggaagaguaaagaauuagugucagccuuaaggaaaaggauaaagaaacacaaaccgaagaaucuggaccaggagaucaauagucucauggcugggacugguggcagugguaucaggcucaaugggaagaccaucagagguggaaggcucaggcaaggccacagccugccgggccaccauagccuccuccuccucuccaccuucuugcugugugucagggcucugaugcucuggggaagguggcuucaucaaucguacaucuucacugccuuucuccacccuacgggggacacagagcuuauaguaucuguccuaggauccuaauaggcugcuaggagggaacacggggguaccuccucucuuugcccuagcugacuucugcuauucuguucucccagaagagggcauuaccagcggucucuugguguuguaucugugggcacauagucaaacuucacuuuccaucgaaccgcauucuugcccaccuccacagcugugacucggccuguguaccacucacgguucacacggaccucuacaugaaguccuuuaucugagaaucagaugagaacuguauuagugcccucaccucagccaggcuguaucuguaaaaggcagugcacagguggaucccuagguauccaccuaggccuagcaaugcugccucuuccaucuggcauggggccaaggcacaggaugaaugacuugccaagggcaaacaccaaagaguuaguauuaaaaagaacaaaaacauaaaaauauaaaagcaagccaggcauggugacacaugccuuuaaucccagcacuuggacacugauccagaggauuauaaguucaaggccaaacugaacaauauaaauaucugcucaaaacccucuaggacuacaaaucaaacaaacaaacaaagacugugaagggacagcuggaccaacuaugggagagagcccaagccaggaagcugcugacuuucaggaggaagcuguugacagggaaagguucuauuuccaucuccagcacagcaugacaggggucuccccagacuugccuuucugagccuuccugaguucagcugggugaucuuccccagcacugucugagagcugcaaggaaaacagucuauuagaagcuucuuuaauggccccggccccggccccagggaggcaaucccugggaacuucaugcgacuaaccaccucauuugcuuccuucuuuuccuccuucacagcaaguuugccccgcuugcaucucucucuccucuucucagcuucuucuucagccucuuccucaucugagacugcaagacuccgcuuccgaccugagguugccuagagcagaagaguagaagcaugaacugaccauguucacuucccaagaugcaggaagacuuuauguagcuuaaaggaacuacucagaggagcuaugucaauucccacuuggaauuacucaguacauacauaugcaaccuccuggucugaccacaacuggcccagguuucucaguuucuucccugcuuaaccugccugccagccagcugagaccuccuugacacacaaugacuacuaccauaacauaccaaagcuauaugucaucaaguuaacaaacuaugcccacaccaugagaagccaacucaaguuugcagcagaccaagguuggcugugcugagugaaaaugaaaagcucccuagauaaaaaaacuugcuauguguguuaguucugagcaagucucuucagcuauggagacuuuuucuucagggcaucagagaagcuuuagaaaagauucagugauccuggauucccugguauaaccuuuuuuccuacagcacugcuaauaagcuggagcauggaggagggaaagcaucucaccacggacuguuugacagguggcucuggcuucuugaccacuggaguuuugauggcuuuuugagcagggaccucccgaaggcucuuggaacuggggauuaaagauagugggggugugugcacaggaggggugggucgggguacagucuugaugggaggguuugcaggcuuucgaggugccucaguuggcuggaguagccuagaaguacuaguuucuccucgggcugcuguagugggugguuuuggaaggcugauaacagacgucuuucggagcuggguacuuggucugggagucugaauagaagggggucugcuaggagcauucuugaucaccgcagguaaaggaggugaccgaggacgcugaggucuccguacagguuccuaaaaagagcccacagacagaacacugaaccgagcuuagacaccagaagagacccgccucccuuauguuccugggcuuuacuucaauaggucuuguagucacuucuaagggcaauuucuucaggucagcuugugagcggaugggcgugguuuucugcaaaaacaaauauaacaaugaaauuguauaucuugguauaauaaacuaucucuuuggauccucacuaugugccugggacagugaucaguucuauuucugaaagcuuuuuauuaucacuagaaaggcaauacacagacacaaaaaggguaccuaugugauugacugauucaucaacugagacacuggggaaagucauuaaauuuucuaaaaaaaaaaaaaaaaaaagagaccaaaaaggugggaaaguucugguaaagaaaaguugucauaaggccagaaaacuggaugggaucaacacacuuaagacauuuccaguuuguaaguauagagcacuguacagacagagaagaaauaaaaaugcuuuuguaacaaauauaaaauugggggcuguagagauggcucaugguuaagaguguagauuagucuuguagggcaccaccagaguucaggucccaucacucggaacaaggaucugaugccuucuggaauaaacaaguaccugcacuccaauuccuuaugcaugugcacaugagcacacacacaugauuuuaaaauaauaaaaaaacugaaaucaugaaacacugaaaauauuaaguacacaugaaaauuugaucaaccuuaaaaauaaaaauuagccauguggugauacaggccuuuaaucccagcauuuaggaagcagagacagguaacucucugugaguuagaggccagccuagucuacaaaguuccuagacagucaaggcuauuacacagagaaacccugucuugaaaaaccaaaaacaaauauuagaauuaauuuuugcuuacuuuucuaaacacugguuaaaaaguguaaaauaauacaaaauaaugcaucuucugcaaggcagcuuaagauuuuccuuguuugguuguuuguuuauuuguuuucucaagacgguuuuucuguguagcccuggcuguccucaaacucaaagaucugccugccucccaaguacugggauuaaaugaguacgccaucauacuuggcuugagagaaaucuuuuaaaaagccuuaauauuuugcaaauucuuuuccaaucuuacaaauuaucaagaaauuauuauguacaaaaaauagcauauguauauauuaaauacaaaugcuuuccuaugacuacuaaaaauuauagaaauguuuauguguacguaauuuaugcaaaauuggaaagagcuacuucuggugauccuagcuacuccagagaaacuuaaguucucuggacuuaaauugaucucagugagacacuguaccaagaaaaaauacaauaaaaagcaagaaaagggucagggauguaacuaacucagugguagugucugccuaacacauacaaagcucuagguuaauuccuguucuugguggguggagauggugggggggggggaggaggagggagggagggggggagaagaggagggaugaaaaguuauaaaacuacugaaucaauggugagauuucuuuuaugauaggauauuuauuuucuggaaugcuuauauguucuaaauacauugaguauauaauuuuugaaaauauaagcaaaaugguuuguuaucuaauuaauaagguauacuggaagcauuugaacuaagaacucaggguugaaaaaccuuggugagaacauauggggaauggaagggacaggaaagccaccgaagacuccuguccuggacagacugcugacacaggcuggcugugcucacuugcccacagucacauaccugaagagcuucuagcuuuuccugcugcuggcgaauuuucucugucagcugcuucugcuuuucuuccugugucuuuggguccuuuuuuaauguccccaaaggaaccuuuugcuucuguucagaagcuucacagcugugaaaagagagacugguaacaaaacaaggcuccaacagggcagagacuugcuguccugcaaccaccacagagcuuccaauguauaaaacugguauguguuacaggacauguuuacucuuccuucuuagaaauacacagccugccgcagccagagaugugaggcuauggaaacaauggcucugaggaacaccccaagaguggagguguuguggcaggcauggugaauguccgaguuagcuuuaauuauagacuugacgaaagccuggauuucgaauugccuagaucaggcuggccuguuggggggcggggggggggggggaggacacugcuuuguuaaauuauauugauguuggaggguccaguccacuauggauagauaguaauaucccuagacaggugguugggaugucuaagaaagcuggcuaagcauggccugguacacaguguuuuuucaugguucuacuucaagguccugcuugaacuccugccugacuuuuuuuuuuuuuuuuuuucuuuuuuuggauuuuguauuuuuuugagacaggguuucucuguguagcccuggcuguccuggaacucagaaauccaccugccucugccucccaagugcugggacuaaaggcgugcgccaccacgccaggcucugccugacuuucuaaaugauggacuauguuuggaaguguagcuaaauugcuuuuguuccugaugucaaucacagcaagagaaaguaaacuaccacagggagggaagaguaaucauaaucuuuguuaaagaaaggcucaccgguccugcucaggaucaggguucauggagcaaacccaaguaucaggguaaucuguuucuacugaacucagcuggaaggggagaguccuccauuucagacacagaucugcaagaaaaaauaccccucucaacaggucaaccauacuaucaacaauuacugcaguccuggcuccucagagcuaggcucaccagcaaagauguccuugaacuucaacuucuuuauuauuacaaaacagugauucacccuaugaacagugauugcagcaaggauuaaaaauaucauggaaucuugaugcuaucaguccuuccuuccuuugggcucaguuaguuauccauucuaaacccuacaugguagcaaaccuacugagccuggcccagcugugauaugaagugucucuaagguguggugacugucgccucacuaagagacaggaggaacugcgggccucaagauugcucacacagccacugccaaacagauccuguuccuuguggaacucaaguucaagucagaaggccagcuugagacuacagacaagaaugucaugacaggagucuagagagaguuccugcaacaaaacucaccacacuggauagugguuggaauuuccauagcucuccggcguuugaaacgcagcucacuagauggagguugguuccaguuggcagaaagauagccaaacucaucccaaaacuugaugauuccacgcugggcuagaagacaaaugcccacacauuccaauggaagcauguaacaacguaaaauccucuuccuaaauucacccucucaagucacauaagcaccuuaaggcucauaaaagagaagcugaggccuaguggccuggucacauuaccaauggcuauguccuuccaguacugugccaagugcucccccauugcucgaaguagaugccgguacuccuuagcaucagcaaaguccugcuuguuauguguaggcuccagaaccaaguaggguacaucaacaaccccaacaaccccaccacaugcccugcaaagacaaagaggucacagcucugucaccaaaacccuccugccauucaccagggcuggaaacucuccugaagcacucacaugcccccuuccagcugugggcccacuuucucauacaucuugaucaggcggcuacaguuguagauaaacaugccaucuaagucccgguguucaauauugaccccaaaaacaaaauuaaguuccuuggguucuuugagagcucuaauaaaggagagaaaaaaaaaaucaagcauauuaacuuauaagcagaaaaacaucauagugaaaauaguauguuaaguuuaauuuaagauguacuaaaguuuuacaucuccguucaauaugugauguuagauuugauaaggaucugcacugucgcaugauccuccucuauguauacacagaauuuaauguagggguggauuuaaauaugaaugaguuacugugaaacugcugcaaaucuuugcugagagaguagucuuacauuccucaaaauccuaauuuuauaacaauaauaguucagucuggcuuguuuuucaagauagagucucacuguguagccuaggauagccuccaacacagagauccaccugucucugccucccaagugcagggauuaaaggcauguaccacugcaccuggcuuauauaauaguuuuaaaggcaaaaaauuaacacaaauacagaagauacuaaugauaugucaagaaaaucuugugacaaguuagagcgaagcgagcugaaacuucgguccguggugaggaaaccaccuggaaucuagcuaggaagucauacccuagagauccugagaagcucuauacacagcuaagaggagggggauuuagaugcaagcaguacauucuaaauaaaacagcacaaaacucaauccauagcaucauucuaaauuuguaaccaguaaggagaaugaauuaugaguauagaaaaaauuaaaaugcauauuuucagaagaauaagggaaugucauauuuuuuacuuaaauacguuauauuuuucaaguuuuauauaaugggcauucuuugcaaucuuaggagaaaagaauaagaaauguaaaacagugugaaggaagugaguuuaguguuucaagugucaaccugccugccuuuugcagaucggcagaagcacuugaccacaucggugaaaucggcagagauugcuuucucuaaguaaacuuggugccgaauggcaaccugucugugcaaaugcuaccuaauuuuaaaagacuguccaaguacuuaccgcugcuuggcauccuugauccuuuucuugacaucagcuucucuacgaagggugauggcuguauucuggaccugccgcaacaucaccugcaaauguaucaccaucaggugaauggaggaggugcucucuguuacaugaauaauacaauauuuuuauacugauauuaguuacccggaugcuaaaacauaccugaagauuauuucuaccuacagaaaagugaccuugugggggacacuucaucuuacuaaguucaggacacuggauuccaauaccacauaugccauaaaagagaguuugagucuaaggacuuacccuggagucccgugucaggucuccacccaugcguacuucuaaaguacgagcuuugcucucugccucccgggccuucucuucagcuaaaacagaaaagaaaucaaagguucagaacucugucguccuuccuugauccacagagcagucccugcugcacaaugagugcaugcuaacaaggaaaaggcuaccuagagaagcaauggccacacgggcauucucugggcuuggacuaaagaacugcuucaggaaaaaaaacaaacaaacaacaacaaaaccugacauucaaaacugucaugaucaagaugguaccugucucuaauuccaguaauccaguuugaggccaacaugggacagagaauaagucuaucuugaauaaaaauuuuaaccccaagcgaaguauuauuuauccucugacaugcuuuucaagcuuuacaaauggauuaugaaaaucaauggggaucaaccaucagcaugaguuggagccugaagaaugcuuuagauaaucacccucaucacacagccaagaaaacuaugguuauucugggagaaaaccuuuuaauuucugcuucaggacaaacugucaagccagaguugauguuuguuaaaauaaaacuagaggugcguuuaaugccacuccagccguucauaaagcucuagaaauagugggaagagagacucaagucuagagaaaaguacuucaaaggcuagauacggggagacuuggaaaggaaguggauuaaguuaggagaacagccuugucgccaggcuucggauauaaguggugcccccagcuccaucccuccuccuaacacagggagcagcauuaccaauccgugcuacaugcucugcuuucuucacuuccuguucugcccgagucuugaaacgacuugauguauacuuguacauccugaagaguggaaaaagcaaccugaaggccaagcagcaguggggcaggcagccaacuugagcagcucaggaagcacccugccuccucccaugugguguugcccuggcuccaugugauguaacaaauccaagcucaauuccuuaaucaauuugucuuugguguucaccagguuaaagagaguaaagaugaucaccaguguuccgggaaacagaaauccuuucucucugccagccaaccuuggcucacccuccacauuaccagaggcucuagagcucccagauucucugggaugcagggccaaaggcuacucaccacuguucccaggaauugccaacuaaucucacagcaggaacaagucucaggaauaggccauggcuuugccuuuccuguaaagggucuauaggcuccugaacuugagacaagacagcucccugugccacucuccauaucgcggaaggcacuuccuuuaacuggccugaccaaccaacccaauagccacaucuguccuauccagaaaaugucucccugguaaacaguguuagauagaggcuucucacugcaccacccuaacaaugccccagagaaaugcagccaggcaccauuucccaguccagaucauggagcuaggcccuuaccugggcuuauauaggcagcaggagagucucuuggucugcaccuuguguccauggaugaagauccucauccggggaucaauauagaguacagcagcauaggcucggaaggagcgucgcucuggcuuccuggagaaagcaggaacugagacauccugccgcucacaccacagcaagccuaaagcuauguauggacuuccucucugcaguuccucaccuuucauuucacauccuggcuucucaugccacuuugacucaucacagguacucccuccugcccugucaugucccuaguacagacaccucaccugacccacagacaccucaccuagacccagagaccucaguuacggaaccacuaauccuugcuuuagcuugccugaggaaaucacuguccugcuuuuaauauuaagcaggcaggaaaucucagacuuucagcucuaucaauacugcuaccaagagaaagccaggaaaggggcucuucucuuucucugaagccaucuaagaaaauaaagaccaguuccagguccuaccacccuucccagccauacucacgugcccucuggcgagguuucugccaucuggauaucuuuuggauuugagauuaugucuaguuccggcucuccauuauccaugagcuugagauuaaagaugaucaccaguguuccuggggaacagaaauccuuucuuucugccagccaacccuggcucacccuccaaauuaccaaaggcucuaucuagaguucccggauucucugggcugcaggaccaaagccuacucaccacuauucccaggaaucuucaugaacugguucaucacuugcuccucaguguggaagggagaguauuuguagacaagcucugucucaauggcaaacuucuccacauugucugugauagguucccguguucgagcauuccaggugggcaaugggacaauuaccuguguuugggguuagcagagauaugcacugugaauggggcuccagagcuaccuuccccgaaacaugcagcuuucuugucccuucaguuguauagucuggcaucagguuuauaacuucugguccuuccccaaacuucugucacuaugcugguuugugccuccaaagucuaugugccuucuggcaugucuuuggccauuucauuaauuugguaaaauuucuacuuuuuaccacuaggaaaaaauauaauugcaaucaucuagugaaucuagagauacaaacgauaaucuacaacucagcaauucuacuucugaguaaauacacucaaaggaacuucuguauguacauaccagcauacacauauaggaauaacccaaauauccacuacagagugacuaaacugaaauagucauugguaaucaaacagaguagagguacagccacaaauaugaauggaucucauaaacacaguauuaucugaaagagauacaagugaauuucuacauugucgguccauguguaagguacuaaaccaaacuaauacacaaacaccaaugacagacaaugccgccagcucaaaaaaagaacgugaucauccuaaaaguuaccagguggugauuucccccagcggcacacuaaggaugacaucggccagguguuccuaagggacuucucuuaacuuugguuuauaauuguggcgacaugggagugugcuuuauuguaacaauuccucaacauauauggaaucugauuuuaugucuaauuagaaaagaaucccuuuucuucaaaacucuuucuuaguggcuucaucauguccuccucccuugcuccaagccaguaguagucagaggguugguaaagggauucucugugcaggaacccaaaugaagcacuucaugggcucaagccaaauggcccacacauaagacaaaggagaaugcagcauccuagcgcaggcccgggugauaacucguuaggagcucuaacacugcugguuucugaaaagcugaaaucauucaaccacaaggcugguuuggacacauuccuccuggacugaaaaugaucuuauuuugaaaucuuggcagaguuugcaauagaguacaauccaaaacagugaccuucuagcaccaaguaagggaaaaaucucaauccagcuguuccaccaagggaucaaguaacacuugcauuccaugaacucgucucuguaccuucccaggugaggacagcaccacucugaccuguaggcacuaacuuccacuaucacucccacuuggcauuucuccuucagcuuugaugucaccaaucucccaguuuucuuccuagacuuucuccugacucacaccuuuuaaugguggccugcuuaggucucaaguccuuuucuugcuccauuuucuuuuuuaagugauguuaucugcuacuaucaauuccagagccuaggaccagggauauagagggaaagaaaggaaaaaaggaaggcaggcaggcagguaaccaggcagacagacagccaagagcuacuauugcccccaaacuccauccacuucacuuuacaugucccacacuaacuuacacuguccucccuccauucuuccccagccccagauggcccacuagcuccaaccaccacaccagagcuuccaagucucucuaauuccuucccuuuuccuccuucaauaguuaucaaauacuguaucaagagucucacacucuaaaaagguaacuccauuucucuuagcucccagcuugcuaccguaaacagggccucuugguugcuccacuccaaaucuuucuaauccaaucacugcaaaguaacuacauggacuuucuaaagaaaaucugaaacuaggaacugcuuuauuaaaaucgcauucacucaaacaaggccccaagcauugguucuaccuggccuuguucuccacagacuaucuuucuccccaacaucaacuucagagguuaaaggauguuuuuacugacucacuccaagacuucuuugaccaggugacauuucuaacagguuugucuuuuacagcuucacugcaugcaucucucucccuccaaauaugcagaauaagguaacaaaccucaucuaguaggugaaaaaaaaauccacugauuggacaacuaaaaauggaaaagguuccuauuuuaacaucaauuaguuugccacaaauuuauucucagauuucaacaagacgaguacaaauccaaucacugcuaaccaacagagaggaacaaaccgaaauucucaacuggaccaucuacuuaagugacaacuaugaauuucuauacaggucccuagcaagucucuuacucagaccugaaaggacacuggacaaacuuucccuacucccauucuugacaaaaacaguggcauaugucuuuaauugcuacauucagcaggcagagacaaguagagcucugugaguucaaggccauccugguauacauaauacguucuagccaaccagaacuacauaguuaaauccugucucaaaagagaaaaccugcucuuuagugugagucaccagaccacaaagagaaucagguaggcuuuuguuuagcucacagguuuuuuguuuuuuuaaauguauaaggauguuuuguuugcaugugugucuaugcaccacaugcaugucuggugcccacagaggccagaaggggguaugagauucucuagaacugaaguuacagacaguaguaugcugccaugugggugcuaggaauugaacccugguccucuggaagagcagcgaguguucuuaacuccugaaccaucuugcuagccccuauuacuaauauauucuauaaguuaagauuuauuacuaagccuaucuuccaggacaguaauaauuacaggggcaaggaaucaucuguuaacaauaccagguggagagcgcuaagaaugaagaucauacuggugaugucuuccauauacuuaccugcuuuacccccugguuagagucugacucauggcuucuuauauaaauuccaucaacacacuuccucaaaaagaaaauguguucacaacauacuccauaaaauaaucaucauggagaaaggcacugauauuccauuauuaccaccagcuauaauuuccaaucaguuaggaaagcucaaaauaccugcucugcuaacaguccauggagacacucuccacagaaauagaguacccugcagauauggaaaagcuucaaauccaacucuuauuucucaccacuucagucucauucucagaaacagaacagccauugucugaaguacccugagauuuuacuuccucugacauaaagguauuauuugccuuaguacccaccuuccaaccaaugcgcccacccaucucauccuguaguaacaggcaccugcucgcuccaaugcuacaguuccauggaccucagaaccagagacaaaacccguaaaugucaaguagcaacucaggccacaaggauaaaaccuacuucaucaaugccuucuuccucaugaaaggugcgagacaagaagaggcaggucaugguaucuuccuucuuagugaaaaggauaaaauccuucccaauccgcauugagccccugaaagggaaacagaaaacagauuacagacucaaagcucaucugaaaagggagcacaccuuccaggcauaaccgcagcugauuagagagcucuccucaagacuuccaacagcccuuguucccuuccacucagccagcacuccuugcugugccuucuuaaggaucucuaaucccuuagucuauaauguauaaccuccuugagcaaaguucccuuccauacaaggguuucagguuacucacaaucccucuagaacauauucaccaagaugacaagcccugccuggguuagcuuccuucccagcuuacuggcacaaccccaacaaaggaucacgcuugagcucuagguucaugggguacucugugacguuaucaaauuucccuccugcagcugacacuuugaacucaucaucaucuuuuguggccacacccgauuccuauccugcccuuccuucacuaacacuuuugucccuuccuguccacucaugaaauggcaauacugucaagaagugucaaaaaccaguaugacugcaacacuuacuaaauacaaacgcaauuugaucuuugaagaucaaggccuacauccaugaccaguaacuauagccguucucuguaucagaauugcuuugcuauuugagcuuacucuacagccuugaguuugucuucaacaaggcaaaaguuuaagcuuggaauagagcagaguggcggaaccuuugccuagcaugggcaagagucuggauucaauccccagagucaauggaaaacaaaauucaucuggcaaaagucuaaauggaaucaguggcuuccuuccucuuggccaugcuaauccuucuacagaacagguugagacaggcuuuuccaggcagcccagggcagggcagaaguaagaagcagcagcacaaggacuaucuacucaacaaugaggcuauuuacuucccuuuuucugaguagcuucugaguuuuauggcuauucucucauuaguccuuacaacaccccugggaaaagacaaugguuggaagucucauuaaucucuauauacaauccagccuggcaugccaggcauacaaaugaaugucacauuccauuucccaaacacucucaaaagcucccaagacacuccauagauacccuuagggcugucaauuaucuuuccugaugacagggcucauuuuccuuaaaucucaguauacucccuccuucccuacagcuuguggacagcacuacccucacucaaauuugacaaaacuuucuucacacuuuucauuuguuuguuucugauccugauuauagagucugauuagcagaaacccuaaaacaucaucuuccuugaucaauccuaugcucaccucaauccuaaaucaccucaucuaacuucugaacuuggaacacuagauggcuccaauucaaugagaccuuuacaaaaaccuccugaauauguugauagcuacauucuaaguuucuucccagucuucuaagcacuuucugaguuauguuuuacugacuccugagggagaauaucagaaguuagaaccucauuuucuagguaggaaacaucagaaaguuaaagcugagucugcaaaaguaauagauaggacuaucgagaccucaguuucauaggucuuagauuaccuuuuuagaauccucuaggggaaguuucuauugugaucacagacuggggacucucaaagcaguaauaacauuuaaucguuaacuauuugauaaguaugauaauuuauaagaaaucacaacuuuagugacuaaauggcuggauuaagaacugaaccuuugucugaccaaagugaauuggacagucacuuccauuuucuaaucagaaagaucugguucauaucuucacucugugagauauaucuucauucugugaggaacaccuguacacucuuaggcaagucaauucacuccuauacaucucaauuuuuuuucauuugagaauguuaauaaaacccaccuaucacaggcuaaaaugauaucauccauaugaaguuuagcacaguaccuccuggcacaugguuaagugcuuauuauuaacauuugguuccuguccugagaagaaaucaaagcccagaaacccuggacacuuuggaagcacucccuucuccacacccaaggcacaauucacuuaaggcccaaucaaggcuguugacagaucaaaccacaacccuuucucaaauaaaacaacauguuuccacagcaagauuggaacaugacucauaauuccacuugcacaaacuccaauuccacuaaaucuuauuccacugaaagguauguguagcuggaaguaaguauuucagaaauagaaaucccuuuucucagggcuuuacuccaaaccagaacaacacauuccaagcacuaaacaauuggaaaccaaggucugagggaucaauagauugaagguauuagauggaucuccucuauccuugcaagauguccacauaagacaguuagcuccaggagaaaaauccuguguuucuuguauucacucuggaucccccgugccuggcauaagcauacugauaacuuugugaagugauucccuugccaucucagauaugcuccagccccagaagggaaccacucacacccucaacuacaggauauaaauauucaauaagaggaaagagauagcucaagagaauaauguuuuagauauucauacuaaucaauauacugagcaauuucagcuagacaguuaacuacccccaaucaccacucguuucugacucuccuauugcuucaaauuaauaguccuagaggaacaaaaaggaagacagcaagaauccaccaucugauuuuuguacccagcccuaugcuaggcuuccaauauacguacgauuuuaauccauugccauacugcccaauuugaguggacucaggaguucuuuuggcugacuucccaaacuggaucacacuagcagcaucaccucaaaugguuaacaagagggaaaaaaaauagcauuacuuucucagaccucucaaaauuagcaauaugaaucaaguuaaauacaagcauggcuguacaccagcaaaaccucucuccacauaagaagguaauccuugcuuggcccaucaauaccaccacaguguccugugcuguuaugagaacaugguuaagagucucagaggaagaagccucaguaguuauggcuccaggauguugcacaagcugauaaaugcauugucaagagaaagguaaucuaacugauuucagguugacauucauguuauccaaacaccucccauguuaggacaagaccuggcaaacacacaguguaauuaagccugagauguugcaacaggcuuuucauuccccagauggaucuucuagccacaagagugaggucacaaaaaagcaacuuuaauaguaaauuguuaugcuccacaaaagaaacaaucaucauauaaccacuuacuuggauccauuccugcuccaucauccaaaaagcaaagcauaaauccuccucgaagguccucccgccucucuauaaaagaagaggccgccauuacucagcuguuaccacuaauagggccacagccuagauauaaacaaaaggugacccaaagugaagccugguaaaaagaguuagguuaaaucuaguuucuucuaaaaguacuaagcuaguaugaguuaaacuuuagagcccuugagcuuguuuggugcuuucuaacucacaacaaagcuuccaagaauuuauuggaaggggccaguauugaaccacacucaagaucaucgaauaugcauauuuuuuauauguguacaucuucucucuuuacaucucuuuacaucuacccaaugccauggaucucaagucauuuaaguagucuauuauguacuauaccucaucaacuuuucaaacucaacaggauaucuuccuuugugauuuaaguucgagguaacauucaaaugaugaugccagauggagucugaguacaaugguggcagcugccacuacuguguuuauauaugaucacuacagacuaaaugcagauugugucacauccuuuccuagauacaagccccugaaaaaacugaugauuuaagacacagguucugggcuagaccugccaggucagaacuacugucuucuaacaguuaagauacacagcagcuguggcagggcuucauggcuaacaggaaggagauauaacagacaguagccaccaguaaguagaugaauauuuccuuaguaagcgucauaugcagugccaaguggcaacucauagcaggucguaauaauggagaaaagacucucaaauaaggaaaaagaccauaccaaguuucaaggugcccuuuaacucaaugaagucuacauaaacaauggaaaucagaucguagagauaaaacagagaagggagugaagcagaaguagaagcagggaucccaaacaaaccacuaacaucaaucuccccauuagggaugcuguucaugggccacugcucagcacaagaauaaaaguuaauaagaacaaaagucuacuaaaaaggaggaagucuguguaaaauaaucuaaggucaagcccaaggcuacuuuggagcgcacucccuaaagagucauguugugcaauuaucuauccugacaaaucuguuuuaaacggguuuuuuuuuguccucgccucagggugaaacuaaaugagucaugacuacccucugcuaaauagacaaacuaauguaaauuaaaauacuauuuuagauggaacauaaaccacagagauuuucaaguaucacucaauguucaggagguugaacccucacuaaaauggcucuucaaaguucgcgaaggcugucccuguuagauccugguagaugagaacauuccucccuaagguaguaaguaccucuuaucaaaaucuagauaauccaagugaaauguggcaaggaggaacaagaguuuuuauuguuccugucuuuaaaguauuaaaagucuuccaauuucccaucuauaaaaagcagugucacaugaagacuggaacuagguaagguacagagcaugauggcagcauugucuuagcaccugcccagagauguauauuaugcauacuaauguauacuaugcuauaaaauuaugugaagacugauuuaggauuuaaaaacuggagcuaaaugcguuugaaaagucccaagaccacugaaacuccuugaauaauucaagacguuacuuucuaggcccuugugcuaggguaagacugccauauuauuucagcacagcacuucaacuguggguucaaauucuccuaguucaauuuaucuuaauuuuuuuuccuauggggagagugaauuuuuuuuuuuugguaaguuucuucauucggcuuauaaguacugucugaccauagagccuagguuggccuugaacuccccacauagcagagaugauuggaaugauccuccugccucuacccucagagggcugggauuaauggcauguaccacaaugcccagcuucuuacauucaugacugucccgaggucugguuaucugucuguagccaucuucaaucggacauuagguuccuagagcaaacgcuucaaaggcucugcacuuuucccaaagcaaguaagaagcacacuaagcacucguuuauaaucuaauuuuccuggauuuacuucuaaaauuuacccagugaaggugguagaagggaacaaagaugaucuuuuuuuuauaagaacucaagcuauagggauguguuccuucaauaucacuugaaguagaggcucauuuuucuuaauccucuggauaauaguuugaauauucacuguuucuuugagaaguaacugucagcacuccuacaagcaaacucagcuauaguuuggaaagacagcacuauguaggagcaaucaucaucuugaagucucuuacuauacuacuuuuuucuuuuacuuucaucuaagacuaaaaagcuaauuagcaugucccugucuaaaaccaaaaacaaguaacaauaacaaacccaaaguauuucgaccacuuuggcagccuuuuuaacagaaggcuuucagcagggcgugguggcgcaccccuuuaaucccagcacuugggaggcagaggcagguggauuucugaguucgaggccagccuggucuacaaagugaguuccagggcagccaaggcuacacagagaaacccugucucgaaaaaaauaaaaaaauaaaacagacaaacaaacacagaaggcuuccagaauuuuggcaggacacuaauauguauucuuuucuccaaauaauuuagucuauauacuucaucuaucuagagaguuuuccuaauaauauaacacuaaugguucuauguuuuauucccauuuaucaagugauuccaugaagguuaucugauaacuguauguuccacauaaacucagacuuccaaaagcuagacauguugcucaaaauaagaccaaaaaccuuucagauuucaaagaagagugucaauaaaauauaucacauuaaacaaaauggauuuaagaauggauuucaauucuauuuuucaagguuuuaauaucaaaaugacccaaauggguguugcuauaaauacugaauaggcagaagaaaaaaaaaaccuacuuaaaaaguaaauuaaaggucaaugauaaugacuauaaacucuuucauuguuaccaucacucuggaagaaagaugaccuuaaaauauaacagcagagccaaugaaguaaaacagcagaggcugccacagugucuaguuuuaagccuaacacuucaaagagauggucuaugauuuucauuccagguaauaccaaauguaaucaaguugaauccagaaacggagagcaaauuugugagggauuuucugcuugguuuaaaauggguggacccagcucuagucuagaccuaggagguggaagggcaccugacuuugaucugaaucuugcagcauaaacacacaaccuucaacuugggccacacccucugcccggaagccuacauaaggacuuggaagacagagcguuugcugccuuuugcccugacuaaugcaaauuuugguagcagaaguaguucuagaacaacagaaguguauggaugaaucuuauaaguaucuguaacuggcuuuucaaugaaucagcagcuacaaugaucaaagccucugcagcucccugucuuccaggagguggcagacuaaaagcucauggcaugaacuauauuacaaaccuauggaguuaaugcauuugacuauauugauuaaggaacugcgaguaguaauagauuuagugacccuauauauaaaacgaugacaguuugggggaaguaaggaaaaugauaaugcugguugguuaugcaauuuaucuauggauuaacugacaaaagacagggaugagcuccaugauaaaaucagccaacuucuagcaucucagaauauggugaaggacaaaaaagaacuuagugauaaaaacugacagaugugcaucaacagccuaaaaguuuuaaguaugcccuagaagggaaucuucuguccagaagccacagagcucaaguuauggaaaucaaacugaagcccuccuuauagaguuggcaaaaacagcaaaaacucaagucccagucucagaagguguccacaguuaaaggaaggcacugauugguagagaaugggagccuguaacuucagacugggaugugugagaggguccuagagaagcugagaacacugaaccuuccaauucucaaggguuuuuuucacuugaaguaguucucucagccucacuccuuaauacugccuuuucacccuugacugggaaaauuaaucccuuauugacugcuaaaccagcagugacuuucucugcaggagaaauagcuaaauguaugguuguucauugauucauaggcuguagcaaauggacuggcuggaugaucaggaacuugaaaagagcaugauuguaaagcuggugagaaagacaucaggggaagaaguauaugaguagaucuccaaaugacaaauuauaugaagauacucaccauucaacaagugaccuggcuacagccacugcugagugccagaucugccaaccacagagaucaacacugaggcucagauacggcaucaucucuggugugacuagaaacagugaccuggugccagguugaccauauuggaccauuuccucuguggaauagacaacuuuguuucguacucuguacuaaaguagauauuuauucugguuauggauuugccuuuuccacacauaaugguucugucaaaacuaccuuccauggacuuagagaaaggccuuacccaccaucaugguauuccacacaguauugcuucugcucuaggaauccacuucagagcgagaagggcagcagugggcccacaaccauggaacccacuggucuuaccauguuccuacaauacugauggaauggccuuuggaagacaggguugcacugacaauuaagugucaacagccuggaaggcuguggcaauguuucuagaaggagguauaugcuuugaauccguguccaauauaagguacaguuucucccacugccagaaaccaugcgugccggaaucaaggggugaaaagagaauaauaguuccacucacuaucaccacuagugaaccuacuaugaaaaauuuugucucuuauucuugcaacccuaaguucugcugacauagaaguuuugguuucagaauggggaaugucucuaccaggagacaaaacaaacaugccagugaagcucagacuuccuccuggccacuuugggcuucuaaugccuuuaaaccaacaggcuaaaaaaauaaaauaaaauaacauuguuaugcgggauaauugauacuaauuaccaugggggagauugaauugcuucugcacaauggaguuaagaagaauugugucuggagugcagaagaucuuuuagggugucacuuggugcuaccagguccugugauuaagucaaugggaaauaacaacagcuuaauccaaguacagguccuucaggaacuaagaugugggucacuccuccaaggggcggggagggggacaagacccaauaaggugcuugacagggguagaauagaauggguaguagaaaaagguaguuauaaauaccaguuaaggccacauggccaauuauaggaaugaaaauuauaauuggcauaacuguuuuuauauuuuguuaagaauguuuuuguacagauauguauguuuucuuucaauuucuuuaucaugcaauauaacaucaaguaagaaauaucaaugauuauauuuaagcuugagauacuaaaacaaugucccccaagggacaucuccaccuauucuaaauuuaugacuuugagguuuuacaagggauaguuauaucauuuuagguguaauuaugaccuuguuaaauauauaauaugcuuguaauuauaugugggauaguuaugauuuaggcauuauuaugaccugguuauugguuucauuuguaaauuaaccacaacauaaagagagaugauuuugugacaaguugacaaggguggauuugugauggcaguuuuugauugucaacuugacuacaucuggaauuaacuggaauucagaaauagaggucacaccugugggggauuuucugcuuagucugaaguggguagauccacuucuaguccagaccuuugagguagaaaggcacaugaauuugaccuggauuuugagcaggaacauacaccuuuaauuugggccaugccuucugcuggaagccuauauaaggcuauggaagacagaagcuuuuguucuuuaccuguuugcucucagcuugcuagcacaaccguucccucacugccauuaaaaccuaccucuuuaggauuccaguguauacugaagacuagcuaagccuuguggacugagugacuacuagauucauggacuuuucuuccacucacagccagccauuguuggacuggauugcuggaugacgggaacccaauuagaguuagaguugcagccucuaagucauucuaaaacacccuuguguguauguacacauacauauauaaauuauauauaauauauauuauucauucuauuaauuucuauuacucuagagaacccuaauacauggucucaacaucucuauaaaccaauuacaagccauuucugccucaucagcaacuuuucagggaggaaucucgucuaucaagaguagugaggaauuaauuccaacaauaucuugccuuccagaaagaugagaaauacugggucauuuuacuucccacuauucuguuccacuacccucauaaaucuccuagguucuaagacauauauaugaucagaacugccccauucccaucuagaacaugaagaaauucugccaucuccaggcugcagaaaccacuuacuucuuaaguacaguaaaaaaaagaaaaaauuaauaaaaagaaaguuuaguaaaauaaggucuaaagucuggcuuaccagcauaaaugucuauucugguagcaucagcaucucugcaaaauuaaagggagaaaaaaaaccuuugagauacaaaugagaauaugaaguauuaaucagcaaaaugcauagugcaauacauacuauuuugaauuauucagcuauaggaaagccuguuuuguuuuguuuuuuuuuuaaaacuugaucacacaauuucccugacauguguaugaacuauuucaagcacuccaaauuauuuaggauacaugacacacaggaccuggauacauuaagaguuucauacauccuaguaucuccuuguucaauauguagccaagaaagacucugaauuucagaucuuccugcuucaaccuccuaagcacugagaauacaagugugcacuaccauacuuaguuuacacagugcuagagauaaaacacaggauuuaugcauguuaguauacauucuauaacuugcacuacaugcucaaccacccuggauauauucuuuaaagguucauuucacuguaaaaauuguucauuaagaauauuauauauguauauguacaugugcauguaacauguucauauaugugugaauguaccugggcaugugaaguaugcaugugaagaccaauguccucuucucauugcucuccacuuuuccuucuuuuuacauguauuuaacguggugugugcucgugugcauggucauggagcacaugcagucagagaacaauuuggaagaguugguucucuccuucuaccauguguauucaaaauggucaucagcuuagcagcagacugagccauuuuacugagccuucuaccuuauuuuuacugaacauggauccugaagacucaauuaaacuggcuagccagcaaguaucaaagaguuuucuccuuuccuuguccucaagcauuggacuuacaagaugcacucuuaggccaggcuuuuaagaguguuggggacucaggucucauucuugaauggcagccaugcccacagcucacacaagugcacacaugcacacacacacacacaaaccaagaucaaauauuuguuuccuucacucacuuuacugcaaucauaaaaagauguuccaacauguauuuuuucauucuucccaacauugaaaagguauaacccaccacagacccaugaaaaauuaggucucaugacaaacacuucaauaaacaaaucaguuccucagcccacaaucuuaucuucccuaaucuuaaaagaaaucucauuagauuccagcaaucaguugaagucagacaaauuugucauaaauaaucucuuuaaaggccuggaauuauauuaguauacuucuauuaaguacagacaaagacaggcacauuuucauugguuuuaaaugaaaaaaaaaauuccacuaaaaauucacacagcucuggagacauagaucagugguagaguauaugcuuagcacauguaagguuuggguucaauccuagcaccaaaaccauaaaacaaaaaagauauacauaucugcauauguaccuauucucaaaggcauaaauguguuuuaacauaugagggugaggaacugagaacguaguucaguugguauggagggacaaaauacugggcuugaucccuagccugagauuggacauagugacgugggccucagaacugagaaaucccagugcucagacggcagaaacaggagaauucaaaguuuaaggccauccuuaacaacacacgaaaucugaagcccaguaucucaaaaacuuaucugccauaguuaaacagcagaguuccacuaaauuaauaagcagcgauuucaaacauaauuccauucaguuacauuuuuuaauugaaugggaaaauuauaaaguaaucagaauuaaaacaaaaugggaauuuuguaguuaaacaaugugccaucuaguaauuuccauaagcugguaacaaacauauaguagcaaaagcaaaauaaaaaaguaugauaacacauaucuauaaugucaacacucaagagacugaggcacaaggaucuuaugcuguagaguaagaccugucucaauaaaacaaacaacaaguacuaacaguauaugucagcugaacagacauuaggaauuguaagcucacucacuaacugcagauguuucaaauucuacuaucaaccauuauccucuuccuccuucaguaaauuaucccagcacuugggaggcagaggcaggccauuucugaguucaaggccagccuggucuacagagugaguuccaggacagccaggacuacacagagaaacccugucucgaaaaaaacaaaaaaaaaacaaaaaaaaaaaccaaaaaaaacaaaaauaaaaaaacuaaagucaauaaauaauauaucugaguuuuaguuuacauucaauaaaacuuaagaugauauuuucauaauauaacuauaaauagaacuagucuuugugaacaaaccccaacuuuuauuuggucuuauacaguaauauguauauucuuuaaacacuagaaaaaaaaauaugugaaugcugaaacaugauuccuuccaaacacugaugcuaacaauggaagauacuagaccaugcauaguagcacacagcacaugagaggaagagaucagaggagcucuguaaauucagucacccuggucuaucuacacagugaguaccaggcagaguuacacagugagguccugucucaaaaugaccaacaaaaaauucacaguggaaaaugauuaaagaacauccacuugcaauaaaaacauguauuugggagaagauguaaaacucuggcauaguuuuaaaggcauucaguggcauagcgucuuagcagcacaaauuaauguuauaaccuaugugucccaucaguuugaaucuccuaucuuaauucccuaguuaucacaauuaucacgcucuaauacacaagggagagugguuuggaagugguuaguucccuaucuuuagguuagaucacaaagagcaaugaaugcauuuaaggaaaucaagaaaagugucaauuacugugcuaauaaaaauacuucugcuaacaagucucucaggaguuacaacaacaaaaaaaaugucuuucucuuaaguccucugagagcaaagguacugauaauccauaguuuccacucuaagcaauuacaggcuggaagacuacauaccuugcauuaucaaccaguucagcaagagcaccaaauaagaauucaugagugguucugaaacaauaaauuuuaagagucaacaaaaguauuaugaacugaacaugagucuuaaaguuauaaaacauuuaagagguuuuagaaaaaaaaucucaaauccccauaugcauuacuaaauucaaacuucuccauaacacaagccuuuguagagcuaauucuucucaaaucaacuccugccauuugcuagaaauauuuauucuauuuuuaauuaaaaaguccaccuuaaagaaucuuuaaauuaauacaugcacuguuaaaaguagugauagucuuccuaagggggaaaaugacuauauuuuaucauuuaauugcuuuaagcaccugucaguuucuacacagaaggaauuagaaauauauaauccuagcaguaaauaaauaucuugaauucugaaaagauaugacuacuaaacccaaacuuucagaagcuuccaggagauaaccacugaagucucuauuuaagacuugguuuuacccaacaucugaggaagucaaaaauaaguauuuguguuuaaaagcugcccaagaggauuaguuuucucuuuucacucguacagaucacacucaggcauuuauaaaacacaccgcuaaaagguaugaucaauuuucccugucuuaauucaugucuuuuuuuuuaggauuuauuauuauaaauaaguauacuguagcugacuucagacacaccagaagagggcgucagaucucauuauggaugguugugagccaccaugugguugcugggauuugaacuucagaaaagcagucagugcucuuaaccgcugagccaucucaccagcccuucauguauuuucuuauaauagucuucauuaaacauaaagaagaacagguccacaaagaaccauccagaaaaccagcuuuacuuucaaaggaaauagaaaaguaguaacagacacaaaccauaaucaauuuucauaaauuauucuugcuuuuucaguuucagucaauagucaagauaacauuuucuaaaaaauuuagauuaaaauaucgcacuaauacauagcauuuaagaucuuggaucacuuauauaguggucuaaacaaacuauaaaccacuaguuuauaaaaucuccuaacugaacuaucuaggaaaacugauuuauguugcugggcagugguggcacacgccuuuaaucccagcauuugggaggcagaggcaggcggauuucugaguucgaggccagccuggucuacaaagugaguuccaggacagccagggcuacacagagaaacccugucuagaaaaaccaaaaaaaaaacaaacaaacaaacaaaaaaaaaaacaacugaaaaaaaaaagaauuuuaauaagaaauuuucucuccuaaguucaguaaauauacguguuguuaauucaggcaguagaaccuagagauauguuguagcaagauacagacuuuuuuuaauuaccaucacuuauggaaugaaguucaaguucuucuggcuaaaauccaaaugcugaguauuugaccuggaaaaaauuaaauuucuaaaagaaaccuugccuuuaaaagucaucuuuuuauuauaaauaagugucuacaaguuaugguaccaaugcccauauuuccacaagccuguaaucucuuuguauuguucaagacauaguaauaugaugaacucaaggucugccuagacuguguauguagcaagaucaaccuagaaacagaggcuguggcucaguuucugagcacuugccuggguuagaucccuaguacggcaaaaaagucgaucuauagccagacauuauagcacacaacuguaauuccauagggccaagggaggacaaugacaaguuuuaggcaagcacaggcuguauagcuagauccuaucuuuacaacaaaauuauuaagaggggacucuagcuuugagcacuagcuauaaccugucuucucugaggugcaauuguugcuaauugaauuaucccaauaccuuaccacgaugacuugaaauauagucagcauugacaauuccugauagucucuauagagacucaaauuauuuuuuaaaagaagacucaaauauuuguuuucaaguuuucagucaucuauauuccugauugauguaaaccagaaaauuauaucaaauuaguuuccuauacaauccaaaauggauauguagaaauauaaaauagccaauucuauuuuuaacaauuuucauuuauuuaaacacaaacauguuuuucauauccgucaaugaaucucaaaaaaauuacccccuggaguauaguaauaagacacaucagaauauacuaccacuucccuuauaaaauagagcucaaauuuuucugucuuaagaaaaauuauauuucugggcuggggaauauagcucaguugguaggguagauacuugacuaacauguacaacauaaaacuagguaugauggcaaaugcccauaacucagaaguaaaggcaaaaagauaacaaggucaaagucagccuuggcuacuuaccaaauucaaggucagccuggacuaugugagaccuugucucaaaacaaagaaaaaagaaaaagaaaaagaaaaacauuucuguccuuuaaauguaaaacuguaaguaagaauuauggggaaaauuauaacaccccuuuccacaagaacaaaaaaauaccauaagcacuauguccaauuguuucauauaaaaacgagacauuuagaauccaguaaauggcuauuaaaaaggcaagcauaaagcacaucugucuaaaauuucacuguacucuaugcaaaguuuagaaauguguauuguacacaaacucuaaggaaaaaaaaaauccccaaauuucguugcuaccaguaacagcaguauuuuauacauguguauuucagauaagcuaaucgacauuaaaacacugcuaaggaguauuuuuguauaguaauacauaucguuaaaggaccuugguguucuugguaaagucagaagcaauacucagaaucagggcugaagagauggcucagcagguaaaagcacugacugcucuucuaaagguccugaguucaaaucccagcaccauaugguggcucacaaccauccauaagagaccugacgcccacuucuggcgcaucuaaagauaacuagaguguacuuauucauaauaauaaauaaaucuuugggcuggagcaagcagggccaaccagagcgagcaggguugaccggagcccaacaaucacaugaagacucacaaccaccuguacagcuacaauguacucauauacauaaauaaauaaaucuuuuuuaaaaaaaacccacaauacucagaaucucaaaugacagaaggagccuauaaaugcugaagccauuguuccaaauauuucuuaaaaaucauuagaacacacaaaaaugcaaguuuccuuuuuuugccaaauauucaaaggguacccuguagcuagcauuuuaagaagacauaauauuuuuaaaaauaaaaauggcuguagacagcuuuaaucccagcacucagaaggcagaggcagguggaucucugaguuuggccuaguuugcauaguaacuucuaggauagcugagaauacacagaaagacccugucccaaaaaaagaaacaaagaaacaaaaaccacacacacacaaaaagccagaaacaaaaauaaaaaacaaaaaaacccuucuuuacagaccuaaguuucauuugcacauuauccaaagucaacuaauuguuuaaacacaaaggcuuuguauaaacuaauacuuucaaucaugauuuaacacuugugacccagaagaaacucagcauuuccaacaacaaacucacauuuugcuuuuuauguaaagaaaaugauuucucagguugauuagucaaccugaauuuaaaccaaaaaguuauccacaaguucaaagccaugaaaauuuuugcugaguuuuuuaauuaguugacaauaguuaauugccuugacugguagaaaauaaagcuaguggcacacaccuuuaaucccagcacuagagaaacaaagaaaagcaugaaucucugugacuuccaucuaagacagccagaacuauagugagaccgugucucaaaagaaaagaaaaaaaaaagggaaagaagaggaggcagcagcaguguuggugacugagaaauucuggaaucauuuuauauucaaauaguguguguauauacacaaauacaaauauauggucaaccucuauuucagcaggcuuauaagucauaugaaauauagaaaucuccgacuugauuaggucccugcacauucauuucucacacuguuacaacuacccaaaaauaucauaugccaagucacagaauguuccaagaguaauagacauaaaaaaccugucaucuugguucagugguuaagagcacugacugcucuuccagaagaccugaguucaauucccagcaaccacaugguggcucaaccaucuguaaugggaucagaugcccucuucuggugugucugaagacagcuaccauguauucauauacauaaaauaaauaaaacuauuuuuaaaaaccugucauuugaaauuaaacauuaugcucaccugacuacauaaaaguauaucaagucaaaugacuuaagauaugcaucucauaucaaaggaacauuacuaccacuauaccaaggaugccaggcacaaaaccuaccaccaaagaggaagauuccuuuaauuugaaaacccuaauuuguaaaaucucggaaaaggaagugaauaucaaaagaaacuagauuuuucaggcugucaugagaauuuguagcccauuccauccuugauacagauauaaccaagaauaaccauuaacaguaaguaucauaggauuugaaaaacaaaaaacaaaaacaaaaacugaaaccuguuuacucuccccaacacauacuucugaauguaucugcuuagguacuagagauggcucaguacuuuaguauaugugcugccgaagcgagcauggcucaguacuuuagaauacauacugcucuuauagaggacucagguucaguucccaguuccuucaguucccaguuccuacaugguggcucacaaacaucccuaacuccagcucuacgggacccgauguucucuucugaacucuguagguauuaggcaugaaugugguacauauucauacauagagauaaacauccacauaaaauaaaaaauauuuuaauaaccuaucuaaugucuaacaccaaugacaggcuauauuacauaaacaauauaaagaaaauaaugaauaccauuugauuuuuauaugguguaaucuucaaacacuaacauauuagcuccaucuuacgaaagaagaaacagaggcuugccgggugugguggcaaucccagcacuugggaggcagaggcagguggauuuuugaguucgagaucagccuggucuacaaagugaguuccaggacagccagggcuauacagagaaacccugucucagaaaaaaagaaagaaagaaagaaagaaagaaagaaagaaagaaagaaagaaagaaagaaagaaagaaagaaagaaagaaagaaagaaaggaaggcaggcaggcucaaaaaaagcuacccugugcauauguauggaaaagcagcauucaaaaaaaauuuuuuuuugaguuuugagguuucuaagcauaggcuucucacaaaaccacaaaaauuucuacacuguagcuugggcucugcuugcaagucuacauaaaaagaaaaauaaauaaaauacuguuaauuucacgauucaaaauauggcuaauauuguaacaucuggaauuggcauuuuuaagauuuuaacagaacaaaggagguacgguaagaucaaucuuuccuucucuggaguugauuuguugacccauucuacuauucuacuauuacaacauauaaaaaguuuuauuuuucucuaagaaugaacuucccaucaagucauaaugacaaaaacaacaacaacaaaaaaaacaaaaaaaaaaacaaaaaaaaaacuuaacaauggcccacaccagaaaucccagcacuuaagagguugaggguaugagguucaaagccagccugggcuacaguuaagcucugacuaaaagaaaaacacccucauugugguguuguacaguuaguguuuucuucaaguaaaacaagacacauucauaguagaaauauuucaaaauucaaauuugugguccagguaagaaauuccaaaauuuccaaaaugauaugccaauccuucuauguugaagcaagcacuaauuucaauucaacauggauaaaauucacagaaaauuuuccaacaucacuuuauucaaguaacucaguuuacuuccuugcuuuggcaauguucauaaacuguuaauaauguguacaauaacaaagggagaaauuauacuuagaaguuuaauaaaauaaaccaaaauaauaaaucaggaaguuaaauucucugccuuacagacagaaaaacaaaaccuucaaaguaauggucaauaguagguuaaaauuaagcacuguagccaaaugcuucauacugucuuaaaucuggauaccuuuaacuugccucuccagcugccucucuguaagccuuuaauuucuuugagccucggguuucucaaaugcaagacaagaauaauucuaaaccuauagauuugucuuagaaauuacuuuauauuuaaaacaguaaguaguggaagcaaugaauugcugauauuacuguuauugcacaaagucuauagugaugcuggaacaagacagauuuuugaaggccaguucagggucauccaaguuucaguauauuuauaauuccaaauuugcucugccaggucaaaauucaaaucugaccccuuuauagaacacacgcagccaugaacauuuaagucucuucaucugcuuauucuuaauauguagcucaaauauaaagaauaucgaaaguguggccaaaggcugugcuagcaucuuugaucagugaccuagguuccagauucauaaucuguauccaagguaaucucugugguaccaucucucucugugaucuaccucaauuaaaagaaaggaaggaagaaacaaacaaaccaaaaaccuuccuaaauaaugcaaaauuaaaccucuuggcauugaacaaaucacugcucagaaaaauuuacuauucaaaaguuuuuuuuaaguaucauggaaucacaaaagacuagaaaauuacuguacuauuaugagauaccugaagucuauggucucuacucugcagauguuuuuucuaacuggaccauuuauucaucuagguuuucuuuaccuccuuauccaaauacucuaauacuuaccuugaacccaaaaguaacaggugaacugaaagauuagacuccgacaagauaacuuaaugaagggcuugguagcauacaccuauaaucccagcauuuaggaggugaauggaaagauuagauuuuggcaagauaaccuaaugaagggcuugguggcacacaccuauaauucuagcacuuaggaggcagaggcaggcagaucucugaguuccagacuagccuggucugguucaggccuggcugggcuagguagaaagacccuguuuccaaacuaauuaacuaaacaaauacacaaacccuaaaauauuccauaccaaaugguaaugauguuaaucucuucacuuacucaagaccaugaacacagcauccuucugugauuucacauacuuuggaaaaagacuaccuaaaucaaggccuuuaaagaaacuuccacucuuccuuagcauauauaaacuacauuggauuuacagccaauuugccaaaaugacaaaaccaauuguuugcugaaaauuaacaaaugcuuucuucuuccaaguuggucauuuuugucaucaucaucuugugguuguugcuguuguuagaaacacuuguuauaaacccaauugucuaggauguuacuaaagaugugcaacaguugauacuagaugguccaaauuuugaugauccaaagagcaguuuugcuggauuccuauuaaacacuuggaugaaacaacucaauaugauauaaaguuuguauuuugaaauuuuugauccaguaagugaaaucauuuucuucuagauuaccaacaaauaauucacugaucucaguucuucaauacagagcucaagacauccagugauacaucuuacuccaaugacacaagccaaagaauaaaaaagcaaaauuuucuggagaaaggauuuccauauuaacaucaaggaggaguuacugguuaccucaguggcaccuaacaagauacuuacgaauuuguguggagauauucaaagguuaguugagcucgguugagacugcuguaauuggugaaggccaugacagcaaugagucuucagucuuugccgguuaacaggaaaguacauauagugaaaucgauuuccccaggauucugaucaguaaaggguaaauuugugcuucuuagugacacauaaaaaaaaaauuucccuaguaucuauucaaaauacaggcagauauuuaaaacugcgagugauuuaaguauuucaaugacucugauguaauacuuuggaaagaacuauauucgaaaccuacuguccuuaagugcuccggggggucaagcuuucuucacacaauuccgacgcacaucaaaagugaacgguucugaauggucuucaaacuuggagguuuacagcuucaacuucacguucaaguccuuuucuguucuccuaaauucaggaaauugaccuacuucugacgguucaccuacuucauuaccaccgaagacuuugucaccaccgaagacaccaggcuccucaaaagagugcucuacuggacagugcaguggaguggaggcuacuucuggcuucaccgcuuuccaacagaaagguccuuggugcugacugacagauuucuuuucccaaaccccgcccaaacacagcuugcuauuaugccacaaucaccacagguugugggugaaauuacucacaguggcccacagaaacaccucacaaccuacccucccgaaucaccucaggugcgcccuucccccacacccuucagaagauggccucgggcccucgggccuucccaggccuggguccuguggccaccuccucgcuaccgacagacaggaguuagucccagagccugggagaacagaggaaaguggcgagugcaccaccagauccgaucgggcguugccugcagcucgcagaugccuuugucccuccccguggaauuggaacucaaccaccgcagcgcgcucuuggaaccaugugcugccuccgcugccgcugccgccgccgccgccgccgcccgcccgcgccgcgacacgacacgacacgccgcgccucaacagacgaugacaggcugggcgucacgagauucagcguucaguacggcuuugcggccggugcugcccgcgccaccgcuaccucagccaccgcuuugucuccguaagcgcacgcagcgcgaaucaccucgcucacu

SEQ ID NO: 5846 - RNA, 9041 nt, Mus musculus
uauaucuacauauacauguuuauugacaugguauucaauugccaggaaauagagccaggcuagaugugcaucaacagauggcuuuuaaaaauacacauggaaucuuauuccggaaaaaaaaaaaaaaaaaaaaaaaggaaaagugaccuuaugauauuugcagggagguaaauguaauuggauaucaucuucuaaggcagagaaagugagacauacaacaugcuuccucucgugaguguagcaggaaggggcuggugaggaaggagugagugugcuagcacacaccuaucccaguacccaggagacagaggcaggaggaucagggguucaaggccacccucagccacauagcaagcucaaggccaaauaaaucuacuaagacccucucucaaaaacuaucaccaccaccacuaccaccaccaccaccaccaccaccaccaccaccaccaccaccagcaccagcaccagcagggcugaagcagcuuagcuguaagagcacuaagcuauucuugcagaggagcugaguuugauuccugacacccacauggugcucccaagccuuuguaaguccagagucagagaauccagugcugccucuggccuuugcaggcacuagacaugcacauggcacacagauguauuugcaagcaaaacacauuagaagccacaaccggucaccaugcagagaucaacugaccaugaggucucugaccccaagggauacaauuacacacagcuccuauccucaaggcuuggggacaucaaaggaagaggagccaaagccggaagaccaggacauccacuucaagauagucuuuuccuuaaaaaaacagaggacaaggaagacagugggggguggaugugaucaacagagacuaugugacacucucuaggagagaauauaaaauuaaaaucugaguaccugcuccauuccuagaaaacugguuagagaugccaacgucaccgccugauuaggaagaaagcauacagacaagucaaagacaaucuaacacugguacagucagagcuauggguacaagaguggccuauaaugggggcuggguggagacgcacccaaagaggagacuuguaucaaaucugagaggggucuugcuuccugcccauaagguaugcaguuuaaucagagcuugggaccaagaccugagccauuacacuggaggcagaaugaagcugacaggagaacccaaguucaaagagaaaagcaaccuugaguuaagcaggcuagugggaggggcagacaggagacaggagguccaaauuugcuuugcaguagcaucaggagggcugguagccaaagaauaucaccauugugacugcaguuggaaagaaugagcgcugggcguggcacuugccaucugccagccccuagaggcagguuaccuuucuacugccugacucuuucagauaaggaacaggagccaagagagguuucgagaucucagagcugguaggcugcugaaauagcagcacugccuaguaccucacccugaccuccuuaccacuuggaugaugcacaguacauuacucaguccuuuccauugaauauguccacagcccuggcgcagcuggccaaugugucaccucagguguguguguauagcaggagacagagcacgugcugagcacauaugcaaagcucuggcuucagcccaaaaucaggagagaaggaaagaagagcugauauucggggguugggguggggagggaaacaagagggacggacaauauaaggagagagacugacaggaacaagaagagaaggaaauacaggcauaaguuuccauguuuacacaagccaaggagacuggcucuuccaccaagcauagguggcuguggggauuucacagggauaggggggcuggcauggagcaaagcaaguuagaacugguguguuuugcgcuccuauccuauccacaacuuuccuuuuauugcucuaccaugguggagaccaacugcucuggggcuccuccgcucucaccagggugguucuguucuuggggcagaucauucugccaugguucagggugguaaggcucgccaucucuagcaucuucagacccguuccuuauccaaguaguccugggugcucugggaaucgcgccuccagcgaaucaucuuucucagcugguccaucaugaacuucuuuuucagguggucguacaaguagcucaucuuccucuuggucuugucagaggcuuucaucuuaugaaaaacagagguggauuuaggauaaacaagucacuucguagccagauacaucugaggcugcugaccaaucagugguaaggugccuguuagaccugauuuucaucccacgaaacagcuuggacuacagggaaccccaguuucauuauuuaaagagagggcaucaggcuggauagacuaccguggugcccucugaugcucugcagccgagggaccugauuuugaccuuaacaaucugaagacugaucuaaggaaauagguaucugggggcagggggggaccaggaaugcagcucagucaucgagaacuggccuagcaugugugaagcccuggguucaauucccagcaccguaaaauaaacaacagaugcacggaaauccuaagggaaugaggaaauggaggucccaggagcaaggagguccaucuugguuuggaguuuguuuguuuucuaagacagcuuuucaagauaggugcccugacuguccuggaacucacucagucaaccaggcuggccucgaacucaaagacugagauucaauauugugguagcugggcuuugguagucggccucaggaggaggagguggccaaacauggaacugcacuaaaggugugugccgcucuuuuuuccaucggcuuccauccuguuucuuucuccuuccaaaaauccucacacugugucccuaugacuccuugugccuuuuacauauuaucugugauucuggcauauaucugugacaugucuaccucaucuaugccuacauauuaccugucacagcccaucaacacagggaguucuaacuucauccauuccauaacuccugugcuggcucaacaacacuguugggucuggaggacaacuccucauucaguggagcacggcaacgaccgggcuuggggaggggugugggaaccaacugcaggugguccccucacuacaguguaaucaggguguaagguaaugcucaacuauuucuaagccugguagaaagugauacaccccuaaaagaaauccagacuucaaaaggcagauagcaagagcuacagaggaggcugggucggcugcccuguccuaccuauccugguacaugaacucaaguucuccauuuugcuuaaacuaguucagauuuaccuuacagaccccauaacuagaagaauuucaaauccuguuuuacaaauaaaguguauaaaacuggucuaucucugagucccaaccgauucugccagaccauagcaugagaagguuaacacagagaacauacauggaccccgucuuaguuugugucuuguggguuugccacuguuguugcuagccucaguucuccucugaaaaugggguaaguuuucaaaagaaauuuuuuaaaaagccuauccauauagugcugaugccaauucagauugcaagccugaaguucugcaugcacaauaaaguguuuugaggaaacaaaacaggaugugagccaaggggucuuucccucugagucucuucagccaugcagagcgagugugauaccuugggcaagacaccaacuccacuguaaagaugggaccugucuucaaauacuuccaugggccccuaucagcucuaggagcugagagcucugcuuccaccccaggcuacauaggcaacccgcaaggaaagaaggaaggaaggaaggaaggaaggacagagggauggggaguguagaguggucagcuccaagcacagaaccuggcgggcacuuuaccuccaucucgcagauacgcugugcguugagguugucacgaauaaucacccgagauaaauggcucuugggcaacagcuucuucacguuugcaucauugguauucauuaagcuagaggagagaggggaaggugggacagguuagagacugcggcucaaugcccaauuugauaggugcuggaauaauggaaaacaccucuuuggguuuauuuaguuuucuuuuggagacagagucuugcuauguagcucuggcuagucuggaacuuacugugagccagguguacuggcugguuuugugugucaacuugucacaggcuggacuuaucaccgagaauggagcuucaguugggaaaaugcuuccaugagauccaacuguggggcauuuucucaauuagugaucaagcauggagguccccuuguggguggugccaucucugggcugguagucuuagguucuauaagaaagcaagcugagcaagccaggggaagcaagccaguaaagaacaucccuccauggccucugcaucagcuccugcuuccugcccugcuugagauccaguccugacuuccuuuagagaugaacagcaguuuggagguguaagcugaguaaacccuuuccuccccaacucacuucuuggucaugauguuugugaaggaauagaaacccugacuaagacaccaggcuagcuuaggacucuuugagauccaccuauuucugcuucccaaguacugggacuaaaggcaugugccaccacaccuggauuuccagagaagugguuuucucauuuucagaggagugaggaaaccauuccaagcuuugccugaagacaagguauguuaaaaaggcuguuucccgagcacagggaggacacagaaagguccaaagcaguccacaagagagguggcagcagaaagaguccucacaauuauuacuguuguuauugaagggauucuggccagccccagcauguagagcauggcucuggcaggccuugacuuucucccccauuuccucgucuugcuaaaaagcagaucacaucccuaagcuagcccccaagaucugguuccuuauuuggccacuuccuccuccugagacugacuaccaagguccagcuaucaaaguauugaaguccagcaauuaaaagcccccuuuggcucaccuaauauuaacaugcccaauuaaaauuaaacacuucauccuaacacaggguuucccacuguuccuuuauaaacugcuauuuucuaugugccaagucugucuccuuucuauccagaagcaguccuuugucuuucaggagaaauaccccuguccuaucuccccuuuucccuuccccuucucccucauccucuaucuccugucuuugucucuuauuuccagccuucugucacucuggagcaaauaaaucuuugugcugagaacuuggucauggggguccugagccaauacuuucccuagcagcuauuguuauuacuguuccucuguaaagggacuggcguggacccucaggcugcaaacacuagucaagcauucuccaggugagcaacccucaaaaugcugagugucagcucaaggagaaaaugccggauaagaguaaagguggaggggcuggagagauggcucagcggguaagagcauugacuacucuucugaagguccugaguucacaacccagcacccauccuaaaugagaucugacgcccucuucuggagugucugaagacagcuauaguguaucuauaauaguaaauaaaucuuuggggaaaaaacaguuggaagguagagguaaaagaugaguuugagagaggaagaggugggaguucuuccuucacagcuuaaaucuaagcgggaagcuuggagaggggagaacagaacaggguagaaaaaaauaaagggaaaggaaagaaaaccagcuguguuuucugucuguuuaugucugugcgcucagcacuugggaagcuagaagcaggaagauggagcucaaggccagccugggcuacauaggcaacugucgaagggagggagagagaggggggaaggaaggaaggaaaggaaggaagggagggagggagggagggagggagggagggagggagggagggaggaagaaaaugaaggaagaagagagauaagggaggauuuggauggacacagauuuagcuaauaaguagagucuaauggaagaguugggaaauguuuaaaaaugagaaaaguuugggguguuaaaggacuuuuagggacuuugacaaguuguuccaccuuuugacacugcaacuauugacaaaguuuacacucaggaaccaugcaaucaaguuaauguuacaguuugcuacaucaguugccauguuggauguugcugcccauaggcauccuggccccagggcaucaguggguuggagacacccacacggguaagagguguggagcaaucugagcagaaugggcagcugggaaugaauugguagaaugugcuuagcacacacaugguccuggugaucuccagcaucaauaaacgucacuugggaggcagaagcaggaggaucagaaguucaaggcuauucuuagcuacauuaugaguuaaagccaagcugggcuacaugucucaacaaauaacagaugaugauguuagccaguggguucucucucuuuuuuuuuuuaagauuuauuuauuuguuauauguaaguacacuguagcugucuucagacaccccagaagagggcauaagaucucauuacagaugguugugagccaccaugugguugcugggauuugaauucaggaccuccggaagagcagucagugcucuuaccugcugagccaucucuccagcuccuggguucucauuuuuugauaauuuaguuauauuaugaaguguuuuucaaugguuuuucccauuuaaaaaaacaauuguucauacauucuaaaacuuggaagccaaguggaucauuguguuaagucaguugauauaauacauauaaucaagaauaaauaucuugguauaauaacuagauagagaaaaaaguuguggccacugcaacuaaacaguggcuacuguuuacuaaagagugaauuuuuguguugugcuuuuuaaaaauacaacacacauauacuuagauauggauuaucuuagccugucaauugcuguaauaaaauacugaccaaaaacaacuugaagagagugcuuacuucaguuuacagguugcaguugcucaucaaauaaggcugaggcagagcuaagggcaggaaccugaagucaggaacuaaagcagagaccacaguggaaggcugcuuacuggcuugcucuucaugacuuacucaacuggccuucuuauacaacccaaccacccgcgcaggugugacacuguccacagugcccuacauccucccacaccagucauuaggaaacugcuccccagacacgcccacaggccaucagcuguagacaauuccccaaaagauguuccuucaucccagguaaaacuaguaguuuuaaauugacaaaaacuagccagcacagugauugguuugcugcuccgacuucuguuugguuuguuguuguugauguugcuuaguuuauuuuacuuuugaaaugauuggcaaaccacucuaaaggaaaccagggaaaugacauacgugcuggugaaguauuucugaauacagauucccaaacaaacaauagcaaaaagggaagaaccacacaugaauugacugaaacagaaauggcugucugauacacacaggaacagaaggaauacaaauaacaacuuauacuaaacucagucucuauugguuagcacaucagaauaagaucaucauaaaauacauucauagucagacaaaacaaaaacaaaacaaaaacaaaaaaacagaaaacaccaccaccaccaaacccaacaaacaaaaagauguauauuuugugacaaggucucguguauccaggcuggccuagaacucccucuugaacugagagugaccuugaauuuccaauccuccugccuccagcaccugagugcuugauuacaaucgugugcaaccacguucaguuaagaagaaaacaaagcaccuuuagggggauucuaauaacguucuccaguucauuuuccuaugaguuaggaacaacuguggucaggcugugcuugcuaauacaaaggaacgaacauugaaagcuacccaguuccacuuuucugguuuuuaugcaggaugacucaacauacccaggugcggaugggaagacagagucaacggucaggaauuuacacacaagucuaaguccuauuuucaaccaaaaagagacuaaauauuuaaagacccucuuuacuuagugaugcaccaaauuuaucaaguaauaaauacuggucauuuuugaaacaaauuguguuuccauaauaaauccucuguaggacuuguuacauccuuggcugaugccgguugaagaagggggacaggauuggagucaaacauuggggaacugaaggcuuuucaaggacgcuggagaaugggaaggccuggaguugccaagucgauuggagccugagaccaauugcagacgucaagccuacacuacgccagggucaggauucauucggaaggcuagaaacgggacagugccuucggcccagaaaacgggcuucugaagguccuacggguuggccugagucugaaaaauccugcgaucggagacauugcugcgaucagaggaacaucuaagggcggagguugggggggggacacggcuggaacaaagugagucggauucccuuacggggucccgggucugacaacugcuuuguauacccgagccacaccugaauaacaacuuggggaguggggaccgcggccgcaggaaguagaucugugguuggacguggaggccaagauccggcuggcuguccagucucucgcgccggaaguucgaaccagaagcgguagucucuucgguaccuuuccuguaauccgagcccaagucccauuugacugaaggccuucugggcuguguagcggucucugacuggcuagagagcgacucaggaaagcuagcaagaccuaaaaccaugguggaaagacacgcggucgcagagcaacuaucuacacug

SEQ ID NO: 5847 - RNA, 8013 nt, Mus musculus
aagcgguagucucuucgguaccuuuccuguaauccgagcccaagucccauuugacugaaggccuucugggcuguguagcggucucugacuggcuagagagcgacucaggaaagcuagcaagaccuaaaaccaugguggaaagacacgcggucgcagagcaacuaucuacacuggagugcguugccugggagacaaccggcaagcagaccgcgugacagucuuuaggcguucuuugugaggcucuguugggcguguugccuaggagacgaagggugagugggcggggcgugcaggcgguggguguagcaaugguccuucuggcuacuuggcgcauuucugugaagacaggcagcccacccagcuuuucccaaacgccugggaacugcguaguccuucgagguacagaaucagucgcggggucccccuaagccccgaacugcccauuguuccgcgaggagaagccguugcuaccaagguccggaaucaugaagggcccucucuuucuuggagagggucguccgcggcucugcccugaaagauuucgggggcacugagggaaggagguaagauuguuugagucuugucaccacguagagaggccaagcuuccuaggcuuguuguggcaccuuccacucaucuacuuguggacucuguuccacguuuauaacccagaauuuaaccagcgccccaccuauauuugccaacuuucuccagaaaguguaauccaccagaaauaucagccuucagaacuugcugucuaaugaugaacaaaacugguuuuccucgagucucagguuucacggcuacaaauuaacuagaugccaaaagccugguugguuguaaaauguaaaaaauggagaugacguuucuguuuccucuccuccccucucccccccccucccccucccccucuugaaacucuugaaagaguuccaguagucuggucaggaacaccacaucuugcuucagcuuccaggucugcucuaccauguccuacugucugugaucgcuucuuacuaucuuugcaacucuauaacaaaugccuuuauuugucauucccacaagcuuugcauuuuaacuuuaccucugaagggacugaagagagcagaaacaaaaccaaaugucacuuggaagucacauuccuuggaaggcaggaacagggagacagaacaguggaaaaauaacugauuggccugagguuaccugaaugacuuuucauucugagaggauaaguuaggccaugaccuuaugcuagcugaaacuggccugccugggaaauccugauuucucaaagguuaauuuuaagaaaacagcuuuguuucugugacaaggaaaaaauuaaaucaaaacaaacaaacaaaaaacccuguaguuuguuuccucagcucuuuguuggggggcaggacccauaaagcaagggccccaccuuucucuucuaccuccugaaugcugcaguuccaggugaccaucaccaaggcucuuuucuacuugcucucaguugacuuugaggucauuaauguuggaagucacacagcugagcagagaacaugaguuuccacuagcugugcuguauguagaugacaccagucaugugugcugaaaacagcuagacuugcuggcugguuaugagaagauggaaagacuuggcauaucacuuucccucuugucaccuuuaaccuuuggguccaguucuacuuaacguaaucggaacauauccacccuaauguucuuucaguggcuucuacucccucagcuccuaaccacccucuuucuccugaaaccaccccaguagaccuaaggcccgucccuuccauuguucacggucucucuggccauggcuggcccccuuccucugugugaaaagacccccagcacuugggcaacaguucuggcucagugaugugaauguugguguaaucacugaguucucugcugugcuucucgauugauggguucuugcccuccaaacuuccuccuccguccugcagguuucagugggcacagccuagcagaaagaugcaagcuuaauacggcacggacugucgacuuccacuuugaugacuucaccguggagugccuucccaguucagaucccccagccuucgaucagaggccucucgcagaucaccaagagccuguuuaucagcaaugguguggcugccaacaacaagcuccuacuguccagcaaucagaucaccacagucaucaacgucucaguagagguagcaaacaccuucuacgaggauauccaguaugugcaggugccuguggucgaugcgcccgucgcacgccucuccaauuucuucgauuccguugccgaccguauccauucgguggagaugcagaagggccgcacacuguugcauugugcugcuggggugagccgcucagcugcgcugugccucgccuaccucaugaaguaccaugccaugucccuuguagaugcccacacuuggaccaagucaugcaggcccaucauccggcccaacaguggcuuuugggagcagcucauccauuacgaguugcagcucuuuggcaagaauacaaugcagaugauggacucgccaaugggacggaucccagacaucuacgagaaggagacccguuugaugaucccacuguaagccagcccaccaguaacuccaguacaccaaggucugaacuugaacuucgacuuuuguugcugcaggagcacagcagauggugcuuuucaugacgccagaaaaaguguugcuauagcauuuaaccucgcaguccagccagguuugguggugcaugccuguaaccucagauugcugaagcagaaagauuacaaggugaguuugaggccagccuaggcuacauaugagacccuaucucaaaaacaaaaucaagaacagaaauucccaacaauuacuaucuugucaucugugcuuucagagaguacauucauuucuuauaauauagugaagguaacuuuucugugagugguaggguggagcuggcagauggugcugggucauaggaaccagugcccagugcauauggcaagcugggguuccugcagcccucccggagaugaccaacccagaaacaaaucugccaaaaucccaccugguucuuucagaggcaaauccugaagcuuccuggugcucuuggaugucucucaauguaagugccagccugcuagauuaggggucuucaaccaggguuacagagacugccccuucuaccuuuaccacaguggcccaauucugguuuucuagaucagauucacacagugcuuggaucccaguggugcccagaucagcaauccuaccuguacacaggccuuaguuuauacauguucucagagccucuaugugagagagaugaagaaauggcuugaucucugcuaggccucauccgagaagccgccuccagaguucucacuuugcaaccugagaguccugacacaagaccgcgugcagaauugcagaccaugagacucagggucccaggcuggcugacuguugaggagcugugaggacugugaggaacaagugaguugucucuagcaagccugagauucagggcugcucagaagcccuugguguuagggucugauucaagaaggcuugguuuggguugguuugguuuaagcccugcucccagguagcccaggcuguguagccuugagcaccggucugucucuuugccuguacuuuaggaaugcuggguucacagguaugugccaccuuguccagccuagacuuagugcuacaguguguuuuuuugugguauaaacucacccaaagcaucuugggggaggaaaggguuuauuugacuuacauguuacacucugucaugaaggaauguggcuugcuccccgugacuugcucagugccaccugcccagguagccacaaccaugguggacuagacccucucacaucaagaagcccaucuccguggagggucccuugucccaggugacuccaguuacacugacaaacacuguaacagucuaauggagagccugguaugagguaggcaggagaggaugaagcuaacugcuguucuagacuaaugucauccuucaucaagagcagccccaucccuucccaccccagccuucaccugguagaaacacagauuuuuuuuuuaacaaagaacuuuauuugagccuuuuugucauuaaaagaaaacauuuggagguggaggcucggugacuaugagaacuuacuguucuucccgaggaccugggguuugauucccagcaccgcauaguggcccacaacugucuaugguucuaguaccaaagaaucuguugcccuuuucucgucuccuagaguaccaggcacacaugcaguacaaauacauauguuuagggaaaacacucauacacagaaaagaaaaauaaaucuuuaaaaaaaaaaaaaccuucuaaauuagcacguuaaauuaacuugaacucaguucucugggucauccuacccuaaggccucaaugcaugcuaggcagaugcucuaccaccaagccaauccccaguccaguucuuugagauugguuuuggucagggucucccuacguaacucuggccgcccuguaacuugauauauaaucuaggcuagccuccaacucaggucagccugccucugucuguacacagauucacauauuuaucacaaaucaggacuccagcaguucuacugcccaaacgauccuguuuugggucccauuuguggucagaccccaacccagcccaacccuaccacagccucuggugagcaugugccugccugugugcauccuauggguuugcugaugcucgguaugugcggccugcagugugccuuucccacagccacgcgucuuugcuuuauggugguguguguggcugugcuacacugcacucaaugaagcacaccugaguugucuguuuuaggggauuguagauaaaauuacuauaaacauguguacacagguuaguguaugugugaacauaaguuuucauuucucuaggguguguacuacagaaugagauauuagucaugaugaugguguguggaaucauuuuuauuuuuaaaaugcuaaccuuacagaguggccauccuuccuucucgccgaacuugauggacacuggucauacucaccccugugcucucuuauccccucccacauucucagaacaccuuuucccaguaaguuacaccaccccucccccaugcucauaacauuucuguguucacaucuuuaaaaacugggcuaguaaggcguuguguuacagcagcuucauacauggcaucacacuguucucggggucccccuccugguccauaucguuauuuauuuuguaaacuguauuuuuggaaaauacacauuuauaggaucugugugccaguuccuccuagcgcccucauccugccucccucccaacaaguccaccuuguuuuguucuuaacaucaauacccuggauccaguuggugcugccuguugcucauggugugggaucaucugcuagggugugggcaccuuaccaguggccgagucgccaaaggaggauggccucccucccucuguagccaucagcgccaauagcuccucccgcaagagcagguggauaaguauguuuacccaguaugaguugaguugaugaguugaugugacaacagccuuaagauagccagcagccucacccuccagcgccuacauucuuccuacucuggggccaugaaaaggaacaggaagcugguugacaccuccugcagaauuccagcacaauuacuguuugucguaaagauugccagcuagaagucacacuuuuuauuuauagaaauuuuguguuaaaauaauagugaauguggccuuacuccuaaacaguuucugggaauuaaaaaaauaagacuuuuuuuuaaaaaaaaauaaauaaaaauguccccuguaagccugugaccuaugacuuuccuuaccuuagcugugaaccuauccagugcagaaacuagaaacuagccaugaucacauuagacuaaguuccaaagccacuggaaacucuguguguguguguguguguguguguguaugugugugugugugugugugucuuugugugugucuuugugugugucuaugugugugugagagagagacagagauagacagacacacagagagacagacugacagacacagacagacagauucagacagaggggaggacugguggaguggggagagacuuaaccaugacucugagaugcccagccacauguguuggaaagaguuugcuuccuuucccugguccucuuuuucuaaauccuugugcuuaauauaucuggguuuuuugcuuuuuguuuguuuuaaauaaacucuuaacucugcuucaaacugucucauccucaaauucuuuucuacuuggaggccaagaauccagcucuacuugauugcaaaucccuaaaacagguaagggaacuccucaggccgcagaggggagccucugauagccucugacagaagaaccagagcgauuacagucagggagccuguucauauucauacgggagccagcccacuccugagcacgugugcucagugcaugcugagcugagggucacggagcacgguuaagcuggaaggcaggaacguuccagccugcucaguuuuccucaugaggaacucgcucaaaauaaaugagagugcuuuggggugucuuauuguaggguucugccuuuaacggugccugccucgaguuagcagagguaaguaagguuuucaggggcucaugggugagcaguagccugugcuugggcucggaugcugggcauuucucuggaaacaggucgagcagaagccucucugggcggucaaugucaaaacauaccguggguguuugcagacauacugcggaugucuuaauguguagaccggggugaccuagaauuuacuugcuguguagccuagauuggucucagacucaaacacaguaacccuguccaagccucccuagggcugugacuauaggcacaaggcacaguguuuccggaagagggcaacaguucacugaguaauauagaguaaguguucugcuaacugagcagaagaauuuggaguuagagaaaauggcagaaaaccccagaaagguauauuugaagacaagaccuugaagcuuacugcucauuucaaaguuuauguguaggcuggggagagaaagggauugagggguguguguguguguguguguguguguguguguguguguguguguguguaggggugugaggcaugaucucucuauaguccaggacuugcaauccuuucucacccuccagagcgcugcaauuacuggugugugaugccugccaggcucuuccguuuacauuuugguaggauuaaaggauuaccaagcaaccucacugucaugccgguuacaguugccuauucggggauaugggccauccuuucuuccugccuugguuucuauuaagauaauaaccuaguuucagcuagucggaacuuuagcacuuuuaacuguaaucuggcauauuaaggccuagugcaaaagcuaauucaaaauacugaacuuccagaauuuguuuuuuuuucgagacaggguuucucuguguagcccuggcuguccuagaacucacucuguagaccaggccagccucaaacucagagauccaccugccucccuagugcuggugugugucaucauggaaacuuucagacuucuaaacaaucuauuacucuacuccgcccccagcucucucaccagugucuucaagcccugggccuucuggcucagcuccuucaguauuuccuucaccugagcuuaaacugaaagucuaauuacucaacaaaguagacuggccaccagcucagcagguggagaggcucacccuguuuccuggggguagggaggugggguggcacggggacacggcacaaagaguucuuucuauuguuuuguuauuacucuccauuugguuuggguuuuguucccauguagucuaggcuagccucaaauucauuuuguagcugaaggugacugaauuu

SEQ ID NO: 5848 - RNA, 16162 nt, Mus musculus
uggagucaacucuguuuaugccaacuguccaugugauacacaggagaguaaccacaaguaacuccccagagaucucugcucccccuccccccaugcaugaacacgaggcaccaggacucuacguccaugucagguaaaucaaggcuuuaauuguauuggauggcccugccgaugaccaaaggcugccuuaugaccacugggaccaccacucucauaacagagagcagggguugggugugcaggucagagccacagcaggccauggagguccuucuugugggacccuggucccagagcagugguacucacaacacccauagccagcagacuucuuuauguagaggaagucaagagcagccuguuccucaggcuauggggcagucuucaugaaagaccugugggaucaggcagggccaaacucaaacuagcagccucccuaggggagguuuuuuuucccuuccugcucccagguggggaguggcuuagauccucuuugggaagguagcugaggugaucuggggggcauuguuccaagugcacuugagguggcagcagggugugaagacaucaggagggaucguaggacuaccaucuaacuagccgcagcucaaugguuuccccguccugggguuuguagucagcaaugccugcagaaaacaacgaaguaaaggggguuagcaaggcaauaucccacccugaccacaucaugugaccaucacccugaagucacaucuaugagacccacucaggguuugguggugggagcuguccggagccagccagagagucagaacgaggcuugguaggcucccucaggucacaggcucauacagcagagagggcgaccccaguggguugacaugggacuaacggcuguauaacagggaugggaaccagggcaguaccugcuuggcagggucaacaucuucaaaauggaguugucaggcaaagggacuguuccagagggugucacaaaugagugucccagaagcaaccuuucaguucaggagaauaccuggcuucaagucccacauucucauuagagaaagauaauaaagccaggcugggucugguuaguggacgauccacugccugacaggccuaagacccuaguucauucuuagcuccagauuuauuauuuccagauuaauaauuaauaauuuauaauaacuagcaacaauuuagaggaacuagagagguuccuuaagaagccaggggacagguuccauuugcugacucauuuucgcacgccuuuaaucccagcacuugggaggcagaggcaggcagauuucugaguucgagaccagccuggucuacagagugaguuccaggacagccaggacuacacagagaaacccugucucaaaaaacaaacaaacaagaaaaaaagaagaagaaguggagucuugagggccaggaugguggggacacacuagaaaucacagaaggccgagacaugaggauugugaguucaaggccaaccuaggcuacaugcucaaaaaaauuaacuuaauuaaaaauaagcaaagaaauaaaagcaugugaauaugucacuggugacucuacauugggauuuuacauucuguaaugaucauuuuugagauauugugggccaaauaagauauaucauauaauauuaguuucaccuacuaggaaacauuuacccaccuaccucacauuuuacaucuguuggauaguguugacagaauauuauuccauuuuuaaaugaaaacaagcauuguauauauuucuuguaguuauaagaaaauguaucaaaaaugaaaaagacuugagcuucggagagauggcucucugguuagcacuggcucucuuccagaggaccuggguaccacaugguggcucacaaccaucuguaauguggucuggugcccucuucuggcaugcagguguacaugcagguagagcauucacugacaauaaauaauaaaucuaaaauaauaauaauaaaguucuuuuagaacuuaauuucuggguagugaaaugcaagcuuucauucuuuccugugucuuggacucuccacaacaacuuccauaaaaacucuaagaauuucaguuaaauauuuuggacccaacuuugagcaugugugguuuucugaugcuguagcccaggaagguucgagggaaaggcugggcuggguucaugcagccuugcugcugggucaggacucggguagcaggguauccaggacaacgggcuacagacucaccuugcagcaggggugugucaggggcucggaggagcugccaauauucucgguccccagcaucuuucccuaguacagaugucagguaggggccugacaaggaggccugggucccauaccuagaaaauagaaaacuagcugcugcucucaaggaggaggcuacuguguugauuuagacaaagagaaagacauucaucccuuuaccccuucagaagaguggaucaaggcccccggcaaauacuaaaacccagaaaugugcaagucuguccuaugaacugguggaguauucacacaagcuccugugugcgucuuccugcgugccuuacuuaugucacaacguuauuuacaauaucgaacacaaguaaacgcugugguggugguuuuuucaauauaguggcaagcaaaggucuauguguucagcccagauuaauacaauuuaguugaauucgcaauuuguaaaaaaugcagauuugguagaaauggauuguuuaggggaugucacagaacagcccuuuucauuuuuuaacgugugugugugugugugugugugugugugugugugugugugugugugcacgugcacacaugcaaguaggucagaagagggccuuggaugcccuggaucuggaguuacaggcaguguugaacccugcuaguggaggcugggaacugugcuuggguucuguaagaacaacgcaguccaccagcccuuuuuuuuuuuuuuuuuuuuuuuuuucuuaaagacagggguugucuguguagccauggcuguccugaaacuuuuucuguagacaaggcuguccuugaacucaagacaucugccugccucucccuucugaguacugggauuaaaggugugugccaccacugcucaaccaugaacaauccuuuucaaugguugucccuuuacucugaggcucuccacggcugcucugggccacuucucuccacaucugucugucugcugugaaaucuggugccucccauguagucucccugucuggcccuugaacucaucucaggcagcuccacucuaacagaacucagagcuucucagacugacacccaccucuuacagguccucaaagaccugacuaaaaagccugaaauucuaucuuuucuccauuuugauucaguauccaaacagauacugagagggggaaagagaagaggaggaggagaugaaggagaagaagggagggagggagggagggagggagggagggagggagggagggaaggacuuuacgaugaguaaauacauuagugccgccaagugacauuauggaagugacuuaggacccgccuggugcuauuucaggacugaaaguucaaggccagccugggaacagaguaagacacuugaugauuaaucuugauuaucagcuuacugggauuuugagucagcaugcaaacagauuucuggguaugucugaggaggaggauuucuagauuagcuuaacugaaggaaggaagacccaagucugggugaccccggcacauggccugggccauucgcugagcgggaaggagagcaacugucaacaguggcucccaucacugaguuuucccaacugugaccacgacaccuugucccaccucgacgaacugucucacccagaacugggagccuaaaccagcuucucucugcacuuugccuccauaaggucuuuugucacagcaauuagacaugugacuaaugcagaccuuguuugcaaaugaaaaguuaaaaucugaacgaucgauaguagagcuccugcuuagccuggcucuagauugcauccuccaccgggaggggggguauaugucacuuaaccugggaaguggggcguuuuuguuccuuaaagacaguggccuuugaucccagcacuugggaggcagaggcaggcagagcucucugagcuuuugaggccagccuggucuacagagugaguuccagggcagccagagcuacacaaagaaacccugucucugaaaaacaaacaaaaaggacagugguguuuacacagcuguguucuaagaguucuuggcccaaaugaccaaacaguccuuagguggcuuucccuggaacucuuguugggaacagaaagcagagauuucucaagauaaggcaagaauccaggggagagagcaggcugguagggauacucagcugcuucgagccagaguuaacccuggggaggcagauccaucuccaugguuggccaggggccagcaaggagcagcaacuaaguuucgccuauucucgcgcuugucaaaucucaagggacaagugucuaccuucucagaguuauuaauggcgagauguuaucaagguuauuugauacaauuaaucuuccuggcgcucucacugcauaccaagcuuuaaaccuacacaaaacaugcccagcggugagcuuaggcucccccuaguggcccugugaagaggagcaacaucucgucccucaacucacuagccugggguuguagggaguggaugaagagugaggaacuggagucccaagucugggucccuugaugacaguggugguccauagcucccagcacaggccaaacaccacaggcccaaaacacaggccagaaaggaguggagaagguagacauagaaauuaaaccagaacuucucccaagaaacuccucuguuccucacccuucccaugauaccauuucaagcacggaggccugagggaagugagagcuaggaugaggaacgggaagccucacgugaauccuccgccaucuugugccaacuucaggacaucuuccaaggaagauccagcaaagacaaaaaaugucuguucguauggugacagggcacuggcgaccuucagcgugacgcugaugacuucugagauguggacaggguccucaacagcuggcaccaacaugacuaugccaggaagaaaggaagaagcagcugucaugaggaccgggagccuggaucugaguccucccuucuuccuacagacaccuugcccgaguggccuacggccuucccucgaaauagcucagucaacagcaugaacagcugcugggcugaaacccgggucucaucucagccuccacauccuucugcagcccaggccugagcuccuugcugggucucugcuucuugccucucuccuaucugacacaccgcaccucagaggacccugucugcaucuguucaagucacguccuggucaccccugacagacacaucuucuuucucugcauuuaucuacuacaccuguucauucucccagacccacuuucucccaugaugccccuguguuacagggccccgcgccucugcuuuggccuucucugcuccuuugcccucuccucccauuuccugacaaguccuuggguaccaacauuaaccaaaugugucucuccacucauugagucauuaacucaucugugaugaucucgcuuuucaaccugauggcaucuagaaucgacuaaaaugcaagucucuggguauucaugagauggguuuucucaaucagauucuucaaaauggggacgacccucuguaaaugugggcagcaccuuccgguggcagaucaggcaaaaggacucggaagaaggaaccugcuuuuugccgcuugcccucacucucacuaucuacuuuaucugaccucuuacagcaucccuuugcugauauuaaaccaacuuccucacacuuccaauguagauagaaggcuaacagcucuucagaauccaucaggccuccugcaucgccacacugggacugcggagacauccagcuuuccagacugagacagagugagagagccacuguugaacuaucuguaccauauaguguaugccaauccaauaaaccauccuaucaaugcugcugcuuuagaggaccaugacuaauacacuccuccauucccucgcccaaacauuuccacgguggguaucacgcaguggguaccgcccagagcacuuguuuggugucugugcccacaccaugaguaucagaaggcuguggccucguuuuagcugcuguguucugugcaugcucaugucgccucagccaagcaucacugacuggucacccaucacugggacccacagagaguagcuuaucacuuaggagacagaaagggcucugcuaccccuggaugccuggcagucugggaagauaagauccaaguaggucuugugguucaggauggguagcagcugggaaaucaucagaggauuuuggaaggccccauccuguaggcugagcagcagggaugucccugccuugaugcacgcugugcccagcccuaccccggaugcaggagaugucaugagcaucugugaggaagagaaggucagagguuagccccugggaaggaaccaggcucuccagcuucuaaccagcccucccuccauugacccgcuaagcagucauggcuccagagucucucucuuaccuguagugccaguggggugcuauagauauucccaaaguagcccucaggggccugggacuucaggauuuucucucgcacugucucgauagccauggugauucguggucucagaucagaguugaaauugaaucgcuccaaacaggugagggccaagccggccauggcuucugugucuagggggauaacaucuaguaugaacuggacagcuugauaagaucagacuagguggggauucaggaucauauaccauaccaauucaggugauuugcccaggacuucccugguccuaacacuggacacaguaagccccagaaaaacgcucagaccuagacaaacuuggucacugaguggcuugagaguaacagguuauauggacagacugaagaagagggucccagaggauggauucuacagucccugcuccuaagccaggaugcacugagaccaaagagggaacuuuauuacugauuaauuaaaucauauugguuuuguaguguagaguauugaauuuaggaccucaagcauaguaguuauuugccauugggcuacaucuccagccuccuuggagaguuuggugccaacagcuacguuaucuacccucaggcauucugauuuaauugauaaagguagcugucagggccugggaguuuuuaagaucuccucuucccucuaggcaacauuaauguguccacuguguuucucuacaagacucugagacaagucuuucauugccagagguccuggugccuuuuucucucuaagcaaucaucuaccaaucaacccccuuccuacuccauccuacccacccuacaugaggccuuauucauucacagaagcccaggccuagcagagaccuugaauugugaugauuaaaaaauaggucugguggcccaaggucacauagugagaaaucagaucaaaauccagguaucagaaucccagguuauacgguaccaagugugugcuaagaccucugcuuguaaagugccuuuacugagcugcugcugggagguuguuuuaaaggaaaagccuggcgggaagaggaggaggaugaccuacagugaacacgugauggagcuguggucaggaugcaaguccaguuucaaagcuggcucacaguccccaccauuucauuucgaagggaucuggcaaggagauguuccaaugaaaggugagcagagggacaggucguacaccccuuccccuggggcuggggaaagcuagguuuuguccacucacccacagagacguggcccugguagguaaaguagucauguucaacagcauacaggagcuugcccaccacgcugucauggagccgcuucugguggacacacagugccaggaugcugaggccauacugguaauaguugguguugggguggccuucaugauugugcccugagauuagaaaggcaaggaguagagagacaggucaggguuuccgccucuucccagcaagaaacuucauagcuuucgggaccacaggcugcuggcugaggucccaauauaugccggguucuaucucugcaggucagaauagaacggugcucauaggacagcaccauuguaacagaaauguggccugaggucccuagagccaauaacagaagucuaaauagcugggaaauugagacaggauucuucauggaugucacucugcagggcacagauaaauaucuagacuuguuugagaaggucauugugccuggagcacaaagagaagcaagcaagcaaugccuagaaaguguaagagaccagccaggcugggcugaggguuagcaauggaagaaugggcggggaggggggcggcggggagggggcugcagggaggggggcugcagggaggggggcugcagggaggggggcugcaagguguaagcugaaugaagaacagguuuauacugaaaaucccugcuucagcuguugggaauuggguccaagucaggaggcuggaaaguugacagaggcuaaggaguaggcagagaggaggccguaccagugucccagagguggaaaccgcuuagucuugcuggcugggcacccaacagcuugugcaugggguaggggaaagcuugggucaagccuggcgacugaguccagcccgagcuucuagguagacccagugagggaguuagaagaggucugggaagaaacccccgaguucugauucccaccaagaaccucaucucacaagaacaauuaugaguccggagccugccucaaaacuacaaacgccgaaaccauuuaaugagcccucccggauguuccugcccccucagaugugguucuccuuaccaauggccuucuucucauccuccaagaaccacuugagcugugagaucaaccugucacccuuucggcucccgaagaauucgcaguuggcccugagagcaagcagguagagcgccaggcugcccccggaaaguuugggcuggcaacuacuguuaucaucgcuggagguggaccuaagacgaggcaagacaagagaaccuuuguaagaaggugcuccccugagaagccaggcuuggcccacacuaaggucacaaaguggaauuagcagucagcugugcugguaugaggugcaugccacagauucuucaaaagaagaaaggugagguaagucaaggguaaaacacaaaggugccuacauccacaucauacaguuugacccccguuugcccaugaacucucuccuuuauuuucucucccuucccugaauucuugagaaggaauggaauggggaagauauuucagauauuucauguuuuuuuucuuuguguguguguguguaugugcauguauuuguuuuguuuuuguuuuucaagacaggauuuaucuguguagcccuagauguccuggaacucgaucugcaaaccaggcuggccucaaacucaaagagauccaccugccuccaccucccaagagcuggcauuaaagguguauaccacuaugccuagugauugauggcuuuuucuuauucuucgccucucacucaaaccccagagcaggccucucuuuaauggcuacucuuuggagaaggaacacagaaauaugcugcuucuagacugcaugaaagaacaugguugugaauuagcagugucugucuguaguacaagaguaaacuacagaguuagauacugcuucuuuguaucaauauacaaucauauguuugguuaugaauuaguaaugucugucuuagguaccaguggggagcacagaaagaguuaggugcugcuucagggaucagggacaccauuucaggacaaagggcauguguuagcaucucugaucuaguaccacuuaccccugcacucugcagauggagaaaggcucagagaagacaaaauaugccuagaguuugucaaaaagccacaaaauaccccaauuagaauccagccugcuaggagcuggagagauggcuuaguggugaagagcacugacugcucuuaaagagguccugaguucaaaucccaguaacuacauccacaugguggcucacaaccaucuguaaugagauccaauacccucuccuggugugucugaagacagcuacagaguacuuauaagaaaggaaggaaggaaggaagaaaggaagaaagacaucuuuaaaaaaaaaaaagaauccaauuuccuaucucuuauaacuuggaucaagucacuggggaagacaagagacuagcaauaccgcaggaggcacugcugguaauggaucuugaggcugugaagguagagguccucuuuggucccagccugcaugcuggaaagucgcaggccaacgaagacgcugggguucaacugcucugaggaaagccgauccauccaagguaaaagacguugacccaacuucucuaccagcuggcugucuauccgugguauuacugaggaaagaaaauggugugagagaggccacagagccaugccacuagcaagcaacuauugugaccuccuuacuaggcaaaaccuucaccaggaacagggguuucuauacccauuaccacacagcccacagcccgccaggagaaaugcccucuauggugaaaggugguagguaaaaagaaaagcgggcaucuccuaagaggaauuagacugggccaaggagagaugaugggcugagaucaaaggaugcuguuaccaugcaaccaccccaccuaucaggugugacuggagaccaagcccagcaguaauggaccaggcaccugucucuuuugacccuccaaccagcccugugguguagauagauauuuuuauuguuguuuugcauagaaaaggaaauagaaguucaaagucaagcugugccuuauaggaugcuggggagccaagacugugucacacugacaccccuccccuugcuauagucacucuccugaguguauccugcucauuguucaaagccccagcccucaugcaaugaguguuccacauugaaguucacaugcuguaggcugccaacugguucucccagcugcccuaggaaauuccuccacaugaaccuuaaaagaccacuuuuucugccaucccuaguuaauagggucugacccugggagaucagcuacuagcacccugucaggacuugggauuuaccugcaauauguaagcaacacacugagaugcccuggaagcagaaaucucagggaugcucaccgauuccaguugauggcugacuuccuuccuugggaaggggccaugcucagauuggaggcacuguggacucucugccccauuuacugacucugucgccacccacuccugcuguccaacggaccuauauuccagcaugccgaacggucugccguagggcccucugccuacuuucuugggcuuccuaacaugagauccagaaucccuugaucauagccacaucucucuaaauguuuuacagaccucauagguaucuauggauguaaggggccauucccaaguacgaacucuaaaugacuguuggcucuauggggcuggccagggcaccuggcuggcuucucaugaaauguucauucugacagucaggcacaagcugaacaugguggcacaagccugcaaucucagcaccugaggggcuaaggccuggaaugcaucauagugaaacccugauggaacccuguaggaacagggaagacuuacucuugggauaucugucuauaucuuuccagaguucugucaguaucuucgagguccucuacuguggcucucuaucuuucugacugucccaggaggacauuuuacuguuuaugcaaggucuccuguauuguaggcuggccucaaacucaauauguccuugaggaugaccuuagaauuccuggucuuccugccucuacuccccacauguugggguuccggguguaugccaccacaccuggauuguacaaugcuggagacucaaaccagggcuuuguucaugguaggcaggcaccugagcucuaucucagcaacagagcucugcucuucugcucuucuuuggaauuagugagggagcccagagaccccacccccggcucugaccuccaucccgaguaagagauaagguaaggcacagccuauaggaggcagauaaccacaauuuacccucucuagaaggaaggagccaggcagauucacucaaacuagucaaaguggcuucaggcaaugcugcuaggauggcuaaucuuccuugucaacuugacugcaucuggaaucaaccaacccccaagcugccagguacuucugugaguuuucuuaaugagauuacaauuggaaguugagagacacacucuaaaucuggcccaaacuuuuggauggcagcccagauaagguaaaggaggagacguugccuuugccugcuugcccucacccucaguggcaaguucaucuacccuguugcuguggcugguauuaaagucucccuucuucgugguuccaacauacauggaagaccaucagcuccccaggacucccccaggacuccagcaccagacugaaucugcagagauaaccagccccacagacugaauaacuaugggauucucagccuuuuuccaucaagagacagccauugcugggcuaccaugaucacauccuguaagccaguguuucaaaacacacacuccuugguucugcugcacugcuagaacagugggucucaaacugugggccgagagccccuuggcaaaccucucucuccaaaaauauuuacauuacgauucguaacaguagcaaaguuacaguuaggaagcugcaacaaaaguauuuugaugguugggggucaccacgacaugaggaacuguguuaaaggguugcaccauuaggaaggcugugagccacugcauuucaguacccugacuuacacagcccuaucucacacacacacacacacacacacacacacacacacacucgugcacuaaggcauccugugcacaggguugucuagcccucucacugacugacugacaggcauucagaagccuggaguccucucuguguacuuuagagaucagaccuauucauuucauugcacacagagccuuggcugaugacgcaagugugguguccucacaccacgccaaggaggaaggaaggaggaacagucucggcucacuucacaaaagucacagcauuggggaagggacccaaugggaacuuugggacccaagcccccaaaguucucaugauggugaagggaggaacucuccuguggucaggcauuggggcuaacagcucaaggcugaggugggaaucccugaggacuguccagacagcaaccagggacccaaggauaaggagcuuuaacaggacauggccagagagucuaggcaccuauggaaggugcuagccucaggucccaagaacuggauccaguacaguucuguuaucuugagcuggggcaucaucucucugauccgugcuuaagguuugcccgaguucaccugagaccagauaaucaggguacccgggaggaaggggagagaugagacaccccugcuuucugccugauccccggguaugacugugccugaaccuauaaccuaaaggucacaaucacguuuugagaggucccuagaaucuauaagaggucucuggaggacuauagcccugggaugacuaucuggagcagucagggagaaccuucaaguaccuggaauguuugccgccgccccccccccccauccauucccucugggacuucuucccaaagccuucuaguccuucuagucuuuggacauccuuucccauccuucucuuugauucgacggacccccguggcuuucuauuguugccucagggugacuuguuuugcaucacucacgguaacccaauuuggcaccccuuuugccccuuucauagagcauaaacccuaggagagcugggacaagucuuguguacuccugacccuuucuccaaacuaaacaccgggccuauuaaccuaucucagagaggccccaugugcaccgaguaaaugaacaaacugcuggaugaacuggggagacccugucggggacagggggcacguguccauucagcaugcccaagcacuaagguccuguuaaaaacugcugugggagaccugaggggcagguaaguuucuccaucccccacuuccaguuuccaauuuccccaauggacaaggacagcccccccccacacacacacauauauccccgcuccccugcccuucuccccccaccccaggguccagacacggguugguuacuuaccacagaauucagcaagagccccaaagacuccagaaaggagcagcagcgccuucaggagcuccauggcaggcacaggugggaggugggagacuccugggucucaccuugagggcuugucugacugcaacuguugucuugcuuaggaagaggcagcuucacugauuaauuguccuuccaacagccggaagcacgcugcuaaaucagcagagagaaagggggaaaggucuguuauggggcaggaggccaaagaacagaggaaggaaggaagggcagagcugcuuguccuccagaugagaacaaaaagggacuccguggggcaacucaaagcuaaccuuaucugucccgaacgcuuuaaagaccccggaagcagcacagaaagccuggugccuaaucugucccaagucuaucugacagugcucgccgggguccgcccugccccggcuugcacacccgccccgcgcccucccccccccccgccccccgcacaucccagcccccugcccacacacacacaccccaccccugccugcacacccgcaccguugcugcucuggcugcagacauucaggacuagaguaccuaccgggugcacuucacaggagucccuggaaaguacuuacuuugacucucggggucagagcugggaaacuguggugaucacgugacggagcucucuggcgucagcuguucugccaaggaggcggggcagcugcuggacccggcccagacaaacaagucucaaucaaccagacacagccuggguuuccuugaggcgacagcgaaaguugaagaacaagugaaucuagcaaguugcaaaaccuuugggagcagggcugcagggcuacuugcccugaacuaggaacgucgcuuaaagacaucuuggcagaaaaaaaacauugcuuaucugcccagccccacuggagacucgaaggaugaaucuagcagcgaugggugaccucucugaguuucaaguuauucucucucucucucucucucucucucucgagagagagagagagagagagagagagagagagagagaggguuaaacaauauuauccuagcagcaauuucccaguuccacuugugaagauguugagaccguaacaugccucuagucaucuucaaaugagauguuuguuacaacuauuuuuauagcaaacugucaaaggucacacuuucaagagaaucuauuuuugugccaggguaauuaucacaagcuaagacccaacacagauauauauggaccuggauagcaguuauuaauuagcaguaauuaacguaaugcauguguuguugcuggccuaggucauguugucagagaaacugaaaaagacaaaggacucuaucauaaugcgggggucacauguggggugcacaccucuagccccagccacucaggagacugaaguaggacugacuggcagccagcuugaguaaccaugagacccuaucucuuuaaaaggaggaagagaagcuggaagaagaggcgguggggagccaaguauggcucuuggugcacaccuauaucuagaaugugggagacugaggcaggagaaucauuccaaguuccaagccaggcugggcuacugagaccucaucucaaaacucagggagacauaagauggggagaaggaagaaagaagugaaggaaggagagaggcagggaagggagaagcaguaauuagcucggaguaaggcgggaaguccgcaugcacgugcauuuugcagggagaagaggcuccaguguugugggugcucaccagagaagacugcucgaaugugaguuugagccaauagaaguccuuauucgccggcacugacuacacugg

SEQ ID NO: 5849 - RNA, 16162 nt, Mus musculus
ccaguguagucagugccggcgaauaaggacuucuauuggcucaaacucacauucgagcagucuucucuggugagcacccacaacacuggagccucuucucccugcaaaaugcacgugcaugcggacuucccgccuuacuccgagcuaauuacugcuucucccuucccugccucucuccuuccuucacuucuuucuuccuucuccccaucuuaugucucccugaguuuugagaugaggucucaguagcccagccuggcuuggaacuuggaaugauucuccugccucagucucccacauucuagauauaggugugcaccaagagccauacuuggcuccccaccgccucuucuuccagcuucucuuccuccuuuuaaagagauagggucucaugguuacucaagcuggcugccagucaguccuacuucagucuccugaguggcuggggcuagaggugugcaccccacaugugacccccgcauuaugauagaguccuuugucuuuuucaguuucucugacaacaugaccuaggccagcaacaacacaugcauuacguuaauuacugcuaauuaauaacugcuauccagguccauauauaucuguguugggucuuagcuugugauaauuacccuggcacaaaaauagauucucuugaaagugugaccuuugacaguuugcuauaaaaauaguuguaacaaacaucucauuugaagaugacuagaggcauguuacggucucaacaucuucacaaguggaacugggaaauugcugcuaggauaauauuguuuaacccucucucucucucucucucucucucucucucucucucucgagagagagagagagagagagagagagaauaacuugaaacucagagaggucacccaucgcugcuagauucauccuucgagucuccaguggggcugggcagauaagcaauguuuuuuuucugccaagaugucuuuaagcgacguuccuaguucagggcaaguagcccugcagcccugcucccaaagguuuugcaacuugcuagauucacuuguucuucaacuuucgcugucgccucaaggaaacccaggcugugucugguugauugagacuuguuugucugggccggguccagcagcugccccgccuccuuggcagaacagcugacgccagagagcuccgucacgugaucaccacaguuucccagcucugaccccgagagucaaaguaaguacuuuccagggacuccugugaagugcacccgguagguacucuaguccugaaugucugcagccagagcagcaacggugcgggugugcaggcagggguggggugugugugugugggcagggggcugggaugugcggggggcgggggggggggagggcgcggggcgggugugcaagccggggcagggcggaccccggcgagcacugucagauagacuugggacagauuaggcaccaggcuuucugugcugcuuccggggucuuuaaagcguucgggacagauaagguuagcuuugaguugccccacggagucccuuuuuguucucaucuggaggacaagcagcucugcccuuccuuccuuccucuguucuuuggccuccugccccauaacagaccuuucccccuuucucucugcugauuuagcagcgugcuuccggcuguuggaaggacaauuaaucagugaagcugccucuuccuaagcaagacaacaguugcagucagacaagcccucaaggugagacccaggagucucccaccucccaccugugccugccauggagcuccugaaggcgcugcugcuccuuucuggagucuuuggggcucuugcugaauucugugguaaguaaccaacccgugucuggacccugggguggggggagaagggcaggggagcggggauauaugugugugugugggggggggcuguccuuguccauuggggaaauuggaaacuggaagugggggauggagaaacuuaccugccccucaggucucccacagcaguuuuuaacaggaccuuagugcuugggcaugcugaauggacacgugcccccuguccccgacagggucuccccaguucauccagcaguuuguucauuuacucggugcacauggggccucucugagauagguuaauaggcccgguguuuaguuuggagaaagggucaggaguacacaagacuugucccagcucuccuaggguuuaugcucuaugaaaggggcaaaaggggugccaaauuggguuaccgugagugaugcaaaacaagucacccugaggcaacaauagaaagccacggggguccgucgaaucaaagagaaggaugggaaaggauguccaaagacuagaaggacuagaaggcuuugggaagaagucccagagggaauggauggggggggggggcggcggcaaacauuccagguacuugaagguucucccugacugcuccagauagucaucccagggcuauaguccuccagagaccucuuauagauucuagggaccucucaaaacgugauugugaccuuuagguuauagguucaggcacagucauacccggggaucaggcagaaagcaggggugucucaucucuccccuuccucccggguacccugauuaucuggucucaggugaacucgggcaaaccuuaagcacggaucagagagaugaugccccagcucaagauaacagaacuguacuggauccaguucuugggaccugaggcuagcaccuuccauaggugccuagacucucuggccauguccuguuaaagcuccuuauccuugggucccugguugcugucuggacaguccucagggauucccaccucagccuugagcuguuagccccaaugccugaccacaggagaguuccucccuucaccaucaugagaacuuugggggcuugggucccaaaguucccauugggucccuuccccaaugcugugacuuuugugaagugagccgagacuguuccuccuuccuuccuccuuggcguggugugaggacaccacacuugcgucaucagccaaggcucugugugcaaugaaaugaauaggucugaucucuaaaguacacagagaggacuccaggcuucugaaugccugucagucagucagugagagggcuagacaacccugugcacaggaugccuuagugcacgagugugugugugugugugugugugugugugugugugugagauagggcuguguaagucaggguacugaaaugcaguggcucacagccuuccuaauggugcaacccuuuaacacaguuccucaugucguggugacccccaaccaucaaaauacuuuuguugcagcuuccuaacuguaacuuugcuacuguuacgaaucguaauguaaauauuuuuggagagagagguuugccaaggggcucucggcccacaguuugagacccacuguucuagcagugcagcagaaccaaggaguguguguuuugaaacacuggcuuacaggaugugaucaugguagcccagcaauggcugucucuugauggaaaaaggcugagaaucccauaguuauucagucuguggggcugguuaucucugcagauucagucuggugcuggaguccugggggaguccuggggagcugauggucuuccauguauguuggaaccacgaagaagggagacuuuaauaccagccacagcaacaggguagaugaacuugccacugagggugagggcaagcaggcaaaggcaacgucuccuccuuuaccuuaucugggcugccauccaaaaguuugggccagauuuagagugugucucucaacuuccaauuguaaucucauuaagaaaacucacagaaguaccuggcagcuuggggguugguugauuccagaugcagucaaguugacaaggaagauuagccauccuagcagcauugccugaagccacuuugacuaguuugagugaaucugccuggcuccuuccuucuagagaggguaaauugugguuaucugccuccuauaggcugugccuuaccuuaucucuuacucgggauggaggucagagccggggguggggucucugggcucccucacuaauuccaaagaagagcagaagagcagagcucuguugcugagauagagcucaggugccugccuaccaugaacaaagcccugguuugagucuccagcauuguacaauccaggugugguggcauacacccggaaccccaacauguggggaguagaggcaggaagaccaggaauucuaaggucauccucaaggacauauugaguuugaggccagccuacaauacaggagaccuugcauaaacaguaaaauguccuccugggacagucagaaagauagagagccacaguagaggaccucgaagauacugacagaacucuggaaagauauagacagauaucccaagaguaagucuucccuguuccuacaggguuccaucaggguuucacuaugaugcauuccaggccuuagccccucaggugcugagauugcaggcuugugccaccauguucagcuugugccugacugucagaaugaacauuucaugagaagccagccaggugcccuggccagccccauagagccaacagucauuuagaguucguacuugggaauggccccuuacauccauagauaccuaugaggucuguaaaacauuuagagagauguggcuaugaucaagggauucuggaucucauguuaggaagcccaagaaaguaggcagagggcccuacggcagaccguucggcaugcuggaauauagguccguuggacagcaggaguggguggcgacagagucaguaaauggggcagagaguccacagugccuccaaucugagcauggccccuucccaaggaaggaagucagccaucaacuggaaucggugagcaucccugagauuucugcuuccagggcaucucaguguguugcuuacauauugcagguaaaucccaaguccugacagggugcuaguagcugaucucccagggucagacccuauuaacuagggauggcagaaaaaguggucuuuuaagguucauguggaggaauuuccuagggcagcugggagaaccaguuggcagccuacagcaugugaacuucaauguggaacacucauugcaugagggcuggggcuuugaacaaugagcaggauacacucaggagagugacuauagcaaggggaggggugucagugugacacagucuuggcuccccagcauccuauaaggcacagcuugacuuugaacuucuauuuccuuuucuaugcaaaacaacaauaaaaauaucuaucuacaccacagggcugguuggagggucaaaagagacaggugccugguccauuacugcugggcuuggucuccagucacaccugauagguggggugguugcaugguaacagcauccuuugaucucagcccaucaucucuccuuggcccagucuaauuccucuuaggagaugcccgcuuuucuuuuuaccuaccaccuuucaccauagagggcauuucuccuggcgggcugugggcugugugguaauggguauagaaaccccuguuccuggugaagguuuugccuaguaaggaggucacaauaguugcuugcuaguggcauggcucuguggccucucucacaccauuuucuuuccucaguaauaccacggauagacagccagcugguagagaaguugggucaacgucuuuuaccuuggauggaucggcuuuccucagagcaguugaaccccagcgucuucguuggccugcgacuuuccagcaugcaggcugggaccaaagaggaccucuaccuucacagccucaagauccauuaccagcagugccuccugcgguauugcuagucucuugucuuccccagugacuugauccaaguuauaagagauaggaaauuggauucuuuuuuuuuuuuaaagaugucuuucuuccuuucuuccuuccuuccuuccuuucuuauaaguacucuguagcugucuucagacacaccaggagaggguauuggaucucauuacagaugguugugagccaccauguggauguaguuacugggauuugaacucaggaccucuuuaagagcagucagugcucuucaccacuaagccaucucuccagcuccuagcaggcuggauucuaauugggguauuuuguggcuuuuugacaaacucuaggcauauuuugucuucucugagccuuucuccaucugcagagugcagggguaagugguacuagaucagagaugcuaacacaugcccuuuguccugaaauggugucccugaucccugaagcagcaccuaacucuuucugugcuccccacugguaccuaagacagacauuacuaauucauaaccaaacauaugauuguauauugauacaaagaagcaguaucuaacucuguaguuuacucuuguacuacagacagacacugcuaauucacaaccauguucuuucaugcagucuagaagcagcauauuucuguguuccuucuccaaagaguagccauuaaagagaggccugcucugggguuugagugagaggcgaagaauaagaaaaagccaucaaucacuaggcauagugguauacaccuuuaaugccagcucuugggagguggaggcagguggaucucuuugaguuugaggccagccugguuugcagaucgaguuccaggacaucuagggcuacacagauaaauccugucuugaaaaacaaaaacaaaacaaauacaugcacauacacacacacacacaaagaaaaaaaacaugaaauaucugaaauaucuuccccauuccauuccuucucaagaauucagggaagggagagaaaauaaaggagagaguucaugggcaaacgggggucaaacuguaugauguggauguaggcaccuuuguguuuuacccuugacuuaccucaccuuucuucuuuugaagaaucuguggcaugcaccucauaccagcacagcugacugcuaauuccacuuugugaccuuagugugggccaagccuggcuucucaggggagcaccuucuuacaaagguucucuugucuugccucgucuuagguccaccuccagcgaugauaacaguaguugccagcccaaacuuuccgggggcagccuggcgcucuaccugcuugcucucagggccaacugcgaauucuucgggagccgaaagggugacagguugaucucacagcucaagugguucuuggaggaugagaagaaggccauugguaaggagaaccacaucugagggggcaggaacauccgggagggcucauuaaaugguuucggcguuuguaguuuugaggcaggcuccggacucauaauuguucuugugagaugagguucuuggugggaaucagaacucggggguuucuucccagaccucuucuaacucccucacugggucuaccuagaagcucgggcuggacucagucgccaggcuugacccaagcuuuccccuaccccaugcacaagcuguugggugcccagccagcaagacuaagcgguuuccaccucugggacacugguacggccuccucucugccuacuccuuagccucugucaacuuuccagccuccugacuuggacccaauucccaacagcugaagcagggauuuucaguauaaaccuguucuucauucagcuuacaccuugcagccccccucccugcagccccccucccugcagccccccucccugcagcccccuccccgccgccccccuccccgcccauucuuccauugcuaacccucagcccagccuggcuggucucuuacacuuucuaggcauugcuugcuugcuucucuuugugcuccaggcacaaugaccuucucaaacaagucuagauauuuaucugugcccugcagagugacauccaugaagaauccugucucaauuucccagcuauuuagacuucuguuauuggcucuagggaccucaggccacauuucuguuacaauggugcuguccuaugagcaccguucuauucugaccugcagagauagaacccggcauauauugggaccucagccagcagccuguggucccgaaagcuaugaaguuucuugcugggaagaggcggaaacccugaccugucucucuacuccuugccuuucuaaucucagggcacaaucaugaaggccaccccaacaccaacuauuaccaguauggccucagcauccuggcacuguguguccaccagaagcggcuccaugacagcguggugggcaagcuccuguaugcuguugaacaugacuacuuuaccuaccagggccacgucucugugggugaguggacaaaaccuagcuuuccccagccccaggggaagggguguacgaccugucccucugcucaccuuucauuggaacaucuccuugccagaucccuucgaaaugaaaugguggggacugugagccagcuuugaaacuggacuugcauccugaccacagcuccaucacguguucacuguaggucauccuccuccucuucccgccaggcuuuuccuuuaaaacaaccucccagcagcagcucaguaaaggcacuuuacaagcagaggucuuagcacacacuugguaccguauaaccugggauucugauaccuggauuuugaucugauuucucacuaugugaccuugggccaccagaccuauuuuuuaaucaucacaauucaaggucucugcuaggccugggcuucugugaaugaauaaggccucauguaggguggguaggauggaguaggaaggggguugauugguagaugauugcuuagagagaaaaaggcaccaggaccucuggcaaugaaagacuugucucagagucuuguagagaaacacaguggacacauuaauguugccuagagggaagaggagaucuuaaaaacucccaggcccugacagcuaccuuuaucaauuaaaucagaaugccugaggguagauaacguagcuguuggcaccaaacucuccaaggaggcuggagauguagcccaauggcaaauaacuacuaugcuugagguccuaaauucaauacucuacacuacaaaaccaauaugauuuaauuaaucaguaauaaaguucccucuuuggucucagugcauccuggcuuaggagcagggacuguagaauccauccucugggacccucuucuucagucuguccauauaaccuguuacucucaagccacucagugaccaaguuugucuaggucugagcguuuuucuggggcuuacuguguccaguguuaggaccagggaaguccugggcaaaucaccugaauugguaugguauaugauccugaauccccaccuagucugaucuuaucaagcuguccaguucauacuagauguuaucccccuagacacagaagccauggccggcuuggcccucaccuguuuggagcgauucaauuucaacucugaucugagaccacgaaucaccauggcuaucgagacagugcgagagaaaauccugaagucccaggccccugagggcuacuuugggaauaucuauagcaccccacuggcacuacagguaagagagagacucuggagccaugacugcuuagcgggucaauggagggagggcugguuagaagcuggagagccugguuccuucccaggggcuaaccucugaccuucucuuccucacagaugcucaugacaucuccugcauccgggguagggcugggcacagcgugcaucaaggcagggacaucccugcugcucagccuacaggauggggccuuccaaaauccucugaugauuucccagcugcuacccauccugaaccacaagaccuacuuggaucuuaucuucccagacugccaggcauccagggguagcagagcccuuucugucuccuaagugauaagcuacucucugugggucccagugaugggugaccagucagugaugcuuggcugaggcgacaugagcaugcacagaacacagcagcuaaaacgaggccacagccuucugauacucauggugugggcacagacaccaaacaagugcucugggcgguacccacugcgugauacccaccguggaaauguuugggcgagggaauggaggaguguauuagucaugguccucuaaagcagcagcauugauaggaugguuuauuggauuggcauacacuauaugguacagauaguucaacaguggcucucucacucugucucagucuggaaagcuggaugucuccgcagucccaguguggcgaugcaggaggccugauggauucugaagagcuguuagccuucuaucuacauuggaagugugaggaaguugguuuaauaucagcaaagggaugcuguaagaggucagauaaaguagauagugagagugagggcaagcggcaaaaagcagguuccuucuuccgaguccuuuugccugaucugccaccggaaggugcugcccacauuuacagagggucguccccauuuugaagaaucugauugagaaaacccaucucaugaauacccagagacuugcauuuuagucgauucuagaugccaucagguugaaaagcgagaucaucacagaugaguuaaugacucaaugaguggagagacacauuugguuaauguugguacccaaggacuugucaggaaaugggaggagagggcaaaggagcagagaaggccaaagcagaggcgcggggcccuguaacacaggggcaucaugggagaaagugggucugggagaaugaacagguguaguagauaaaugcagagaaagaagaugugucugucaggggugaccaggacgugacuugaacagaugcagacaggguccucugaggugcggugugucagauaggagagaggcaagaagcagagacccagcaaggagcucaggccugggcugcagaaggauguggaggcugagaugagacccggguuucagcccagcagcuguucaugcuguugacugagcuauuucgagggaaggccguaggccacucgggcaaggugucuguaggaagaagggaggacucagauccaggcucccgguccucaugacagcugcuucuuccuuucuuccuggcauagucauguuggugccagcuguugaggacccuguccacaucucagaagucaucagcgucacgcugaaggucgccagugcccugucaccauacgaacagacauuuuuugucuuugcuggaucuuccuuggaagauguccugaaguuggcacaagauggcggaggauucacgugaggcuucccguuccucauccuagcucucacuucccucaggccuccgugcuugaaaugguaucaugggaagggugaggaacagaggaguuucuugggagaaguucugguuuaauuucuaugucuaccuucuccacuccuuucuggccuguguuuugggccugugguguuuggccugugcugggagcuauggaccaccacugucaucaagggacccagacuugggacuccaguuccucacucuucauccacucccuacaaccccaggcuagugaguugagggacgagauguugcuccucuucacagggccacuagggggagccuaagcucaccgcugggcauguuuuguguagguuuaaagcuugguaugcagugagagcgccaggaagauuaauuguaucaaauaaccuugauaacaucucgccauuaauaacucugagaagguagacacuugucccuugagauuugacaagcgcgagaauaggcgaaacuuaguugcugcuccuugcuggccccuggccaaccauggagauggaucugccuccccaggguuaacucuggcucgaagcagcugaguaucccuaccagccugcucucuccccuggauucuugccuuaucuugagaaaucucugcuuucuguucccaacaagaguuccagggaaagccaccuaaggacuguuuggucauuugggccaagaacucuuagaacacagcuguguaaacaccacuguccuuuuuguuuguuuuucagagacaggguuucuuuguguagcucuggcugcccuggaacucacucuguagaccaggcuggccucaaaagcucagagagcucugccugccucugccucccaagugcugggaucaaaggccacugucuuuaaggaacaaaaacgccccacuucccagguuaagugacauauacccccccucccgguggaggaugcaaucuagagccaggcuaagcaggagcucuacuaucgaucguucagauuuuaacuuuucauuugcaaacaaggucugcauuagucacaugucuaauugcugugacaaaagaccuuauggaggcaaagugcagagagaagcugguuuaggcucccaguucugggugagacaguucgucgaggugggacaaggugucguggucacaguugggaaaacucagugaugggagccacuguugacaguugcucuccuucccgcucagcgaauggcccaggccaugugccggggucacccagacuugggucuuccuuccuucaguuaagcuaaucuagaaauccuccuccucagacauacccagaaaucuguuugcaugcugacucaaaaucccaguaagcugauaaucaagauuaaucaucaagugucuuacucuguucccaggcuggccuugaacuuucaguccugaaauagcaccaggcggguccuaagucacuuccauaaugucacuuggcggcacuaauguauuuacucaucguaaaguccuucccucccucccucccucccucccucccucccucccucccucccuucuucuccuucaucuccuccuccucuucucuuucccccucucaguaucuguuuggauacugaaucaaaauggagaaaagauagaauuucaggcuuuuuagucaggucuuugaggaccuguaagaggugggugucagucugagaagcucugaguucuguuagaguggagcugccugagaugaguucaagggccagacagggagacuacaugggaggcaccagauuucacagcagacagacagauguggagagaaguggcccagagcagccguggagagccucagaguaaagggacaaccauugaaaaggauuguucaugguugagcagugguggcacacaccuuuaaucccaguacucagaagggagaggcaggcagaugucuugaguucaaggacagccuugucuacagaaaaaguuucaggacagccauggcuacacagacaaccccugucuuuaagaaaaaaaaaaaaaaaaaaaaaaaaaagggcugguggacugcguuguucuuacagaacccaagcacaguucccagccuccacuagcaggguucaacacugccuguaacuccagauccagggcauccaaggcccucuucugaccuacuugcaugugugcacgugcacacacacacacacacacacacacacacacacacacacacacacacguuaaaaaaugaaaagggcuguucugugacauccccuaaacaauccauuucuaccaaaucugcauuuuuuacaaauugcgaauucaacuaaauuguauuaaucugggcugaacacauagaccuuugcuugccacuauauugaaaaaaccaccaccacagcguuuacuuguguucgauauuguaaauaacguugugacauaaguaaggcacgcaggaagacgcacacaggagcuugugugaauacuccaccaguucauaggacagacuugcacauuucuggguuuuaguauuugccgggggccuugauccacucuucugaagggguaaagggaugaaugucuuucucuuugucuaaaucaacacaguagccuccuccuugagagcagcagcuaguuuucuauuuucuagguaugggacccaggccuccuugucaggccccuaccugacaucuguacuagggaaagaugcuggggaccgagaauauuggcagcuccuccgagccccugacacaccccugcugcaaggugagucuguagcccguuguccuggauacccugcuacccgaguccugacccagcagcaaggcugcaugaacccagcccagccuuucccucgaaccuuccugggcuacagcaucagaaaaccacacaugcucaaaguuggguccaaaauauuuaacugaaauucuuagaguuuuuauggaaguuguuguggagaguccaagacacaggaaagaaugaaagcuugcauuucacuacccagaaauuaaguucuaaaagaacuuuauuauuauuauuuuagauuuauuauuuauugucagugaaugcucuaccugcauguacaccugcaugccagaagagggcaccagaccacauuacagaugguugugagccaccaugugguacccagguccucuggaagagagccagugcuaaccagagagccaucucuccgaagcucaagucuuuuucauuuuugauacauuuucuuauaacuacaagaaauauauacaaugcuuguuuucauuuaaaaauggaauaauauucugucaacacuauccaacagauguaaaaugugagguagguggguaaauguuuccuaguaggugaaacuaauauuauaugauauaucuuauuuggcccacaauaucucaaaaaugaucauuacagaauguaaaaucccaauguagagucaccagugacauauucacaugcuuuuauuucuuugcuuauuuuuaauuaaguuaauuuuuuugagcauguagccuagguuggccuugaacucacaauccucaugucucggccuucugugauuucuaguguguccccaccauccuggcccucaagacuccacuucuucuucuuuuuuucuuguuuguuuguuuuuugagacaggguuucucuguguaguccuggcuguccuggaacucacucuguagaccaggcuggucucgaacucagaaaucugccugccucugccucccaagugcugggauuaaaggcgugcgaaaaugagucagcaaauggaaccuguccccuggcuucuuaaggaaccucucuaguuccucuaaauuguugcuaguuauuauaaauuauuaauuauuaaucuggaaauaauaaaucuggagcuaagaaugaacuagggucuuaggccugucaggcaguggaucguccacuaaccagacccagccuggcuuuauuaucuuucucuaaugagaaugugggacuugaagccagguauucuccugaacugaaagguugcuucugggacacucauuugugacacccucuggaacagucccuuugccugacaacuccauuuugaagauguugacccugccaagcagguacugcccugguucccaucccuguuauacagccguuagucccaugucaacccacuggggucgcccucucugcuguaugagccugugaccugagggagccuaccaagccucguucugacucucuggcuggcuccggacagcucccaccaccaaacccugagugggucucauagaugugacuucagggugauggucacaugauguggucagggugggauauugccuugcuaacccccuuuacuucguuguuuucugcaggcauugcugacuacaaaccccaggacggggaaaccauugagcugcggcuaguuagaugguaguccuacgaucccuccugaugucuucacacccugcugccaccucaagugcacuuggaacaaugccccccagaucaccucagcuaccuucccaaagaggaucuaagccacuccccaccugggagcaggaagggaaaaaaaaccuccccuagggaggcugcuaguuugaguuuggcccugccugaucccacaggucuuucaugaagacugccccauagccugaggaacaggcugcucuugacuuccucuacauaaagaagucugcuggcuauggguguugugaguaccacugcucugggaccagggucccacaagaaggaccuccauggccugcuguggcucugaccugcacacccaaccccugcucucuguuaugagagugguggucccaguggucauaaggcagccuuuggucaucggcagggccauccaauacaauuaaagccuugauuuaccugacauggacguagaguccuggugccucguguucaugcauggggggagggggagcagagaucucuggggaguuacuugugguuacucuccuguguaucacauggacaguuggcauaaacagaguugacucca

SEQ ID NO: 5850 - RNA, 945 nt, Mus musculus
uggagucgaggagauguguauucaggggauucuaggaaggguuggcaugggaggaagaggagugacggaggaacggguaaauaguuuugaaaagauaugggauguucaguuaaacuuuauugucagguaaugaauacauuuuaaggaccauccaauaucacucaaaaagagucuuucaaagucugaaagcuuucucuuucccaucuuucuucucuucuuuugugauuucaguuacuuuccccuaccgugccugcucagaaagcgggaggaacucucacccuguuugggauaucacacaggaaacuagaggucacaaggugaagaggacaccuuggcccugguccaauucuaccaaccacuggcugaagaaaaugaggccaaugcucuuggaagcucaguuucugucauggcucgacacaagcuagaauuaucagagaggaaggagccucaguucagaaaaugccuccauaagaucuggcuguaaggcauuuucuuaauuagugaucacuggggaauccccaauucauugugggugguggcagcccuggucuggugccacuaggcugagcaagccaugaggagcacaccaguaagcagcgugccuccacggcuucugcauuagcuccugccuccaggauccugccuuaugugaacccuggcccugucugccuugucccaggucuccaggggcauggaaagcaucaggugaucauucucguaucugugugagcagaggacaggucaccggacaaggggcacaagcccuuccagcccucugggaggcuuuugauggugaccuguuauguaaaacugagagaaauaaaucuuuuccuuccaaguuguuuuuagucaugguguuucaucacagcaauggaaacccuaagacagucccuauauauaagauggucacaagagccuguguccugaaguguaggcacaggucug

SEQ ID NO: 5851 - RNA, 4655 nt, Mus musculus
ccguguagaugcugggacuggaacuccggcccucuggaagagcuguaagcgcucuuaaccacugagccaucucuccauucucacccauuuugcuuuacagacguggucguugggaccgggguggggaguggggggaggggcgguguguguguguguguguguguaaguggcuuacaucuacuaggcggcccaaguaggauuugucucuaggggccauagcauugccccucugaaaucccagaggauucagagugcuuuugccccuuguaauaacucccuagcucccuuuuccauuuuaacaguugcaugagucaggagaguggcuguccucuuugugucucuauuucccuacuguaaaguaggacccuacgcuagugccagagcuuaaggaagcaaacuugagucuacuggacacaugaugacuguuauaauuaauuaguccuugcgacugucuaaggcagugaauguuggcacgccucccauuuacacacgaaccgcggcucagagaaauacaccuuuccuagaagccgcacaccuaagaagauuccauucuccgauuggaacucugaccuauuuaacuccaaaaacuagucaugucugggagaguuuugcauuaacugcucagagaaaacaagaccaucugucugcaaaacccaagccuaggagaggggcuuggauguuguauaaggcaauuuucagacacucccugcaguggcguuagcgauagcgggacccguccuucagccucggacuacuggcggguucuugccugguguuagccaagugcuaguggagacacaguuguggugagacucuaaucugcagcgacuccaaccuugccggggaagucaugucggagcagcagcggcagggcgccgagcgcgaccucuaccgggacacgugggugcgcuaccugggugagcgugggagugacagacgcagcgaccccaccacuccggaggggcugggggcgggggggggggggaagcaauggaccggguugccgaucuggagucugaaaaggggcuuaguucuuauucggcuuggccuggagacagggcucaggagaaggcuagggacuuguccaaggucacacaacccuguugguucagaucuguccacggggcucuucuggaggcacaaaccgaguguguggguugcccucugccaugaccgugcacuagccauggcgucagaggaucuggacuccuagcaagucugccuuucccaggcucuuccuaagcuucaguuuucucuucuguaaaaagggcugaaugcgaggcacuccugucgggugcugacuguaagagcgggcugagguaaggccuuaaaagaccuggcacuugauacuggucaguggagcccacccucagugauucgguggccuccggucgccucccuggugcagauccccagaaccacggcuggggacuuugaucagugagccaugaacuucauugucggugucaguccgcgggccuagaaaccaaaagguaaaguuacuugacugaggucaccugccgcacuguaguuuaagagguuaggguuagaagcagcuuucuguguagcgcccccuuguggaaagggccagagaguuaaaugccuuuucccuccaggcuacgccaaugaggugggggaggcuuuccgcucgcugguuccugcagcuguggugugguugagcuaugguguguccagcuccuauguccuggccgaugccauagacaaaggcaagaaggcaggagaggugaguguuaauuaacccuuuccaacccauccuagugugggugguaugcagucuugcaguggggacagcccuauccccguuagcgucucauagugcaguccauaagcuaaucuuguuuguaggauuguucauccccacccgaccaaaccauuuggguaggaggugacaguugguaccucuccuggaugugggcaaaucacccccaacccugaauguaguacagcccaguccuccacccagcugccuucuacccuacuaccuccgcauguucuuccuccuugguccaccggcaugcuucugucuauagguuuccuaccucugccccagcugggcuaaaugucuuuguaccuuucaggugccaagcccugaagcaggccgcaacaccagaauggcccuggcuguggucgacaccuuuguguggcagucucuggccucuguggcuaucccaggcuucaccaucaaccgucugugugcugccucucucuaugucuuggguacuaugacccacuggcccccgacuguccgcaaauggaccaccaccacacuuggacugcuggccauccccgucauaauccaccccaucgacagguaggggccuuucuggucucagggaccagucacucugcagguagaguuaggcugugaacugugggcacaaaaccggggcagcagaggcaggguugaaguagagaggccaucugugcucuuaucagcuagagcggcagagcggcagaaaaggaagcagagugccuuauggguacuggacaaaggucaaguaaauucacagaaauaaagaccagugcugcaaaauagccagaguuagccaggagugcuggauugaagggagcugauaucggcaugagucaaacuuaguuugcaagguaaauacaaaauaaaagucuuaggauguuuuccgcacggcuggauccaagcaucugagcgcuacugccacacagcauccuucaucuucccaaccuucauccauccuucagcaucucuccccgucccguccuuguggguuucacucuccugccaugucccagugacucaugguguccugucccuuacaacaucuuacaccccauuaaaacuucuccguagugauagccaagaugccaaggaagauucucauuggcucccucagaugaggggcccauguaugagcaguuguccuucugaguagccaacccuguguugugugcuugcuuuuagcacuagagguaggaccagacuggagggaacgcucaguggauacagcacugucugcucuuccagaaaucccgaguucaauucucagaaaagacaccacggcuuacaaccaucuguaauggggucugaugcucucuucuugcaugcagguguuuaugcaggcacaacaugcauauacauaaaaaauacagaauuaaaaaaaaaagauuuauuuauuauuauauguaaguacacuguagcugucuucagacacuccagaagagggcgucagauuucauuauagaugguugugagccaccaugugguugcugggauuugaacucaggaacuuuggaagagcagucagugcucuuaaccacugagccaucucuccagccccuguuuuguucuuuugagauaggauucucuguguagcccugcuguccuagaacucacucuguagaccaggcuggccucaaacucagagauucaccugccaccugccucugcuuuccaagugcugggauuaaaggugugugccaccacugcucagcuacagaaauuauuuuuuaaaaaaucuaagagagagaaagagagggggugggagcaccucagugguggcagggguaggcuggaggggagcauagcuuacccugaaccucauggugaguccuuuacccacugugccucaauuucuccagcuguagaaaaaaaaggaauauggcuguuauccuuggggggagggguguaagcaugacuuccuuaagggaagagaauaaucgaauguaucuugacaugguugcuguugguaccaugcaucgagagucuuuccccuagcccuuguguuuccugcaucuccucauccuuggcuaccugcucaccaggccuucucucucuguaggucaguggacuuccuccuggacucuagccugcgcaagcuguacccgucaguggagaagcccagcacccccugacccugcccugugccuugccuggggucggcccacucacaucaaagaauguggauacguggcuguuugggguccauggcacugccaucuggguggguucacauugaugggagcuuagagaugaaggccccgaggaguaguggcagugaguucugaggugggacccaauucugucugccucaguggccacgguugugcugagugggaacgaacucuggcugggccugucuuuugaaaucuuuuuuuaaaaguauuuauuuuauguguauaaguguuuuacuugcaugucuguauguaugugcagaacccuuagagguuaaaagaggugauuagaccccucugggacuggaguuagggaugcuugugaacccccaugcgggugcugagaacugaaucugguucuucugcaagagcagcaagugcucuguucacuaaaguuccucuuagccccgggcccaccuucugauggaaaaguuaguuccucccauggaagagaagaauacuaaggcccagagagggcagggaauacugagaucaugugacaagugagagccagucuucuggcuauucuaagucacuuugugguaguguggcugagcgacuuagggaaagauacagagguacaguauuugggacacucagggcagagucucuggccagccuguuccuguugcaggagcugcugggccuggugagaggcaggacaaucacaacccaagugcuaaccuaauaaaacuuucaaaaauggcauc

SEQ ID NO: 5852 - RNA, 7206 nt, Mus musculus
cggccccgccccucccggugccgagccccgcccuguccggcgcggccuggcucacucuguucucccgguccccgggaccuuagacuacggccucgccaccucuccggucggaucaugggcucugccgaucgccccgcgcugaggucgccuucguugccgcccccucccccaucgccgccgucgccgcugcugcuacugcugccucugcugccuuuguggcugggccugaugggcccgggagcggcggcggacggcagcgagccggcgaccggggagggacggggcggagcccgcucagugcgaguggaugugaaacugccgcggcaggacgccuugguuuuggagggcgucagaaucgguccggaagacgguccggaaccucugcuggguggccgccugcugcuggugagcucagccccgccuaaacuugccaugacccucggauagaccccgcugucuucauccagaagcuagcccuugacagcccagaaugcuacuacuucccagccuucaggaguuggcaaaccugacagccacaugccccuuccacacucauucccguacccguacccugaccuugcgugcuuuguggcagacccgggcugccucuucuauuccccuugccuccuucuuuucauggcuccucguuacacagauggaugucguggaugcugagcaagagauacccguagauggcuggauugcaguggcauaugugggcaaagagcaggucgcccaguuccaccaagagaaucaaggcaguagccagaaggcauaucccaaggcucugguccagcaggugcaaaggguguuugagggaaggggagaaagaaaaugcauucgaaacaucugcuagagccaggcuaacagguggccuaugaggagccuuuccagagaagcccugggcccgagugggucagcaaacaccaguauggagcaucaaagcagugugauggggaggagguggagagacuugcuggggaaaguggaccugcucuggugauaggagcuggcaaggguggagagcugcuuugcuaggacuagggccaaugaaaagaauuuuggauccuacagaaugaaaggagcauaaguuucucacacacaugauaauguacaaauuucuuaaaaucaagaauauucuuuauguaacuaugguguaggaaaguuagcaucuauaaaauguugugaucuauguuccauaacuaaauauugccuuaguccacaaccaucguguguugccuuuggcugucauuaucucuucggccuccaaaaccaucccuuagcuuuggcuugacuucagggagcuuauagcuagucuauccagaugucgggcuccugagagcuggggccguggguaaggcaggugugugacagccucccaccuuccgucuucccuugcagaugcgucgagcccuuuuccugggagccucugcccugcuucuccucaucuuaaaccacagugugguccgagagguaaccuggcuuggacugugagggugagcaggugaggggacaggggccggaagccugcugacccugccugucuccugcagcuggauguaucccagcuucugcugaggccagugauuguucuccauuacuccuccaaugucaccaagcuguuggaggcccuucugcagugaguuccguuuguucuggguggucugaugccugagugcugugggucucuugcuuuucgaugggcucuaggggaggagacuaucucugaagaaggcccuuaccuguuggcccuuaaacuccuaagguugaaacugggggauggcaugggaaggagaggcaagaucugggaaaagagcugcccuaugggcagaggggacuaguccagcaugaggaagcuggaugccuggcugacaggcuauuccuuggucuggcugcguaaaaacacgggcaaagagcagccaggaaaagucugggagccaaaucagaaggccuauggcaacaguguccuuguguauccacugcaagaggaugaguguaggccucccuucccaaaggccuucugucugcuucccacccaugacucuccucucaggaggacccaggcuacugcugagaucagcaguggagagucccuuucagccaacaucgaguggaagcugacauuguggaccaccuguggucucuccaaggauggcuacggaggcuggcaggacuuggugugccugggaggugcucaggcccaggagcagguaggcccaauggauccuaggacagcccuacauacauucggcugauuacuuagaguggaucauguaguaguagaugauuagcagugccaugacaguuggccuagguggugggcaauggcugcugaugccuucauggucucugcucaguguggccuucacaacuuucuuacuugagccaguuuuuccccaauggggauagaaccagggccauguacaugcuaagcaauguacaacgcuucugguagacaaugucaccuccacugggucaugucuugccaccuacagugugccuuacucuccagcucccauacgcacccugacuuccugccucugggcccgaccagugauugguauucgauccucuucucaguccuccgcuggcucguggaccccucaucgcucauuuugccuuccugcuuugaauguuugcuccucugcucauagccccacugucugcucagcaugccugggcugugcacugccauagaagcucuaagccuguauguuagagagagugacuguguguccuuguggcuauggcuguguuuuguguccacaucuuccagugcuugucuuccagggauucaagguguucaaguccacagcauuucuugaaccccaaucuguacagguugaagggaaguagacauacucucuucuucuacugcauagauuccaauaguuugugaugugggccaguuucaagucagacagguuaaaacccuggcuccuaaacuuuaggugaacuaccuaagccaggugcuuuccuguucucucucucuccucccucucacucucuccucccucucucccuuucucucccccccccucucucuccccucacuuauuggggggacgggaagcauuuggugaagggcagagggauagguuacaucugggagaagagcaggcuggggaagggccucuguggccuggaggugagaauguauagcuuaguccaggcuggcagggacagaggacaaagcugaauagcugagaagguacugccagccaagauggggguggcuauuccauguuauacagccauggcaggugaaauguucaaaugauagccgggcaggcaucucuaggaacugcccugagcugggaauguggaaguugcgcugaaucaaguccuggcugcuccagaccacaggcugcagagaggcucuucuugauggcugacuggccugccacacuguaguacacacugcacaguagucugcacuguggccagggagcagcuaaccacugucauuccguagggcugacccacaagcuggcagcaggcacaagcucuuccaggucaaagcaaaaaagaccugagcccaaccuugggcucagacuagaugccaccacuccacugugauuagaggggaaagaggccucuaaugaucccagugcugucaccccaagcaagggcugguuuugcugcauucacagcucccagacuggucuaggaugguagcucuuuugucuggucauuuugacccuucuccuuugcugugaugggagucaaaccuauguuaggaagaacagucccaggauuuauagggcuguucggacaucccccccgucugcugugacaaagagcuacuaggaaagcugaggacuuugaagugaauuguuuuucagucacaguacaucuaaacucgguguaaaauggugugccugggugggaaagccccuguggcuugcugcuucugccacuucaguuucauucccccaaagacugagucuccaauaugacuaugucauacuaaagggccuggaggacuacccaggacagcagcaagagagcccauggccuauggguaugaggagggcugggcagggggagcacuuacccugagcgucaggggaugcuccuggagcaguaggucaaaggugugaagagaagggacaaugaagaucaauuuucaugacaggggaaguguggcaaggcaagggacaaaggagaccaaggcauggcugucagauugcuggugauguccugggcguggggguggggagugcuucgugcuucugguugaagagaaaaugaccauagcacagaagcacucccaccagcuuugucuguggcuucaggugaccaucagcuuagaugacggugaguggaggauguagggacugagaacagccgaggaggagaucugugcuggggcacaguaacaggguauuagggagacaugcgacucuccauggagcuggggcagacccgggagagcacauaggccaguggcauggagacuucagaagagcaagcgaggggcuuccacaggcagagccccucaguguuucggggguuaauaucccugggggaagcauguggagcguucucagugcccugacaucugccucccuucgcagaagccccugcagcagcuauggaacgccaucuugcuuguggccaugcuccuguguacaggacuugugguucaggcccaacggcaggcgucaagacagaaccagcaggagccuggaggccaggugggagccagacgguggaagcccucauacccgcagcccuugggccugcaagacuguggccaucuucuucccacaggaggauuuguucaaacgccgugugguucggaggcuagcaucucucaagacucggcgcugccggcugagcagggcagcacacagccuuccagagccgggcacugagacgugugcugugugucuagauuacuucuguaacaagcaaguuaguaccuaggcacagucagcuacaagcuggccuguggcguccccaauccugcucccaagagacccucaaaucuccaaccaggacugucuuccaguccuuauuauggcuggcaaaagcauaccuggcaauggccuaagagugcuauaugcacagucccggugaagggcacaggucuagcucccaucuagagccugugccccuccucucacccuguaguggcuccggguacugcccuguaagcaugaguuccaccgagacuguguggaccccuggcugaugcuacaacagaccugcccacugugcaaguucaacguccugggugagcaccaggggccaggugggauccugggcuaacucccuaagccccaccugaugccucuuucccugucuuuccuuuccuuacagggaaccacuacucagaugacuaacugccccaguggaaagucugcaguucgggacggacccuucccagccuacacuacaggagagugggauggacagaccagcuagcccugugggcaaaggaaaggucccaccaugcccauggcggguagaagggccucccagcuccaggcugaacacagagccggacccagcaggcaaggagaaaucauuaagagcccuucucugcaaaccugggguauuugugucuguccucauaggcggcucccacaacucugggaagaacauacggccauuacaccuguccccagcacuccggagcgucaguguugaguuuuaugcuaucuauugggggauagaugaggggaaagauguguggccaugggacccacuggcaggaaccugucuuucaggccagggccugaucaaugacuuuaaagugagccugcuccgugaccugcugccuguccagcugaguucuuccaggcuggcuggguucagaggccuuagaaaccaucuagugcuguauuucuugguugggcuaaauguuacugaccaggauacuugaggccacagaaucuauguggugcaucugcaagggcaucauuaaaaggaaaaaacaaaaacacaaaacaaauguuuggguagggaaguuuuaauaguaaaauaaacauggaaucuauuuuaacauaaaucuguuaagacauaaaucugugugaugcuuuaagauauuaaggaaaagauggguauguggugacauaugccaauaaucccagaaacauggagguggagacaggaggauucauaguuuaagaccagcugggcauagcagugcaccccuuuaauccuagcacugguaaggcagaagcaggcagaccucugugaguucaaggccaaccuggucuacauagcgaguuccgggacagccagcacuauacagagagacccugucucaauauaacaucacaaaacaaaaaguucaaggcugcugggcagucccugcaauccccuuguucuuuguccucugggaagggaaaccagaggaucaugaacuccugaucauccuuggcugcacagggaguuugaagucagccugggcuacucucaaaaagaaaaacaaacaaaauaccagucaccuugguuucucuugcugggaacagguagaauucuuaaauuccucaaggccuugcacuccugggcugcacaaacauaccuugcauaaucuuuaaaauauugacucuaagacauuuuagccccugugaacagguuauguaaagugaccuucagaugagagaggcaaggacuggggcauggggagcugguagagcacuugccuagaaugcacaagggccugaauucaguucccaacacuaaacacuaacaauaaaaaugaggaaagcaucugaccaacacacaagcccacggaaagcaggaggaaguagaggaccuuggggcaucccauacaggacacacauugucugcugcacacccuccauuucuuucucuuuuucuuuuugagacaggguuuguaaguggcucuggcuguccuggagcuuucucuguauaccagccuagccucaaacucaaagagagacuccugcuucugccuccugagugccaggauuaaagugcuaccaugcccaccucugcugccuucuugaagaugggugguaccaauaagaagccaggcaaggaaggcuccuugaagcagcaaggcuccaaccccacagccuaagccuaagccuaaagcucugucacagccaggagcuuguaagaggacucuugcccagagccaucuaaaggagccauccugagugauaccuuaguuucccccucugagcacccugagcaaagggccugaucaaauagauggacuucugg

SEQ ID NO: 5853 - RNA, 4205 nt, Mus musculus
accgguagcgggcggugcuucuuuaagcccggcgccaccgcaucgccuccugccuaggucucgcuggcggccaggccggggcugccguaucugcgauggaacuucacauccuagagcaccgggugcgaguacugagcauugcccguccgggccucuggcucuacacccacccgcucaucaagcugcucuuccugcccugucgcagucggugcgcacccggguucacgagcgcaggucgggcggguggaggcuccucugccccucugggccaggggcggaggacuagagucgccgcgaagcagcggguaccggguggggacgcuagccacucuggccaucauccagccugggccuuacccuuucugcgacgccgccuauccggcccggagggccccgcucccagggcuugucaaggugcaaacugccuggaguaggcaguguagugggggcauguguuccuuggcaggcuguagccccuuucuagucuccucacguuaacuuuugagaguuguccagggggacccaaagccuuccacuucuguggaauggaggggagaucccaaauaugggaucuagacucauugauccaaggaagagagugaggcccgagugcggguccggaaggcuccuggugggggguccuuuagugcugcuggagcagacuucauuugcugucuccauuccauucacucuaggcugaaagucuucccaccccuucccuccuccuaggugcaaguucuucagccugacugagacuccggaagauuacacucucaugguggaugaggagggcuuuaaaggucggaacugguuccuuguuugccucuaagcaguauucuuacuaaguuuagggauccagcuucccagagagcuuagaccccaaaggaauauagguccggguucaaaccuuccaucacucacugaaguacugugugggauggagucgugaccguuugacaaaauuugugagaguuuuauaaacguaaaacccacacggagcugaauaugagucccaggccagcacagguggccauggugucucacaguuuuaggggaaaauaaagggguuccugcagcuguuuuacccugaacauuauuucuucuuggacuugucuccccaguggaaagcagccccucccuuacuggcuugggaagccuaggcggcugagaguuagggaaggaaugcaggggcaggcagcaagcccagagcaggguccagggccuccuggcugagucugagugaacaacagcuacccuggcccuugucccuguucaggacugggaccggggaaaugacuucuggcuuccaugucugccugcuugccccauccucuaaggccuggagucucaagcuagccaccuagaguuuggcugagccucccucccuaaggacuuagauucccuguucuguagggaaaucugucugcaagggagcuuucccaucaguuggucacugggugcccucugguggugcuuugaagcccaugaaguccauuuugcagauaggaaacagacuaaaugguguuuguaaucccagcacauaggaggcuguggcaauaagaucaguuuaaguuaaaucucagcuuaaucuacauuguaaaggcgcugucucaaagcaaacaaaacgccccaaaacacacuugucucacacagcaaaaugguguaaaaagaaaaaagaaaaagaaaaaucugggccuugaaucuaguugugaguuuggaguaguaaugcucacugagaaugcucgcaugaugcacaccaagguagaaacgauaggaaccggcccugagcucugagucugucaggaaacagaucugaugggcaagguuuaaacagagaaacugagaggcggagagagcugacuaaccaggcauguaccuccugcccacagagcuacccccauccgaguuccugcaaguggcugaggccacauggcuggugaugaacguaucucacaguggcuccguggugcaggcugcuggaguaaccaagauugcccggucugucauugccccgcuggcugaacaccaugugucuguucugauguuguccacauaccagacagacuucauccugguggguuuugggcaggugcuaaugcaggucauacgcagagggaccugguguugcguaauauguguccuuugccuugacccagguacgggagcaggaccugucuguggugauccacacacuggcccaggaguuccaaaucuaccgugaaguaggcggggagccugugcccguuacuggagacgauuccagcaauggcuuuccccagauccagcacggugaggucugcccgccagcacccagauuuaagugggaccuuuucccacgggagggcuugucuuuuaaaagggugcaaaacacucucacuguaugagaugggcuagccuuuccuugaccugccaccaggggucgccccaguccaagauaaccuuguggccccugucuccugagcagggcccagucccacggugcaucccauucagagcccucagaaccgcuuuuguguccucacacuggacccugagacacugccggcugucgccaccacccucaucgauguccucuucuacucccacaggugggucaugcgugcacgugaucucugccucccacuacuguuuccugcccucugccuuuugucucaucccuucuguuacucugugucaugcucagugccuuaggguucugacagccuguuaggccucagccagaggugucggcagagccacuucccagccauauacucccaauccggcucucccucugcucaaggccucuggccguuggggcuuaucccucaggaaaucaggggucucucacaaugaaguaagagauucaagggccuucccagagcuguccggcuccuccucuguggucugcucguuagguaauguucccugccaucauaucucuuaaguguccccaaggaagcggccucgggcgguccugaaucaacguccauuccguucuucgcuuucucccucaucgagggguacaucuccauugucauggaugcagagauccagagaaaguauguaacuccuuccuuaauucuccauagaccacagacccucagccagccucagggaaggugggggaggggugccagguuccgagguuagcaggacaggcccuaugggucaggcuagaugggggugcgugaagugccuuucccaucacccacugcuuccccagguuccccagugaccuccugcugaccaguucuucuggggagcuguggaggauggugcgcaucgggggacagccccugggcuucggugagguccacucacucccuggggggggcggggagggcaagccugugggucuucacagcaucuaagguaagccacccgugucuccaacccucagaugaaugugggauuguggcccagauugcggguccccuggcggcuguugacaucucugcuuacuacaucagcacauucaacuuugaccaugcgcuggugaggaccuggcugggacggagguuccagcaagcacacugaggucccuugcggggggagggggggggcagcaucacagcuaguuuagggggucgggcaucccuggccagaguuagccuggcguuucaugcuguacacucccuccagguuccugaagacgagaucggcugugucauugauauucuccagcgaaggcaggaaagccaggcuuccaaggacccauagggaagcaccagacccccagcauucccguaaagccccccggggcuccagaaacuuuucugagcuucagaacaagucccugguccugccaagggauccugguucugcugucugucugucagcuguauggagcugggacucguggccaugccugguucugcugucugucugucagcuguauggagcugggacucguggccaugccugcccacaaaagauaccuuggugcuuggggcuuagauccccgacccaacauuuucuaugugaccucagcaaugcacagagccugcuugccugcagcuggagccgccucuccccuggcuaaggcucacauccccgggccgggcucugaccuccagccugcacugcuuuccuagccagaugaguucagcagugcacucccuucgcgggacuccgaaggaagaauuaaaucucacuuuuauuuucaugacuguuuauauaaauaaaagacuugcggauuugugcccucugguucugagugacag

SEQ ID NO: 5854 - RNA, 15105 nt, Mus musculus
cagcccugcuucuccuucuaacaacaccuuucccaccaccgugucaggcuccaucuguggugugggugcucuaccucucugguccucagcuugggggugggguggaaguggggggagccucaggccaccaacuucagacggaagucagguggggggcagggugaggagccaacgccagaggagccucaggaggagagggaagcagaggggcccaacaacgauggugucacccugaagacuggacaacugugcagacuguggagggcugcgagaccacgguaggauucccuugagggggcagggcggaggggcacugcugcaccccacacuuauccccaggaggguagaugguccaucaguugcuccccuguggaucaggggcaccugcuggcccacacaacccuccagcauucgcucucccugucuguaauggaugcauuguaagucaggcuuggaagucucucuuggaggauggccaagcaaagcuggagagaccagcuguggaagugucccguggguuaaaguucacaggauggguaaagggcaguggagagagcacauggauuccaggcuugcauugugccaucgugguagggucagccugauucuaaaggcagucaugauuucugcauccccaggggacucaaaucccuuuucuuuuucuagaguucugagcuugcagaggccucauuuacccuccgguagauggagcaguggagggccgucccuguccauucaaaaugggcugcagcaguccacggggaccaucaugggugcucuggggaacuugaucagccaaggucauuacuccucugccuuugaccuugggccagaucggagcuuggccggucuucgucccccccgcauccgagcuccaggacagugacaaagagagaaaaacaaaaaccaagucugugcaagagcccccugcguugggugcuuggcauccaaaauuccaagaggcucuuaccucuaauuugucaguguuccuccaaaccugcuagggggcugacaaaaggaggggacauuguucccaggauccuguccaugucaugccaugccgggacaggacaguaaggggagccugggacuagucuguacaaccaagugguuuaguuugcuuugauucuugccucuugcugugugaauuugggcaguucauuuuccuucucugggucaccguggcccccugcgaaguugacagucugauccccaccuggaagaacugucaggacaaggugggagcagguagcaggaccaggaaaaggccacugcccccucccccagagccauggcaaggcugugccccauugaccacugaaugugguucuggcaccuccuuguggccagucuuuugggcuacaccuugcagauauuaggacaaagcucuggaagcccccaagaggagccuucuucccuuguguuggugaauggccucugcccacccccauccugcaccccagacacccacucacuuccucaaauccaguuauccagccccacccaccuacugguacggacugaacaggcgagcuggcgagccgacuguacuugcugauucugggcagcagguggcgcugcugaccagggcuuggagcugcuaagcguuuacagggcaaagaacccuaaguucagguuucaagguuauagagggagcccauccacacccccggcgucaaugacuggaucuaaucaaggcaguaggaucucagggagcgaguccucucuggaaucuucacaagcaaacuaguuuggaagucuuggaacccaggacaagcaccagggcauauauuaucaaggauggcccacugacuuguuguguggcuuuggcaaaguggcaugcuuucucugggucucaccuuugcagcuguaccagauaaagaugucuauaauaaagguguaucuuguggcuuugccaacuuaagauugacgauccuguuaucaauuuugcacacgucguagcugagguuuaaaugaugacgccaccugccugagguggcgcaccuuguaaaugacaacuaaaucugagucuaaggucugacagacuccaggguccacggccccucuguuccagcuaacagagucgcacccugcuuggaaagacaggcaaggacucuguguggugguggggggugcuaagaugacuguuacagagaaccaucuucccucuaagauagucuucccucucagccugcagguccaagucuucgcagaggagaugccacagcugaggggugacaugaggguugggcacaggucucaccuggaaaggcagggaacagaagcaggauccaggggucagguggggugagguuagcugggcaggagaucagaguggauuuugucacggagcccuguggcugauaagcacuggcuaccuggagcacuuaggcagcgaggguugcuccccugggaugacuggccccagagcuccugacagaucuugcugcccugagcaucuccuagcugucccaacuacccguuagaugucccuggccuuacuucagagagggcgggcuagggugggaacgcgggguuuugcaucuucggugacccuggacaauucaacuccugagcuucaguuuccaagugugacaaaggagaaaugggagugggcuggaggccuuagggggucuucugagcacucuguaugauuuucuggaguggauuggggggggggugucccugagacuggcaugccaaucuugagcccuggaagggucuucgagauuugcagagaccccagguuuugggacuaguaugagacaagaguugauugacccugugcuuccugacaggauagccaguccuggcuauggcccacuguccgggcagcuccaccugcuucuguccccacagccgaaagcuuauucuuuucuuucccaggaaguagacacuucacucugacgagucuuucucccacccucaccucacuauggaacccuucauucuucucucucaucucccucaugucuccccuuccuaacauccuuggcggguggggggaccuuuuuucaagucuuccuggcacugagguuuguagucagggcucgggccaccuccccagugucaccucuuaguccgguuaaguggcccuugugaguuuaacuagaaggggggacagagaugaggccaggcccuaccucuguggccagcuuccaacuuccugugugucugcccacuguugcuuccuguucuguuuauugccuccaaguucaggaaaccaacgggugccccacccccaccuuacacacccgugauuauuuaauagcagccgugcuacagucucucgcucucuuuuggaaaacccaguggggaaaggaagcugacagcucgagcucugacaucagcguugucccugagccaaaaauccaggguggccggggugggaggggcagggcggggagggaaccaguugcugguggcccccaugacacgaggcugcccuaagguucccagggacgggggccagacaucgaaaggcagagacacaaggacacaugcauauucaugcacagggucaugccuggcuaccacccagacccacacaggcucacacaggcauggacacacacaugcauucauguguguaugcaugcaugcucacacacuuggggugaggggaggacuugcaaagcccagcucuguuuuagccucgugcacacacaaacacucuaaucaagugcauacacacacacacacacacacacacacacacacacacacacacacacacaccagggccagacacugaugaacgcagacucaacacugacaccgcacaagcacaaaagcucccugagacacagacacaggcuccgggaagcuccucauucucagggauucuguagagcgcccucuucuggacgcagcugggccccuggccuaggccacccugaaggagcccagccacuuccuccugugguguguaugaagggccccugaugccuaugagcaaaggcuccguaguugugacuguccccagccucaccuaggcaaggcagggagcccugagggucuaaggcugggggaggaagugguucuggagaagccgggcucugcaagggacuucgucacugcuaggccugaugccaggcuuccacccccacaccaugccucuggccugcccauaccugggcccauaaugcaccucuggcccauuccugagcuggcuuuaguggaagccacaguugaagucaggcacccugugcugcugacugcugacaggccuugggcaagucacauagaccgugugggccaggccuucguuccuguggcuaucuguggacaacugggaagagugcuucagggggccaugcucgcccuggcaauguugauguauuuugucaucccauuuuucuuugaaggugcuacuagcuccuuguaacuuguaccugugacucgugaggugcuagaggccggcgugagagcauuguucuccaucucugugaccuggacauucaggagaauagggccaaaguaugaaugcuuauucaacauguacacaaacuccugaccugggggagagcaaccuaacuuacagaaaaaggaccggaggguaguguuagggugggacuggccaccuaccaugccacacccuggccucuggcccuacugagggucagcucugugggcugcuauuuccuuugcuguuucuagaacugaagagggggaggggaugcagacacucugauucaccucuaggggcuugauuccugacgcagaacuagucaggaagugucggggugaugcuggggcuguuggcuguuggccagacuacuugaggcucuucuuuggcucugagcgggugccauuggugccugccagagaucugguggggggaggguaagaagcugcagauuccauggcagugcucggucugagacaggacugacacaggacggcuugcugauauucuccaaggcugaccacuaccaggguccauguccacccccaaggacugagagacucagaagccaggccagcccuaaccagcaaaguaugcugagucucuccaggccugguccaaacucccuauuccccguuggccagaguugacugagcaucuacccugaauuguuuucagaggggaaacugaggcuuagagaggagccaucaaccagggccacacaggcaguguucggcuacccaguucauccaguguuccacaaguaacaacccuuaaguauuaacuuaaggguaucagcgccacagugccucagagucagggcugcaacucuaaggacacccucauuucucaaggcugacaauggagccgccucugccuuuuggggcacguuaucgacugccuaguccaugccagggacagucucagguuucuccuauuuccuuugacaccugucaccagcuagggccuugagaagcauccuccagcccccaguuuccucucagagcacaguuuugugcucaccuuucagcaauuucaggugagaucgccaaagcccagcugaggcucuguguuuugaagaacugagaucguucaggggaggacgcagggagaacgggggggggggggggggggggggggcuggccugccuguggagcagcucagcaucugggucauuggucuuggggaauucccagugcccagagagcugcuuccuuaccugcugaguaaccacugcccacacaggaugccuggcuggcaggccaccuccccaaaccuugcaagcagucacugcucugcuguccucucuccugagucugagagccccagggcccaggaaagagacagcccagcaagcaggcaaggggcuagcccccacccccgcguuuccccccacccccuacccccgggggcucugcagggggaagcuggugauucaaauuccuuugagcugagcuuuucagauggggucugggggugaaucagcuccuggcugguaagguccaaccagcagcuuucuucaucucaagcccugauugggggugucugcccugugugugugugugugugugugugugugugugugugugugugugugugugugugugaaggguccacuucccaaaagccacagagcauguaccucacugagccaaaucuccagccugcuucuaaaugaggucaaaguccacacaugcuucaaaccaccagagcuccuccuaccuuugcccagaccacuuucaagguguaaaaugcuuaaaaauagacgggaucugcagaguggucccuccugaccaucacugucuggaacagaccccuuuccaagcccccagagcccaagcaaucugugccuacuugaaacaagaaugaacaccaaggcugagugaaugggucaggcugcagggggcugagggguucuuccuucugaaagccauugccuccuagaggggucacuggaucuugcaagccagaagcucugccguuaacucuuuguguauagaucuuuaccugccacccccuuaaccuccauaagugaaaagcaaguggcuaugagguccugggagagaguugugacuguugagugaaagcuaaugggaaaggcaaggcugacuggcccuaugugucaaaguggacagaagagaggacucucaagggcuuugggaaggcccaggcuagcuuagguuuccagaccagucuacaaucucacuuccuggagagaagcacuggauacugcaccugggccuggcauggcagccccuaucccugcugagggauucccuggguggaaacgggcugucccccucauccugaagccugucaaaccccuagcaggcccagugugcaggagcuggacaggcugcagaugaagucacagcuggaagaggcugggcuggggcugccacuccagggcggggcccagggucacaacccugggaacaggcagccaagaagggaggaugucuucugugagggagcagagggaaacacacauacagcggcacagagagggagggacggaugcaaacccccagcucacgccagccacguugcaggcggcuugaagacagaggcucagcucugcuuggagaccuuuccuggugccuccucagaggccugucacagguggugcucagacauggacuggagcaggaggcagggccuggugcaccaaggggcccagagcacugggggagcauggacuaagucagguacugugagaggggaaacugaggcacaaaugagucaacuaguucacugaacucaaaagguccucuuaucagugucuucuggaaccuguucccaccuccuguuuccugcaggguggagccgagaugaaaugacuguugaguggacccaugugggggucuagugauccagagagcagugcaaggccuggaagugcucuggagggauguagaggagagccaggcacaggaguggggccguuagggaugagguccuccgugacuggaacacgcaaugagguguuuagccuugggggcaggagguggauagagaggaccaugauggcuuucugggcugauagaauuggggcccauguaaggacaccaggcagagucagacagcagcuguucggaagacgugaugguggaugagggccgauucagaccuggugugcucugaguaguucuggugcgguggcgcugggaugugugggguguggagucacaugcuaaccuauguguacaggaauggugaaccccagacagggucaccaaugaagagacaaggugugucaggaugcagggagaaagaaagggugccaaccugguggcuucaucacuccacuauucgaggcucugccaaaagaccacaagaaacaagaaucuggagggggcgggguguaugugugggggcggggcaaggagaacagacacaaggcacccugcuaggauaagaacaccugaguagauccugaauauggcucagggcaggagcuagggacaugggggugagcgaaggggcuggagaagccaggcaacgcuuugguaacccuaauugucccacuuggaucugggguuaggucagauggaaagguugggauagggucccccagcgcaaugacaccuccaggucuagaaggacccaauggcucgggauagcauggcccuagguagguguguuuggucagugcucucucgccgaaugcuucucuguacugcuucauaguuaguggggagacccuggucuuauuucagccugucuucuuccccacugucccucagagagucucuaaccuaccagcaaggaccugccucgggauccugccguagaccuguaagaagcaccuguuaggagucaccuuuguacucugaggccaagcacuaggggcuuccaaagagugucagccauuccuaggcacccagaggaagcaggagccccauuuugcccagccucccugaucauugcuuuaggggucccuucaacguaguaaggcugaguucuugcccagauaguucccagauagacgauacaaccucauacucuuaccaguccuccauagagggggcaugcugauggcugggggugggcaagacccucuggcacacuggcagcaagccccuuugugucuucucuuuacccauuggcaauggacaggcuggagaaaggccaccccuaaggugacucccagcguccacauucugcuucacuuuauggcugucuaaaguucaaaagggccccggccccccuucugagaaacugcuucucaguggaaccccagccugacuccuuuugcugccccgcaaagccccaccaccaccaggggacacaaagguaaccuccagucuguugccacccucccaaacccaguugaaacuggaacgucugaaggggggcacaggcugaggaccccucugaaucccccugagacccuuuccccaccagacccaucugcaaaaaacgcccagagcaaaccacuuaggaaaaccacagggcgguuuuuuguuguuguugaagacuucauuauaauuuuaucaaucaaauucuuagaagaaggaaaaagucugcccuccccacccuccccccucacucuuccccccucccccuucacucucacuuucuuccauucauaauuuccuaugaugcaccucaaacaacuuccuggacuggggaucccggcuaaauauagcuguuucucucugucuuacaacacaggcuccaguauauaaaucaggcaaauuccccauuugagcaugaacuucugaaaacggccugcaucuaaggucuccuccaaggcccucuggaguccagcccauaaugaaggucuuggccgcagguaaauccaugcgccgggcgccgauuuaagagucccggcugcgggcgcgccggcagccuggggcgcugggcgagcacccgcgggacacccgcccgccgcgccacucggacacuuggggcgcccgcgcaguccgggcccgccggaggcgcuggguggcggccgggagcgagcgccgcacaugguccgggcaccgcgcgcccagcccgccggggccagcagguuggcggugagggaccuggccggcguagccuugcuccaccgccuucucuccucgccccacugcucuccugugcugcucuuacuucuccgcugucgccuagauuuacccucccucuuucuuuuucuuucuuuccgcuuucucuuuuccaacugcgucccgggcugcucccugggaggggcgcaggcggcugagcagcuugcaaacuccggccaggaccggcgcaggugcggcuuccgucugcuagucccuggaaagcugugauuggcgcgagaugagaugcagguauggguacccccgcagcuauuccggggcccuaacaguguuuggggaugcugagaucaauagaagacuccaggggaguaaacuuaagguucuagggucuuuuuagucccaguauggggaguucaggugggaggucuccagccucccuuaagagaugacuucagccucuaucaccuucuggugucuuuagccugguguuggaaaggcuggagcuggggugagggggccggugaagcuaaaagugaaggacgggcaggcgccccgggggaggggugauccucgacaggcccggacagcucccggcucuccugacaccuuucgcuuuccucuugcguguccgccugcgaccuuuccccaccccggccucuuuccugguugcaccacuuccucucauuccaaaguauguggauuuuuuugggcggggggggggcuguagcaagcaggggugaaagaugauuugguuggagagugggcaccugcagaacaaacagguggaaaguucucuauagggccucauugaggaagaugggauuaaaggcaaucguuuuaggaagccagagucuaguggcaguuuuaagagauggucuacagaaaccccagcucccagccugcacggccugcaagggguucagcucagaguucuaggcuccagugggccaauggacaccaaccaaguuaagaaucuggccgguccuggaaaggggaggacgguuuauuucucuuccccucugcuggaccuaauaccauccaucuaggguaccaggagggaugaggcuagaugguugagugcccccgccccccagaccuagcuuucaguugguacaaauggcucccaccuugauaccuugccucuuaauccaguggcauagauggggaaacugaggccugggagcagggaaagagaaagccagagagccagggaaccucaguagagcaggagacuaaaggcugauggagggugggagggggcaggaagggccucgcugaggugcccccccaacccccgugccgugacccucagccaggcuucuugccuuuccagucacccuccgugucucuuccagggauugugcccuuacugcugcugguucugcacuggaaacacggggcagggagcccucuucccaucaccccuguaaaugccaccugugccauacgccacccaugccacggcaaccucaugaaccagaucaagaaucaacuggcacagcucaauggcagcgccaaugcucucuucauuuccuauguaaguuacuuuccugggguacugaggaaggggggggcugccuggcccggaggggugcccuucagagcuggaagagcgcugugggaacccauggcucccuccccacacccuagccaaagcacagagacuggugggcaccacucgccagcaaguuggggugagcggcggggacugugcuuucugucuugucccauggcucaggguaccaaagaagaggcuaugcagugaauggacagggaggugucauugaaagcaguguguguggggggcccaggaagaggcuggggugacugaaagugcaaguguaugugguguucuggcugaggugacaccugcgacaugccacauuuccucuauccauuuaugucaccgugaccuuggugagugaguucacauuucugaucauugcugacuaaugauucuaguugccuacagggcagcaaguggaguccccaugucacagguggggaaacagaagugcaagagcuugccccaaggguugguggcgggcuagaacacucacccugacucccacaucaccucuccucucuucugcaguacacagcucaaggggagccguuucccaacaacguggaaaagcuaugugcgccuaacaugacagacuucccaucuuuccauggcaacgggacagagaagaccaaguugguggagcuguaucggauggucgcauaccugagcgccucccugaccaauaucacccgggaccagaagguccugaaccccacugccgugagccuccaggucaagcucaaugcuacuauagacgucaugaggggccuccucagcaaugugcuuugccgucugugcaacaaguaccgugugggccacguggaugugccaccuguccccgaccacucugacaaagaagccuuccaaaggaaaaaguuggguugccagcuucuggggacauacaagcaagucauaaguguggugguccaggccuucuagagaggaggucuugaauguaccauggacugagggaccucaggagcaggauccggagguggggagggggcucaaaaugugcugggguuugggacauuguuaaaugcaaaacggggcugcuggcagaccccagggauuuccagguacucacugcacucugggcugggccaugauggaaucuggcaaaguugaaacuuccauaggcagagcuucuauacagcccagcaccagcuagaaauggcaaugaggguguuggucugagagauuucugucucacucacucacucacucacucucacucacucacucacucacucacucagccccuugcuugcuggguguaugaacaagcugcacaaguugucuacagcagacagcaaagggcugggaaguguccuagaccccuacagagucaccaucaucugguccuuugcugucucucagagaaacuuuggaaggcuugguugggaugugagagagcuaaggggacugggauccagaaggaauccuuuuauuuuauuuuauuuuauuuuauuuuauuuuauuuuauaaguuuuguggguggaaggguacccugggguggaaugauggaaugugucuucucuugaguuggaugagagaguucaggcuuagagacugucagauggaagagucuaggucaccaguguucaggcucccacagaagcacagcggccagcuuccaguugucaaagccugacgaacucgguuagcuucuaugcaguuccccccacagccuggcgugguuggggucugccagcuggaccuagaggugaggugugugcaggcaggaagaggcaggcugcaaaggcagguucccagaguccucccggggaaggaccucuaacugucuaggagucagggaaggagcaaggcagccagccauugcugaggcaguagccgacugcagcucucaucugcuucucaaccccugagaacaggugaucuugagcagacagacagguagcauaaaguagaaugucgggucugaggccccggaggucgcaaagguacuugaaggggaccagagggcugucuugggucccuggagcauggagaagcagaacuugaggucagggucucagggaagaugaggcccagagugcuguguuugauccagcacagcugucuauuuauuacuauguccuauuuauauuaacuuauuggugcuuuaaauggcaaaguuaauuccccgaaaugguaugaggcuccuuccaugggagcuggggccgagacucuccaccuaguggggccuggucuggaggcacaugauuguuacaggugcagcucaugggucaaaucagagagcuggcuagcuccucugucucccacugugacucacuuuuagggugucagggucccccagaaaaagcugggccaguuugucucucugcuucugucucugucucuccgagucugucucugucugucucugugucucugucucuuugucucucucugucucugucucucucucucucuccccgccccccccccuucucccucuggucuccaaggggguggaacaguuucuuguuguuuugucccacugagcucucuggcacccccuagauuccugcuaugcggugcaccauucauaaugaagugaauggcucuggaaccuugggcaaaacugauuccuuccucaaaucguagcugaggagugcugaaacauccugacccggcacccagcgugcuuucgaccagcauggaagcuccucggguggcccgaacacccacagagggugaauacaggagguuggagcagugcaggcccugaacugggccugaacagcugcccagugcgccagagaaggggagaucaaggcccgagacgccugggacacagaccaggaagcugugguccuugcuucaucgcugccuucccacucccgcccaugucugggcucccaggcagggaauccgaucugaucucuccuuugugcugaggccaggcaagcagaggaacgcccucgaucugggagcaggguagggaggaaggcagccaagcuggggcaguggcugacuacagagcuagcugccugccucucaggcucugaacagggcgguccuuagcaguucagcagugggauucugcuucacgcgguuuugcaccuuucucugucacucucuaagcacuuuaccuggacggcagguggacaggcccuggagcucuggcuuaggaaaggccuggaaccauagaugcagcaaggagacuauggugggggccacgcgugucagcgacaaaguuacuccaccguacuccuguugcugcgucaggcucaucucaggacuggcugcccuucuccaagcugagagucaauuugucuaaaagccaagaugaugccacagccuggggccuguugggcuuugucaucacuucacauuuguauggacuuggacucucugggcuccgcccaccuggcagcuuugaaggcucagggaccaauggacucucuccgugcacgcccccguccccccaacgcaaccaccuaccugcgucuuacuccaucaguugcccagcaucccagaaccauugagccuuuggggaaaacagacuuuaggggcagguaguugcucaccugacaucuuucaccuggaagcauugacuuccaccgagcauaguagguagugugucuggaccagagaaaaagggauggggcauuuugcaguuuauccagagagaagcaaaggggccuuuauuuauuauuuaaaacuucaaaccugaaagcacugagaguuuacuggucugccccccuccccccacucuugucuauuucuguguccuugaucccgacucaagcaacccagcucugcuuugccugcucucuggagcagacaugguaugugggccaggaccccggagucuugcaugguagcggcuucagaagggaaaugauauggcugucugcauucggaugacuccccagucccagcccagccucuccuuugcacugcugcucucccucuuuccuuuccuuuggaagggacuuggccuugggugacaaauuccucuuugaugaauguacccugugggaauguuucauacugacagauuauuuuuauuuauucaaugucauauuuaaaauauuuauuuuuuauacugaaggagugucuuuuuuuuuuaaagaaaaaaugaaauaauaaagaacucauucuuguugag

SEQ ID NO: 5855 - RNA, 15105 nt, Mus musculus
cucaacaagaaugaguucuuuauuauuucauuuuuucuuuaaaaaaaaaagacacuccuucaguauaaaaaauaaauauuuuaaauaugacauugaauaaauaaaaauaaucugucaguaugaaacauucccacaggguacauucaucaaagaggaauuugucacccaaggccaagucccuuccaaaggaaaggaaagagggagagcagcagugcaaaggagaggcugggcugggacuggggagucauccgaaugcagacagccauaucauuucccuucugaagccgcuaccaugcaagacuccgggguccuggcccacauaccaugucugcuccagagagcaggcaaagcagagcuggguugcuugagucgggaucaaggacacagaaauagacaagaguggggggaggggggcagaccaguaaacucucagugcuuucagguuugaaguuuuaaauaauaaauaaaggccccuuugcuucucucuggauaaacugcaaaaugccccaucccuuuuucucugguccagacacacuaccuacuaugcucgguggaagucaaugcuuccaggugaaagaugucaggugagcaacuaccugccccuaaagucuguuuuccccaaaggcucaaugguucugggaugcugggcaacugauggaguaagacgcagguaggugguugcguuggggggacgggggcgugcacggagagaguccauuggucccugagccuucaaagcugccaggugggcggagcccagagaguccaaguccauacaaaugugaagugaugacaaagcccaacaggccccaggcuguggcaucaucuuggcuuuuagacaaauugacucucagcuuggagaagggcagccaguccugagaugagccugacgcagcaacaggaguacgguggaguaacuuugucgcugacacgcguggcccccaccauagucuccuugcugcaucuaugguuccaggccuuuccuaagccagagcuccagggccuguccaccugccguccagguaaagugcuuagagagugacagagaaaggugcaaaaccgcgugaagcagaaucccacugcugaacugcuaaggaccgcccuguucagagccugagaggcaggcagcuagcucuguagucagccacugccccagcuuggcugccuuccucccuacccugcucccagaucgagggcguuccucugcuugccuggccucagcacaaaggagagaucagaucggauucccugccugggagcccagacaugggcgggagugggaaggcagcgaugaagcaaggaccacagcuuccuggucugugucccaggcgucucgggccuugaucuccccuucucuggcgcacugggcagcuguucaggcccaguucagggccugcacugcuccaaccuccuguauucacccucuguggguguucgggccacccgaggagcuuccaugcuggucgaaagcacgcugggugccgggucaggauguuucagcacuccucagcuacgauuugaggaaggaaucaguuuugcccaagguuccagagccauucacuucauuaugaauggugcaccgcauagcaggaaucuagggggugccagagagcucagugggacaaaacaacaagaaacuguuccacccccuuggagaccagagggagaaggggggggggcggggagagagagagagagacagagacagagagagacaaagagacagagacacagagacagacagagacagacucggagagacagagacagaagcagagagacaaacuggcccagcuuuuucugggggacccugacacccuaaaagugagucacagugggagacagaggagcuagccagcucucugauuugacccaugagcugcaccuguaacaaucaugugccuccagaccaggccccacuagguggagagucucggccccagcucccauggaaggagccucauaccauuucggggaauuaacuuugccauuuaaagcaccaauaaguuaauauaaauaggacauaguaauaaauagacagcugugcuggaucaaacacagcacucugggccucaucuucccugagacccugaccucaaguucugcuucuccaugcuccagggacccaagacagcccucugguccccuucaaguaccuuugcgaccuccggggccucagacccgacauucuacuuuaugcuaccugucugucugcucaagaucaccuguucucagggguugagaagcagaugagagcugcagucggcuacugccucagcaauggcuggcugccuugcuccuucccugacuccuagacaguuagagguccuuccccgggaggacucugggaaccugccuuugcagccugccucuuccugccugcacacaccucaccucuagguccagcuggcagaccccaaccacgccaggcuguggggggaacugcauagaagcuaaccgaguucgucaggcuuugacaacuggaagcuggccgcugugcuucugugggagccugaacacuggugaccuagacucuuccaucugacagucucuaagccugaacucucucauccaacucaagagaagacacauuccaucauuccaccccaggguacccuuccacccacaaaacuuauaaaauaaaauaaaauaaaauaaaauaaaauaaaauaaaaggauuccuucuggaucccaguccccuuagcucucucacaucccaaccaagccuuccaaaguuucucugagagacagcaaaggaccagaugauggugacucuguaggggucuaggacacuucccagcccuuugcugucugcuguagacaacuugugcagcuuguucauacacccagcaagcaaggggcugagugagugagugagugagugagugagagugagugagugagugagugagacagaaaucucucagaccaacacccucauugccauuucuagcuggugcugggcuguauagaagcucugccuauggaaguuucaacuuugccagauuccaucauggcccagcccagagugcagugaguaccuggaaaucccuggggucugccagcagccccguuuugcauuuaacaaugucccaaaccccagcacauuuugagcccccuccccaccuccggauccugcuccugaggucccucaguccaugguacauucaagaccuccucucuagaaggccuggaccaccacacuuaugacuugcuuguauguccccagaagcuggcaacccaacuuuuuccuuuggaaggcuucuuugucagaguggucggggacagguggcacauccacguggcccacacgguacuuguugcacagacggcaaagcacauugcugaggaggccccucaugacgucuauaguagcauugagcuugaccuggaggcucacggcagugggguucaggaccuucuggucccgggugauauuggucagggaggcgcucagguaugcgaccauccgauacagcuccaccaacuuggucuucucugucccguugccauggaaagaugggaagucugucauguuaggcgcacauagcuuuuccacguuguugggaaacggcuccccuugagcuguguacugcagaagagaggagaggugaugugggagucagggugaguguucuagcccgccaccaacccuuggggcaagcucuugcacuucuguuuccccaccugugacauggggacuccacuugcugcccuguaggcaacuagaaucauuagucagcaaugaucagaaaugugaacucacucaccaaggucacggugacauaaauggauagaggaaauguggcaugucgcaggugucaccucagccagaacaccacauacacuugcacuuucagucaccccagccucuuccugggccccccacacacacugcuuucaaugacaccucccuguccauucacugcauagccucuucuuugguacccugagccaugggacaagacagaaagcacaguccccgccgcucaccccaacuugcuggcgaguggugcccaccagucucugugcuuuggcuaggguguggggagggagccauggguucccacagcgcucuuccagcucugaagggcaccccuccgggccaggcagccccccccuuccucaguaccccaggaaaguaacuuacauaggaaaugaagagagcauuggcgcugccauugagcugugccaguugauucuugaucugguucaugagguugccguggcauggguggcguauggcacagguggcauuuacaggggugaugggaagagggcucccugccccguguuuccagugcagaaccagcagcaguaagggcacaaucccuggaagagacacggagggugacuggaaaggcaagaagccuggcugagggucacggcacggggguugggggggcaccucagcgaggcccuuccugcccccucccacccuccaucagccuuuagucuccugcucuacugagguucccuggcucucuggcuuucucuuucccugcucccaggccucaguuuccccaucuaugccacuggauuaagaggcaagguaucaaggugggagccauuuguaccaacugaaagcuaggucuggggggcgggggcacucaaccaucuagccucaucccuccugguacccuagauggaugguauuagguccagcagaggggaagagaaauaaaccguccuccccuuuccaggaccggccagauucuuaacuugguugguguccauuggcccacuggagccuagaacucugagcugaaccccuugcaggccgugcaggcugggagcugggguuucuguagaccaucucuuaaaacugccacuagacucuggcuuccuaaaacgauugccuuuaaucccaucuuccucaaugaggcccuauagagaacuuuccaccuguuuguucugcaggugcccacucuccaaccaaaucaucuuucaccccugcuugcuacagccccccccccgcccaaaaaaauccacauacuuuggaaugagaggaaguggugcaaccaggaaagaggccgggguggggaaaggucgcaggcggacacgcaagaggaaagcgaaaggugucaggagagccgggagcuguccgggccugucgaggaucaccccucccccggggcgccugcccguccuucacuuuuagcuucaccggcccccucaccccagcuccagccuuuccaacaccaggcuaaagacaccagaaggugauagaggcugaagucaucucuuaagggaggcuggagaccucccaccugaacuccccauacugggacuaaaaagacccuagaaccuuaaguuuacuccccuggagucuucuauugaucucagcauccccaaacacuguuagggccccggaauagcugcggggguacccauaccugcaucucaucucgcgccaaucacagcuuuccagggacuagcagacggaagccgcaccugcgccgguccuggccggaguuugcaagcugcucagccgccugcgccccucccagggagcagcccgggacgcaguuggaaaagagaaagcggaaagaaagaaaaagaaagagggaggguaaaucuaggcgacagcggagaaguaagagcagcacaggagagcaguggggcgaggagagaaggcgguggagcaaggcuacgccggccaggucccucaccgccaaccugcuggccccggcgggcugggcgcgcggugcccggaccaugugcggcgcucgcucccggccgccacccagcgccuccggcgggcccggacugcgcgggcgccccaaguguccgaguggcgcggcgggcgggugucccgcgggugcucgcccagcgccccaggcugccggcgcgcccgcagccgggacucuuaaaucggcgcccggcgcauggauuuaccugcggccaagaccuucauuaugggcuggacuccagagggccuuggaggagaccuuagaugcaggccguuuucagaaguucaugcucaaauggggaauuugccugauuuauauacuggagccuguguuguaagacagagagaaacagcuauauuuagccgggauccccaguccaggaaguuguuugaggugcaucauaggaaauuaugaauggaagaaagugagagugaagggggaggggggaagagugaggggggaggguggggagggcagacuuuuuccuucuucuaagaauuugauugauaaaauuauaaugaagucuucaacaacaacaaaaaaccgcccugugguuuuccuaagugguuugcucugggcguuuuuugcagaugggucugguggggaaagggucucagggggauucagagggguccucagccugugccccccuucagacguuccaguuucaacuggguuugggaggguggcaacagacuggagguuaccuuuguguccccugguggugguggggcuuugcggggcagcaaaaggagucaggcugggguuccacugagaagcaguuucucagaaggggggccggggcccuuuugaacuuuagacagccauaaagugaagcagaauguggacgcugggagucaccuuagggguggccuuucuccagccuguccauugccaauggguaaagagaagacacaaaggggcuugcugccagugugccagagggucuugcccacccccagccaucagcaugcccccucuauggaggacugguaagaguaugagguuguaucgucuaucugggaacuaucugggcaagaacucagccuuacuacguugaagggaccccuaaagcaaugaucagggaggcugggcaaaauggggcuccugcuuccucugggugccuaggaauggcugacacucuuuggaagccccuagugcuuggccucagaguacaaaggugacuccuaacaggugcuucuuacaggucuacggcaggaucccgaggcagguccuugcugguagguuagagacucucugagggacaguggggaagaagacaggcugaaauaagaccagggucuccccacuaacuaugaagcaguacagagaagcauucggcgagagagcacugaccaaacacaccuaccuagggccaugcuaucccgagccauuggguccuucuagaccuggaggugucauugcgcugggggacccuaucccaaccuuuccaucugaccuaaccccagauccaagugggacaauuaggguuaccaaagcguugccuggcuucuccagccccuucgcucacccccaugucccuagcuccugcccugagccauauucaggaucuacucagguguucuuauccuagcagggugccuugugucuguucuccuugccccgcccccacacauacaccccgcccccuccagauucuuguuucuuguggucuuuuggcagagccucgaauaguggagugaugaagccaccagguuggcacccuuucuuucucccugcauccugacacaccuugucucuucauuggugacccugucugggguucaccauuccuguacacauagguuagcaugugacuccacaccccacacaucccagcgccaccgcaccagaacuacucagagcacaccaggucugaaucggcccucauccaccaucacgucuuccgaacagcugcugucugacucugccugguguccuuacaugggccccaauucuaucagcccagaaagccaucaugguccucucuauccaccuccugcccccaaggcuaaacaccucauugcguguuccagucacggaggaccucaucccuaacggccccacuccugugccuggcucuccucuacaucccuccagagcacuuccaggccuugcacugcucucuggaucacuagacccccacauggguccacucaacagucauuucaucucggcuccacccugcaggaaacaggaggugggaacagguuccagaagacacugauaagaggaccuuuugaguucagugaacuaguugacucauuugugccucaguuuccccucucacaguaccugacuuaguccaugcucccccagugcucugggccccuuggugcaccaggcccugccuccugcuccaguccaugucugagcaccaccugugacaggccucugaggaggcaccaggaaaggucuccaagcagagcugagccucugucuucaagccgccugcaacguggcuggcgugagcuggggguuugcauccgucccucccucucugugccgcuguauguguguuucccucugcucccucacagaagacauccucccuucuuggcugccuguucccaggguugugacccugggccccgcccuggaguggcagccccagcccagccucuuccagcugugacuucaucugcagccuguccagcuccugcacacugggccugcuagggguuugacaggcuucaggaugagggggacagcccguuuccacccagggaaucccucagcagggauaggggcugccaugccaggcccaggugcaguauccagugcuucucuccaggaagugagauuguagacuggucuggaaaccuaagcuagccugggccuucccaaagcccuugagaguccucucuucuguccacuuugacacauagggccagucagccuugccuuucccauuagcuuucacucaacagucacaacucucucccaggaccucauagccacuugcuuuucacuuauggagguuaaggggguggcagguaaagaucuauacacaaagaguuaacggcagagcuucuggcuugcaagauccagugaccccucuaggaggcaauggcuuucagaaggaagaaccccucagcccccugcagccugacccauucacucagccuugguguucauucuuguuucaaguaggcacagauugcuugggcucugggggcuuggaaaggggucuguuccagacagugauggucaggagggaccacucugcagaucccgucuauuuuuaagcauuuuacaccuugaaaguggucugggcaaagguaggaggagcucuggugguuugaagcauguguggacuuugaccucauuuagaagcaggcuggagauuuggcucagugagguacaugcucuguggcuuuugggaaguggacccuucacacacacacacacacacacacacacacacacacacacacacacacacacacacagggcagacacccccaaucagggcuugagaugaagaaagcugcugguuggaccuuaccagccaggagcugauucacccccagaccccaucugaaaagcucagcucaaaggaauuugaaucaccagcuucccccugcagagcccccggggguaggggguggggggaaacgcgggggugggggcuagccccuugccugcuugcugggcugucucuuuccugggcccuggggcucucagacucaggagagaggacagcagagcagugacugcuugcaagguuuggggagguggccugccagccaggcauccugugugggcagugguuacucagcagguaaggaagcagcucucugggcacugggaauuccccaagaccaaugacccagaugcugagcugcuccacaggcaggccagcccccccccccccccccccccccccguucucccugcguccuccccugaacgaucucaguucuucaaaacacagagccucagcugggcuuuggcgaucucaccugaaauugcugaaaggugagcacaaaacugugcucugagaggaaacugggggcuggaggaugcuucucaaggcccuagcuggugacaggugucaaaggaaauaggagaaaccugagacugucccuggcauggacuaggcagucgauaacgugccccaaaaggcagaggcggcuccauugucagccuugagaaaugaggguguccuuagaguugcagcccugacucugaggcacuguggcgcugauacccuuaaguuaauacuuaaggguuguuacuuguggaacacuggaugaacuggguagccgaacacugccuguguggcccugguugauggcuccucucuaagccucaguuuccccucugaaaacaauucaggguagaugcucagucaacucuggccaacggggaauagggaguuuggaccaggccuggagagacucagcauacuuugcugguuagggcuggccuggcuucugagucucucaguccuuggggguggacauggacccugguaguggucagccuuggagaauaucagcaagccguccugugucaguccugucucagaccgagcacugccauggaaucugcagcuucuuacccuccccccaccagaucucuggcaggcaccaauggcacccgcucagagccaaagaagagccucaaguagucuggccaacagccaacagccccagcaucaccccgacacuuccugacuaguucugcgucaggaaucaagccccuagaggugaaucagagugucugcauccccucccccucuucaguucuagaaacagcaaaggaaauagcagcccacagagcugacccucaguagggccagaggccaggguguggcaugguagguggccagucccacccuaacacuacccuccgguccuuuuucuguaaguuagguugcucucccccaggucaggaguuuguguacauguugaauaagcauucauacuuuggcccuauucuccugaauguccaggucacagagauggagaacaaugcucucacgccggccucuagcaccucacgagucacagguacaaguuacaaggagcuaguagcaccuucaaagaaaaaugggaugacaaaauacaucaacauugccagggcgagcauggcccccugaagcacucuucccaguuguccacagauagccacaggaacgaaggccuggcccacacggucuaugugacuugcccaaggccugucagcagucagcagcacagggugccugacuucaacuguggcuuccacuaaagccagcucaggaaugggccagaggugcauuaugggcccagguaugggcaggccagaggcaugguguggggguggaagccuggcaucaggccuagcagugacgaagucccuugcagagcccggcuucuccagaaccacuuccucccccagccuuagacccucagggcucccugccuugccuaggugaggcuggggacagucacaacuacggagccuuugcucauaggcaucaggggcccuucauacacaccacaggaggaaguggcugggcuccuucaggguggccuaggccaggggcccagcugcguccagaagagggcgcucuacagaaucccugagaaugaggagcuucccggagccugugucugugucucagggagcuuuugugcuugugcggugucaguguugagucugcguucaucagugucuggcccugguguguguguguguguguguguguguguguguguguguguguguguguguaugcacuugauuagaguguuugugugugcacgaggcuaaaacagagcugggcuuugcaaguccuccccucaccccaagugugugagcaugcaugcauacacacaugaaugcauguguguguccaugccugugugagccugugugggucugggugguagccaggcaugacccugugcaugaauaugcauguguccuugugucucugccuuucgaugucuggcccccgucccugggaaccuuagggcagccucgugucaugggggccaccagcaacugguucccuccccgcccugccccucccaccccggccacccuggauuuuuggcucagggacaacgcugaugucagagcucgagcugucagcuuccuuuccccacuggguuuuccaaaagagagcgagagacuguagcacggcugcuauuaaauaaucacggguguguaagguggggguggggcacccguugguuuccugaacuuggaggcaauaaacagaacaggaagcaacagugggcagacacacaggaaguuggaagcuggccacagagguagggccuggccucaucucuguccccccuucuaguuaaacucacaagggccacuuaaccggacuaagaggugacacuggggagguggcccgagcccugacuacaaaccucagugccaggaagacuugaaaaaagguccccccacccgccaaggauguuaggaaggggagacaugagggagaugagagagaagaaugaaggguuccauagugaggugagggugggagaaagacucgucagagugaagugucuacuuccugggaaagaaaagaauaagcuuucggcuguggggacagaagcagguggagcugcccggacagugggccauagccaggacuggcuauccugucaggaagcacagggucaaucaacucuugucucauacuagucccaaaaccuggggucucugcaaaucucgaagacccuuccagggcucaagauuggcaugccagucucagggacaccccccccccaauccacuccagaaaaucauacagagugcucagaagacccccuaaggccuccagcccacucccauuucuccuuugucacacuuggaaacugaagcucaggaguugaauuguccagggucaccgaagaugcaaaaccccgcguucccacccuagcccgcccucucugaaguaaggccagggacaucuaacggguaguugggacagcuaggagaugcucagggcagcaagaucugucaggagcucuggggccagucaucccaggggagcaacccucgcugccuaagugcuccagguagccagugcuuaucagccacagggcuccgugacaaaauccacucugaucuccugcccagcuaaccucaccccaccugaccccuggauccugcuucuguucccugccuuuccaggugagaccugugcccaacccucaugucaccccucagcuguggcaucuccucugcgaagacuuggaccugcaggcugagagggaagacuaucuuagagggaagaugguucucuguaacagucaucuuagcaccccccaccaccacacagaguccuugccugucuuuccaagcagggugcgacucuguuagcuggaacagaggggccguggacccuggagucugucagaccuuagacucagauuuaguugucauuuacaaggugcgccaccucaggcagguggcgucaucauuuaaaccucagcuacgacgugugcaaaauugauaacaggaucgucaaucuuaaguuggcaaagccacaagauacaccuuuauuauagacaucuuuaucugguacagcugcaaaggugagacccagagaaagcaugccacuuugccaaagccacacaacaagucagugggccauccuugauaauauaugcccuggugcuuguccuggguuccaagacuuccaaacuaguuugcuugugaagauuccagagaggacucgcucccugagauccuacugccuugauuagauccagucauugacgccggggguguggaugggcucccucuauaaccuugaaaccugaacuuaggguucuuugcccuguaaacgcuuagcagcuccaagcccuggucagcagcgccaccugcugcccagaaucagcaaguacagucggcucgccagcucgccuguucaguccguaccaguagguggguggggcuggauaacuggauuugaggaagugagugggugucuggggugcaggaugggggugggcagaggccauucaccaacacaagggaagaaggcuccucuugggggcuuccagagcuuuguccuaauaucugcaagguguagcccaaaagacuggccacaaggaggugccagaaccacauucaguggucaauggggcacagccuugccauggcucugggggagggggcaguggccuuuuccugguccugcuaccugcucccaccuuguccugacaguucuuccagguggggaucagacugucaacuucgcagggggccacggugacccagagaaggaaaaugaacugcccaaauucacacagcaagaggcaagaaucaaagcaaacuaaaccacuugguuguacagacuagucccaggcuccccuuacuguccugucccggcauggcaugacauggacaggauccugggaacaauguccccuccuuuugucagcccccuagcagguuuggaggaacacugacaaauuagagguaagagccucuuggaauuuuggaugccaagcacccaacgcagggggcucuugcacagacuugguuuuuguuuuucucucuuugucacuguccuggagcucggaugcgggggggacgaagaccggccaagcuccgaucuggcccaaggucaaaggcagaggaguaaugaccuuggcugaucaaguuccccagagcacccaugaugguccccguggacugcugcagcccauuuugaauggacagggacggcccuccacugcuccaucuaccggaggguaaaugaggccucugcaagcucagaacucuagaaaaagaaaagggauuugaguccccuggggaugcagaaaucaugacugccuuuagaaucaggcugacccuaccacgauggcacaaugcaagccuggaauccaugugcucucuccacugcccuuuacccauccugugaacuuuaacccacgggacacuuccacagcuggucucuccagcuuugcuuggccauccuccaagagagacuuccaagccugacuuacaaugcauccauuacagacagggagagcgaaugcuggaggguugugugggccagcaggugccccugauccacaggggagcaacugauggaccaucuacccuccuggggauaaguguggggugcagcagugccccuccgcccugcccccucaagggaauccuaccguggucucgcagcccuccacagucugcacaguuguccagucuucagggugacaccaucguuguugggccccucugcuucccucuccuccugaggcuccucuggcguuggcuccucacccugccccccaccugacuuccgucugaaguugguggccugaggcuccccccacuuccaccccacccccaagcugaggaccagagagguagagcacccacaccacagauggagccugacacgguggugggaaagguguuguuagaaggagaagcagggcug

SEQ ID NO: 5856 - RNA, 7845 nt, Mus musculus
uguuccaauaaagcuuuauuuacaaaaaaaaaaaacaaacaaacaaaaaaaaacaaaaccaaaccaagaacaacaacaacaaaaccaggcaggcagcugaauuuaacaugucaaaauucaggauguucagcuacaucgaaauguacuuuguaugcaacccuagaccgguggggcaucuagagcugacagcauucguguagacugagcuggcuuggaaaccuaaugaaaaggaaaagaacaaccauugucauggaaugcuacuguguaggugacaucacguguauuuucuguguaauaccucguugucuuaacagcagccugggaguugagcaggauccaccauuuuacuuauaaggaaauggggacucagaaggaauaugaggaguccuggcccgcagagcuggucaggggcagagacuaagcugggacacucggggccccaaagccugugccagcucacacagccccccuuccugaucugauggccaaagcucagagagugcggugcggcugccucuagagucccaguaacacagaagcuccagguggauaaagaacugccugcccugcucauggaggucccagggccacccaguccuagcugcaaaggugacaguggugacuucucuaauuaccaugcuuaugcauguguguguauaugcaggagagcaugugugugcacaaacagauccacagaugaagaaccauauugugauagugggacuggagcucuggaucacgucgcaagugucacugugaccagggagcagauuagacagagcaagaugaugagagguggcugauugguggguagauuuauagauuuauuuauauugauauauuauauauuauuaauuuucauauuauuguuauagauguauguuauugugcuuauuguauuuguuuauuauuuauauuaugguuauaguuuuauuuauauuccuauauauuuauuauauucauuaauuguuacuuauuuauauuaugguuguagauuuauuuauacuaucauauacucuucucccugcaauagcagagggaugauucuugacaggugaggacugcccagagcauugcggaacaugcuuaggcaacaucccagcauugcucuagaccauuugaagccaggaucccccagaauuggugugugccagcuaaaaacaucuccugagugccaaggugagggaugagaacuccugaugcugccuguucugggcuugagagcuaccaucccuggcccgaaggcccccgaucuccccaaacauucucugagaaucuucuaggauucagaauccagccaaacaguaucaggaaagcccaaacacagaauuaaggguuugacauugccaagacaugagcaaaacagagucccgugggcacguauguaacgcugcugaagggaagguuccagaaccugucugcuucaaauugacuccagguucacucgggcuuguucugcaggacacaggccggcucugaaggcccuacagaccaucucuucuuucuuucuuucucagcccacccaccucuaccuccagcagguguuggaguggauuccugcaggucccuuggagagagucaggggcccggggcugccacagggagaggggcacccggguguaugcacccugccauguggguggcugacuucuuuacgucaggcuggucugguggagacaaugaccucaccugcuuggaagagcccuggaccgcugcugagaucugggauggggaggggucccaaggcccagacagagaggagcugggggcugagaaugccccuccucugggccuggcugaggcccagcauagcugccuguggucuggccccaaagcaagggacagaccuccucuguggcuggcaccggcucagcagccucuucccagccacguuaagagaaagagagaagggcugacgugggccugaccucaugcccagcccccuccaacagccucugucucccucggccuggccuucuaugcuuccaggaagcuggaccucccugcaccagggcacggagucugcagagagcuuucuucauuagacugggagacaccuaagcuccucuucuacccuauaggagagcugggcuuagccuucugacaguuucuaugacaguguggguguggggauucccaaaauucaugaugcuuguagcagguggggcacugacaugcaggugcuaccuggcuggauggagccuugucgcagcugcuugcccugggacuuaggaggaggcuguggacccuagaauucaaggaacuuaguagaagccacggggccugugccuuaaggcuccucugcuccugucaucuggauugaaccuaacccccgagguuccccuccaagugcugaauguaacaaggcuuuuugccagcagugaggggcucccuagcugcacccaugacagccugaggaauuccccuaaucuuuuagggaacuugaaucaggacaaccuuaaguuugugacuuccacucggaaaauaauuucaggacuagcuauuuuacaaagccaaguuagaggucuuacuaaagauuuuaauguaaauuuaagcaugagcguuaagagagagagaagagcagggcgggacagugauguugcacaccuuuaauccuaacacuugggcggcagaggcaggugggucucugaguuggaggccagccuagucugcagagugaguuccaggacagccaaggcuacacagagaaacccuguccgcauguagguauggaugccucgggggagaagagcaguuaauaccuguggcagaguccuaucucuguaaaugaggcuucuagugagaguucuagaaaacauguuuacagcuggggaggagaauggccuuaagcaguuguuaguugugcuggaaugagucugcuuagccucaaccagaugccuaacugaggagugguucacagcucgcucuaucucugccacgccccccaauuuuccccggagauagaccaagacccgagacucuggcugcuguuuguuuguuuguuuguuuguuuguuuaggaggguuuguuacuaaagauugaacccaaggugcuaggaaauuucucuacauugaacuauauccaucuuacuuugagacaagagucucucuaaguucucaagcuggccuugaauucacucuguaguccagacaagucuugcauuuggugauccuccugccucagccuccuguauaggugucauuacagguucaugaccccagacccagcaagauucuccauguuuaagcucuccagagcaugcacagugcuggcugguguucccauuuuacacacagaguguguuuggauagcuagcccagaccccagauagugaaagugugguugcuaucacccaggugaggaaucuacacacguucuguauguaugcaguaggcgcucaaagagcaagguucuugugaaauaugauccugucaagagaaaguuggauagauugcacaacccuggaaaagcacaccaaggagcuaacauugacccagaagaacccaaccuuacggagccacagaacacuucacacaauucaugacuaaguaaccucuggcagaauagcuuucaagaaucagaaucucggacauagcaaaagagagcugacauacuagacaaagggaagaaccaaaccaaaugguaggccgaagucaggcuguggacgguguguggcugagcaaacuucuaagccccugcugcagcuagagagagacauugagaaccaggcaagcucagaagguuagccuguacaauggaaaugccaggcagcuacaguagguuguuaaacaggcucagggccuugugccugaggacccuguccacacacaugaagucggccuugagguggggauuagguugugacugacaagaaaugggccuuauccuguuggcaucucuugcagaaaccuuaaaacuuuugaagugagauggcuugaucggacugauggccuugcggcaaggagaugaaggcuguugaaggcuguugccacaacacaggaggggagcaacagggacacagugaggggggacagccucaggccacagagaaucugaugaguagcuuugauacagguagaagagacgcuguggcggagauguggguguguuggggaccagguuaauccacuuucuguugcuguaacaaaaugccugagaccacuugaaaagagcuguccugugauguacaggcuuggaagucugagacugaggaccacggccugcuuucugcuaugaggcagcacuguguagagcgagagccuggagaagguucccacaaucccuaucgcggcucccuccccagagccccagauccagaggcucauuuuuuaaaacacauuuaucuuacuuccuguguaugagugcuuuccacacaugggugccuagugcccucagaggucaaaagaggacuccucaugacccggaaccagcguuauagauggcugugagcuguugugugagugcuaagaaucaaauguggcuccucuguaaaagcaagcgcuuuuaacuguugagccaucuuuccagcucccugcacccuucuuuaaggggucaagccuucggagaacacuuacccaagacacccauagcagugucucgggguuguccuuacacaucaccacaaguagguggcuuccuuccgucaacaaaacacucuuccccuacucucugagaaccacaaguguaaagguaagauauuggcaggaccgugcuuccagaaagcccuuccuggccccacagugucacucggucugccuuccauggccaugucuccugucuugcuuuuguguaucucuuagaaagagucccuuagacucuucuuagagucuaagagucccuuaggauucaggcugaacagauaauccaagauauugccuguugaggucccuaauaugugacaucuguaaagauacaucuccugaaguuggggucacaggcucuagggcaucagucccagaccuguguuugugagcaggauagggcagaaguuaaugacggcccugguaggggcugggauggggagagcggucaguaggggauucaggauucugaaccucuggguuuccacgugucccuugccuguguagacugaagaucaucccuucuggagcugggaggguuccagcuggccugcaggcccagaggcauggggccuuggaggagccaggacgggcugcugacagguagagcccuucugggcuuugauucauugaccgucugggcaggagcuggccaggcugcuaagaaugagaaaaaugccucacacauauuuuccucucagccagcgguuucacucagugucaguacaguggagagagccugucugcuccgcuugcugaaccccagccugguccccaucugugguccgucugcggcucccucucucuucuucacacacacccgcccccgguccccgaggcuggauggagugggcagggcuggaccacguccucauaauugaaauacuuggcgcuuagggugaagccagacuuccccaaaucaaagggacagauucaagcugggccucugugacugcaggaagccccggaagcugccaggaugccaaaguugguggccaaagacuuucggucagggucccaaaggacucaaguagccuuggaacaaggugaggacagacacucaaggccacaagcccuagcccccuggcccagucucuuuuucugccucuuccucagccucucacccuggcugcaggacucugcccaucgcagagccuuccuggagaggccccgccgccuguuccauggguuucuuauagagcagugaaagggauuugaagguuuggagagaugguaaaacagauagcaguggcgccuuuguccuacaagcaugaggagccagguuuggaucccccaaacccgugggaaaaagagggacacaguaacacaggccccugauccuagcauggggaggcagaacaggaggauucaaggagcuugcuggccagccaggccagccuaauuguugugagccucagguucaaugagacacccuuucccaaaaaaaaaaaaaaaaaaaaaagaugaagaagagcaaugaccaauggaggaaagcuugugcugugcugcucuggccucacacaagcacacguaccacagaacucucacacgcaggaaacauaaagggcuuugaaagugaagugagccgggcagugguggcgcacaccuuuagucccagcacuugggaggcagaggcaggcaggagcucucaguucaauauuagccuggucuacagaacgaguuccaggacagucagggccacacagagaaacucuaucuccaagaaaaagaguaaagaaaagagaagaaagaggacaagguggugacggccugagggaggguccugaguucaaggguagccaggggcacaaaugaaacccugcguccuuccucccucccguaaagagcuuugaaauccugagggcagauggaggcuucugagaggcauucaguaccaagacucaaaagucuccccuuagggggcgaucaaagccccgcuacacaucugucaccugaaccccuguacaguccugcuugguuugcacuggguugcagcauuugcaccgacuucaguaaaauccaucucuuccggggauauagguguugcugacaguagggcccauggugccacuggcuacccacugccaccggccggggguuucuuggggaaaguuccccuuggaacccagccccacgccccagaaaugcuugccucaagccuccuccuuucuaguugugagacucacguaacaagaucauguuucccuuucucccuuugcugccaggaaucuuugcagucuggccacggucauuguguggccccuugcccccuggaacacccucaccccaccccuuggucuuagucuccuuacucaguuuguaucuucucuguuguuggcucucaguguuaucaucaguaugucuuaugugcuuuccauugugaauugcugcucacugcuuugagaaaaaugaagacuauaaucaggagauaaacacacucgggcuccauuaugccauucacguguauugaugaaaacugggugguuugcuacaauaaaugaauucuccugacguauucucuucaaaacuuggguuuuagcucaggaaauucucuuucuucuacguuaacccuugagccccuuagguaaaaagccugguacaaaaagacccuuaucaguucugaccauguuugcugucaccagguguagaccauggccagaaacagauggugacuaccaaaugaugucucuuuguaaacagcuaagccugaggacuuguggaaccaguggaaugucuguuagcaauuguccucuuacaucaagggccuuguccucuugaauuccugggaacccaaauggaauccuauaggcacauuacccaucccacagcuccaucauguaccuaagagcaugaggccuuugugauccgguccugaggaccugggucucaguuaccaucagggaagcaauuguugggauauugguugaccuucuccagauugucccuggcauccuuuggacucagaguuagcagaaccuucccuuccacaaccaucagggagccaugagacucucacagcaaagcaggcagcugggcugugacauucacccugcuuccugucccugccauccuuggcuaaacaagcuaggccaggcgagacaugcaauucacaugacaucucugucuuucugucccuuagcucccucgggcaccacuuuaaguaaagagggccgcucuccucucugauugcucucacagguucauagauugagagauaaacggugauggagagaggcaaggaccccagccaaccuuucccagcaca

SEQ ID NO: 5857 - RNA, 95308 nt, Mus musculus
caggaaaagccguuggccucugcugagguaaaggccgaggggaaggccucgccgcguguucacacgcggggucuccggaggaaggcguucggguggguucuggggucuucaaguucacacuucucuguucuuuuuaauugacuggguucaucuguggaacucgccagcccucugaggagaaguguaaucguguaaucguggcggagggccaacgaggaccggaagcuucagguaucaugguugccuacucuggacggugaaaaacuucacacguuaaacaaagagcugguggcgaugcgguggcgaggaaugaacugguagaccuugaauuuccaucauuuuaauagcugaaugauuuaggccuuuuuuaaaaguuggaacuggagaucacuaaauuaagugaaauaagccagacccagaacgacacauagucagguuucccuaguguguggaaaccugauuuagaugcacauauacaugauaggagcaugaaugggccguguaguacguuaucugcucaccuagugaaagcaaaguguaagcgugguucuugccccuaaaaggugguagauuuuauuaggacgauagccuaauuucuccuucaucagaccauucauuucuugaggcaaagaccauauuuaacuuuuuguaaucccguguuuuaccuggaacagugcaaauugcacaguaaacguugaauauauggauuaauggaacuagcaugagaaauauauuuuuaaaaaccaaagagcgugaacaaauaccuaauuaauacaguaggaaccgcuuaguccgagcaagcaugaaguagcagaauuaucagggacaaauggaauuugugaaaaugguggcuaauaauuuauugacguacgcucagcaaaagguuuaacagggaggacuugggcaaaccaaauucucuugcugaucuucaauuuuuuuauuaaaauuugaugguuuuuguucguguuuuuuuguuuuugcuuuuugagucaggucuguuuguuuguuuguuuuuguauuuguuguuguuguuguuuugagacaggguuucucuguauagcccuggcuguccuggaacucacuuuguagaccgccugccucugccucccgagugcugguauuaaaggcguuuauuaaauccgguuugagucaggucuuuguguagcccugcuguccaggccuccaacucagagauuaccugccccucccuccugaguaccaccccaaaggugcucgccauauagcccagagcauuuuacuucucucugugcacaucuguguuuucauacaccuggaaauucgugugcauuuggaggucagauguuagugucuauuaccuucuuugcuugcuuaguguuaaaaaaugguuuuuauuuguauuauuauuuuuuaacuuguauagguguuuugcuuuauguaugugggggccuagugccuacugagggccgaagagggcaucaacuuuacugggucugguguugcaggcaguugugagcugcaggugggugcugggaauugaaccuguauccucuggaagaucagucugugcucuuaaccacugagccaucuccccagcuccuuuacccuuuuuuuuuuuuuuuaaagacaggaacucucauugaagcuggagcacuuaaaaaaacaaacaaacauacaaacaaaccuucaaaaauaccaagcucaacagauauaauuuuacucuuaauuuaauucacaauaaguagucacauacacaaaauagauauaauauacuauguauugcaaugaggacauaacuugagcuuggcagaggugguaguagaaaucggggcauuguuucuugaaaaacuaaaccauguccaggagauaguaauuugaaguagaagaggauguuucagaccagaagaauauugcuaagagaaaguaaagcuguacaaaugacuggugcauaagaaauaucaggggagggcuggagagauggcucagcgguuaagagcaccaacugcucuuccggagguccugaguuuaaaucccagcaaccacaugguggcucacaaccauccauaaugagaucugacgccaucuucuggugcaucugaagacagcuaaaguguacuuagauaaaauaauaaauaaaucguaaaaaaaaaaaaaaaaaaaaagaaagauauaccuuuaaaaaaaaaaaaagaaauaucaggggaaaugauugaagaaauuaggagggcaugaggcaaaucuugaaacaaugguaaagaguuuuuauuuuauuuuuuuccugaggguaguuggggagcuauguuaaguacuucaguuuggaaauaauaagacaguuaagguaguaaugagaaaagucuagcugaaacguagaagggagauggcugagcacagcaacaggcagaugggugguugcaacaauucaggcaaaagaugaggcugaucugaucuaaaguagagauggcagacccaguguaagggcucacuguaacccgagcauuucugaaguggagccagcagaaucaucucaaguucaaggcugcuuggacuauagagcaaguuugaggaagcuggagccacguagugagauuccacaaaacaacaaaagcagccucaacaauaacaaggaaagaagaccccuccccaguaucagcagacaacaguguggaaaaagugagcagcugacacauuugagaaauacuaaguugacugaacaaagaaauagggcagaguugagucauacauuuucagacugagugacuuaaguacuugaugaugccauucgcuaggaaacagaggguuugaggggaaagaauuagcauuuggacaugcuaagaccaucaaagugggaauugucuaaugggcagaauuguagaucaguaacucaugagaaugaccuggguugggaauauacacacacaaaucauuagacuagaaauaguaauugaaauaaugggaguauauuuguuuguucaguggcuauguuuagaaguuuaaaaaaagcugagcaguggugguggacaccuugugucccagcacucaggaggcaaaggcagggcgaucuuugugaauucaaggccagcuuagucuacagagugaguuccaggacagccaggacuacauagaaaaaucaucaaacaaacaaacaaacaaacacauagaaaaaccguuaaacaaacaaacaaacaaacaaaaaaauaacagaagacuacuaggacagaaacuugaggaaucccaagaaggcaggaggaaaagaggcaggaggaaaaggcaggagaaaaaggcuggaggauggugggaggagccgaggcugggaaacaccaggagaggaagacuuaauaugcaggugcuuuguuuugaaagcaaacauacuuucuuacauuaaugaaguguauauaaaaaacuguucuaaguaccauauuaguuuaauagauuuaauguugaaauaacugugaaguagacacuguuuucuguacagauggagaaacuggggcccacaucuuguccaagguuacauaguaaacugcccacugagaugugaucuuagguaguuuguuucagaaaguucacguguuuaaacccuggccuauguuacuauuccagguguacagugagcaagaccugaaaguugggucuguauuuaugguuacaaaaacagaaaccaaaucucauaggaauuaauuuaaccagaguuauacaacugcuagguaauagaauccaaauuugaacccaaauuucauaauuacaaagccuacuuuugcuagauugcauuguuggcugauuuuucuuacauauccauuuguguugcauaaaauugaauuuuacuuguuuuauaaauauuuuuaaauuccuuuucagaugcaacagcccugguagaauuguuuuucaguacuauaaauuucaucugggucauccauauauucuaaaaaugcagguaccuaacuacgugguguucucaugggcggaugccccuggaaauaucuuaugaucuaaaaagauuggcuaaaauccuagcaauauaaaaagugauuuaaaaaccauuauuccuucuauuacugcuucuccgguaggagguuauauucuaaugggauagaacuggaacuuaaacccuuaucgcuacuuuccuucuuccuucuuucuuacaguauaaaggagaugcugugagucagacucaacaguuauacucuaaaagaaaacagccuuuaaagacuacucaaggaccgcuagguagaucucagucuccuguagaaauauuguacuaguguccccuagugcugcuugaagaaauaaucuaagagaaauucaauaguaucuguuuauagucucuaucaccaccuuguggcaaugucuccaaauaauucuaaccucuuauuugcaaaaaucuuccagaaucuugucuuaauugauaauauaacagguaacagauugcccugagugagccagaauggacuuucuuuaaacagguuauuucaaguaaggccuccgacugaaauaaaauuaaggccuucagaaagaaaagggaagauuuacuuuaaaaaaauuccaccgaagcaaaaaaaaagggugaauaaaaaauguuuucccagacucggcaguaucguuguggauuuccccaccuccacuguguucuucauugugaucuaugugcauacugggggacugaccaugucagccauucuccauguuuagucuagucauacucagcugucaggugacaauugcuacccauuugcaguuuccaaaacaucucaucaucaugaacagaaacucuccuaguaaacugccauuucuucuauccccacccgaguccagauaaccucucgucuacuuuuugucuguauauguuugcuuauauguagguucucauauguaagcacauguauuuguccuucuguaucuagcguugucuaauuuuaaccuagaauugugcuugcaagguucauuuacauugugucauguuaccacaauuucauccuuuucuaaagauugaguagcccuuaaauaucacaaacacauuuuguuuaucuguuuaucugcuccuuuuuuuuuuuuuuuuuuuuugagauggggucuaguccaggcugacagacuccugugcucaaaugauugcccugccccagcuugcacuguaggugggcauccagugcaugccacugcccuuggcuguguguucguuugucuguuugucugcugauaggcauuggaucaucuccaccuuugaccgugaagaagagugcugcugugccuguggguguacacguguuggaggcacucccugcuccuuccucccuguuuauuucuuuuggcuguacacuuagaaguggaaaugcuggauaccgguguaacugcuuagaaaugugaggaacuguauacugcugggccguuuuacauuccagucagcaguggugaggauuuuaauucuccaucucuucaccagcgcuuauuauguuccuuuuuggagaaaguuuugaguuuguaaacaagucugaaguuaaccuaaaaaauguucugagcccagcugaacacaagaagacagcuccucuuugagggcacaacaaagaugaaugggauacauuguugagggcuuaggugacuuauaacuuaauuuucuucugagaauguguuuaugaaugaauaaauuauuuuaugauuuuauugaguugaugaaauuuaaugcagagacuuuaugccagauuuaguaaaagcuuauagugaaaauucaagugguuauuaaaauuugcuaccaaaauuacaguuaacuuacacagcucucauuuggaaaauucaaaauaagaauuuuucuaauucagauucacuuuugcaauuuugauagggcuaagaagaacuauuuuagcucuguuuuuccuuuguauuuacaaaauuaggcuugguaaauuuuucuuguaacaggacagucugagaaauugucuauacuuaacuguaauugauuuuaauuuuugguuuuaggguucacuuacaucuuuggaaagacaagauaguaaguauuauguuagggaaagucucuaauuuuuuuuuuaacagguuggaauuguugaaagaauccugauucauucucacgauggcuacugcgcagcucucucacaacaccagaacacugaaggcgucuaagguauuuguuaagaauuaaauagaaaaaucaaugaccauuuagugaguuacuuaauuuaaaauuucuucagcagcaguuuuaucagcuaauuggcacauaacacucugggaaaguauuucuucauuuuaaugccuaauggauggggauauucagaaaaucaagaccaauuauaaaguuaugcacuggguacuuguuuccugcuuacuagaguaaaagaaaucagaaacaaaacgacguuuaaagagaagguucuuuguuaggcauggacuuccugaagcaauuaggaagcuuguaguuuucagaaccagagaggagauaucugaaagaagcuuugaugcugagagucuggggaagaauguauuagucacuuccuguggggaggacaaaauauaugagauaauaaacuuaaaaggaaggaggauuuauuuuggcucacaguuucagaaguugcuucuauuguuuuugacucaguaucaagacagaacaucauggagacaugcagggaaaacauguggcagagcagagcggcggcacaccacagaggucaaggccaggaguggggguggggaggagacacucgacaaccuagugucauuccacuagauucugucucuuaaagguucugcugucuuucaguaucacagcagguugaugacugagccuucaacuuaaggggacauuuaagauucagacauaacuaugucaggacaggaaacuuugcuggcuuuacuuaggcuaguucaauaaaucccagaauagucauuaaugcaucacauacaguuauuuagauucaguauauaauauauguauaauaauguguuguuuuaugagaaaauacaaauugaucuuuaucuucuuuguuaucauauuaagaaaaauaagacuuaugguaacuggggcuggagagauggcucagcgguuaaaagcacugacugaucuucuagagguccugaguucaaaucccagcaaccacaugguggcucacaaccaucuauaaugagaucagaugcccucuucuggugugucugaaggcagcuacaguguacuuauauauaauaaauaaauaaaucuuuaaaaaaaagauuuaugguaacuaagucaauguaucuauauuuacguacacgugaaaaagagugagaccaggagaauugucccaugcuugagaccaguugggcuccauaguggguuccaggugacccugagcuagaucgagaaggugcuucuaccucucaaccuacaaaggauugcaguaauccaaacuguagcagcuuaggaucguuauauacucugaaaugaugaaaaggcucauagaggagggaacaucucaugaggagaccuagccuauaccuuggcucaggaucagaaauaagcgugggauguuuuaggggaagccgcucugucuguaguaaagcugugaagcugucauguuggccaggaggagaaaacaaaccagaauaggaauuuggggaacagauuaauuuggaucuuagaagccagguuaaagaaccgaugcuuuauuuuguagccagugccaagucagaagguuuguuuguuuagaagagugaguauggguuuguguuaggaguguuaaauuguagcagagagagaaagagaaguggaaguugaaggagaaauugggcaucaagcaagcagucaccucucuggcuuugucccaccguacuucucaagccaacaccaaaucucagccaguuuccuaagggagugcucucaccugggguugaguggggguguaggggucugaauugcagucagcagagcagccauuucucucacuguaaaugaacaaauugacuuuuugguucaaccagaucuuuguuguuugaguuacaugaacugcuuuucccaguaaauuucaugugacagugcgguuccgguaucugaugcugaaaacaaugggaauuguuuaguuuuggaccugggauaaggcacugaggugcauaucaaagcagaccugcccuccagguucucccagcaucccucagucccuaccuugcauacucugcccccaauucugaacuuuccagcccuggggcuaggcuguccuuaccgcagagucuccucccuauauaauccagacauuuuacccccucuuucuuuaccccuucuccuucucucucuucucucccucccucuccuucucucuucugcccuuucucccccucuucuccaccaugguggcuucccuggccuccuccuuugggcagugagguugcccacuggagaacagcuucucaauaaaccagucuucaauacagucuaaucugguuugaacuggcucacugacagagaaauaaccuaccaauaauaacuguagaacucagucuuuagucagcauuuaacuaugugccaggugcuguaccaagggcauuaugccauuauuucaguuaaaaaucucaauaaggaagaaacugagcaaacugcugcugcugcacuucuuuaaucucuuugggaggcagagucaggcagauguuugaguucaccccagcccuggucuauggagugaauuccaggacagcuagggcugcacagagaaacccugucuggaaaugaagaagaaaguaaaucuuggaggaguaaagugugcagcucagggccacacaaggcugacaugucaccgcagcacuuuacuaccaaggcauggcaaugcaugcuguuuucaagcugugauguuuucauguauuagauauuuacaacagcaucuccaggaacaucccuuuuccagcuguugauccuuguuacuauaaauagccuguuagugccuguaauaucucuauacuuucaaguuauuuagcuuuauaagugaguuauucaugcauuacuuuuguaauguuuucagugaguuauuacauguauucuguaucagcaauuacccaguuagucaaagaaacuuuuaauuucuuaggauccauauguucaaaaucccaaauuuucuguuuaccuuuuagaugugcacugcauagcccaaggucacuauguaguucaggcuggccaugagcuuacagucuuuuugcuuccaacucuaggauaauaggaucuuaauacuagaaucauaggagugaacaaccaugucuggacucaaaaagaaaaaaacuaaauggcuuuaaaauaacugaauauaauguaauuagccaaaaacauaaaaugauaacucauugucauuauccagacuacuaaagaagauacauucuuauauauggcaaaaucauaucuagaauauccugaagacauuuuaggagcguguguguguguguguguguguguguguguguguguguguguauguaucucugugugcaccuguaugugaacuuuuuggaaguuauuuuucaucuuaagauauguuugcaaguaguaacuaccucuaaguaacuuuauuaaaauuauuagaaguauagcauuuggucuguauaguauacugaaaggacauuuguuacuugccaacuuuaugaucuggcaaaucacguaucuuucuagauuuccucugaggacccgaugacaagagugcauugaguuaaaugagcucugaagucuucccaauuuaaaaauacuaugcaaagccuccagaauuagauuuaauuaacuucgauuuaaugaaugucuuaguuacuuuucuauugcuguaauaagacaacaugaucaaggcagcguauagaaagaagagcuuauuggacgcuuauaguuucagagcgugaccacaugaccauuauggcagggagcaugucagcagauaggaaggcauggcaguggaaugauuacugagagcuuaugucuugauacagagagacagacagacagacagacagacagacagacggagggagagagagggaaugaccauagaauagcuuugaaaccucacaacccacccucagugguucaccuccuccaacaaggccauauguacuaauccuuuccaaacaauccaaucaauuguugacaauucauuuaaacauaugagucuaugggggcaauucucauucauacuaccaaaauuaggaaaaagaaacuuuuguuuuuuuguuuguuuuuuuguuuuugguuuuuuuuucgagacaggguuuuucgguguagcccuagcuguccuggaacucacucuguagaccaggcuggccucgaacucagaaauccgccugccucugccucccgagugcugggauuaaaggcgugcgccaccacacacggcaggaaagagaaacuuuaaaaguuuuaucacaguaauuuauuuauuaauauauguaugcauauuuauuuguguguguguaugguaugcugguuagcuuuaaaucaacuugacacaaguuggagucagcagagaauagggaucuucaauuaagaaaauagcgcuauaagauuggacuguaagcaagccuauagggcauuuucuuauuagugauugauggggaagaacccagcccauugugaguggugccaucccugggcugguaguccugcauucuaugagaaagcaaucugagcagguggggggggggcaguaaguagcgccucuuuauugccucuguaucagcuccugucuuccuccugcccugcuugaguuccuguccugacuuccuucagugaugaacagugcuguggaaaguguaagccaaauaaacccuuuccucuccaaguugcauguggucauguuucuuugcagcaacagaaacacuaacuaggaaacugaguggggguaagcagugcacccuguguacuugcagagaucaguuaccucuucguggauccuggagauggaacuaaggccaucaggcuuggugccuuuacacaagaaccaucuugcuggccuggaaagagaaacucuuuagccuguuuauuacuaaggcucugacuccaucaguguagucucauuccaguaagacagggaaggcuuacucugucacuaaauguuacaguuucccuaccuuaaccacucuaucauuuugagacuuggggacaacaaaaguucuaagaaugacuuggccuuaagaauuuugugcuuuuaggauuaguauguugcugcucaugaucuugguagggcuuaccgucccuuaaaauauuucugcuggucccagagccagaauucaaacaaacaaacaaacaaacaaacaaacaacaacucaaguauuggauacaagaggaaagucaucauucaacuuugcuggguuuucuguugcugugaagaguaaauacaguuucuuuacuguggugcccuagcuuugcuguacauuggcuucuauuuaauuuccucucacucuacccaguguaacucugaggauugguuauucugaaaugaugaucagccccaugucacagcaucucacccucucugcuguccuuccucuucuuugccauuuauccuuagggcucaguuuagucucacuuuucccacagccuuccuccucaggugaauaguugcuccugccucucauguguagccucuacucucuccucacucauuuguccccagucucugccccuuuagccuaagucuuuccugccugcaccuggguugugaacuccauuaggguaugcaugcucucuucaguucaucuuugguuuucuuuucuuuuuucuuuuuuuccccagacagaguuucccuauauagcccuggcuguccuggagcuugcuuuguaauugauguuuuacaaauuaacagaguaauuaauauguguucacauaauaagugaaaacacacacacacacacaccucucaaaacacaguaaaugauugaacuagggaccaugugaagcacuuuauagacuuuagccuauuuuauccucagucaaguaggucuucauuaccccucuuuacagaugaagggacugagugagguacagagagauggaucuaugcagaaucagguaccugcaacaguuuauuagcaauagaguuucauuguaacagcuuuacuuauaaugugucuguauuuucuuucuuguugcaaugccagaaugaacugcaaaaccuaagaauuucacuaucugagcaucuauuagaaaaggccacugaccuccacccaaaucauaaauuguguuuguaacagaacagugauuugaaccugguuaucccaugcagucugugcccugaaccuccccaccaugcugccuccuucucaccauucuacuuucaagugacuaguuccuuuaaugcugcauucugcaagcaugaggccaugugguuaaucccaggcacugugcacacuuguaauaccagcauuggugaggugaucucuggugcuugauaaccuaacugggugacucacaagguuggcucaccaggacaguguaagauccuaugugaaagagagagagagagagagagagagagagagggagagggagagggagagggagagggagagagagagagagagggagagggagagggagagggagagggagagagagagagaaugagaacaccugagguugcccuuugguguccauauaaguauacccacaugguugcauaccugcacauauuuguaccuguauacacaggagcauacacauagcacacagaggacuuuucuugcuuuaaaaaaaugguuuauuaaaagagacaauuuggugauuagaaaugguugguagagggagaagccacagaagagugaugcugcuucuagccugguaacuagaaucgaugcugauuuacuugucuagggaugaaacuggggaccaugccuuaugccugcuagcagagacaaacugaauuucagggucuacaaaguaguguaggaguagaugcccagauacuagaaauauaggcagggaacauaaauuagaaauugaagucuucucuauagacuauaacugaagaugugaggacagacaagagaacugugaagagagaaaaggacugaagacacuccugggaagacggcugguuaaaaaaagagaaauggggucggugugguggcacacccuuuaauccuaggaggcagagacaggcaggucuuguuucauaaaaaacgagagucagggaaugaguggguggggugacauucagcuguguagggauagaugaaagcugaaguaguguuagcagguaacaguugagcucaguaaccaagguucuugcuuaacaugcaacaagguccuagguuugauuuccaauucugccaaaacaacaacaaaaaacaaaacagugucaaggcagcuuaagggggacauauggauacaaugucaaacgcuccagacaagggggauccauacucugauaaguuguacaugguaacuuuggagagagcgguauaaaagagacaaggguaaaaauucagauuacagugaagucuagagagugugugaagagaggaauaagguuauaaaauuauagggaaacucccaauuuugcuucagauuaaugggucauugaaauaaauuuucguccuaaauuacuccaguauuugccugccuuucuauuuuguuuugcuuauaugaagaucuauuuuaacucaguauucagagcccuguuuucuuuugauuaucuagaaauguaucagauuugaagucuuaaaaaguuucuguccuaucuguggucaugguuugaugggcugaauauucaugaauacugauguuuaucaucuuugauuuucuuccagaacacgauuuucccgucccaagugacaaaugagcaugagucacuggugguggugaagaagcuuuuugcuacuuguaucucauguauaacguaccugaggggcuuguuuccagagagcuccuacagagaccgccguuuggaugguaaaguugcauuaaaugauugcuuuggcugaugucccuuuucuacucagaaacacaaagcuucccucacucacagacuguguuaauccuaucucauggguguguccuucaagaucaauugacuaacucacuucgcauuuuaauuuugucguguguguugguuuuucuuacaggaaccauuaaccucaagcuagcuaucaaaugaaaaaacaaacuuguugagcuaugucucguaauucuaagccauucuuguaaaagugagaacaaaaaucuaccuuaaugcugaagguuuacauuauuuugugucucaguugaauuuguucuuugagguauauuuugacccugaggaaauucaaaggaaucaggugagaaauaucucaccuauuagcauauauaaauaugcacgggaggcauaaauccauuuguggauuagcaugaauauuuagacaguuauuuuaaugaguuaaguuuuuuuuuuacaauagccuaccucuucauuuuauuguuaucagugugcacauauuuccuugcaaaaugcuauuuuuuccaaaucuaauuugaaauuucucauguuuauauuuaauuauauaccauggcuucauucuaacuuaauuuucuuaggcaauauugauucuccaaaugaacagccgugagugcauguuugcucuaaacacagaagcaugguacuuguaaucaugacaccuuccuucguguuaaucacuccuuuuaacuuaggagcuaaaucuguaagauuuaguguguuuucagggagcauauaguuuguuuccccuccuguuuggaacauggagcuauaaaagaaggcauacuuuggaaauuaagcacuuuuuguauuucaguugcuacugcuaacauugaaaaacaaaacaaaacaacaaaacccacagcucuuacuucaagaaauaaaagagauaguuuauucuagguucaaaugugagugacaugggccagggacauggauguagguugcuguagguguuccaucuaguauggaggaaguuucaugaaguucuuacaguaacagaacaaagaaagacauagggucaaagaaagucauagaaaguugggguacagccaaguggggaaaucucugcugucagucucgggugcugucugcugacauuuccagcuuuuguguugguguaagcuagggagucuguugguacauuucaaaaggacucaccuaauauccauaaggauguuagcucacacacagaguuaggcaauagcuggcuaugaggagacuagagauagcccaacauaauuuuuaguuuagcucuggacuuggaacaucccaacuucccacaaccacugaagccuuaaucaguuagucggccucaugaaguacggcuucucuccaggagugcugccucacacuguccuaggcacggaggcaaaagcauugcucagaguccuaguuuuuuuucuugcgacuguuuuaguagaugcuagucuuccuuaauguauuuguauuuaaagugacaugucacaaaaugcucaauguuuguauaacacucuuuuuaacaaugucuaaguauuuugucaaaguagaauaacuuucuauuccucaacaaugguaagaagugauguuaauuuuagcauaggaaaaccauaugaaaagauggaggacucuaagagcuggcgagauggcuccacaggcauagacauacuugcugccgaaccuaaugaucugggacccauauaaugaggagagaucccaguaagucauuuucuucugacuuguacacgcacauuguggcauacaccuuucuacugcacauacauguacgccaacccauaaauuuauaaacaccugaugauuuaagaugccucuauuaacucauacaugggucagugacuuuauacagauuucuuuauauacuaugucuuucuuccuucauauggggaagugggagaucucacauggagauguuugagaauaacuuacacauuuguguuuaauauuuuuucauuaagagggaaaauaauaaagaaugaaauuaggaauguguuuaacuuguuaguugagauggucucagugacaucuuagauuauuuagagagaaugggauaaggaaaagagaccagagugggagucugcuacacugcuccagaacuaggacugagggaacuauccacauaggauucauguauaaaguggguguuuaaacaucaaaacgugccaugcaguggcgguguacaccuuugaucccagcacucaggaggcagagccagguggaucucugaguucaaggucagccuggucuacagagugaguuuauggacagcuaaggcuacacagagaaacccugucuugaaaaacuaaauuuuacaaauaaaaaaauaaaggaaaugcuuuauuuagcaugaaguuuucaguauaacagugauguuucuuuuuuucuagaccucaguuuaaaaauucuccgggaagacaaaaaguguccggggucauuacauauuauuaaaugguaaguaaauucuguaaaauugcccaucaaacuuuauuuucuaaaaucuuuuccuaaaaagagaauacuuuauuagcccucuuuccugaaaauuguagcaauuauucaguauuauuuuaaacuauugauuucauuuuagaagaaaauagacuuauauaaagaaaaaaaaauccuaacugcgauuauucacuauauaccuuuguguuuacuaccauucugugcugggaagagagagaacacuucugugcuucagagcuguguguuauuuauaauauucuauagauauaugggaauggcuugggguuuuaaaaggugguuaaacagaacgggcagaaugauuguuaauuuauauacugcaaaauagaagugcaaacuaauuacauacuuggauuuauuuuuuuggcuguucauaugggcuaaagugacauuggauauuauuucuugacaggauucaagguuguuuugaugcuuuggaaaagagauacguaagaauuuuugaaaauuuaccuccaaauuaaagacucaucuuuacuccuuaaaaaaguuuagacauuuuauuuuguaguguuuaacaguauagcagugcuugcuuuuuuauuuguuagucgauuuucuuuuauuuugucugugucgccucacuguugucucccuuacaacaaauagaaacgaaagcuucguuuuccuuuuuauauacgcauaucuuuuuuaaccacagaauuuccucugaagucacuggacaagauccacaggauguggguuaaggaagacaagaaucugguaguuagcacguugaacauguucuaaauagcggugacucgguuugcagauggaaaagaagaaauaguuaaauaaugaaguuuuacucuauuuuauuuuguuaauuauaacuccuguguauaacuuugaacuuuuaaaagacacagcccagauuuuaagugcguaugcucucucaugcuucaguagacacgaaugaagaaugugaagaaugaaggcucaaggucuggcugaagagaugcgaugcaccugaaugaaaccccugcuccuaugcuugcuccauucccccaagucuucacucgucagcuccacguuaagcugcagugaagaggcuugccauugugucaguaauguagucacggagucccucacuccuucccaccuugggugaacaguuacucacauucauuccauuuugacccaggggacagagggauacaaagauaagacagaucagggaagggcuuagagacauggcaggaggugaguguugcucauaugagggcuaaugauugcuaguuaucuacugguucagcuguaccuguugcuaaauuauugguugucuggggucuggguugagaaagagacauugcaggaugaauuuggcuucucggcagcgcagcgggauggauuagccucggaaguacugaacaccuaggaacuuuucauaaguucuuuauuguuacacaaaaaaggcacuuuuagcaagacaauuuccgcauagcaaaaccucuuaucugauguaggaguugugugaaggccgauuaccuaagcaguucagucaggagauuuccugguucgccagguaugucuugggacuaaguuaugcaaaaacucugaauccuucagaagggcagcuccagagaucucagcuaaccugaucaaggccguccacgcgugacaagacccucuuucacuccagagaucucagcuaacaguccugaucaaggccauccacgcggugacaagacccuguuucuuacaaagaagaaaggagugggggaagaggaagaggaggaagaggaauaaaaaagcaggucacuggugacgcaagccuuuaaacucagcacucaggaaguagaggcaggucucugugaguuucaggccagugggaccuacugagugaguuccaggacuaccaggacuguuauauagaaacccugucucaagaaaacccaaagaaacaaagaguaguucaaguaaaaccagguuucaaguagcaagugcccuuggaagauguccuguugaagaacauggucuuacuaguuaugaaauucuggguacuuccccuauugccccucucaucucucacaauuccugcucgugaaccacacuacauucuuucagaaacugaacucugaucauguuauccuuuaugccuaaaaauuucccaggaauuuaaaaaaguguucaaagcuguuugcacgaucgagcaggccugaaugucccuauugauuuucuaagacacccucccucacucccaugcucaggcuacacgaagacucucuaggaugccaguaucuuccacauacuguuccucuugcucaaaaaggucuguccagacccuaugcauggccugccuagcuccaucuuguccugccgcuaaaauugucccucauuugaggguuccccuaacacuuuguguuguuucuucacagcagacccugaguauaacaguguggccaugugauuuucuuacuguuaguuccccuuucuagucggcaugcaucuugagaucagcggcuagccauauucuuucuucuuuuaaugugacaauaaacuauuaauaguuuuacuguguggucauaaaaaucaguuauaaagaagaaaaaaaaaaucaguuauaugcuaaaauagccacaagguggcacuaaaguuuuagucaacugcuacagaauuaugguccucacguuuuauauuuaagaauuuaucauaguguugauucuauuuaugucuguauauucaauauucuuuaaagcugagagaaugucuuuguaguuuugugauguauagagaaaggcacgaguuugugagacacaucagaguuucuaaguuguuuaccuugcuugguaaauuuuaaaaggaguacuuauuagggauucuugugguacauuuaauuuugaacaauaauggauuguuuugcauaucuuuugguucccgaauuagaaaauaagaaacuuuuuuuugauaauccuucuuuugucccaguaaagccaguguuuguaauagaaauuguuugaaugggugaauuaguuccuuuuucugaccuucugaauauuuucucucugaaguaauauuugaauuagucuucaucagaauugucaauacuauaguacaaacauauaauaacagaguuuucuuuucucuugaagcuacacauggcaguauuaacaguaaguacaaacuuaaaggccaagucucugucucugcaugaacuuuuggcaaguacagcauuaaacaggcaucuuucccgcuuccccucgugagauuuaugacauuuuagcauuucaaaauuggauauaucagaacuuaagauauuauaaauguucaguauauuucuuugacauauauauuauuauaugagagaacauaucauaugagagaauauaucauauuaaugcuuaggauuuaaauauauuuuuagauauguaacagauccaaagucuuuuguuugaaaguuuuguggacuuuuuuuuugaaguuuuauauacccauagguauaaaaugauuguagaaaauugagauaccauugauaaaacauauuaauuauuuaaauauuuaugacauaacaaguuaagaauuuauuuguacagcugggcagugguggcacacgccuuuaaucccagcacuugggaggcagaggcaggcggauuucugaguucgaggccagccuggucuacagagugaguuccaggacagccagggcuacacagagaaacccugucuugaaacaaacaaacaaacaaacaaacaaacaaacaaaugaauuuacuuguaguucagucauauuaaucaaaaauacuaugcaucaguuauaaacuuccuuauauuuaguguucauagaaaguuguaaagauuccgaguuuuuaguaaaauacgagcucauccuauaucuagcuagaaauaugccuagcuggugcucgggacucaguuagcacaguacaaauuaaacucuucacaaagacagugcauucagugagcagcaauuaguaagucuggaaauuaagugcuuuuuauuuucccuuaaacagcuuuacacaaaucccaaggaaccugagguaagaggguaguguauguauacuauauuuaaguauauuuaucugaaaugaggcuaucaauuauguuacuagacuaccacauaaacagagcaauuuaucaugaacuuuauguuucauuauaaaugaaacaagucuuuuauuaugaaaauauuuuuagaaacuagauuuuuuuguuuuuagaaacacccaaaaaccaaaaaaaaagcaguuuagaacugaggcuauugggccgggccggcagugauggcacucgccuuuaauccuagcacuugggaggcagaggcaggcggauuucugaguucgaggucagccuggucuacaaagugaguucuagaccagccagggccacacagagaaacccugucucgaagaaaaaaaagaacugaggcuauuuuuuauaacaugucaauauuaagauucuccuaaucauaaauguauaaaaguaauuuauuaauauauauuguagaacuaauaagcauuuacuauuguaugauaauaauaaaauaucuaauuauuugcuuaugaucuucuggaaaaguaaaagcuacagcauuacucugagcucgugagcacugaacgcccucuguugaugcucucauagacgcugagagcguuccaucucacucucaucuuuacauuccugagcuugcuuagugacuccuggacccugcugcuguucagaucuuuugugaaauccucuuuggcucacuguacuaacuucuacuuuuucuaaaguccuuucuaagcagagcccuguuuaacccucuggguugauuccuauauuuccuaaggagaugaggauuuggaguuccugggagaagcguguuguuuucuagcuuguagagugacuagcauugccuaaauacgacauaguuaccugugccacuuccauggccuuucugccugugacacgaacacagagugagaagcccuuuguuuucucacccgguuuugucucucuccuagcuuucuccucuuuuuuuccccuugguuugaauuuuucuucucuaagccaguguauuuagucuaacuggcgacauucaaaacuaaauuguuaaauccuuaguauuuucucugugcaagauugaaaauaaccaugcaggugaggagaauaacuacuacacacaaguguauagcaauuccuuaaugcccaaacuggucuuagguccuuuuuucugaaucucucucccccuuaagcuguuucuagaacccacuauguagcugagaauccccuugaauuucagaucccgcugccuucaccaaaugccccaguuguguauacacaguauugagauuacaagauagcaccaugccugguuuacugaguccuggggcuggaacccagucuuugugcucuacuaccagcuaucccgaucuuuuucuucuaguaaguuucaauuuuuuuuuuuuuaaauuaggacugauuuguuuuucucauucuuauuauguuucccuaugcacacaccucuccuaguuugaaaucugguuaguuuuggugcaugaucuuuuauuuauuugcagauuuuuuaaaauaauaaacuuuauuuuaaaaaagaaaucaguaguuuuagagguaaaacuugaguuuaccucaggauaaaucugacaaugagaauaaagugacuaaauuaguuuugaugcuaacauauagaauaaugugguuuugggggcuggagagauggcucagugguuaagagcacugagugcucuuccgaagguccugaguucaaaucccagcaaccaugugguggcucacauucauccauaaugagaucugacgcccucuucugguguaucugaagacagcuacaguguacuuagauauaauaauaaaucuuuuaaaaaaagauacugugguuuugaaaagagagcguuuuguaugauaaguuucaagcuauccaugacccaacaaaaauauuuugaacacuuaccauuucuucucuguggaagcaaucccuaagugcuacguuuucauagcacacaucuaauuacuaaaaaacgguagacuauuugagucuuuuuaaaaaaacuccaaacaaagucagugauuguauuaguacuuuccugcugcucugauaaaaugccaucgccaagagcaacuuagagaagcguuuauuuuggcuuacaguuccagagaggaauuccucauggcaaggaggcauagcaagcagcagguaggcagcaggggcaggaaaccgaguacucacaucuucaaccacaaacccaaagcagagagagcaaacuggaaguggaaaugagguuauaaacuaccaaaguccacccuagugacaaacuucuuccagucagguuccuccuacagguuccacaacauccccaaacagugccaccaacgggggccaagcguccaaauguucugagggacauuucucaucagaucacauagcagugauuauuacacuuucacuacuaugccaguucuccacuguucauaguguagaaaggcaugcccaaggucccacuguuuuauggcuuggcugcugccuaacaucaagucacugagaaaacuguggggcucucugaccucauucucguaaauaaccaggagacaaccuuuucagaucaaccuaaucucugucauuuauugauccugugccaauagcuugagucaucucugaaaggauaaccuucccuaaacaaaauggcacaaaaaauaacaguaaaauauuuacuaggaauaaaaauaaacuuuccacuugggacuaaaauuugcagcacuccugugaagaauauaucaagcacaacaguugaacagcuuagauccaagaguuuuuccuaauuccgaagcggacagaauuaggagccgugcacacaacuguagcacauuugcauuuauacuuuuguucugacugcugucgugaaagagagccugaaaacuaaagcgauaagaccgacaacgagcuuuucuguaggcacacacugaagugugggggcaaaucaagcaaacacgucuuaauuugugauaaaccguuaagaauuacaguuaggaguuggggcaguagagucccgcacacgccuuuaaucccagcucucaggaggcagaagcaggcggaucucugagucugaggcuaguuuggucuauagagcaaguuccagggcagccagggcuacauagaaaaacuaugccuugcaaaacaaaacaaaaacauuacauauaugaguuuuaugagcagugcuaccauguguuucauugucuagucuuuugugccuaugagaggugaucacacaauuuuaacuuccuguuucacugaacaauaggugauccuaaaauauguguuuagagacuuuguuuuuauucauuuguuuguguguuuguuuguuuuuggguuuuugagacuaaaguuucucuguacagccuugguuguucuguagaccaggcuguccuugaacucacagagauuugccugccucugucuccugaguauuggguuuaaacuugaccuagagacuuuuuuuuuuuuuaaaguuugucuauuaaagaccagguguguggcacauaccuauaguugcagcacucaggagaggcaggaggaucauuacuuucagguuagcugcacagcacagaaaaacucuaugucaagagugaauccuuguaagaugaaauucuucuugaagaugaacucuggguguuuuuguuaguuuuguauuuagcacuguuuaccgacauaaaggggacagaccaagucucugaccucuagaagcuuauauuuguaugaagaagaauaaccaaugaguaaauagaacuuaguaaaagucauuuaaggucguaaugcuaugaagaaaguaugaaagguguugugcuggucagaaggagggcugagaugccaguuuuagauugacaaagccauaggaaacaucccugggggcuagacugcuguuggagcugagauggaauaagggcaagccacaguaaugacagguagaacagcacugagggcaacaccagguucuggagucagaccgcagcucuaccacguccucucuccaucaauacugacaacaaugaugcuaccucagaguguugguggcauaauccggaauauagacacacugagaccccaagucaggaaguguuuaucggcagaaaagagaccccggaucugucucauaagugaaaaagggaaauggcagaagagcuaaguggaggagaggugaggaggcuuuagcacaaggacagugagaggccggggagcagugacacgcuuugauuuguacucggaacguuucuuuuuguuguaguccgaggaauuggacucaggccuugccuagauccuccccgacccuugcccccccuuuuuaaaaauaacauuauugagaugacuagcucaguaugcuacucagguuggccuucaauugugauuucccugcuucagcuuccucaguagcacuuccugaguggaagcauauguaauguguaccuggccugguuuguauucaaaaacucguggcuagaggacagagaauaaagaucacauggaugugugacucacuuuggagacagaccugagaagucuuuucagugacuuggaauagagagugagaaacaguuugaagauggugaacuuaucaagaauuaacacuuuaaaauauucuuuauaucuguauucaucugugucuacgugacuguaugugcaucauguaugugcagugcccuuagaauccagaagugggugucagauccccuaggacgaguuccaggaaguuuuaagccucccaacuccucuguaggaguaaaaagugcucuuaaccuaagccaucuauccagcccugggauuaacauuuuuuaaaaacaguuauauaucucaacaguaaaaccacugguuuaggaaacaaauaauaaaaauaugaccaacuacuuaaagaucucuuuuauuuacaaaaugcguucccauaguauuaagaggcuagaguugacuagaagcaaggacaggugagaagaauaggcauuguuugcuuggcaggacaauuauacuuagcauuggcuaagagaggacacuaugucuagcaaaucuggagugaaccuguugcucuuaggcaccugcagccaccucugaucugaccuauuuuuucuauuguauucacaaaacaguccccugaaaauagguugagcaguuaguuauaaaggcaauucucuuauaacacuaacucauuauaaucagucuccuuagguuuaggcagguaugagcugauuuccaggacuugaucacccgugguuaaguuguauacuaaagaucagcagagcuuugagcucagaucuuagagauaaguaacaggaaugugaaaacuauuuuugaucauccccauuuccacauugucagaugagugagggucauagucuguguucugauuucaauucauacucucuuuagaacuucagcucugucugcaaacccuaauuuaucuagguaaacaguuauuuuuaagcuaaagcauuuuaaauugugugugugcaugugcacgugcacgcuuguacaugugcaguugugaguggcaaguguauggagaucagagaacaacuugaggagucaguuauucuucugcucuggguuccugggauaaaacuuggguuuucaggcuuacaguguaagcacuuuuauccucugagccaugucaucugccugaaaggacuauuugaguuuguuuuuaaugaggaaauuuguucucuauauuccaucacauccuuaccaaugaugagagcagauagcaguaguagauucuagugaaggaaauaaaauucaguccccuaguuccuccauucccuuacuucucuaaaucaccacagaggcuuucuagguguccucauggcuucccugaauguguccuuccuucccuucuuuccuuucuuccuucuauccuucuuuccuuccuuuuucuuuuucuuucuuuuuccuucuccguuucccuucccuucccuucccuucccuucccuucccuucccuucccuucccuucccuucccuucccuuccuuccuuucuuucuuccuuuuuuuuuugagagauuucucugcuuagcccuggcuguccuagaacauacugaucugccuuccuuugcuucccaaguacugagauuaaaggcacgaaccaccacaccugcacacuuccugucugucuuagacacuguuccuuugcugugaagagacaccaugaccaagacaacucuuacaagaaaaagcauuuaacugggacuuacuuauaguuuuagagguuuagucuauuauuaucauggugaagaacaugucagcacacagcagacacuagagcaguaguuaaugacuacauccugaucuguaggccaugauuagaugggggaagauagacagacagacagacacugagccugguguuaccagugauacacuuccuccaacaaggcuguaccuccuaauccuccuaauccuuucaaauagauccacucccauccugaugacuaagcauucaaauauuugagccuaucagggccauucuuauucaaaucaaaacauugucuguauucuuuuuuauuuguuuaguaguuguuguuuguucuauuuaaauuuuguauguauguauguguguguauguauguuuuuaagauuuauuuauuuauuucauguaggugaguacacuguuggugucuccagacacaccagaagagagcaucggauccccauuacagaugguugugagccaccaugugguugcugggaauugaacucaggaccucuggaagagcagucagugcucuuaaccgcugagccaucucucuagcccauugucuguauucucaagguauacagagagaucuuuaaaaacugcaaaccacugaucuguuuaaacuuucaguagacuuugaugaacuuagaauaaaauccaaaauccagcagggcaugguggcacacaccuuuaaucccagcacucgggaggcagaggcaggcggauuucugaguuccaggccagccugaucuacaaagugagcuccaggacagccagggcuauacagagaaacccugucucggaaaacaaaaacaaaaauccaaaauccauacuauugucaacauagucucagcaacaucucucauuuccaucuaguuggcuucuuuuuggauucugagaaaacaucccuucacaauccagagcuuuugcauuacuguucugccuaucugaggcacuguccacaggucugcauaugacugacucccuuuuuaaaaaaaaaaucuaucuaucuaucuaucuaucuaucuauaacuccagauuuuauuucccgcccuuguccacccucuaacuguuccauaucccauaccucgucccugucccccugucuucacgaggauguccccacccgaccagaccucuaaacucccuggggccuccagucucuugaggguuaggugcaucuucucugacugaacccagaccuggcaguccucugcugcauauauguugggggcuucauauaagcugguguaugcugccuaguugguaguccaguuugagagaucucagggguccagguuaauugagacugcugguucuccuacaggguugcccuccucuucagcuuccuccagcuuuucccuaauucaaccacagggcucagcagcuucuguccauugauugggugcaaauaucugcaucugauucuucagcugauuguugggucuuuuggagggcagucaugauaggucucuuuaugagugcuccauagccucagucauagugucaggccuugggaccuccccuugagcuggagcccacuuugggccuguugcuggaccuuccuuuucuuaggcuccucuccauuuccaucccuguaguucuuucagaugggaacaauuaugggugagaguuuugacugugggauggcaacccacccccuucacuugaugcccugacuuucugcuggaggagggcucuacaagucaaaaaauauuauaucuucaggaaaaauuuccugauccuucuaagucuaaugagcccuucuuucucuccacuaugcacuuucugccauacuaucuguuuuauguuguccggggcaccaguucuaucugaaauuaccuuguuuucuucguuuacuagcuagcuuuguagauucuauggaaaaaaaucuucucugccuuguucaccacaaugacucugguuuuuagcuuaaaguagauaauuugauaaaagauugauuacaugaaugaaugauuccucaacaggugauaucuaauggaaacaguugcuaccuaacuuauuuuuagcugagaggagagagauuacguuaucauuauaucugaaaccacuacuccuugauaaaguaauucugcgagacaaacauacagaagaaacauaggaaauagucaacaagauguuccuuuuaugagguaaaaaucugguuuuguuucaaaauuaacuucuuucucugcucucuuugguuuuucuagaaagugacugagauauaccaauucagauucaaauacacaaaaaaaggaaccacuauggacuuugacagguagacucuaauuguuuaaugaacaugagaaauguauaggaguacaguaaauauaagcuucuauguggccaguggaaaucuuacaucuuuuuguaauuuucucauagcccuauaaaaccucgcuaucacaaauagaaauuauaauaauuguuuuaaggucugaggucaagaaauuuggcuggugaaaguagaggcaaugguggaugucauugcucuuaaaauuauauuaauaaagggcuggagagauaacugugguuagaaagcacucuuccagaggaccugaguucaauuucaaagucagguggcuuacaacugucuguaacuccaacuccaggugaaucucgccucugaggauaccugcacccaugcacagacccacaugcaggcacacaccuacagauaauuaaaaauaauucuugaaggaacagaagauuuaauguaaaaauauguuaauaaggcugucaacaugauguuagauaaagaacccauaugacugucucuagcuauuaauccaguagcccuguuggcgugcaaagaugucaauuuauuccauuuucaauagaggaauacugagccugagggaaaagaaauuacuggauuauuugccuauaugcacaaaugcugucaguugcuuauccauacauauacacauaccauuuucuaugugucauaugagaaaacucauauacacuuauuuuccuauaagucuuuuguuguuuuguuuuuugacacaggguuucuuuauguagcccuagcuguccugaaacucacucuagaccaggcuggccucaaacacagaaucugcuugucuuugucuccaaguuccccaccuaaagguguagacuaccaccaccuggcaccaucaaaucuuaaaauccauauuuuuagauauaguaaugggucaaagagcaaaaccaaggaaaacccuagugcauauggagauguuugcuagggaacgucauucaucucucagaagcuuuggcuucagaucagccaguggguauagugaaccaagggcugcagaugagacaggauagaaguugaugacacagagucucuaaaaagacugcuaaugaaagucuucaaggggagauagcuacccugaaaggaacaauucugaagagaaauugaccauaugccuucuuuccaauaaguucuuaaguauucucucauuugugagacuugcagaaaguacucagauauaaaaagaaaagucaguuccaggaaggauauuuaaaauacuagccacaauuaauuaguauuuauaugccguuuuacaggcuguauaguacuuugccuuuuguuuuguucuguuuuucaagacaggguuucucuguauagcccuggcuguccuggaacucacucuguagaccaggcuggccuggaacucagaaauccgccugccucugccucccaagugcugggauuaaagguguucgccaccacugcccagcgguacuuugucuuuaaggcagcaucucauguggcucaggcugacuuugacuuaacauauaggcaagguugugcucuaccgugccgagcuguauaugacauacuucaugcuucccccuacccccacauaaacaguuauccuuacucuccaaaacuccaauauacauauucuggacaaccagauuaaucuuuuuguuuguuuuagagauacauaugcugaaagguaaacaauaaagcaaauggguaaaauuuccagauacucuaaaggugagaagauaauaugcaguauaaauuucuagaaaauuacuuaaaugaggguccuuaauaugaucuucugauguuucgugaggcuuuaugagcuacauagcuauaccccuucauucugauuaaaaaucugauuuaaaaaguugauggaaauugauagaaaagguaaaguaauccaguuaauauguuuguuuacuuugugaucucucacugccuccaaaaauuagggagagaccuaacaguuuaagaacuugggauuauuuugcaguucuaagugccaauauguucaagguacugcaaauauauagccauuguagcguguccuugaagacacucaaaugugagacuaauugggaagaaaacuuuguacagaaacaagaaaauuugaguuagaagauuagccgagcucucucauucauuuauuaauucagcaaaucuuuauugaguaggugaauaccaaaccuaguacuauggagaugaaagauuuagccguucauagucuauauugggacagauaauucuucggaggggaggugcagaauauaggggagaccucucgaggagcuggcccaugagcuagguaggugcugugggagcaucaggaugagagacagaaaguacaauacggcugcagaugugugugguugaaacaaacugggugacagcugugggggugggugggggugaagaauaguuguacaugcgccaucucucaccuuugguucaaagcugacagguguaauagaaaacuuuagcauaaaggugacauaagcagacccuccuauugggaauaguauuuugccugcaguauggagaaugucuucaaguguagacaaaaaaagaaagccagaagacuagaugcuuuaguaaccuaugucggagugaggaggggauuucuuugagagacaaucagaugguagauaagcauagagcuagagacugauuucaugcuuggagagcugcagagauaagcuuaucucacaaaugggcuaccugaccuagaaugugugcaaaugacuugaccgaggucauacagcugauauuagaugccaggucaccuaauuacaaauccauuguucucauuacuagaacaugugacuauuugaaagucaaaaauuuaaaaugauacuuaaaaugcaucaagaguaucugcuauucagagauucuguacauauacauugcagaaaauacuauuauucccuuguuaucucuuaaaaacugucuaccaaauguccucauguuuaauuuauuagaugacauagcuaaaaguuguguuguuuuggaguguacugugaauguuauacgugauugaaaggugccauuuuucugugacuacagcagcagcacaagcuuugaaagugggacagacagugaagauauuaagaaagccuguucccuacuaauccgucaauuguauauacugaugcagaaucuuggaccccuuccgaaugauguuauacuuacuaugaaacuccauuauuauaacucagguagguagagaccuugguuaaauucccuguuaagugcgcaggugauguuguguaugaguagaaggauuugugggcaucuggaagauguuuuuacuguacaugaaguaguuaugucacguacucuauugaaacuuaauuugaaauauuuuuguccuuucugcagugaccccacaugauuaccaacccccuggcuuuaaagaagcggugaauucacacuuccugcuguuugagggggagccugugagccuucgaauggguucagucuccucuggcuuucacagcaugaaaguaaaagucacaacggaggccaccagaaugcucgauggggagaacagugucagucaggacgauggcacuacugagauagcucaucaggggcuagacugugacgaggaagaggaggccugcggcagucaaguaaggccaacuuuuagugacccuucauuguuuuacuuaaacacaggugacauuuccaguuuguauuuaggucaugucacaguaacagaguccaguggagcaugccagcuaugaaaacugaaacaaacuagcuugugacgucaaggacuuuuuaguaaaaccguccuucuagaaggaaaucuaugcuguuguaugagauugucuagcaauaagaaaaauuccuagaguguuuuuauaguacuuaaaaauauucuaaguaucggguuuguucauacucaauagaaguauacauuagcucuuaauuaguaguaacuggacaugagggcuagggaggaacauuuuuauggauuaaccugaaucagagagagagagaaaaaagaaauaacaacaucuaugacaagcauugcgguuugauugcuggggagagcugagggguugagagcuugcagccagucccagugauaaguagagcuuagagccuuugacuuugcuuguuucuauaauaccuuaacuguggacuuacuaaggcuuuguuuuguaguaggaagguccauaccaugauuuaguaguugucuggauaauaauguuugcugugugcuaacacuguaggugaaggauucugaaacaaaaacauuuucuggcuguuuaguggaaagggaaacuauaaagauauuuguuguuguuguuguuguuguuuuaagauccugcuuuuaaaagaugacuguagaagcuguagaguuggcuuagcaguuaagagcacuggcugcuuuuccaguggacccagguucuauuccaagcaccuauguggcagcuaacagccaucuguaacuuuaguuccaggggaucugacacccucuucuggccuccauggguaccaggcacacacaugcaggcaaaauauccacacauauaacaguaauaacaucaacacgaguuugauggcuuaccacacugggcagcuucuaaaagugccuucuaaaucuuuagcucagcauuaguuuaguauauugaaagggagauccuagucuuaauucaguuacuaugacaaauguaaccaaacaacagguuuuuaauguuuuuuuuuaaagcuuuuucauugugucgggcaugaaaauaacuagauucuagugcauuauuuuucauuugauuccaugucaaaacagacauaguuagcauggcaaagcuaaacauaauaacaacaauaauaguggauaagagaauaaugagacuauuuuuuauuuuuauuaugaagaaaaaacuuaacagcuguacuagagcaugccauuaauuccaguacuugggaggcagaagcagggagaucucugugaauucaaagucagccuagugaguuccaugaaagccaaggauacacagaaaaaacccuaucuuaaaaaaaaacaaagaaaaagaacuaaaggaagaagaaagauuuuaaagggacuggagaaauggcucagugguuaagagcugauacccucuugcagaggacucaaguuucauucccagaaccuaugucugauaguucacaacuaccaauaacuucaucuucuagggggaucugucaccucuagacuccauggguacccauacucauaugugcauacccacauaugcacauacccuucacacgugugugugugugugugugugugugugugcgugcguguguguauaaauguaaauacuuucuaucaagacuauacaaaguuaaaaaggcaggcaugcuuguacaugucuccaaccuuaggagcaaauguggggauaacagaaguuuaugagcagccucuguuagauaauacguuugaggucaacuugggcuaucugagaccagaaaaccaaaaagaaaaaaaaagcagauuguccuucucuuuugccaaauacauguaagcagagcagccugccagggaaagaggaguggcagggucuggacuugcugagaggauucauugacgcaaguaccacugacauccucacuaaaccauccucguguuuccuccuagaaaguccucacguccacauucugacacacagauacaaggaacuuucaucuuuauuacuuuaaaacauuuuugagaagaguucucuuuauagcucugacaguccuuccuuguaguuuugccaucuuguagaguauuaguuugaguaaauauauagauagacucugucauuucugucuuuugcuggacugucaagaaugugaucucauuauuguguauuuuuccuuuccacugcuguauucuacucaguuuuguuuguucagggguuuguuuuguuuuguuguugagacaguuucacuauguagcucugacuggccuggaacuuguucuauagacaaggcugggcuagaacucauggaaaucugccugcuuugcccuccuccuguacuggaguuaacucuguguacauuagauugacccuuauuuuccuuugagacagaaucuguguugccuaaacuaaucuuagguuucugacuucaagugauccuggucuauggggacaugcuucagucucucaugucacugaaaggucgcuccugucuagauauuguagucuggcuggccuagaacucauaaagagccacaaagcucuaccuccacaucuauacgcacacuuacugguacaugcaaaugagugucuacagggaaaauaguaguuuuagauuuguuuuaaucacugcucuauuacuauuacgagauaccaugaugugucucugugacgagacagcuuauaaaagcaaacauuuaauugagggcuuguuuacaguuuuagaagguuaguucauuaucaucaugucagggaagauggcggcauacaggcaggcacuggaacagucucugagagcuauauccugauccauaaguagagaggacucuagacuuggcaugggguuuuaaaaccucaaagcccacuccaacuucuuccaagaaggccauaccuacuccaacaaagccacaccuccuaauugaucuaauucuucucaaauagugcuaguuccugaugacuaagcauucaaauauaugagccuaugggcucuuauucaaaccaccacagguuuacacauuuucaacuuuguuagaaaggacaaaauaguuuuccaaagaacuauacccauauuuauuauaccaacaguggaagacagaccucauauucuguaagcacuuauuauugcagaguucauguuuucagugucugcuugguaugcuagcaccucaucauuuuagcguauuucuuauuguugaugcuugagcauuuuuucauuagucauucugguuuucuggugcauugaauuaucuuucuuuauucauauaaaaauauucuggggcuagaaaaauagcucagugguaacaauuuauacugcucuuccagaguccuugaauucagucccuagcacccaugucaggggggaucaugauugccuguaacuccagcuccagagggaccuauugucuagccucugagggcaccuguauuguguguacagcagacagacagacauauaugcacaauguacaaaauuaaaagaaaaaauauucugauaaucauucuuuuuuacuuauuuauguuacaguaauuugucuguuuuuguggcuugucuuaucuucuuuaaguggucuuuugguaaagaaaggcuguucauuuaauguagucuaaucuuuuauucugacauucuuaagaaauuaucuacuuaaauauacauauauacacuuuaaacucucaccuuucuuacucucuagcccuccuucucucuuucucuuauccccucucuccacauggccauggccggccucucucccuuuuucuaccuucucucuuucccccugccuuucuacaauaaagcucuaaaaccauagacugucucucugcucaucaaggcccaccaugcuugaacgaugagauaggcuuuccucuaacaagcccccgucuaaccuccuacugaaaggccuuccugugccaccaacuggacuaaggacucucgccugugugggaaccacacagcaccucccucucuccccacccucuccucccuuuggcccuggacugagccaucccccgggguugggggugggggcauucuguucucaggucuucccuguguccaguggugucugggaugcccgaggcugagaaccuguuaucuagaacugccucuuguccaccaccugccuagcuggggaauuccaagaaugugagcacaguacacauggaaccagcugaaguugccucagaaagcaaugguuguguggcaugcuagcuaagaacagagagauguguugaaguucaccacauagaauaauuucucuugugagcucuauuuaaaacucaagaccaucagaguuacagauccuugcuggcacaacuccagguugaauucuguaccaucagcuauucaaggacuccauuagaauaccaauugcuuccucaaauauguaaccuuugccugaugaaaguucccuugcucugaacauaauggaguaucacuuggaagugacaacuuacauauucaauaaaaaugaggucuuuuuuauuaaaaauacacacacacacacacauauauauacauauauacuaucuaccucauaccauaaaugaaauaaucucuguguguuugugugugugugugugugugugugugugagauuucauuuaugguaugagguagcucagaccccuuuacaguuuuaugucuaauuauuuuaugcaugcagacaaauaaauaacuuagugauacagcucaguaaacagacacaaaccaaacaguagggacggcugggacaugggucaggcaagcaagaugcccaggggagagagugagagccuccuuaaguuguucucccuggguucuugcuugucucaacacaucuuggcccugcugaauagucugacaaaagcaucaaucagaucaagaggugggauacuaccagcugcuuagaaacauaguuuuaaccucacaguucauacuccaguuagcaagagcauuggcauccuuccuucuguuagcaugcauuuuuuguucaugcugucgcugguauccauuuggaugugcucugacuuggggucacuaggacaggcacugcuaagacuucuggugcucggugcucggucaggacauauugacggugggaaucagguuggaaggaguggacagcugagucaaagggcaugcaugcaguuagcccggcuagguacagcuucccaagcgcuugugccgagguccacacagcugcuuugcaucuucauccacuuuggcgauuucuaucauuuuuaucagguauauuuuguaugcugagcauauuucaucuuguuagggauaagcauucuaguggguggcagugaugaguuguugugguuuucauuuuuguuucccuucugaauagugaaagucagcacacuugucugacucacugauguguaggaauucuacagauacauucuguagagaaguaauccuccaaaacaaguguauaguaaauaucuuaacuucauaaauguccuuuucacuguuuuauagagauauuuuaugaacaguucuuuuuuuuuagaggaauauaaaacaauuucuugacugcuguucaccauuauuuacaacaaaguauacaauaugcaguugaauagcauuugguaauaugaaaugauuuucuuggugucuauugaaucaguaaucaagaacuggaaaggaaugagucaggguaaagaaaaaauguacaggucaauaauuuauaccaaaauuuugaacagaaguuucuaauuuuagaagaauucaacuuguuagucuuuucaagcgacauucagcagaaugaaaaguauuuagaauacuucuuaagaaacguuuguuaaggacccuucguuagacaaggguucagugcccuuuuugggcucugugggcacuacacacacauacacagaaaaauaauuuuuaaauacuuaaagaaaagaaauucuagucuacuccagagcuuacagaggcauacucuguguccuucucuaaagggacaguaaccuagcaguaaccacagggaaagaaguuuuguuuaauuaugguggagugugcacauaugagacacuggcuucaguuugccuuagugcugggauaggagugaagggaaacagaaacaaagaucaccauaaauauauauauauacauacacacacauguauauacacauauacacauaugcaugugaacauaugaguaccuggccuuuuucucagucacuuuuggcuauacuuggaguuauuuaugaugcuuucacagauugggaaucuauuauguuucuguaguuguuugccucuuuuccaucuggugcuauuuauuugagucccuuuauuauuauauaugccccaaaucaguauuuuuuaaaaaguuagguuuugauugugcuguucacaucuauugcuucucuuuucuuuuacucaugguuucuuuucuguuuguuuucucccugaccacacauugaucuucccacccaugugcagacgugcauaccuauaggguccucacaguaccauugguguacagauguacacaucugucuuagucacugugaagacacugugaccaaggcaacucuuguaaaaagaaagcauuuaaauggggacuugcuuacaguuucagagguuuaguccaucuugaugggaguaugguggcuugcagucaggcacuggaacaguagcuaagagcuagcuacauccugaucuguaggugagaagacuuuagacuuggcaugggcuuuugaaaccucaaagcccaaagacacuuccuccaacaaagccacgccuacuuauuggucuaauucuuuucaaauagugcuaguccgugcugacuaagcauucaaguauaugacccuauggaggccauucucauucacaccaccacaguaccuacaagucucuaucaaugcacagacuuguauucccuauaggucccucauuuuacucucuaaauggaauuucaaucauuuuccucucaggcuuacuaucuguggcacuaggcacugccacucuuccaaacaaccaagauguuuaaccuccauccucuccuuacuccucacauccuuuuggaucguguuucaguccgcucuguuuugaaauacuucucaagcccggcccuauccgaccaugcugacucaggccgugaggcuuucuuggugaguaacagcuacaguuccugacugggucucucuaacauucagucugucuuucagagugccaggaaugaagguauuuaucauucucaaauacuucaaauaguauuguuuguguaauuucaagaggcauaaagaugcaguguaugaaaauagcaguugugagcagagcagagguagggaagaggguaaugugauaaagcucuuuggcugcuuucggugguaagaauggaaccaggccuugugcaugcuaggcuuguguucuauuacugacuauagcuacagccugaaagagcuuuuuaaaacaauacaauuaacaacauuaaaguaauugaaaauucagaucuuucaacuguccuuauaucuuaucaauacaaauuuuaacuuuguaugccccauucuuuucaguauuuuucaauggauauauuuauuuguauauuauuucaauaaugguauauauaauuucauuuuuauuuagcaauaauuuuguaaauauguccuaccuagccuuuauauguaaaguucaaugacuuuuugguucauuuagguucauaucauuucucuauuuuuaaauauuucgguugucauacgugaauguugagcauuccccaguacuuuacauuuaauggcuugguucccaggcuugcacuauugaggacagaugaagccuuuuaggaaguggaaccuaguaagaggccugguagccaggaagcaugucuuugaaaauuagcuucuuccuucucccuuuugcuuccuggugauaaagucagcaguuuguccugacacauacucccacuaugguguccugucuugucacaggcccaaagcagugggccagucagucaggaacuccaaagcuauaaaucaacuauuucuuagugacaaagagcugacuaauguguaggcuaauuucugauaaugcuauuauaaauagcauuacaauaaauaccuugcaagugugacaccuccuuuccuuaccuucuauuggauuaacaguagcaggagugaaauauacauauuuuugaaauuuguauagaguuuggaugaauauuaucaauauaugauaauauucagaaacuuccaguuuuuccaccuccuaaggauggcauuuuugauaaugauagcuacuugauaaaaagggguagcuccccaucaccagcucugguuacaucuauuacaugcauacauagacauauauaauauguacauauuauauauacauauaaaauacaugcgcacauaugcuuuuguucaagauagaguauagaugacugucuuuaggauauuacaaaaaccaacgauucagggaguuggcugagcuaaauugaucucugagaucucuuucaugcucagauuuacugggcuguauuaagacugguaccuugaaaacaaacaaacaaaaaccaaaaaauaauggugucuuggccagacaaugguggcucaugccuuuaaucccagaacuuggaagccauaguuagguggaucugugaggucaaaacuagccuggucuacauaguggguuccaggacagcuagauucauguggaaagaucuugucucacaaaacacaaaacaaaaacaaacaaaaaaagaugccuugcugugaggaaaacgauacagaagauguaguuuuugcucugagaacuaacugaagacacagcaaguauauguuaugagaauauuagagacgaugugaaugacagaaaguuuuccuauuuuuauggucucaccauauagcucugucuacccuggaacucacuauguagguuagacuauucucaaauuacaggaucuuucugccucugccuccaaguugcuggaacuaaaggugugucccagcaugcucagccuuuuccucaguuuguuaagguagaagguuaagcugagauuuuggguauaacccaggcuugccuggaaguaacucacuguguguccaggcuggccuugaccugaagauccugcuaccucaguuuucagccauuccuuuuuuuuuuuuccuuuugcuucuguggauugauuuaacccaggaucuuauguauguuaaacauacaccuuaucauucaugucccaacucauuuuuucuuuuucuuuuuaaagauuuaucuauuuuuauuuuguauauguaaguauuuugucugcauguacauuugugcaccacauacaugaaaugcaugcagagaccaucagagugcauccgaucuccugguacuggauuuacagacagcugugaggcacuaugugaguguuaggaaccaaacuagguccucugaaagaacaccuuuuaaccacuaagccaucucuuuccguccccccuuuuccuuaauguguguauuuauaguauuggugaucagaaauaaaauugagauguagagaccuaauuuucaggcagucuuuuuaacuagauagagaaagggggcuacaaaacaggaacaaugcucgcuauaggauauccaguugccaagcaacggagaagaacaggcauuguauuugaauuguuggaaugaucagcacucuggccauuuucauuagauaugaggauggauuuugaggaaaucucuuacuaggacuugagauaugguagaacacuuaccuagaugcacagacccugaguuugaucuuuaagcagcacacacagcacaacacacacacacacacacacacacacacacacacacacacacacacacacacacacacacacacaaucucuacaugaucucuuucuuuaguguaaggaauuuccuguguaaacagaugagugaucacuuugucacagcagguaucuaagcauuacccuggauccagugguuuguugcuauuuuccuucuaugauaaggagacaaagggugggcauauauuaucauuagcaagagaggaagcgacucuugguggguuacaggucuaugaauuguggauuaggacugugagaaccuguguuuguuguccccuauuucuacuuccuucccccuugagguuuucuuucucuguaguccuaagggaguucugaagaguggaggcuugugcuccagaacugcucagaacugauuugggacuguuugcuuuaucuauuagaggaauggaaugucuuuuuccagugggacauaguauuugcaucaggcaucuaauauggauuaaaagcugcaggcagaauaucagcuugacuuggaauugacagagucuagaaaaugaagacuacaguuuaucaaauacacacagaucaacaauuagcaguggacuaauagugacuaauggcuccuaucaugguagaagccagcauuugguauaauccuuucauagaucuuuugguucucugugugcagcccacauaggauccggcaagauuuuuuuuuuuuuuuuuuccgagacaggguuucucuguaguccuggcuguccuggagcucacuuuguagaccaggcuggccucgaacucagaaauccgccugccucugccucccgaguucugggauuaaaggcgugugccaccacgcccggcaagauuuuguuuuuauacucuaaaagaaccuguugguuuuuuucuagauuaauaguauauuauagaauaugacaagugugguuugucuucaaacaaaaaguggugguuaaaaagagccuucuguacagcaucugggaaggguuuaauuuuaggcaaaugccugugauggcucauagucucaagaaggcaauaggugauagcauaauucagggcccugaguuuccuggaguaguaugucuaaagucuguuuaaguaauaguugacauuuuccacucuuccuaaggccuggaaaugccaggcacaauguaguuuauaauuaaccccaaggguuugggaaagguugcauuuucaacaaaagaaagccacuuaucaccuagcagggacauugacagccuaaguaaaaggcauuuguaagaggcauucaguacuucuagagccuuuuuaauauaguagggaaaacauauccauccuauaaaaauaccuguaaacaaaauaauaauaauaauaaauaucugugaacacuaauaaauguuuauauccaucuuuaggagguuuuugaguaaagucuaauagccaauuuccccuuauuagguaccagguauuagagaggcuuuucaaauuguggagccgcugaguggguuuaaagcuugcuuauuuuguaugcaaauuugauaggugcaaacacuucuuuaacaauuuuauaagugcuuuucauaagaaaguagcuuuuccuuaggucccuggugagugacuagccucugcagucagucuuuuguccauugauacagaauccccacuuacuccauuuuuguacaccugaucaagggcauuuggcauucugauuaggucaggaaaaucugggacuaugugcuucugugggauccugugugagagcuuggguuuuagcuacaugcuuugcaaucuuaucugucacuuuggcuuguuaagaauccauucuaugguggcgcacgccuucaaucccagcacuugggaggcagaggcagaucucugaguucuacagagugaguuccaggacagccagggcuacacagagaaacccugucucgaaaaacaacaaaaaacaaacaaacaaacaaaaauggauuccauccuauuggguugggggggugggauggggauuuuugcggggaggaaggaccaggaaaagggauauuugaaauguaaauaaauaaaauauccaauaaaaagaauucauccuauuaauuuuccuuuuaguaaguucuuucacuuauguaaagggcuauacugauggagaacuuucagccuuuagcauucuuuuccagaagccauagacauacgauaguaggaauucuuacaucaagccuauguagcugcuuaaggucuuucuuggccucacuauagggccugaguaagggcaaugggauuuugcuuuggggacugaggcauaaagaggaagggcauuugcuucuauaguauggcagguagcuacagcaucagccuauuccuuuaauagcuuuuguaaaacuauugucaucuguaaacagccagccuuggagcuauccagaagcauauuuuuaaauaugauuggcuggaaaagguuuagugaucuguauauauugauaaucuagaggagacaaacuuggaagcaugauaguugaauuucaaguuuuagcacacaugcagggcuugauagguucucggugaugccucuugauuucugaaacucucugaacuugguaaaguuugaguuucauauguuaccccaaaauuaauuuuuaagccuuuuaaacaagcagaauuuaaaaguuaaaaguaguuuagguagcuacugcuuuuaaauagcaugacuaucacugagccacuaaaucuuguuguuuauagagaauagaucauuggucuugggaugugucauaguuuauaggcuaaaaucccuaaagucaaaccuggcacaccauauagaaaaagcauggaagcuuucaggaaccgaggagaccuaaaauggaggugugcaacuuaguuuggucuucaguuggucaaaugcccuuugaucuucuuagaccagcacagaggcuuuuucuaauccccuuuaaugcuucucacuaguuucauaucauuuaggacgauauucagcaaaaagccuuuaauuccuagaaacccucaaagaugccuuguagacuugggguuagacaacaaaauggaagccugcuuuccauugggggcuagugugcagacuucuaggguaagaauccuacaugcugaacuuuuugaaagguaaucagcaacuaaauuaaaaguauagugguuuauaccuauaacaccagcacuugggaggcagaggaagaaacagauuagaguucagccugaucuacauagcaaguaccagaccagccagucacacuacagagugacucugacugucucugucuacauguuucucugucugucugucugucucacacacauacacacacacacacacacacacacacacacacacacacacacacacacgcucuuuacacacagucacacacacaugaagaagaagagagaagagagaagaaaaaagaagaaggaaaaaguagcuaugauacaguagccugauuuaucuuagugguaauaucaauaccucauuaucacuguauuuagauaggauuccauuuuauaauuguaauguuaguaggucuugggcuaaagcauuaccaaacaaguagacugucccuaaauuccuaaggcaauacuauccuggcauacuggauagcuucuugaguuuuggaguucuuccauuuaaagauaagucauguauaugaguaaaaugguauguaaaguaagaugucauuuaaaagaaaacaauaaaauauuuagcugguauuugaauaaggucuagaauuucuggccuauagaaauagauggaaacaacaauuucacuuauaucccugagauucuuugauggggauauuuuccagagggugucuuagugggauuguugaguguuauguuggagauuggcaugcuugaauaagcuacuggccaagaauuuucucaauagggucuguauuccacaaagacauuuggauuuaaaugggauaaucuuuucuaagaguauuggacccaauguuuuaauuugaucugaccuggggacagcuaauuguaugcccuggguuggugguaucccagagcgugagcuucacugaaucaaguacuccuucaaagaagagaaucuucuccuguuuaaagaggauaguaaaugaauucccugggcuggaggaaccuccaaauuuggcuuccaguuaaugaacugcuucuuccuugcuuagucaauagaucccuuacuaacagaggggugaugugcuucaggacauaaagaaaguacauaaagaaauuggcuuggaaucuaggcaagauggugcacaucuguaaucccagcugugaaguuuaaucaggaggaucaagaguucaaggccagucuuaguuauauaauguggucauagaggugggguguugucugaauaccaauuucacaagcaagacaaaaaguuugguuugauaaacagcccagugggucaagucagaacagaauaaacagauccauuaaucagugaacagucaagugauuuggccuaccacauggaaaaugacacaauacauacauggguuuuuuuuuguuguuuuguuuuuguuuuuuaaaaaaagaaaaaagaaaaauaccugaguauaguaauacaggacuuuuaauuccagcccuuggagaucagaggcagguggaucucugaguucaagaucugcuuggucuauagauugaguuccaagauaaccaagccuacacagagaaacccuguuuugcaaaccagacaaaaaagaauagagcuggguuuucauuccuuuacuguauaaccucuuagaccuuuaauaaguuaguuucauuaccuacuucuuuauacccuuggcaagacacguagggaaaugcuacauuuauucccugugggcaucacagcuguaaucccacuuagaguuggguguugcuguuuuugucugugucuuaguuacuauucuauugcagugaagaaacaccaugaccaagguagcuuguaaaagaaaacauuuaacuggggucuagcuuacaguuuuagaagguuaccauauuauuauuaugcccagaaacauggugcaagcagguaggcauggugcuggagaaguagcuaagagcuuguauguuaucuauaagcacauaagaggaagagaauaagucuggcccuggccugaguuugaaaccucaaagcccaccccuagugacauaucucuuucaacaagaccacaccuucuccaacaagaccauacuuccuaacccuucccaaauacuuccacuaacuggagaccuagcauucaaacacaugagccuauggagccauucucauuuaaaccuccacauucuggaaggcagauccuacacuauauacacugugaccuagaugaguaagaacaaauuuaucuguugccucuucagccucaguuuuagucuuuauagauauuauagagcaacaaaccaaagcuaucauuacauuuuuuauuaggugaaggauaggagaaacuaugauuuuuaugaguucauccuggaauuuauuggacuucucuaaaagcuugacaauuuuuucuuuuuauguccuaacucugaaauggggaagaagacauauacuguaaugaaagccacccaccucucugaucggauauggcccuaaaugagaaaauuucaauaguugauuccaguuuuguguaagagucccacaggagaaguaagggcuaccuucuuuggaguagagcaaggcagaaggggaguggugccacaugaaguggugguagcagaggaagcaaagcacuauggagacaggaugucagcagauccugaguccagccaugguggugggccauagggugggccauauacaauguacuaccuaucucuucugaacaaggauuguuuuuaaaugauaguuguaaacuauguagaugcuauaguuguuuauuuuaaguuuuggaucuuggauaaccaaacauaaaucuguauguacagauuucccguuuuucuugucucuugcagcagcaguucagauauaaaauggcuuaagaauuuagaaagcuauuaaggagccaucuuuucugacuaagagcauaugccaucacauuuaaucucaacauuugggagacaggaacagaugaucucugugaguuugaggccagccugcuuugcagauugaauuccaggucagucagggcuacauagugagacccuaucucaaaaacaaagccaaagacaauuaucucuuuuuuuucuuuagagaaagaauccuucuuuuagagcccaggauuccuguaaaucuaaugacucacaguaaguggcccagggauguaguauaaaacccaggaaugacccacacacacgcuauguucauggaucugugacaacaggacaagaguagcuugagacgguacaggcuggcucucuaaaggaaucuauccuggcucucuaguuuuaagaaaaucuaucagguaaugaauacauguauguauauauguucacauauguguggguaucuuagguguuaucaaacacaaugacuaaaagccgccuuggaggaaaggguuuauuuuacuuuauaacaugguucaucaucaaaggcaguugggaaagaacucaaacagggcaggaacauggaggcaggaggucauggaggaugcugcuuacugacuuacuccucauggcuuguucagccugcuuucuuauggaacucaggaccaacagcucacucaugacaccacccacaauggacugggcccucccacaucaaucaccaauuaagaaaaugcccuacagguuugacugcagccugaucuuaggaagacauugagguuuucucucagaugacuugagcuuguauggagcugucuuaaaaucuagccagcagaaugaauacuguguauguugguguguguguguccaggguugaugugugucuccucaguuggucucuauuuuauugauggaggcaggauuuuucaguggcacucaaagauugcugaucaacuagucuagcuagcuggcuggcucaggggauucccugucugccucccaggaacugggacuacaaugggccaccaugucugucuagcuucuccauggaauuuggggaccugaaguucaguccuuaugcuugugcagaaagcaguuuacucacggagccaucccccaaguccacagauaacugauucuugagcucucucuucagccccacagauauuaaauuucauucucauuccaaucaaaacccaaaucacaauccaauuuacauacaaaauuagaauagcaaacaaggugccugaggugguaggcggcggcaucauggagaaagcaugcaagucgugcaaggggaacggcauuggaaaggguggccuaguucugaaaggacucagagaggggucaagggauucuugucagucagauggguucuaagacaugggagcagugggaagaaggaacagagaggaagagaaaagggaaaagaaaccacauuaaacaacaauccaugacugaagacacgaaccugucagaugacauaguaacuacuuuuagccagugacuuucguccucagauggcuggcccucugaaggucuuaugggaccagagucuuaaaugagaaaaagaugaaaagaacuuaaacccuggaguucugacaaagcuggaguccagaaacuucacuaggucccagugguggaguauuccacugcccaacucccacauccaagugcaggaaaggguaaagaagagggaacuucugccucuaggguggaagaacuggcagucucggggacauccggagacaacuuccuggauggccacucuggagaagacccaggcaacugcucagcuggagaucaaguuucagguuccaaguuaaacagcucuugcguaucauauccguguacuucccugcaguuacuagggucauauuggacacaagggagcuuugaucuagcaaguacagaaaugacugagauacagagaacaaacuaccaagaaaagccuuaaauaggaagaaaagggggugcgggaauagaagacagcauugauuguaugagauuuagcuugucugcugccaaaggggaaaagauaguugucagguuaucucagauguggucaucauuguucaucaugaaggugguguuuuuaaagacucuugucuuugugcugucaggacauuuccauauguaagagacagcuacaccgcauugugucggugaugacgcccuuacccccccccccccaucccacccggcaccugguuuugcuugccuuuuuguuuguugucucuuuuaugauaaaaaauaaaaugauaggcacauuuugguaggccacacauuuauacauuaaaggcaugagauuucuguugcaugugcagcuauaaauuucccugugagucauguauuaguugugugagcuuugcuguguuuucauuuuaauuuucuucacaguauuuucugauuucucucugauauauuuaaauauuuaagaguguugauugcagauuugggcaacacaaacggucuuugaugggguggaaagggaagcaaggguuagguauauaugagaaaaguuuaagaaaggguaaaucaaauuuauuguaugcgauucucaaagaacugauuuuuuacaaaggagcauguugauuuuguauuuguguuuuguuugucuauuuauuuguuuguuuguuuguuuguuuguuuguuugcaguacggggcauugaauccagagacuucugcguacugggcaaguauucuacuauugagccauaucuccagccuuguuuguuuauauuuuaacuuuuuacuuuuacuugguguguguguguguguguguguguguguguguguguguguguauuuaaaagugagaggacaauugcaggggcagcuuucuccuucuccuuguguguuccaggcaucauucucaggucauuaggcuggaaggcaccuuuaccugcugagccgucucuccaaucugccgauuuuuuuguucucuuucuuucuuucuuuuuuuuuuuuuuuuuuuuuuuuuuugagacaagaguuucucuguguagcccuggcuguccuggaacucuguagacuagacuggccuugaacucacagauuccuaccugcuucugccucuggaguucuggcauuaaaggcauaggccaccaccaccaccuagccugauuuauucuuuguauaagucuagaugacacucuguaggccaagcuugcuuagaaccuacagugcugcccaaaguggcuucaaaauucauaauccuuuuucuucaacuucucaggugcugagaugacagcagacacauggugccaugcccucaaugaaguuaaugucuacauauuuuuuauugccccaaauuugauucuuuauuaguuuauuauuucauuccauugcaguuagaaaacuuguuuuuuuauuucuauuuuuuaaaauuuaucaaaguuuguuuuaaagaauaucaaacauaguuuaugcuggaagaugucuuguuggcuuaugauauugaggugguuuucucuucaguuguucagucauucuacucauuacugaaacuggaguaucuaggucuaugauugcuacuauuccauugcauauuuuccccuugauuguauacauuuuuguuuccuugaaauuugauauucuuuuauugugcauguauauuuguuuaaugaauuaacucuuuuaucaucauaaaauuuccuuuauuauuuccaguaauggucacugucaacaacuauuuauugguuguuuaaucuaguugcauuuaaugcuuguauuaauacaguuguaguuauaauugcuauuuuaauuuuuccuguguaguuaauaucuuuuugcucauuuauuuauucuuuacuauuuuucuuucaaugaagugaaugaagcauuuaaauuuacuuuauaguuaucaaaauauuuuggguuauuuuuaaucagugcuuuaggguuauauguacuauacagaaaauauauaaaguacacacauacauauguguguguauacaccaauugauuaguguccguuucaagcacauacuaguuuauaccacaauuccagugugguauuucgaugucacccuuauacagauccaguauucuuccucuuuuuguacuauuguuuuauauauaguauacugguuaauguuaaaaguacaaccacuauuacacuuccuacuuuacucuguagccaugccauuucccuagcuaagugcaacuuuuuucccagugccuuuuauucuuuaauguguguguguguguguguguguguguguguguguguguguuaguguguguguguaccaugacacuuuuguacaggucaaguacaauacuggauaucaguccccucuucugcuuuguuugaaguggggucucaugucauuugaugcuauggccagugguucgcaaauuucugggaauucuccucccaaacacugcaggaaugcuggguucacagguaugggcucuuccauggguucuggggauuagaacaccaguccucaugcucgugcaacaagcauuuugccugcugagccauuguaccagcccccagugucuccuuuuuuccaugaauuaacuuuaauuagcauauaagguaauagguucacugugacauuuacaaaugcauuucauugugugcugcucacauucacuacuguucuccuccuuccacccccuucaucuuccugcucccucucuccuccaaaguacuucucuucugcuuccugucacucaugcuucccacgugaggaaagccagugacacugccuuucugagcucagcuuauuugacaugaggauugcuuuuucuaacugacacagcucuuuugugcaguacaagcaaaagaauacauuuauuuguauuuuaaauaaaacuauauaucacgugcauacuauuuuauauaacuuauuuaauagaagaaagaaaaauaugcauuuauucugcuuuugaaauuugaauucaagagcaguuuuacaauacucuuuguuuucuuuggauuguuuaaaauaacuggggcucuugcuuuuagcuuaagguuuuuguuuuguuuuguuuuaguauugcuaaaagauggacauacauucugaugaaacucuuguuaggugauuucauuguuguuugaauaucacacaaucuacuucagcaaaccccaaugaggcagccuacagcauagcugaacaguaugguauuacuauugucacaggcuacaugccaggcgagaugggacuguucugaugcugaggcaguuacagcacaguggggacuguguacguauccaaaugugaaaagguacagugagaauaugguguggcacauuuuagaaugguggauuuccauuccacgaagaagugugccuagcugcaggcugcucuugguguaucaguaccugagcuaugagugacagagaaaguccccacccccacccccgucgucacccuucugccuacuguugacugacacuacacuuagacuacucuaaauuuauuaaaacguuuuuucuucuuuggaugaucaauuaguuuacuuuaacauuuaccuuuauaaacuuuaaaaaaccuuuuuaacuuauuuauaguaacauucaguuuaauauauacauccauaaacuacauaguagauuuuuccccuauauauuccugaaacuuuuucuauuaaaauuuauuuuuauuauuuuuaaaacuuauuuauaaaggggcuugugagaugucucagcagguacgagcacugacuauucuucugaagguccugaguucaaaucccagcaaccacaugguggcucauaaucacccguaaugagaucugacaccuucuucuuaugcgucugaagacagcuacaguguacuuauuuauaauaauaaauaaaucuuuaaaaaaauaaauaaaauuuaaaaacaucguuuauaaaaacaaaaacaaaaacuacgucugagagagguaggaauaucucugugaguucaaggccagccuggucuacagagugagcucugggauccccagggcuacacagagaaacccugucucaaaaaaacuaacaaaacaaaauaaagcaaagccacaaccuuguccaugagccuagggaccacauaggucauuagugccagugcuucgcugauacacaucuuccugccauccucucacacugcgcucucuucucuggggcugcagggucagcaguucucuggagugccaacuccugugacugcccuguccuguaggauccuuccuaaaagaccauaaagcacaaaucauuuuuaaauguauguaucauuuuuaaaccuguugccccuugucuuuauuuauuuuccuauauauauuuccacagauguuccucauugaugaaaaccuuucaguuuguuaucuagguuuuuaguucuuguuuuguuuuguuuugcucguaaccuuuuaaaggaacuugagccugcaaaaaccuuugcuaacuguucauuguucacuggcugcugcuucuuuuucaccugcacuuuucuuuucucuucaucccugucuucacuagguaugcuacagcucuauuauaaccugguggaucacccaaauauuugucauuguuuucuaaacugcuuucuuuuuuaauauccuaauuuauauugcucugucuacaggcuugcuaaucgcuuucuucaccagcucagaucuauugcugagccuuuccaguugaauauuucauuuccauuaucuccagaauuagcauuugauuaggaauuuuuaucuuuuuauuaauaucaucuauuuaaugcaaugcuguuguauuuuacuugcuuauaauucuguugccuuuaguucuuugagcacauuuauaaugggcaucuugaagcccuauauuuuauuugacaucugcuugaguuggcaucuuuuccaggucaggccaugguuucuugcauguuucagcuuucuguuagaaauuuggccuuuuagauaaaguagcaacucaauauauacucuauacucaccagggcugauuauugcuguuuguuuguuuacugacuggcuagaugauuguagucaaauggacuuuucaucugcaguacugucucugauauucuuacuuggguuuauccauagucacucugagauaaugguggguuguucuguuguuauugucagugaugucaaugguuuuguuuucagauagucucauuguguuucauuggcuggccuggaacuuucugugaaagccaggcuggucucaaauucagagauucaccuaucucucccuccuaagcucuaggacuaaagguguccuggaaugagagcaguuuuuacucaacucagaauuuacauuuacucagcuaacugauagugauugaauuacuguuaacagugcucuccaccccucaaucucaaauuuguaguuuaguucaguugaacucauuggaagggauguuucuggguuuuauguuugaaaauugcccugaccccagaaaaagugaucuguuuucccauaaaagaaucaucuuacagugucuucuaccuguagcuccaguaagccgaccaaucucuuuuggcuguuaucuaacuuacuugaaauagucucugccucuuagucuuggggcuagaggugaggacaguaccaagcucucuaaguagcaagaugcuucaguggcuagaugaguuaguauuucccaucacuguggcccagcuucugaugaagacaauuauugaaguguccgggaaugucacgugugauggugugggauacucugaagcuccucacauuugguggaucaagaagcagaaagaaagacuaaaaggagggccaggcuauaacucuuacucugccagccagacuccagaaccucccaaaacaagaccggcagcuguucaaacccagggcccugugaggguguuugcauucaaagcagaaccgugcaagguagcgugggcacaguaaacucaggucugccugacucgccucucaucaucauggaggcaguugcugccucacacgucugagcaacagacgggcugcagaauucuagugaugcuguacccaaagcucauccaggucagaugggugaaaggagagagagaugcugcuacauggcuguacacucucggagcuuacaccaagugauauuucugucuaugaugacagcuuccaguguuagagcuuagaggaaagagcccuguuucuugguugcaccaguuuaugaugggauagaaugaaaugaaggccacgcuuuacugagaugagaggguagagaaaaugguuugguuucuaguaccuaccaguuuuguucucauucuuagcaauuucucguagcugcucuugaauaaauguguuucauugcuguacacccuugugauacuucuguagaccuuacuuuguuuauacagcaucuuucuauggacccuaaccuggcaucaaauaugugauucuccugccucagccucugaaggcuaggauuacaagcauugccaccaaguaugacugagacgacuucuucuucuucuucuucuucuucuucuucuucuucuucuucuucuucuucuucuucuucuucuucuucuucuucuucuucuuuuuugagacaggguuucucuguauagcucuggcuguccuggaacucacuuuaacuucuuaauaacaguuuucccaguuuugcuggagagccguuccauggacacaugagaaguuaucucuuacacaauagauugcagagaaaauuagagaaaugaauuagaaagcuucaucugaggcguaaguacaaauaggcuaauaggacuaauuggguuguuaauguguguccauuuaucagaauuaucagaggauuuuuauuuuauguagacuagaucucaauaagaugaaccaauaagaaagcuauuauaaguauggucacagauuuaaagaaaaacuuaaguauaaugaggaaauuauagaaaguguuucauuguuuguuucguuuucaaaacagggcucucuguguaguccuggcuguccugguacuugcucuguagaucaggcuggccuugaagauuuaccugucucugcugggauuaaaggugugcgccacuacugcccggcuguuuuguuuguuaaggagagaaucacaaaaugaacuauagaucuuaaacauacuaucuuuguaacuuuaaaucuuuacuggcuagguuuagcagauaagaggccauuaauaguucagugaauuuguaauguacaguaagagacacauauuugaagcauauuguagaaaacaaaacaaaaggccaaaaucauagagucuuaagcuuugugggacaccaagcauucuuaaacauggacuuaguauauguugcagcaauuuuuacuccuuuuacacauaaccacauaaaggcuuguguguguacauucauuacaacuuuauuuauaguaacuggaaauaacacaaaugucaugaguacaucaaagaagcaaauuggugaugucuuuggaaagugaauuauaauuugcaagaaaaagaaacaacugauacaggcaaauauagguaugagauuuauaagucagaauaaagucaaacaaaagaacauaugaguauaauuuuuaaaagguaaacuaugacuggucuaguugugcacccuuuaaucccaggccuugggagucagaggcaggcaguucuuugugaguucaagaacagccuggucugcauaaguucuaggauagccagggcuacauagugagacauauaggaacuuuuuuuuuagcauaaugaauauucuguaucauuguagcuaugauuaucauuuaucaaaacagaaagagauauacacuucaaauaguuuaauuuuaugguucauuucauuguguuuuuccucaaggccacugaauuuaagacagggucucacuguguggcucuaacuggucuggaagucucugugaaaacuagauuggccuugaauuuggagauccaucugccugcaguugaauguaaaagcauaguauuuuuuauuuuaaaauacugauugguuguuuuuguguaugugugucuugaauacaugugcacaugugugugguaccuucagaggcaggaaaaggguaucugacccucaggagccagaggaacaggcaguuguaggccaccugauaugggugcugggaaccaaaccuggguucucuggaagagcaacagucaucuuaaacccuaauucauaguguuaugguuacaguucaguuuauaguugcuacaaauguaggacuaaucaugucccucagagaaggaucggcucagucaauuuugcuaggucaauaaaguaauggcuucagcucauuaauggcuguguuugcguuucugaagcacucuagcuaguggccgccauguuagacaacauuaacauaaagccucccagcaucgaaaguccugcugcacagugcugcucaaaccaucugguuccucuuuggucagcuuguaggguuucugccugcuguugcucucacacugcagccuucccugaccggcuuccggguacucugccagucuuggauaucaagaucuuacauguccuagaaauaucauuuuacccguauguuugauuaaggauauuguuggaaauaaaaaucuagcauguuaauuaucugucuugguaaauuugggggacguuguucuucuguggucuagcuuucuguauugcugcuuuuugggaaguuucagaccuuucugauucuaaguccuuguucauuaucugaucacuccugucugaaagcuuuguuccucaagguuuucaaauuuuauagcagcuucccuugauguaggccuauuuuuauacauuauuuguucugguuacauagugacccauuucauugagggagggcacucccucaauucugggaaccuucuugaauuauuuccuuaaggaaaacaaugucucaucaaguucauuucauguuucuucuuuguggaaccccauauagauaucagaucuuucguauagguauucuguuuguuaaaagauuuguaaucaguuuugcauauuucuacuguucuuguccuggggaaagagaacucucaacacacuccggauucuuucucauuuguagacuauauuuucauuuccaagaccuuuguuguuuuucucugaauacagcuuucugauagcauccuguucuuguuugugguuauagauuugucuccuaucuuugaaaauauuaauuacauguauucagucuaggaggguuuuuuaaaggguguguuugucugucugucugucugucuguguaugucugucugucucuguguguguuagucugucuucaggcucuuguauuuguauuauuuauuuaaauagggcuaaccucaaauuuggccucccaaguucagggauuacagccauauaccucuauguccagcuuacgagucugucucccuccuucccauccacguguuaguguuuguuucuucuguucucuaucucaucucucuagcuccuauguucacauuuaagaguucagagacuuaaaaaaguucugaagcuugcuguggccuucauuauauaaugacuuguucaaaucuuugggagaauucccaacaucuguguuuuaaagucuuuguuuuucuucaucaguguccacaaaaguaugcuauuuagcuaaacagacaugagauguaaaggccccucccgucguguguguguguguguguguguguguguguguguguguguguguguaggcuagaagaaggcaaucucuuggaacuggagauauaggcaaucgugagccacuugaaguagguucugggagaagaacucaggucccuggaagaacaaccagggcuuuuaacugcugagccaucucucuagcccagcuagugucuucuuaggcuuucuguccuuuuaaguuucugcuuucugaauuuauccuuuucauucuagugagguuuuuccucaccauucuguccagaagacaguaaauacauuucuaaaaaaauacuucaaaaaauaguuagaggaccuagaaauaaaguauuuuuauccauuuugaccugaagaaauaaauauauaaauaagcuucauacagaguugagaauugccaaaguuuagauaaaauuuaacacgaaaacuacccccaaaauacuguaaaaauaacacaaauauauuuagauaguaagugugaauggcccagagaagacaauauuaauacauugucuucuauuugaaaugucuucuggguagaaggcuacuggauagcauaaucuauauuaucugaaaagacuucaaccuuaaaaaaaaauucucccuccuacagaauauuuucagagcuuucagaacaacucuaagcucaauuuugaaacaaaaaauaguaaaagggauaauuucuuguugguuuuuaaggacagagaagucaaauucuuccacuugcuuuuaugacauaaaucugaaauuguucaaaaauuagucuuggaaauuguaagggaaauuuaaagaagcuggucuaacauucaguggggacaagaaguguaaccuuccugugacccugguuagcugcauucugguugcugugcugacucucuccuuacagcccuccccuccugagacggccccuccuaaagauaaaaggacauaucaucaucuacucuaugaugauggugauauauucuuuuauuucccaagccuuugcuuucuagugugauauuaaugagaacacaugacauaaguccagaccgucaucugcagccuccucuccaacguguaccaccaccagcuagcucaucugcuuuagcauaacuauagcuuuccucagaucacuucccuagucaccaagaucucaugacugccauuuccuacuacaucaagucuaaacaccucugcccagcuucaggcugcuccuagucugguuccuccugaccuguguuuuuaucacuguugcccaacacguucugcugccuguaguuagguugguuucucacuggcaugagaaaacagucaaguccauuuaugcuucccuauuuuagcaaauguauuuuaucuuguccaaaaugccuuuucuaccacuuauccgaacucuguucauccugcaugacaauucccuuaguucuucugugucuacuucucugcuuucuguuguuuuuagcccaguuuacucagacuuucaucucgacagcuccauugucuaguccacaguucuguucauuuuccuaacauuauucacuucucauguuaguuuuguuucuguugcugugauaaaauaccuugauagaaagcagcugaggggagaaagcaugcacacugcccagguuaguguugacagucccugagacuggcaucccaagugauucuuauuguaucaaguugacaaauaaagcuaaccucacaccucuucaucuuuuccuuuucaguaaguaauacuaucuuuuaucugguuacaucagucaaaauccugggagccaaguggaucacugugaguucaaggccagccuaguuuauagagugaguuccaggacagccaugucuacagagaaacccugucucaaaaaacaaaacaaaacaagcaacccugggagccacccuugguucuucacacucacaacccacaucuagcucaucagggguccacugaguugcuuuccacacaagguacauuucacaucaaaccacuucucacucacugcugccacucagacagacagcacauggcaccuccgagaucucuuugcucuuaguuuugcccuugccugguuuaguugaccugagacaucuuuuaaagaagcaucccuggccuggcaaugguggcgcacgccuuuaaucccagcacucgggaggcagaggcaggcggauuucugaguucgaggacagccugcucuacagagugacuuccaggacagccagggcuacacagagaaacccugucucgggaaaaaaaaaaaaaagaagaagaagaaagaggaggaggaggaggaggaggaagaagaggaaggaggaggaggaggaggaagaagaggaaggaggaggaggaggaagaggaggaggaggaggaagagucccugauaggcuccagcccagacugugaccugacauccuucugauuucuucccauucuuuuucaucuccugucccuggcacagugcuuuugacaccucacuuacucaucacagagcagucguagguagguuagagacaaguuagugccucccaaaauauuuauuuaaaauauguauauagcagaaaaugcuaaguccuuuuccuuaaaauauuuuccuaaaaaucaacauuuuuauauguuuacuuuuauuuugaaauaaugccagguuugcagaaaaaucugcagguucagcacaaaucagauuuuuuuuuucccugaacaaguugcuucauuauccuagaaaacuuaagcaauuccuagaaauaaaaccauucaccuccauagugacaguacaaccauccgugcuaggauaaacuuguagaauaacuguaauguggcccuuagacuccaccccaguuuccccagcucuccuaauacuguuccuuauuacagaaggguccaggucagacagagcuuaauugacuuaugcaaaauuggcaaaauuaccaaaaugauugccaagguuauauuuauugcuaugccaaaauggguaagauguaagaacuauucaugaccaguaggcugaggacagauuuauguuaaaagacuccuaaucucauacuuggauuuagaucugugaauuccuuaagacuuuauucuuauuuaguuguuacauuccuuaagccuccuuuaguuaggaagucuuuccuugauugcacugauuguggcauguuucaauagaacugucucccugaucgucccguaugcaucugacccauguguccucaggauuaaauucaggguguguguguguguuuaaguacuccagagugguguugaguaaugacuacuuuaaguagcaaaugauuuugauuugucccauuguuaacuuuuuccuuggugauuugaauagggugguaucuguuaggcuucucuauaauaaagucagucuuuuuuuuuaaccguuuagaacuaaucaguauagaguccucuggaacucuacauuaucuucaucaaacuucucauuuacucacuugugaauccagugugaauucacccguugcugucugcuuugaugcucauagucuuuugauauuaguaauuaucccaucagggaggcucuagugucccuguaauuguuuacuagcuacuugcauucugcccugacaagcuguuccagauuuauaguuucccuguuccagucccagaaucagauuuuuuuccugaaaccucuggauauguaguaguuucuuuuaguaaacaaggugugagcucucucaguggacagagauggagaauaugucagugcacaagugcuugagcacaaacacacacuugcaucucuaugugcguaucugaguggaaguccaugauuucaugcugccaguccaauacuauaaagaucauucugguuuucucacuuuccauauuuaaaauuuuuccaucugugagaacuugggcuccuaucauccauaacauauuuaguugcuucccuggaauauaaccaaauuccuaugcucauuuuuuccauacauacucacaaauaccugugucaccccucccacccagggcuccugacuccacccagauugccucccuagccugcugggucuuuggcauucuaagcuaggccuuuuuuuuuuuuuuuuuuccauagaaguaaaaaaagaggauuaggccucguaauccuguuuauauugugauacccagaugguggucaccuuugcuugugacacacccuccuuaccauaugacuccucacagcaagccugccuucugugaggacccaucucucucuugcucagguccacucucuuucaugcagacugccuggcuuagauacaucucacaccaccucagcacccggcagauacgggcugggaaggagacgaagaauuaaggucaauauuauauuuagaaauuacaucuuuaaugcaugagaaggcuauaccacuucuguucccuuuaccuuaauuuucucuguguguuuaugaacuuuagucugucugcaauaccauaccaaucagaaaagucaaacugcugaaagaacagccaacugaaagaaaugcagaaacaaaacaagcaaauaaagggcucuuuuguaguuuuucaccuucuguucaaauacuguggcauuacaacagucucagaaugacuauugagcaguuaaugguuaguuauauuuaugaaccuuacaucuugaagaggguauucucugaugucuggagccuuuggacuacaauuuaccuugucuuuuaagacugagaaaugcaacuauuuuacauaauaguauguauaacugcuguucaguuauaccacaagauuuugcaaaucaaugucuauguuggaacauuaaugaaagugucuacaagauagcccugauaaccuugguauagagugaguugaggaaguagaguguacucuagucaaagacauugaacaagcccaggaaaaagcuaaugcccuuaaguuugccuccauguauuuucaguguauaagcaaccauuucaagaagcuuucucauucuuauucuuaccucauuuuccucgugagaaucaauuagucuuucuuuuaauccagcaugauauggauuuugcuuaccgcugaucuacaacauacccagacuccugcugcauuccuuggaaauccuaaagcagugcuucucaaccuguggucggagccuuggggauaaagcagccuuucuuaguggucacauagcagauauccugcauagcagauauccugcauagcagauauuuacauuuaugauucguagcaguagcaaaaguacagcuaugaaguagcaacaaaaauaauuuuaugcuugggggucacuacaacaugagaaauuguacuaaaggguggcaacauuaggaaggcugagaagcacuggucuagaugcuguggaagugcugucuuggcucuaccuuucugcucuaugggaucagcaguccacauccguauccucugggagccacggagaaggaaaacuggcucugguuuucuccagccagguggcucauauuagcugggcaguccacuuaggagggcccugaaagccugcuggguggguacuugagcacauccuacaaacugcuuaugaccucauaagccaaagaccaggucucacgugguggacuaagccuaaauauuauacuuuauauuuauguagagucuguuuuccaaggaacuccagccucuuuucagacauuaugucauuaauccucaaagcaucccuguuugcugcauggcaaauaugagucuccuugcuuuuuuuuucuuuucuuuuccuucuguguagaaacuugcaagucaguucuggaacccagcuccccauucuuacucuauauacuauagcaugaaaaggaccagagggcuggcuucgcaguguccccuguguccuggugggauuggaauggaugucccaguuuguguucauaugcagccuggcacucagugucuccagucucaguucuccucuuggaguuuuauuuuuuuuucuuuuuuuaaauuuauuuauuuauuauauguaaguacaguguagcugucuucacacacuacagaagagggagucguuacggaugguugugagccaccaugugguugcugggauuugaacuccggaccuuaggaagagcaguagggugcucuuacccacugagccaucucaccagccccucuuggaguuuucuacauugugggcucagcauguucaggcauguguaguucaccucccugcuguauuuaugggaaaguagaagaucacagcuggaguuggaagugagaaacuuugaacaggagauggacuuccccuugcuacucagagaucccuuaugcucucacacccaaacaccccaugcccaugucaaaguaaagcugaguuuaagucaccacaccaacucguaacuuacuucacuuuauacucaccucuuguucaaugaaaugagauaauguuuaauuagauguaacuaacugaucuguauugaauaaucaacauauacuaaccuuuaugucaaagauuugcaaagauaggaucucauuuuacauauguaauauugcaugagaaucuuuuaaguaucaagucuuuuaugugugaaaauaucugcaguaaggccaucaaaacugucaaaauggcucagcaagcaaagguccuguuaccaaguuaguucaaucccugggacgcacauaguagaagaauagaacuguaaauuguccccugaucuccacauguacaacaugcaaacauacacacacauuuuuuaucuuauauuuuauuuuauuuuuuaucugaauuuuguuaacauuuaauaacauauuuugaguaaauagacuuacaucacauucuucuuucccuuuuaaacccacuccucccggaaagccccuuucaaaaucugcaguaccuuacauguuuuaucacaucuuuaaaauguauaaaauauuguaacaauaaaaaugaguauuauaaaaguugucugauauaaaacaacaaucaauugaacagccuuacguagauguuugucuacagcaauacugaaaauacauguuuuucucaauauaaauuuuaaauaacuccaaauauauuaacuguaugauauuuuaaaauauaucacuauuaguuuuuuaaaugaacauaaguagauaaagucuuuuuguuuguuuguuuuguuuuguuuuuaguagagcuuaaaaucuuggcucuuacugugguacaaacacaaaauaagaacaguuuuggauauuggaguucauuauaauaaggcuguacuuaaaugucccucacaucaccaaagaauuuuaccuccauaguagauaagcuaagaguugacaguucugcugugcccaagaaugaauuguaggcaccauuuuuggauacagauuuccugcuauggucaaagcuauuuugacuugagugauucucgucguucuccggcuguagguaacagguuacauucuuuaaagaaauggugugauacacacacauuuaaaaggaggcgcugauaguaauagcucuugagcuaucugccuguaaggaacuccccaguuacuuuucauuacuauaguggaaauccaagaguaacuaauguucaccaaaauuugaguaaauuauaaaacuugccaggagucagcucuaacccacagaaucaaaacucaaaaggucagcugcagugcagucagugggaagcacgggaggggagggagcagcgcagaccucuggccaagccuuucuucaucucgcuuggauaggugacuccucagcaggauuccuagaacucagaauugugaacuaucguggcacagaaacccauuucacaucccaugucauguucuuuccccguuugguagauguugguacuuggcugaauuuggucauggaaauuaauugagagauauuggguagaaaucagagaagcuucccagugugaaccaguaaauccugaaagccucagagccaaagugugucccaugcccgcagcagcacucagcucucagcucugcugaugugaaagggcucggaaucuaaaucguguuuaacuggaaacugagcagcccugccucaucauggaaaaucuuuauaggcuggaaaacauaugucauggugaaguguauaauguggcuguguucugaaagcacagcugcauugcagugcgcauccaacagccuuggguuuuaaguacguuuuccaagcauugcaaacaguguuucuuagauugggaauacuagccaaagggauggucuuuguauaucaagucaaaacuuaguguugggauuagaaaguguguguguuaaaaacuaguguucaaagccagaacugaggcucagugauaaugcuugucuacuguaaggcccuggguuuauucucagaagggcaaacagcagcagcaaaauaacuuugagauguuugugcagcaagguuccaugcuuggaucccugcacgcuuggaggaccaaaacacauagaaguauaacugaggucccuugaguugagcugagucuagcagccuagugcuaaccugacaguaaaggauuugaaaaugcuuguaaucguccuucagcaugcagcucggacagugcugugacugagcugugaccgugguggcucucuuaucauuauuucugcauucuguguuuuugcagcuuccuuggacuuuuuccccuccauguugguuccaaaagacuuccuuugcagccuuugugcacugcucuggcauagucucagcucacguuucaugagucagggaaagcuuuguuaggcagggccagccagcgccaggcuaagguauaaaguccuccuccaucccuugcccuccugcaucccuaaagcacacugcgggcacuguuucuuagcccuuuccucacuuuaguugugcuagauguggcuagaguuuguggcuucugugucuuuuuucugacugccuugaaaugcucuagugcuaacuccugcucuccugcugccaccgugcccugcuccuuuuacuccaaaccuucugcccucugagccucccuucccuccacucucuggcucucuccuuuccuuuaguuaggaggagacccugugguugcuacaugggaguaacuaucugcaggaggggagcugcccgcucaggaccaaaagugacugcuugcuccaaccuccgcuugacugcucucacuuaccaugucuccuacagguuaugucaacaauuuggagagaauaaaaugauuuuuauagcaguuucaguuuuuaguuguaccaaugacuucaaauugagaacagguacuugcugcaaagauucaagaaacugacaaugucaagucauggucaucucuuagaggggaguugaaugacuucaggguccagccucacugcacacuuuuccauuaccucuguguuacagacuucaaaaauguacuauugggauaguaaguaauauaaaaauuuaaacaggaaaauuaaguaguaguaauuuaauggcacaaaaauccacugauuauaugaagugauucaaauguauuaauuugaucaagaaaaagguauaauuguuuuaaauuuuauuucaaaauuuuauucuuuuuaaaauauuuauuuauuuuauguauaugagcacacuguagcugucuucagacaccccagaagagggcaucggaucccauuacagacgguugugagccaccaugugguugcugggaauuaaacucagggccucuggaaaagcaaucagugcucuuaaccacugagccaucucuccagcccagaaacuuaauuaaaaaaaaaaaauccaguguuuucuuucaauuuggggugguaugugguuuuuauuuugauuuugaaaccaaaucucacuacauagcccaagcuagccuuaaacuggcuggcaggucucugccuccugagaguuggggagagagagaaagagagagagagagagagagagagagagagagagagagagagagaucucacuguauauccuacucuggccuagagcucaggaugccccugccucuuuucugagcacugccccauggugaacccccaugccuggcuuucguuugugucgggaacuuugauaugauauugagugugagucugaagagcuggcucagcacuuaagcugcugcagaagacccagguucagguuccagcaccaacaugguggcucccaaugugacuuuaguuccaggacaucccauacccucuucuggcucccaugggugcucgugcucaugcaggcaggcagaacauucauacacauaaaguaaaaauaaauacuuuuuuucaaaaaaaaaauaaguuuagggcuagugagguggcucagcagauaaagguguuugcaccaagccuaaaacccacgcaguagaagaagagugucuacuccugcaugcugcccuuugaccuccacaggagcacuuuggcaugccuccucgaucaauacauguaauuuaauauuuuuuaaaaaaauauuguuugggugccugcucgucuuucagcacuugucuucagugucugucucuuucucuuugagguagggucuagccauguagugcuggauguccuggaacucacuguguagaccggguuggucucaaacucacagugaacuuugccuuugccucaugugugcugggaucaaaggauuguagcaccacacccaaccuuacucucuuauuagaagaaucagcaacacgucagauguaacacagaugucauuguguuauuccucaccuguagguuucuuguguucaucccacaaaccaaacaccagccuugcuuugcucuucucuucucuucucuucucuucucuucucuucucuucucuucucuucucuucucuucucuucucuucuuuuccuuccuuucuuccuuccuuccuuccuuccuuccuuccuuucuuucuuucuuucuuucuuucuuucuuucuuucuuucuuucuuucuuucuuuucuuucuuuuuuauaaguuuauaugcuuuuuguguccaucuuuaccaccagaauucaaaaucaauuacuuagcuacuggaauguagggaaauaacugacuuuucuugaaaaguaucuaguaaaacauuuuggaaauaacuuaugaucuuuaaaauaagacgaauagugaggcaucccaacacuugggaggcagcauucgugaaggccagaagagagggucagcuccuccaggacugcaguacagauggcgugagacacaaggagaugcuugggauugaaccugaggccacuagaagaacaucccagccgcuggucucaacccacugagcuguuacuccagcccuaggcuugaacauauucuuauagacuauccaacaacugcugugggcauucauuaccuuucccuuuacuucacacacacacacacacacacacacacacacacacacacacacacacacacacacaaucuggcuaguuuggguacaggagagggaacuacucaggaaaauacuugcugugcucacauuagggcuugggcccagauccccaguacccagucagaguucccagcuagucuugcagcauuagugagcucucaguucagugagagcugcugccuucuguacaucauaaaaucagauaguaaugucuuuaaaacuuuguuuuacuuacuuagaaaguuuuuccucacagcauauuuagauaaacugccuuccuuuuaacugcaacauaguauuccuuagauuucugcuuuuggaaaccuauuguuuuacuuuucugaguuggcaacauugcuuaguggguagagacaccuccacagaggccugacagcuuguuugaucuccggaacacuugucaaaguagaggagagaagugacuccacagaguuguucuucagccuccgccugcacaccaugacagguguguguguguauucaaaguuaacuacaauaaaauugauacauuaaugguuuaauuuaaaauuuuauuucauaaaaacagugcuuuagcuaugucuuugaacauggcugugcacauauggaauaauuucucuagaacugaccccucaugaaguuucuguagcugauagacugucauguucaaacugugcugcaacaagagauguguuuucucuuauggugcuaucuuuaaaaacacaucaugggcguuuguguuugaguugaagauggucaaauaaccagucuguuaaacugaaaaguuaacuccgauuacuuacugagcuaagggguucacuaaugcuagggaggugcuguacuacuauguuagauccuuuggccuuuacaaagauauucgagacggucuugcugccacccaggcuggccacagacucacacuauugcccaggcagacuuugaacuugugauccauaggacucagucuucauaguagcugggauugcaggccuaugcugugagacuuaaauauuauuuuaugugucuaguuuaguagcaacaaguauauucacauugcaauguaaacaugaccaccacccaucuuugauguccuuauuaaaaacaauauuccaugaaauaguaguuucccugucuucaccaucaucccucagcccugaaaaccauccgucauauaagaaaugccuuacuuuuaagacucaauaaugcuguguauuguauauauaacaucucuccaucugugaauguuguccuggcuaguuuuaugccaacuugacacaaacuggagucaucugaaagagagacuuucaauugagaaaauaccuccauaagaucuaacuguaaggcauuuucuucauuagugauugaugggggaaaguccagcccauuguggguggugccaucccugggcuggugguccuaggcccuauaagaaagcagacugaguggauggagagaugguucagugguuaagagcacuggcugcucuucaguaggaccucuguucaguucccaacacccacaugacagcucacaacuaauauuccagagaaucugucacccucauacagauauacaugcuggucuccguguucucugcuaucagcuaccgcauacagguuucugcaguuuuaaauuccuuaccugaccuccuucuauuauggacagugauuggauuaggacguguaagccaaaugacccuuuccucccagguugcuuucaggcgugguguuucguccuagcgauagaaacucugacugggguggacauguacgugguuuccacuuugguuguugugaguuauacuauaaacguugguguguacauauucuuuaugcuagaugcuccacuacuaaacuaugccacuauacuuccuuauaaauuuuagaauagcuuuuguuuuuauuuauguaagaaauguuacuagguuccuuuucacucauuuaguaggggaggcgguacaugugugucacagugcacguguagaaguuagaugacaucucaucucuucccuucugccuuauugguuccagggauucaaccaggcucaucaggcuuugcagcaaccaucuguacaagcugagcucucauuggccuauuguuaggauuuugaaagguuucgcuuugaaucuauaguaaugacagugauuauauuaagucuuacagcucaugaaugugaacauauuuccauuguuucacuguuucauauauugcuuaagaaacucuuucuaccagacauaguggugcaugucuuucaucccaggacugugagggcaaauguaauagggaaucucucucugugaguuugaggccagccugggcuacaaagugaguuccaggcuaaugaaggauacauagaaagacccugucuuaccaggaaaaagaaagaaagaaagaaagaaagaaagaaagaaagaaagaaagaaagaaagaaagaaagaaagaaagaaagaaagaaagaaaaagaaacaaaguaaaaaccucaccucuccacaauacuguuauaaccaaaauguucuauaucuacuucucauauuguuuaagauucuuuucuuaaauauuugacuccuugagcaagcugaaguuuuucguaguuuaaagacuuuccccacuguauugauaacauuugaacagucugcucugcccugcuaaaacugaaaggucguguucuuaggugugaguagauauuuuauaguugguauaaaucuacucuugaaauauuguuaucaugcucaaauuauucuaauuuuaugguauguuuugguaucuggaaguuuaacucuuugccuuucacaauucuccucucugaacguccuuaugguaauuuucucuaauguaugacuacuagaagccauguaauggguuccaccaugcauauuauuggaauuuuggccaggaucauguuaacaugauagcuaauuuugagaacaauuguuuuuguaauaaucuuggugucuuaaggaaacaugauuuaauagugucuauguuucugcuaccacugugucccuagaaagcucuacauguauguuguacuugugugacauccacagagagugcuucucaaaagaaccauagcuccgcuccauagagacuccaaucugccuguggcucacugcugucuucuguguucauaucccuuugugucuuuuucuuuuaaguacacaggaucauuuaaacccaccugaguaauuaaaggacuaauaaucucccugucucaagauuguuaaucacauuggcaaguaucuccuuccuccccuuucucauguaaaggaacauucgcauguuucaagaguuaggauauaggcaucucuugggacccaacuguuagccugccauaaggaugcaguauggcuggagagucuugaggcagugagagugauugcagcugucagucacugaaugacuugaugggugagaugccguuuuaggggcucugucuaugucauuccguuuacucauuaccagaaugcuguguaggccacuucugaugacagggaaaugaugaugaguagacauuuaagagucaugagguaaacgggugcaaaagaagagcaaaaauuccacuuuagcuguguuuaggucacaguagaguccucaagaaagggccaaucccaaguagaagcccaggaccuacaaagaguucugaugaccuccccuaaaauuuccuaccuuucccccucuuuaggguagaagaagcaaauuauaaugaacaaugaguuugauagcaggagaccuggauucuguuuauuuaauagacugagcuucagucuccacaucuacaaagaugaauguucucauuuucuuucuguugcuuugguaaacauaauaaccaaaagcaguuuggggaggaaaggguuaauuuccacuuacagguuacaauccauuauugaaugaagccauagcuagagguggagguaggaaccaaaucagagaccauggaggaaugcuacuuacuagcuugcuucuucugacuuacagcuauugcuuccuuuguauauuuguguuaaauauguaugaauauuuugccugcauuauguuuguucaucauguguguacaguacccgaggggucaaaagagggcaucagauuccccccugaaacuggaauuacagacgguucugagcauguggaugcugggaucaaacccagguccucuggaagagcagccagugcucuuaaccucugagcccacagcuaauuuucuuauacaauuaaaaugccuucccagcaaugguagcaaucacagaagguugggcauuccuacuucgauuaguaguuaagaagaugccccccacagacuugcacacaggccaguuuaaaggagacauuuugcaguugggguucaccuuucaaggugggcucucauuuuugccaaguaggauaaaacaaaacaaaacuggccaacacaaggaauaagggucugaaggaaggggacacuauucacugcugguuggagugcagacagguacagcaacuauggaaaucaguguggaaguuccucagaaagcuagaaauauaucuauuccaugauuuagcuauaccacucuugggccuaucuccaaagaacucuacuauagagacacuagcucaucccuguucauugaugcuguauuuacaauggccaggaaauagaaacaggagggacuauugggaaagauaacuaacacuaaagauuuuugaaacaaaucauuaggaagccuacuacuguagaugcuuccuaaaauauacccauccacacauaaaaagacucaaagccaaugaauggaugaaaugcauuuacacaauggaauuuuuaaaauuuguacuuuauacaaauuuauacaauauauuuuaucauauuuucccuuccccaacuucucugauauccuccacccaacucauguuuucauucuuuuuuucucaaaaaucuaaacaaacaaaaaccaauaaaacagaaaaauaacaaaacaaaaagcacacacaaaagccaaggacucuggcaggaugugguggugcugcuggagagaacuaauuuucccucucccagcggguaucaguugccaaguagcuucuugguuagggguaggacuuuaugggcacucuccuucuuggugcugggauuuuuuuuuaaagauuuauuuauuuauuauauguaaguacacuguagcugucuucagacacuccagaagagggagucagaucuuguuacaggugguugugagccaccaugugguugcugggauuugaacucuggaccugcggaagagcagucgggugcucuuacccacugagccaucucaccagcccggugcugggauuuuauguaacugaauauuauuugacuguuaaaaaugaaauuacaaaauucacaaguaauagagcuaaaaaaacaaaaaacaaaacaccauucugauuaagguaacccagacucagaaagacaaaugucacaugacaccuuucaguuguggauguuagcuugaaucuuuuaauauuuguguuucauuuggaauacucacagaggucaggaaacaaguagagacaugggcggcuucuaagagaaggggauggaguguagcuucuaggggaggggagauagacugcauuguucuaaaggggaaugaugggccauugaaggcuaaggauggugggauaugggagggcaggguagaggaaggaauauagguaaugaggccuacuacuguagaugcuuccuaaaauaugugcauacacaguagaaaaagaguuaaaaugguguuacucuguaacaggacaauaaugauaccacagugucuuagucaggguuucuauuccuggacaaaacaucauaaccaagaagcaaguuggggaggaaaggguuuauucagcuuacauuuccacauugcuguucaucacugaaagaagucaggacuggaacucaagcaggucagagagcaggagcugaugcagaggccauggagggauguucuuuacuggcuugccucccuggcuugcucagccugcucucuuauagaaccaagacuaccagcccagagauggucccacccauaaggggccuuucccccuugaucacuaauugagaaaaugccugauaguuguaucucauggaggcauuucccaacugaaucuccuuucucugugauaacuccagcugugucaaguugacacaaaacuagccaauacacacagauuaacaaaaagcccagugccagagguagguaaauuuccuccuuuagaguuguuaagaguacucaucuuuuguagucguuggccagugagggcucauagauuccagaacucuucauuacagguuuuugccagugcucuugguugccuuccagaaauugaugguaaggcccuguugcugaagacaccauguacuugacuuacagagaaaucaagcugauacugaccugagaucuucaucuguacugacuagcuuucacaguccuggaggguuccaugcaugcaauagaggagacaaguggauggaagcuuacucagcuguuacggcaagacuugcccucuggugcaauaaacggcaugaguauccuggaagugaucacuuucuuccuggauuuaacuggcaccauuauggaagccagcaucuuguggcuagacaggucacaggcccuaaaggaaaaccuaccacuauuauucugcuaaacagauaaaguauuaaaccagcugccaauaacuuauccuuauucccauagauuugugcauaucucaacccucaucagagaaacuuuucuuacaguagaugacaaaagaaacccacugacuagucaagaaacagagaauguucuugaauaagacauuguaucacauccucuucucccaggacucuggggucacugcaaaaaaggaauugcuuuggucaugguaucucuucaaaucuguugugagagcaugcacaaguucugaacaagcucaagcuagacaaaaucccaacauugagagggaugugaacaugaagucuuaccucuaagcuaauuacaauagauaucuucuaggauaggaagagucgguuuucuuuaagggugugacuccugguaaagugaccacacuccaguggauagcgacacacccaagaguauauguugccagcauacauuggacuugauguuuuguuuuguuuuuuaaaagacacagauuuguacagacaagggaauuggucugagagaaauggaaaggaguguaaaaauuaucaaaacacauuguaucaaauuccaaaugaacuaacaauuuuuuaaaaaccuaaucaagaacucagucaauaaauugucucaagaacaguucacagaagaugauaugcaaaugcuaaauaaccaugugugauguaagaugucuaguuggggcauugucucccccauuuguauggugauuccauuuaucucuucucauauuccguucuuuaccuugccuuccaguccuuccccauuuaauccuaguuucugccuuuauuuccuuauaacacuauauucuguuuucucuuacuugaaagauucccuucucuccccuggucccuuacuagcuaccuaaucuccaugacuauucuaauugaaaacacauaugucuaaagauuaaaagcuaaaacacacaaaaagagaaaauaugaauaauuaguuuuggggagucuggguuacucaggaugauugauuuaaaucccauucacuuagcugcaacuuucauuuuucuuaacaguugcauaauauccaauguugaauaauauccauauuuucaaagccuauucaucaguagauggauauauaguaguagacuguuuccaauuucuagcuauuauguaugcaacaacaauaaacaugagugagcaaguaucacugaaguaagaugaaaaguccuuuggaaauaugcucaaaaaugcuuuagguugcaguagauuaaucucagcuuuuuuguuguuguuuuuaagacaggguuucucuguuuugcccuggcuguccuagaacucacccuguaaaccaggcugaccucaaacgcugagauccaucugccucugccuccuaaacacuggaauuaaaggcacuugucaccacuacccagccaguuucagcgcugugauaagccuccacacaugcauuccauaguggguauaucaguuugcacucccaccaguguucccuucccacccucaccagcgugugcugucuuaauuaauuaaucuuagucaaacugacuguggaaagguaaaaucucaaauuaguuuuuuuauuucccugagaccuaaugauguugaacuuuaaaaaaaaaaaaaguguucucagucauuucaucauugagaauucucuauauagguuuauaccccauuuucaguuggguuauuuguuuuuuguuguuggugguguuuuuuuguuuguuugguugguuuugguuucuuguuuuguuuguuugucauacauucuagagauacuaacccucugucaaaaguauaguugguaaaguuuuccucuucuguaggcugaugcuuugaaugguguugcuugcugcagaggcauuuuuguuucaugugcuuuuuguguucuguucagaaaguccuuccucugccaacgaguucaagccuauuccccaccuucugucugucagguucaggaugucugaucugaaauugaggugugauccauuuggaguuuggcuggggauguuagauauuacgucuauuuucauccuuuuaugugcaguucgugugaccagcaccauuuguuaaaggugcugucuuuucuucauuguguauuucggacuuuuugucaaaaaucaugugcccauaguuuguagaauuaugccugggucuccauucuauuccagugaucacugugucuguuuuuacaccaauaccaugauauuuuuauuacuauagcucuguaguacaacugaaaucugggauagugauaucccuagaagaucuuuuguuauuuagggcuguuuuggcuauccugguguuuuuguguguccauaugaaguuggugauugauuuuuucaauuucugugaagaauuauagugagauucuuauggggauuguguugacucuguugagugauuuugguaggauggccauugucaaaauauuaaccccucugcuuuaugaacaugggaggucaucuucugauggcuucuccaauuuucuucuucaauauuuuaaaauuuuuauugcacaagucuuucacaugcucuguuagaucccaagauggcuuuuuuuuuuuugagacuguuguggaagauacugucuccaugauuucuuucuuagucuauuagucauuuguauaucugaaggcuacugauuuuucuguguuaauuuuauauccuguuacuuuugcugaaaguguuugucaguguuagaaguuuccugguggaaucuuugagggccuuuuauauauaaacucacaucauaugcaaauaagaauaguuuuacuuuucuuucccuguuugcacccccuucaguugucuuacugcucuagcuaagacuucaaguacuauauugaauaguuaugaaaagcgugagauccuuaucuuguuucugauuuuaaucaagaauacuuugaguuucuauuuagagugauguugucuaugguuuugcuguaaauugccuuuauuguguugagguaugccccuuguagcccuagucuccucaggacuuuuaucaugaaggguguuggauuuugucaaaggcuuuuucugcaucuaaugagaugacccugugauuuuuuugucuuuuaauguaguacagugguucucaaccuguggguuguauaucagauauccugcauaucagauauuucuauuacuguuuauaacaaauuauaguuaugaaguagcaacaaaauaauuuuaugguuggggggccaucaauauaugaggaccuguacuaaaggguugcaguaucaggaaggucuaaaaucauugauguaguguauuacauuuacuuuauauugaaccuuuccugcaucucuuggaugaagcacacuugaucaugguggaugaucuuuuugauauguucuugaauuauugaaaaauuuugcauuuuuguucaaaaugauauuaauuuauaauuuuacuuuugguugggucuuuucaugguuuuaguaugagaguaauaauggaucuauuuaaaauaaguuuuuaaaucuuccuucaguuucuauuuuacagaauacuuugagaaggauuggcauuaauucuucuuugaaggucugguagcuuucacugaauccgccuggcccugggauuuuuaggguugguuauuucuucuguuucacuaggggugugcuuaaacaguuuauuuuauuuugauuuaacuuuuucaucuaucaagaaauacauccauuucuuuuagguuuucuaauuuggugaaauacaacuuuuuaaaguauauccuuaugauucuuagaauuuccuuggugucauaauauuuuaugacaccauuuuuaaugugucuuuacauuuuuaauuauauugauuuagauucucuuucugugucuuuugguuaauuuggcuaaagguuuuuaaucuugcugauuuucuccaagagccaauucuucauuaauuacuuguaauuucuuuguuuucuuuuuuaaaaagauuuauuuauuauaugaaaguacacuguagccgucuucagacacaccagaagagggugucagaccucauuacagaugguuuugagcuaccaugugggugcugggauuugaacucaggaccucuggaagagcagucagugcucuuaccugcugagucaucucucuagccccaauuucuuuguuuucaugauuucagcccugaguuuuguuauuucuucccaucucuucuuuuugaauauuaugucuuucugguuuuucauagagcuuagguuauuaauaugaaaucucuccaggguuugugguuuguuuguuuuaauauaggcacuuagugcuaugaaauugcuucuuagaacugucucccaaugugucccuuagguuguuuucauuuguauucaguucuuaaaaguuuaaauuuccuacuagauuucuuucuugaucuaauauucauucagugguaaguuagcuucccugaguuuguauacucugcucuuuugauucuuguugauacccaagguaaucagauaagaggcaagguguuauuucaauuuuucuguaucuguugagacuugguuuguguccucauaugugcagucuuggaguagguuccaaucgcuucucugccuuuugccuaagaucaaguguggaguagguuccaaaggcugcugagaaggcauauuuaauaucugggugaaguguuccguagaugucugcuagguacauuugauuuagauguuacuuaacucuaccauuucuacauuuaguuuuuuucuggaugaccuaucuacugcaaagagucagguauuaaaaucacccaucaucacuuugugaggaucaauauauauuuuuagcuguaguaguguuucacuuaugaaauugggcauccuuguguuuggugcauaaauguuuagaauuauacucuuuguggauuuuuuuuuuuaguguauauguaguauccuucccaucuuuucugauuaguuuuuguuugaaaucuguuuuuucagauauuaaaauaucuaugccuacuugcuucuugguucuuuuuacuuauaauaucuuuuuacauccuuuuauccuaagauaaaggcgucuuugguggugagguguguuucuuuuguagagcaaaaaguuagauccuguuuuccugugucuuuuuuuuaauuaggaaauuaagacaauuguuauugaaaguuauuuuuaagcaguguuuauuaauuucuauuauuuuguuuaggugaguucacaucccccuccucuuuguuugauuaacuguucugcgauugcuuaucauuuuugcccucucaggugucacuaauuuuuauuucggacagauuuuuuuucuuucuagugccuucuguagaauuuaauuuguggacagaaauuguuuaaauuuguuuuuuuuuuucccuugaaacuuuuuuuuucuuucuccaucaauugugaugggaaguuuagcugguuagucgggguuguaaucuguggucuuucagaauuccuaagacaucugucuaagcgcuucugguguucagagucuccaauaacaagucagauguuacucuagugggcuugcuuuuauagugacuuggccuuuccuacuuaaaaucaucucuuugcuuugugcuuuuaguguuuucauuauuauguguuguggguaauuuuguuuaugguucuauuugguguucucuaaaucuuuuuuuaucuuuccgaguaucuuuuuagauuggaaaaaauuuuauucuaugcuuuuauuuaaaauauaugugugcauauguguauagauagauagauagauagauagauagauagauagauagauugauugauuuuugaccuggguuucuucuuucucuauuaacccacagguuuagucuuuucauagugucccauauuucuuggauauuuugugccugauuuuuuuuuuacauuuaauauuuuuuuaacugaaaaacacauuucuucuucuuugucuucaauaccugaauuucccccccaugucuuuuaaucuauuggugaggauuaccuacaaggcuuuugcuuggcuuccuaaguuuuucacuuugauuuuuuuuuccacuuugacuuuuaguaauucuauauccuuacugaauucugcuuuuauguuuuauauuguuuucaucauuuccuuuucacaaucuucauuaaaacacuuauuuauaauaauauuaagggccuugaacauccucauaauuguuauuuaaaaguccuuguguugugcuugagcuaaauuacuuuuauuggggccuguuacaauagugucguugucuuuuggaggaggcauauugucuugguucauguuugugauuuugggacauagacaucugguguuaugauauuugagguguuucuugguguagcuaucuggucuugccuucaauggguggguggccuuugauggaugcauaccuuccuuugguugcuguugucccaaucuggguccuagucaaguguaacaguucugugugucccagccaaguauggcuguugugcaucucuguuaaacaaagaaguucugcugguucacagggaguuacaaaggaaugcggaugggcuagaaagaaagacugaaagggggcagaagggaagaacuaggaggacccugggacugcaccaagaggccgauuuccagggagauggaaguaggcugaaggugauguaaccuggccauuauuuuuacauaucuuuuauuggcuccuuucccuguauucuguugugcugcugaacagggccacgaguugcagcucuuggaugcccaugcagucagaugauacucuauaguauauugugcagcuaagcugagacauucacuaacuuagguguuuuaaaugcauuuucaccuaagaauauuuucaguaaauagaagauuugucuuaauauaacuccauuaccaaugaagaaguauaaucaagguaggcagaggcaggcauaucucugugaguuagaggccaggcuaauagcaaguucuagucaagacuacacguuaagacaaagccaagaaggaggaagagcaggaggaggaggaggaggaagagcaggaggaggaggaggaggagcaggaggaggaagagcaggaggaggaggagcaggaggaggaggagcaggaggaggaggaggagcaggaggaggaggagcaggaggaggaggaggaggagcaggaggaggaggaggaggaggaagagcaggaggaggaggaggaggagcaggaggagcaggaggaggagggaggaggaggaggaggagcaggaggagcaggaggaggaggaggagcaggaggaggaggaggaaaucuuuaacuguaucucuguacuuccaaaugucagaaaaguacuaucccauccuuuguugagagaacguccuucagugucugucccuagugcugauuccucugccaggagcuacucuugcagcguuagcacucucauggcacccguccuagucaccucugucuggcccccacacccuuagucuuguuuggcucucgucuuggucagcagcauuaccaacauggguaacuuuguccuuuuguguucuuugcuucccauccuugugcugcucccagugaauagugaggucaaguugggcuugaguggaggcugucauucuuucagccuucuagccccucgcugcucugccaggaccuugcagcuucucuugcuccuccucaggcauuccuccuuuaaagcaguaucauugcuucucagcucagccuucccugcaacccuucacacugcugcccagacaugugucuucacaacccuuuagcugcacaccguguuaggacaaaguccacacuugagagaugguauucucagcccgucgcaccccuuccuguuagucucauugaacacauucucagaguccccagggguguggcugugcugcuuccuacccuguaccugugcuccggcugucugcaaugucuucucugcaacccuguacuuuuuuucugaaauuugucuauuauuuaaaugcauuuuauacaucaaacauguuaaugauauugaauauuuugagaaucaaauaaugcauaaaaauuuuguucaacuuuuauauucaauauccuuucauacccuaaaaauaucauuaaugaauauuuaauacuauccauaacugagaauccuauaucuaauauugaauacuaaauuguuucaaaacauacaaaauauucuuugggaauuaagcauaguaaaagagcauaaaauauuaaaaacgaaucauuaaaaaauaaauucaaaagcccuuauaugauaccaccugacacagugagagaguauuuaaaacacauuauauauccguguacauugucagugcucuuaaacgcugagccaucucuccagcccucuguguacagugucuaacaaucaguuuacuuaaaaaaauuaucaguguuucuaggauaaaaauuauuuuaucaguaaguauauuuuaaaaauuucaaaauagcaaaaauucuuugaaguuaaacauuaagaaaaugcuaauuucaagcacagugaggaaaaguaucaauaauauuuccacaauguuuguaggacaugauuuuaauauuuucaacuguugauauucaacaaacaaaauaguaauuuuaagauauauuucauuguuauguuucccuuuuuauuucugauuuuauuuggauacugucucugugcccucugcuuugucuggcuaaggguuaaucuaucuuguugauuuucucaaagaaccagcuccugguuuuguugauucuguauaauucuuuuuuuuuuuucuauuuguccccaacccuuuucuuaugccaugugucuacugacgcugucugccuguaauucuuacuucagacuucaugucuuugaagccuugcaugucuccugaagaaaacuggcucauaucuuauuggagugcguccugcgccuucaccaugaccaccaucaacucucugacuguucucccuccccgacucgcuuuaaggacauagagcacauuuugaucaguuuugaauuuguagugcuuacaucaaugucugcaacagaaaggaugcucaaaaagcauuuaucaacuucuguauuuauaaaacucuauuuauuuagacagagucucaccaugaaucccuggcuggucuggaacuaguuauguaggaccuggcuuugaacucacagauaucugccucccucaggcucgggagugcuagaauugaaggcgugcaccaccaccccugacuucacugugagacuuuuaucuuagggaacauagaaagaugauugauauaauagcuucuugaguuaaauggaauuaaucuaguuauagcccuauaaagaauacacauucaucuccuaaauaaaaagucauauucagaacccugcuuaugauagaaaauagagaaauuacacauaggcaguuuccauagcuccccugagguuggagauaagcauccucuguaagcauuugccuuggacuguucauucauuacaauguuaacacagucuacauuuauguuaauaucauuuauuuuaaauugcuguuaauccuuuuaugaugccagaaaagauaaacgggagaagaaucaaacaaaugucaaugccacacuucuuuauagggacauagacucucuggaccagggcauuuugugacuaggaaaugacaaguccagagacucuagaguuaaggcuucauugugaauugacaccagagaaaucacauuuuauaggagaggcauauggccaaauaggaccugaaaaauaaguuugaaguaaacaacauucaaauccauugcacucucaccaaggcauguaaaguucucaguguauuuccuggaugccuagggcagcccaucccuugcuuccccacacagcccaaccuccugaugcaagauaauuaccguggccugaacugcucacucuugcuauauggaaauaugucuguuuucuuuccaaaaaccuggcuuccagcuggcugacacugggagaucauuugauaaguuaauuuauacuaacaucauauugaguaauaauggaggauauauaaaaccuagcccugcgagcugcucugauagaaggauguuucccauugucccauguacuuuccuugucgguuuuuuccuuuucuucuuugucuuuucacaacucagcaacuuuaaauaugcugaacucugccucaagugaccuccucccucugugucuaccacuaccuucugucuggaaacugcugcucacucuucaagauggaaaucaauaucucucaucuaaguucucuguauuccccaggccuuugacuuucauaaagcuuuguguacuuuuguucaguuuuuuucccugaggucauucacuuuucaguugacuucuaccuccacaauucagugugcccaguagccuccaggaagcugacugaacagggcacacaccagugcccgccauccauuaccugucagcaacacugcugcugcugaccaccgccuuugauugccccauucccuguucuuagcacugcuucccugaauuucuugacauaacagucugcuaguauuuuagcugucauuuuuuccuuucucagccuguuuguuggcuccucuuacagcuaaucucuguguuggaauuccuuaaggcuguguccuggccccuuucccuucucacgcucugcucucccaauaggcgaacacuuccacacccagggccuuaauuauucaggcagcugacucucagauuacaucuccaacccucaguucuauccugacacucagccaucugcuguucaguauagucccugaggaaguuuugcagguacucugucuacacucaccagguucaaaacccacauuguucuuuggccaagagaauagcgccuucauuuacacauuagcccaacuaaaaucuaggaguuaccacugacauaccuaauuccuuucacugccauagcccauuggccggccuccuaacuucuaacuaucgcucguguuugaccuguguccaucaccacugacacugaagucaucaucagacuacaacuauguggagagccaccauccugcacccacuccaugccuagugcacuucuacauugcaaacggugcuauuugaagauucauuuauucuuaagccuuuucuacauggaaggcacuuccuagaugcugcugauacaaaugugacuaaaaugccuuguuccccaucuagaauucuguagauggugugauugggaaacguaauguaauugagauuguuuggauaaauaaagcagauuguuuuccuuuugcucucacaacucaaucagcauaaaagacuuuuauucuucccucuguguguguacauuauguauguauguguguauguauguauguauguauguauguauguauguaugcauauguguguucauuugugugccaguauacaugagcauguaugugcacacagcaugcagaaagucggugucugcuauucccucaguuacucucucuacuuuguuuuugagucaggguuucuagaacauggaccucaccaauucagccagccuagcagaccagugagcuccagggaucagaacugagaucgcagacacuguacccagcucuaacacagugcuggguggccugauguccucaugccugagcagcaggcacuucaccugcuaagccauguuuuagcuccgacaaagaagacuuuuaggauguugaaaaauaugaggauuucucuucaccaaaagcaagcaauccuuucuaagacaggagacacuaauucaguauucuccaacucaguugacacuaucuacuuaaaguuguccccagugcaccaucuguacuccccaggcacacacauuuagaugccaauugcuagcugcacauuguuucuuucuccugugccucugaccuauuggcacaauuuaggauucccacacccccucaaguucaacuaauuuguuugacuggcuccucaaauuuaggggugaacgcuguguuuauaauggauguuagaaggugcauggagugguguauaggagaaggggcauagagcucccaugcucucucuggcauuuguccuuucgggauuguaaugcuaacagacuagaugacagaggcuguuacagccugucucccuggucucaguugaggcaggucauuuucuaaaaugaggguaauaucugcuguuuuuugucuagcaucuacuaucagaaaaaguaggucagaaagaccaaagauuugaauuucugugacaugcccugaggcaggaauuaggagcuagaaacuguagaaacuaaauauauguccauaauaauaucacaggcaaaauuucuuuggggaaauaauuuuuccccagaaucagaaucuacaagugaagauauaagagagaagaguauuuuaggcaaagaacuagaauuagaaagggacaggcuaugagaucaaagcacaugguuguagccagaugugaccuuacucaagggauccaguaaccucucacccagucugccagagugggcgagcaccacugccaagcagacauccaugacuggugugagaccauuggaagaaucuaagacaaaaaguaagguaagcagacuguacaauccuuagcuggggucccaucucuuguccacuuagaucugucuuaugcacaguguuugcugaaagaauggaugucuguuuggacagcacaccauugcaucauauuguagcaugugcuuaaugacucuucacaagacucaauccugaaagaaugacuaggauuauuuuuauauuaauauauauuauauauuauauauauguguguguauauuccuaaauauauaaauacaaccugcucaguccauauguuguuguugguauguguguuuucagggcugaucauuugguauuggauaaccaauuugugugcucuucucuaaggaaaaguauuucucucacucaacauuccauaguugucuguacuucuuugccuaagguugaggccucaugagcucuccaccaaucucagacuuuuaccuugaucaccuuaggcaagaccaaugacuggcaucaugcuuagaggaucaggugauaaauuccagucucagcuguagugcagcugaguugucuuugcaaugaccauguagagacuauagugggaugcacaugcacaugcacgugugugguucagaagagaucugaauugaacguguaacuguggggcucuuagcuuaugaaauguaauugauucuuaggagauuaaaaaucccucauagaugggggaagggagaggagugggaagagggaaagaaagagaaagagagaauaggaagcagaaaagacagccaaaaagaaaauucugggacaauauucaaauaauaagcauuuuuaagauggcgacuauagaggaaauaauaacagucauuuauaaagaaaagaccuuccauaauaccauccacacacucucagaugaaguggcucuccaucuguacaugaggcaaauccuguucuugggcuucuuaaguagaauguuacuaagucagcaguggaaauuaguuaagccucauacaguagaaaguauaucuucuaagccuucaggcccauguaaauucuguauuccuuggguucuauugguaacuaaucaugguagccucuuaguagucugaguguacaagaaacauuuugugguuuuaaaauuuuggucucgcacaaccacucuggaaaucagucuggcgguuccucagaaaauuggacauaguacuaccggaggaucccgcaauaccucuccugggcauauauccagaagaugucccaaccgguaagaagaacacaugcuccacuauguucauagcagccuuguuuauaauagccagaagcuggaaagaacccagaugccccucaacagaggaauggauacagaaaaugugguacauuuacacaauggaaugcuacucagcuauuaaaaaaaugaauuuaugaaauuccuaggcaaauggauggaccuggaggguaucauccugaguuaaguaacccaaucacaaaggaacuugcacaauauguacucacugauaaguggauaauagcccagaaacuuaggauacccaagauauaagauacaacuugccaaacgcaugaaauucaagaagaacaaagaccaaaguguggacacuuuacccuuucuuagaaaugggaacaaaacacccauagaaggaguuacagagacaaaauuuggagcugugaugaaaggauggaccaucuagugacugccauaccgcagggauccaucccauaaucagcuuccaaaugcugacaccauugcauacacuagcaagauuucgcugaaaggacccaguuauagcucucucuugugagacuaugccagggccuagcaaacacagaaguggaugaucacagucagcuauuggaugggucacacgcccccuaauggaggagcuagagaaauuacccaaggagcuaaagggaucugaaacccuauauguggaacaacaauaugaacuaaccaguacccaggagcucuugucuuuagcugcauauguaucaaaagauggccuagucggccaucacugcaaagagaggcccauuggacuugcaaacuuuauaugccccaguacaggggaacgccagggccaaaaagggggaguggguggguaggggauuggggggguggguaugggggaccuuugggauagcauugaaaauguaaaugaggaaaauaccuauuuuuuaaaaaaaaaaaaagagauauuaaggagaaguaaaaaaaaaaaaauuuuuggucucuuugagacacugaagcccaagcugcccuugaacuuacaacaguccucccacagucuuccaagugcugugcuuagagauaggagccuccaugccuggcuaagaaguaaauuaagaacuguguauuuaaacuauggcaaggcuggggacauagugcagguguauuacaucaacugcuguagugaugugcacccaaaauacccugggacuggagucacugacaguuguaagucauaguaugggugcugggaaccaaacgcuguucucugcgagugcuuuuauccauggagacgucucucuggaggacccuuauaugugauuucuugaugcaauaucucauguauaucugaggagauccucagucuccucggaaaccaggugcacauguggugugcacacauauauccaggcaaacacaaauaaaaacaaacauuuuauuaaauauaaaugcauuuggaaucauuugauuccuaucugauguguuuacaggugauauaucuagccugccuaauugcuugaccaguuggcauuuggcaucaaagguacaaauguaaccagucggauauaccuuguguggauauuguguggauguguuagcuuauacaauucauauagaucauuuaucuauguggaaguggccccugacugauaacaugcuugccuuugagcaugccaguuuccuauaaaccauugagaauccgcaggcuucacugguugccauaaaacuauaaauuauugaagguauuuugauuagcuccaugaaauaaaauuguaguccuacaguuuaaaauaaaacucauuuauuuggaaauagaagaaaauacgaguaagcuuaguuaaagcaccaggagaaguggucguuuaaagcuguucagccguuguuccucucuucccaugagcucccaggagugauggaagagucagagccccagcgucccagcgucccagcgucccagcgucccagcgucccagacaggaugagcuuuaucaaaugcuuuucuuacagccaaacuacacacacucaucucauaggugaaaaagcuggcuugugcuuuguguuuucauguugcuauucauuuuucuuuagagcaagccauuucacacuucugcacauauaaacacaugaguuauuugauaagcaaacuuucacuuuuuuuguuuguuuguuuauuuuucgagacaggauuucucuguguggcccuggcuguccuggaacucacuuuguagaccaggcuggccucgaacucagaaauccgccugccucugccucccgagugcugggauuaaaggcgugugccaccacgcccggcuuacuuucacuauuuuauuagucaguguuuuaguuaagguuaaagggaguuugugguuucugagaugagagauucagcccucuuauaaaaucacugcccggcaaauuccuccuuucuaguggccgaauaauauacaaaugucuuuuaugcuuuucuuggaacuccaagcaucagagguugccugacagauauauauacuuccaguuauucauucaguugagccaaaauaagucccaagaucuuuaacuaaugggaaugauaauuagugauaauucaccgaucaacuucccuguaaucaauaauauauacuuuucuucagcaaaggagucauugucuuuuuaaguuguuggucuaaacaguugcagaaaagacaaggcugugugucucugcuggcuggaagagggacuuacauuaugucugccucuaaaauaaucagugcccuagaucucuccugacccgugcuugcuccuuguuggccccacaccuugaucaacaacccuccccuccagaguuggaugugcugaauucaauagagagagccaagaaacugucccagaaacuggcugccuccaggggacuggagcuccugaaacuuggaaugccagauucugauacuggcagcaggguuaugaucugggccaagcaagcccacaggaaagcagguuuggaucgguuaugcgugauuggucuuccuguuuuauagaugucuugugaggugucacaucuccgcuuuaauguaccucucucugacucucacagguccaaagaaugaauuuugugcacauugagccaaguuuugaaaguuccagaaagaagaagaaggucagcgaaccagugacagucuucauuccuaacagaaaaugaaacuuaggugccuuugcuacaccuguuuugcaaaaaucuaugaagugcuguaacaggauaaugaccaagccuucuuucuuccuacggcuuugcuccacucucuccucagucugugaaaggcuaagcuauugagcaggcccuagguucacuucuccagaaggaaccuggaucgcagagcugccuugggaugggaugaccucgcggccgaguuagagaggagacacgcucuguguuugcaaaaaaccacagcaguuaguuuggaaagaaauaagcugcuguucuucaaguaaaggguuuuucuuuacauaauuaaauucuccagguaucucugugaaauacucugacuuguuagaaccugugaguuggaauccuucuauagcuuuacuaaaacucacacagcgcagcauaggauauguguggaggugcuuagccaggcaugauuuauauguugauuucagucacaaaguugaucagcagcaugugaauccagaugcccucccucccugugcaguuccucagcucugccccaggcccugccccaggcccugugcuguuggccaaucccaaacagcugacaugcaguucaggagccugguuccccuguaagaccuauguuguguauuuucuccaaaauacuugaguuuaucugucuguaacuugcaggugaugcuauuuguccccuccauauucuggaagaauuuugauaggcuuuuguacuaaugugauaugaauaauaaaugacuuacagaauuguuugauaau

SEQ ID NO: 5858 - RNA, 2702 nt, Mus musculus
agagcacuggcugcucuccuagaggaccugaguucaauucccagcaccuacacguagcuuacaaccaucuguaccccccaguugcaggagaucuaaugcuuccuugggcaccacaacacccauuuauauuaaauaagaacaaaagacugggacuauugguuuaaagauaaccucuauucaggcugaugaguucaaacuaggauucuugggacgugaauggaacaacuccaaaugguagagucuucaggaguuugcauggggcuugggcacggucucaacuaccaagcggagaucaggaaguuaauaaaggacucgugcaaaagccggucucaugagcacuuugcauuuauuugcugacagcuguacucaaacacagcagaagugagucuguuuguacaguggagccauagcuugcccacacacuggcggucggugaacggcaacuugaaacucauccuuaggcugaggccccaacuccaggcaaacagcugaccggcgacuguuccuucgggucccacaggggcaggguguuacuccuuguucucauacuugugcuuuauauguuuccacaguuucugcauuuaaaacacaaggcaguucaccguuaaccuuuguccucacauuuuacaauaacucuagcuguccaaagagaagagcagagaaaucaguguugaaagaguuaacaauguagcugagcuagacgguggcgguacacccuuugauuccagcauuugggaggcagaagcaggugggccucugaauucaaggucagccuggucuacagagugggcucuaagacagccacuacacagauaaacccugucugaaaaaucaaaauccaaaccaaaacacacaaaaaagcaacauaacaaaucacuccuacuccauuaaccacacuaggugggaagggaaaccagcacuuguacaagacaguaagauagguugcaagaacgucccaguuucuucauuauuaaaaaacagcaccuagaaaaugcuucccccacccccacccccaaauuucacauugagucacuuuuuauucuucagaccuaaagugguuacacaauucccauuccuagaagcacgggaaaaugggggaauucugacaguguacuuaagacaacuuucgauacuuggaaaugcuuauaaaagaucagagugggggcuggcgagauggcucagugguuaagagcgcugacugcucuuccaaagguccggaguucaaaucccagcaaccacgugguggcucacaaccauccguaacgaaaucugaugcccucuucuggaguaucugaagacagcuacaguguacuuauauauacuaaauaaauaaaucuuaaaaaaaaaaaaaaaaaaagaucagaguggcaacacuuucauauggacaggaagcuaccccaccagaggaaauacagcaacuaguagacagagccugucugggcagcaggucagagagcccugagggggcuggagagacgacucaguggcuaaggguacucugguugcucuuccagaggaccugcguccaguuccuagcacagaugauguacaugcagacacaacauaagcaaauaaaauuaaaacaacaaaauuuaaaaacaaaccaaaagagguaagaaaggaaggaaggcaagaaggaaggccacucagugaaggagcuggucggugguggcucaggccuacaaucccaacacucagguggcagaggcaggagggugagucuaaggccaagccuugucuaccaucuagcuccgggacagcaauagcuacacagagaaacccugucucgagaaaaagaaaccagucgaugaacaugcuggccaucaguaacauaccuuccccaauacucucacaaccuuugacauaaaacaugcacagagugugggacaguuaagucaaagagggcucgccauuuccuacuuuauauucauccccacauuuucccaggaugcuaucuuucagugguaucauuaaguaugaacgguagcaccucaucuguaucccaggaucuuugauccacuaugaccuuuauucaauaccacgguuaagugcuuuaaguccaguauugccaguuagggcuugagguuucauagucuucacguuuaauccaaagagccuacgugggcggccuucggaacugaaacaucaauuuuaaaaggucagccacauggucuaaggagaccuacuuuuaacgacugccuugcugaaaucugcccuugaaacuagcaaggacggcaggggucggaguuccaacucaccaccgacuuaauggagugguucagacccguaaguccucugaugucucaggagucaggaguuagcuuucgcaaaugaauauguggaacugugugacaggacauaccaauuaggccucgcaccaugucaagagaaauagauguauuaacgggcacaguucaccccagaccugguaagacuugauugaguuccguccuaccucccucccagucacccuucaggcgggcccaaggucaggauggcccaggcccucacccccucguugaugugcucguagaucgcgucugcgcccugaucgaaggcucgcucgaagaacagggcgcccacugcgauggugagggcaaagguggaaguucugcggaacagcaaggaguacaggcgcgaagggaucgucggcgacgacauguugccucacugccgaacucgcgccacugcgcuugcguaga

SEQ ID NO: 5859 - RNA, 450 nt, Mus musculus
gucggaguuccaacucaccaccgacuuaauggagugguucagacccguaaguccucugaugucucaggagucaggaguuagcuuucgcaaaugaauauguggaacugugugacaggacauaccaauuaggccucgcaccaugucaagagaaauagauguauuaacgggcacaguucaccccagaccugguaagacuugauugaguuccguccuaccucccucccagucacccuucaggcgggcccaaggucaggauggcccaggcccucacccccucguugaugugcucguagaucgcgucugcgcccugaucgaaggcucgcucgaagaacagggcgcccacugcgauggugagggcaaagguggaaguucugcggaacagcaaggaguacaggcgcgaagggaucgucggcgacgacauguugccucacugccgaacucgcgccacug

SEQ ID NO: 5860 - RNA, 8344 nt, Mus musculus
cgagugaggagugcaggcggcggcggcggcggcgguggcggcggcggcgguggcggcggcggcgguggcggcagcggcgggagccggagcggcgggucgggcagccgcaccagcgagcggacgagcgggcggcgagcaacgcggagcgcgcggagggagcgcagcgcgcagcgguccgagccaagaggccggagcggcgccgcccccgccaucccugcgagcccccggccgggaucccaacgaaggagccggcggcauggcccgacagcccggggcgcaggggcgcuaggucccggacgggugcccauugccucgccgccgccacugcgcgccgcaccgcgcgcaccgcccgcuccagccgcccccggggccgccggcggcccaugagccccggccucaaaguuugcggcgggcgggcgggcgcggagccuccaagaugccguuccacccggugacggcggcguugauguaccggggcaucuacaccgugcccaaccugcugucggagcagcgcccgguggauaucccugaggacgagcuagagggugagugcccugccgggaccccugccacgagcccuccuaccugugcgcccuggugccgcgcuggcccggggagcccgggacccugcugcgcgacucggaugagcggcuacgcgggaggcgggacggccggguggccccgggcgccgcggugggggucgccgcggcgcaggagcagcccggccccugcccgcguggcccccagcgcugcggaaacuugcggggccccgcagcggggucacugggccgcguggccggcggugacggugcggcaaggcggcgggggcugaaguggagaguccgagcuguugccccccgcgcccgccaccggagcguccgcauccugaucccuuccgcggcgcccgcccguggcucugcgcuccuauugacauuccgcucgugucgcguugagaauccaaucugcuccggcagugggagaaggggagagagggcgacugccccgcucuugcugggugcagggcuacccccauccccuucugcggcccugcgagggaccccccacccgugcgcugccgaggcagcugggaggcguuggcgacaacaaguggccggauugggaggcucggucgcgauagcaaaagccuggaaggaaaggcagaggccggaaccuaaaccuccccccgacccuaguccccgugccuuucgggaauagggaccgcacgcaggcaguuggcuauugaagaucagagcagcaggccgaggcugggguuccuggauugaguguccuggggcgcagugagaccccuggggccuuccuagcuuuuucucugcugagauugggggcgggggugugcucaagauuccccuccccccaggccucuugaggccccauauggaguggagucggagacucugagcugaugggagucuuggucccuuaggguguuugucggcugcugggggagggguugagauuacccagaugaugggccugucuccggucucuguagucaaggggucucagcuuuggggucccacuugggcucauaggagugaguuggagugaccaacauaggaaaggauacuagugggagcccaggggaagccauucgggaagucuguccucagcccaggccuggucuggggcaaauuuugggcgaguagacaguggagagagagagaaagggugcaacugccaugcucacugcaccacaguccaccagacacccacuucccacaccccccaugaacucagaagcaggaaaagucgcagaggggcucucagccccaacaguggaggcacagauggaaggaugugugcuuagucuauaccccggaaaccccagguccuguccugucuggaccaaagcagagccuccuccagguugaggggaagagauggggcccgggaggggugcagggcgcaggccaguuucccuuuccuuuacugccuuuaauucugagccacgcagaagcguccauccaccccuuucucuccacucuugggacagaggcggcaugucuccccagagagauccagccuccuuuccccugcucccagcaccccccacauaaccuggccccaugacuccaggucucacuggauccccagucaggcuaucgagaagcugagagagacagucgugcaggggugagaagcgccagggugggcaaugcaagggcaaggaggcccacgcucccuccgagccaucccguggucaugcuggcagaagcccagugcuguuagucaccaucacaucaaauacacucccugcuucucucugguccccuuuggacuagaggaggggcccuggugcagggggcaccugaaggacagggccaucccugugacuggcagguggagggcacagagccagcagaugccuaugggcaucuacacauuaaggcaguaaguucuccagaccccuccuuggcugaaaaccagguucugggcucccugcagugggucuugaaugccagggcugggugcagagcggcuguccuucauacagaugccacuuuugguuccuuaacuucuccaguacacacuacucuuccuguccccgggcagucuggguaagacccaggcccuguuggcuggaagggaucagugaagcagcccauagacuagacaagggagucggugaccuggggugaaaugcugcagacaccucgugcugccugcugcagaaauccagggggcggucagucugcaugggggaggaggaccagaagcagcaagggaagaguagaaugugggggugagaggagaagagucaggcaguacuggguucgagucucuacacccugggcucagggagugaacuuggacucucccucucagaguucgccucucagagucuugcuuuccccaucaauaaaaggggauuggcacuguugucacccggacggauggcacuguugucaccuggacggaugguggccgagaaugcugugggaguacucagcacagggccuggccaugggggcugaggacccaaauguaggaagagcacuccagacucacgagcuugaagcaggcuucgcagcagggcagcaaagggcaugaguauugggccaaggaggcaagcugaggaccaggacugcagaacuugagguccuagagaggaaggggcuaggcagagugggcuaggcagaguuaacuuggaggcccacccagccccauguacgagaggcaagggugcucccacauuccuccugaauauaucacaccauggcuggaacauaaccacuuucuaaaaugcauccaaguggggaccuccagcaacacugagacagugugcucaccuagacaguaggguccagcaugcaaaggcagggaugggacuggcuuccugaaagagagaagcagcuagacacaaggcuggguucuggaauggaaugaggagccucuguugaggguggccaguuggggaccacuggggagcccccuuuucugcccuugcuuccugaaucccaagcccggcagcugccucugcacaggccagaaauucaaggauggaggauuggggcgcagagccaaugcugcggagaauggcagccaccauagagggugacuacugccccuuccaguguucccucucuguccagacucaaacucuccggcucagugcugcauccuuuugggucugcagaagacgucagucccagugcagcuccacaaguugggagggucugggaaucucauguuaaaaacggaagguaggggacaagaucagccuggaaaccuagaggcccugccagcccauuuccaggccagacauccccaugccaagaugaagcacaaguuuugccuggccucccucauggggccgcgagggagcaaggcuuucggggaauacaucuaguagugauugucuacggcauacagugacagggcauccugacacccaccccccguggggcccuuagcagaggcuagaccucagccauggaacaagauuucauccuacuucacagccgaggcaucagagauucagagggaaauaagugucuugcccaggucgcuuggcugcugagcaggagaaccagacagaauucaaggccgggcuuugaguucuggucccagcuaucaggcaggccagugaggcaucccacccaggcuugccccagacuuccccuuccucccgcacugccaucagagauggucugauuuacaaggcucaccuugggugauucuucucacuuaaucauugcagaaaguuccauugcauaaguaaacagcaacaucacaccagagcugggauucaaaccugggucugggauaucagaauacuucucuggcugagaagacgaugccugaacuggaccucuuguaggcagauggauggagugggcugggauaguguucugaagcacuaugugagcuaggugugcuggaaggggggagggggaugcacagauggagaguggccagcuguggauuuacccagcagccuugggagggaggucagcccugccugagaaacgucuuugguacucacacagcugucuuggagccuguccccugagcauacaucccacgauucacuugcucauuauugucucuccugccuggugcauuuuccucagggcccuuggaaaagggcauugaggcagccccacaauuggagagucacccugaaaccugccaaggugggaaguguagcucaggccucagcacaaagcagagaguggcuuccauagcauccccacuguaucuaggacuucggcuuccuuccucauaucuaggcagggcucccuuacgggccucagacuccaagggguacaguuucugacucugaaguuccucagaccgacccguggcuccaauucucucuucugugagguguggagacaucuguuugagccuuccuuggagugcucucacauucaguccuuugagcacguuuauccuuucaaggacagguccuguucucggugauggggacucuguggacaagacccacucggucucagcacaauccacucgagggaaagagcaggaguguggugggaugggcaaccagagaacaggcaaggccaggcaggggcagagcgacagaguccuucagcugggggucugggcuacauuugaguuugacaugaggacagacaaagcugcagguacaaagcagucuugguguccucugggcuugaggggcucccuggacaccaguccagaaaggugacagcacugguuagaaauaagaguagggagagaggggagaaagaaggagagaggagaaagagcgcgggagagagggaacuuaagcacaccucugcacuauccagaugcuucaggcaaauggacuucccacagcagcuccggguucuccccagcagcccuggcugcugccaggucuucauuucuggccacaaggggcacaucgccucuuucagggcccaggaaaaugcugggugguccuuggccuagagcugcuaggguccaagguuuucugcaaccccugggucugacucagaucuaccagcccagcacuuuccuugcccugacgcuccuaauucaaaaaacagacccuacaacuugccugaggcacguguggguaaugucuaccccagccggacagugggacucugaccucaagaccucaucaugugugauccuacaugaagagccagacaaggaucagggccaugguuuuuacucuguggcagggccaacaggcuggccugcacucccucuucucaaaguauaggccccuuacaagccauuucagggcuuauggagcccuaaggcuugggauaguguaaccaauaggauaguguaauugcccugaauucucacugaaccaggcuggccuccugcccuccuaaacccuuguaggucugcaguguggagcacuucaucugucuuuauaucucucucucuuucacacacacacacacacacacacacacaccccuaccuugacuuugcccugcugagugaaauucuacccaggguacaauucaggcaacggccaugaagguggcaagugaacaaguugcccacgggggcuggagcuaaggacugcaaucugucccucuaggggaaugcucuuuaggauccugcuggguuugugaggacagcagagagacaggcagggcaaaggugaaagguuccugcuguguuugcuuuaguggugcucccacauaucacccauuugcugugcauaagacuaagguuggccuaagagcauauacuguguuauuuggucccaaagucuaaaucaagugcauuguuccccagguccaagugcagaaucccucuggcccucaggccucagucuucugucaucccaccaugaguuagugcugccugaccggaacaggaaguccagcgggaaggggaugaggcacgauggugccacaugaucauagggagccuccagcagcuaaccuggccagcgggucuggugcucucccugcgcccaccgcaugguguagcccugagcacggcagggaggcugacagacccaagcacggucacugucucaggccagauguaccuucaucuccucuucccugucugcccagagacccuagaucacagcucaagaguguguccuggauacccuaugacuggcucucaacaggccuauagguugcuggggacagggccgguuucagcuucucuguuccuccgcagagauccgagaggccuucaagguauucgaccgggauggcaacggcuucaucucuaagcaggagcugggaacagccaugcgcucccuggguuacaugcccaacgagguggagcuggagguuaucauccagcggcuagacauggauggugagaugcccugccucgguuuacccgcccaccgucaucuaggccccgggaccugaaccguggaguggaucugaguccacucuggccuuuugcuuccuguggucaugaucuacaacaguucucauccuagaaaguggagaccagaagaggugugacagucccagccacauaugggucaaacugccccucccacuccaugaucugagaaagauuuuaaguguggaaaaggagggugggauagcuagcucagcuucuaccacccacagcaauaguggcugcaucugccaccugguauuuuuacuaacgcuaacuacugagaaugacuaguaacaccaaguccccucugugcccgcgcaccuguugccucucccccccuccccccagagcgagcuccuuucccaucugcacggccgaaaggaugaucaguacugugcugagggccaugagaguucugaguguaccaggagggugucccacaucuggggaccaucugcugcucaccucccacacggccucccauggagcuccaccacauuugguagccuugacauuagcuucaagccugguacauuaggcaccccugaaauugauuggaggcugaggucccacgguuggucagaggcaggccaagacuccauuucaugcccugagcucuggggugccugcucgugcugucucaguuugacccugugcccacucuaggugacggccaaguggacuuugaggaguuuguaacccuccugggacccaagcucuccaccucggggaucccagagaaguuccauggcacugacuuugacacggucuucuggaagguauacccuggcaacugggucucugcuagguggaggugucauggggccugugaaugguuagacccacgccacagugagggagggagggagggagggaagggugaccacuguucccuguguccuguucccuggaggccugggcuccgaggggauggaauagcugugucacuguuacggaaccuggagaccuuucgucgggacugugcacuuacagggugcugggugggggcuguggcaggguaguaggcagaacacuugucccuuuugccacccaagugugacaugcagaagcugacaguggaugagcugaagcggcuucucuaugacaccuucugcgagcacuuguccaugaaggacauagagaacaucaucaugacagaggaggagagccaccugggcacugcugaggagugucccguggacguggagagugaguggccugccuugggucucugugggugggcacguacccaggguuugcauagagggccaccuuauguaucccagcccgguguucucaugccaaagugcagcucugauuccaucccuucgcuguccugucccccuuugucucucucccugguguuccuggugggcggcugcagccuguuccaaccagcagauccgccagacgugugugcgcaagagccugaucugcgccuucgccaucgccuucaucaucagugucaugcucaucgcggccaaccaggugcugcgcagcggcaugaaguagg

SEQ ID NO: 5861 - RNA, 20258 nt, Mus musculus
cugcccccagccacugggcugaggcguggcuuuccuccaaccugcuccgguccaacauggcuccgcgguugugcaucaucucugcagcggcacggcggcuauucacgaagccgagaccccgugcuggggaccucgcggcugcgggugcugugcggugagaggccgacggggcugacugcgugcccggaacaggagcaggggagggggcuggaaugaaaaacagacucucggauuuggaauugagggguuagaggcagagagcuaccaggauguaggccugaggcugagaaagaauggggaaggugaaaagguauggggaugguuuugguuuuuaaacagguucguacuacaugugauucgaccucggaaucuucuugccucugccucccagauagugagggugugcacuaccaugccuagcugggcagguucuuuguccuguuugggaccuggaucugggcugagaauaaaaaaugaggugagugggagggacagguuuugagcccuggaucccggacgaaggcagaggauauuggcagccuuuugccuggccuuugugguuuagcacgcgcuggggucuucugagccagcagaaaguuuuggaaggagaggaggacuggggguacggugggaauucccaaagugauuccgcacccugcuuuguacaggugggucaacagaguggggugggagcuguucaaggucagcguccgugccauguggaggcagcucuggauguuaggacccaggucuuacgaugcacucugcacuuuguaccacggcugguggccuccuaggagagaggcucaauucuggcuuuggagagcuuggcuuccuuccccugacuggcucugggcugcuccucccuccucgaugccacgcccggugcuacccccaucucugcaccuaucacccggagcacuucugacccugcucuccuguuuccccagccccacacccucacaaguuuuaggacaggguuugugcaaaaagcauuagcuaaagaaguggaacaccugcccucacaccuguggaaagggaccugcguuacuccugccccagcccaagaauguggccauggaguuccguuagaucgcugugcacauuaggaaagcacggauagaagaguugggacgcgugcccuucacuuccgugcuggguaaugagagagaagccgacaaugggaaaaaagccuagaguguaccuuguaaacucagccuuuucuggagggaugaccuuggguaggaggagaaaauaggaugugucugauagccuuguuuucuauugcuaggaagagaacucaggaguuuagguaugcuaggcuaauguagugcucucuccaccaaguaaacaaugacaucuccagcccucauuggauuaaagagaccaugcuuaugccucaaacaauuucugucauugugagaaaggauauccagaaaaauaaucuuuuauaacauuuaaaaaaauauuuuaagccuagagguggugcaugacuucaauucaagcacucaaggcaaucagaucuuggaguucaaggccagucuggucuacaaagugaguuccaggacagccagggcuacacagagagacccugucucaaaaaccaaaaggaaaaaaaaauuauuuugggccagguguggcagcaugcaccuuuaauuccaguacuuaaaaggcagaggcaggaggaucucuggguuggaagcccucauaguucuacauacccagcuccaagacaguuaggacuacauagaaagucaaacaaacaaaaguuauucugaggacuagagacauggcucacacuucugagcacuggcucuuuaagaguacagagguugauucccagcgcaugugcacucacgcaugcacugguucacagcugccuguuacucuacuuccaggccuucuuccggccugguccaggugugcaagugaugcccaugcaggcaaaaaccaacacauaacauaauuuaaaaacuacuuugugugcauaugcaaaugaacacuuguauuuguguguguguauguacauguacaugucauauggucgguccuauggcacauguguggaagucaccuuguggcucccagguaucuaacucagguuguuagacuuggcagccagugccuuuacacuggcccaagaucaucuguuuuuccuuuauuucuucauuuauuguuuguuuguuugguuguuuugagacaggguuucucuguauagcccuggcuguccuagaacucacucuguagaccagguuggccucgaacucagaaauccaccugccucugcuucccgagugcugggauuaaaggcgugcgccaccacgcccagcaggauuuuacuuuuacuuauguguguguagaggggagagagaaugagaaugugcacaugggugcaggugcccacucaggccagaagauggaguggaauccccuggaacuggagcugcucuacugaugggggcgcugggaaccaaacucagguccuccucuuaaccacugagccaggcguccagcccacaagaucaucuuuuaugauacccauuucgcacaugaagacagugaggcagagaaaggagcggagaguuggugguagcucuuauguggcaggcacucagaggcgagcugcuucugacuuggcaauccuggcuaguugauggugagucucgguuuccuucuguaaaaugggcauggugagcccugcuaugcacuuuccccaggauugcugugaaggggcuggacacugaucaagcccuugucagugacuugcccauagugucugucuuucguggucuaaugcucuggucguacccgagacuugagaccaccccuuuuuccugacccucagccugcucuuugccuuucuggagucacuccuggggccaucgguaaagagaccucaugguagacccuuaacaccaggagccaucuggcugcccccucauuguuuuaaaaaaauguacugugacaggagaggugaauaugauuaaagcacauuguacaaaauucucaaagaauucauccauuuuaaaaaauguacugggcuggagagauggcucaguggguaagagcacccgacugcucucccgaagguccagaguucaaaucccagcaaccacaugguggcucacaaccauccacaacaagauccucuucuggagugucugaagacagcuacaguguacuuacauauauuaauaaauaaaucuuuaaaaaaaaaaaaaaguacugugaggauuagcuuuuauuacauaguagcugcucaauaaacaaugcuauuagccaggcuuaaugccuuguguuccuaucacugguagacagaggcaggggaaucaugaguuagaagcuagccugggauauauagcaugacuuuuuuuuuuuuuuuuuuuuggaauuauuucuuuuauuuauuuauuuuuuauuuuuuuuugguuuuuuuucgagacaggguuucucuguguagcccuggcuguccuggaacucacucuguagacuaggcuggccucgaacucagaaauccaccugccucugccucccaagugcugggacuaaaggcaugugcuaccaacacccagcuuauuucuuuuauguaugugaguacacuguagcugucuucagacacaccagaagagggcaucagauccuauuacagaugguugugagccaccaugugguugcugggaauugaacucagguccucugguagggcagucagugcucuuaaccucuaagccaucuaucucuucagucccagcaagacucuuuugaaagaaacaaauaagaaauucuuguugcuccugcacuaaucuuguuaacaaaacuaaagugagcuuugcuggguuugcuuguuguguguuuauguuuccucuuguaggggucaaacacaggaccucaugcaugcuaggcaaguauuuuaccacugagcuguauaucuucagccucaaacauuaguucuuauagcugagaacaccucucucaugacaagcagaaauguggccccuuucuaaagccagccaguuuaaaucgagauguuuuaggaccuacagagagcugagcuucccagucuggaaaguucugagguucucgagccaugacacuuggagaggcaucggacuggagugccaaugucgauaggagugugacaucuacaauaccugccuaaggagauggaaaugcuccaggcuagguuauaugauuacugagcugugucucagaggcauuguguuaguucucgugagggaugggagggugauggucugcauagucugugacuugcucuauagcuguggaaaaaggcagagcuguuuaaaaugaaaguugagguggaaaugcuuucccagcccucuauucccugcuaucauuccuagccucugcuacuuauuugguuaggcuuuuuuuguuuguuuguuuaaaauauuuauuuauuuauuauauguaaguacacuguagcugucuucagacaucagaagagggugucauuucucaauacagauguuuguugaaccaccaugugguugcugggauuugaacucaugaccuucagaagagcaguugguguucuuaaucgcugagccaucucuccagcccuguuuuuuguuuuuaagauuaaaaaaagacuugcuuuauuuauguguuguuuugcaugaguuuaugugaaguguuuaugcagaagccagcaaaggucagaucucuugaaacuggaauuauagaagugagaugccugguggguacuaggaaccaaacucaggucuacuccaauagcaguaauuacuauuagccacugagccaucuccagcccuugguuuguguguguguguuuuuaaagauuuaguauguauauauauacuguagauguuuacaaacacaccagaagagggcaucggaucccauuacagaugguccagcccuuaguagauacagagucuaacucuagcuagccuggaacucucucacagaccacacaaaguucuaucagccucugcuuccugacuguugggauucaaggugugugccaccaagaccagccuauuuccaucuuuaauuauguguguagguguguaucugaguggauuuguguaugugcguguagacaguaggccagagggguggaugagagccccuggagcuggagaugguugugagccaccagccugggacagaacucaaguccuuggcaagagcaggaagugccaucuuaacugagccgucucucuagccccauuagugugugucuguuuuguuuggggaugggguuuccucuauguagccccugcuguccugaaauucauuauauaaaccaggcuaaccucaaacucacaaagguagggauuaaauacauacccuaccaugccugcauuguuagugggguuuuguuuguuuguuuggauuuuuugagacaaggucucauauaguucaaacucacuaugugucugaggaugaccuugaacuauuauaggcgugcuucaccaaaccuggccugaauaggcuuuaaaaacugauuaggauuggaaaguugguaucauaguuaacaguguaaccaugagaccuggguuuggauuccagcgagcaugugacaauggguguugucucucaugugccuguagccccaguacuguagugggcagagacaggaagaucacuggggcuugcuggcugucaugcugacuuggguaggaggacaagccccuaggucaaggagagacucugucccaaaggaauagagggagaaccagcuaccuuuuucuuaugagcacagaugcaaauguaucucucucucucucucucucucucucucucucucucucucucucucucucucucucccccccuccucuccccuccucucccuuccucuccccuccucuccccuccucuccccuccucuccccuccucuccucuccucuccccucuccccuccccuccccccuuccuuccgcucuccccuccccuccccuucucucucucucucucucucucucucucucacacacacacacacacacagagagagucuaaaaugcagacuguagccaugcaugguguauguccaugauucuagaacuuccaggcaggaucaccagugugaagccagccuguguuagggaguuccaggcuagccuaggcugaauaaugagcuccacccccaauaaaaaguuaaauugcuggguccacccguccccagagguuuugcgccauagucugggauggagccugagagcuuugaauaaauucuuaggcugugcugauaguguuaguccaggaagcacuguaggagggauacuugcuccaaaauccgcaaacuuaaaagggagcuagaaucucaaguagagaaguagagauauucagacuuugcuuugugggcauagaguuagcagugguuuccaaccuuccuaaaacuguaucccuuugguacaguuccucaugcuguggugaccccgaccauaaaauuguuucauuacuacuucauaacugggauuuuguuacuguuaggaauuguaacauaaauaucugacauacaauucccaaagggguccugacccacggauugagaacccugaagcagaggccuguuauaaaaaugcuuucugguugggacgauggcucagccuguaacauucaugccauguagcugagaacuuggcuucagagcuccagcauccaugugaaaagccaggugugugucccucugacuaagcacuggcagaagggacagaaggcuccucaagccugcugaccagcuagcugucuugccacccauugagcucgggguuagcaagagaugauguugcagaaacuugaggagagcaauagguagcuaauaucaauuucuagcacuuaugcagacacacaaacaugcaugcacacaccauacacacacucuaacacauaauggaugcucauacacacauguacacguacacacacacucucacagacacgugcacauaccugcaugggcucauacacacacacacacacacacacacacacacacacacacacacacacacacagcacagauaaugcuuuaaagaacagaguguaggucagagguagagugccugucuggcacaugccaggcucuggcuucuguccuagcacucuaggaaacaaaauacuuuacaaaaguuaaggagcagauuaaggagagggggaaauggggaauaggaaggaggagagccauuaggaagugagaaguagugauguuagcugcugucugccacgcuaggccuuuccucuaauagucccauccuccaccccuguuuuacagaggagugaaagcugaagcauuagcuggguuugucccugcaacccugacaagucauuuuguucuucugcugugguggcugggauggaaaggcccccgagucugaguucacauucugggucaagguuucccuuuucuuuaacuuucaggcuuuaguaucuaucuaucaaccaucaauucauccauccuuccauccauccgucuuacaucugugccucuuucccguucauuuccuaaacacagauugaacauaugcuguauguaagucuuguuccaguuacuggagacaacagaacacaccagguccucaccugucuuagugaggguuucauugcagugaagaggcaccaugaccauggcaacuuuuuuuuuuuucuuuuuugguuuuucaagacaggauuucucugugaguagaccuggcugucuuagaacuugcucuguagaccaggcuggccucagacucacagagaucugccugucuccgccucccaagugcuggaauuaaaggugugcgccaucauguucugcucauggcaacuccuauaaaggcaaacauuuccuugggacucguguacaguucaggagguuuagugcauuauccucuuggugggaaguagggcaguauccauggagaaagagcugauaacuuuacauccauaggcagcagcaggagaccgugcagggcgacacuuccucccauaaggucacaccugauagcaacacuuccuagggucgaauauucaaacacacgagucuagggggccauuccuauuuaaaccaccacaucacccuagugaagaauccggcgugggguggggagggagaagcugaacagaaagaacucuuuuggauuuugguauguuucauuuuuuccucccagugcuggagauggaacccagcaugcuaugcuggguaggcaaauauucuuccauggaacuauaucucugguuuaggucuagggcuuugcauguucccacagaaugaaacaagggagcggagggagaagggcaggagaauaucaccggaaaagugaaacuugaacuccuaaaaaugugcaccggagggcuggagagauggcccagugguuaagggugcuugcugcuuuugcagaggacauguauaacuccaguuucaggggcucaguguucucaucuggcacccaugugguguacauauauacauucagguaaacacaguagguaaaugcaucuuuuuuggaaauguauuuaaagguguugacuugaaacugagacuucccuugggucugaacaagucucuuuuuaaguuuuuaccuauaaaaaagaucuuccugggguaguguucuuaccuggcuuagcaguuaagagcacuggcuauuuuucuggagaaccaggguuuaauuccuggcacccaccugauagcucacaucugucuguaacaauaguuccagggcaucuguuaucaucuucuggccuccugggagccaggccuggaaguggugcacagacauauaugcagguaaaauauccauauaccgaaagaaaaauaagaauuaauaaaaaaagaaaagaccuagcugggcgggcugcuauguuuugcuuauucaacacaugggaaacagcccugcaggcaggguuugaaugguaggaagagacugaaggaauuaaagcuccaggaagcuccccucucuuccccuccccucuccagcauugaaguccuaggcucacucuucaggagcagccucuggauauuuaucuuggccacuacugacguuaaugaguuacugcgagccuagcucuggagcaaaggucuggguggccgaguggagccgcuuuucugcauguuacuaccuccuccugggacagcagccguguccauucagagcaaaggccacacccuucggugccccacuugaggggcugguuuucaagugcuguucuccgauuuguccuuaugacccuuggaaguugcuuaaacaguaagcugcugcugauccugaagggggcgguaguggagcgcacacuaaugguguguugcuuaggaagcuccugcugugaaauguaggucaugaggcuaggggagcauggggguuauuggggcucccgggccuccacauggggguuauuggggcucccgggccuccacuuggcccucucaacuccucuguucugcagcuucuauuccaaggacagugaaggaagcugguuccguucccucuuuguccacaagguggauccucggaaggacgcccacuccacucugcuguccaagaaggagacuaguaaucucuacaagauccagugugaguagcugcuaaacuggagagcuccacccuuaggcuuuuuguggguggggcuggggcaaagagaugagaggaugaggaugguccaugcuguccugagagccuuagcccuguuuggggccugcucacucugacacccuucacacacacacgcacacgcacacgcacacgcacacgcacacguaauuauugcacgcaccucaccuccugcucucuguccuguguugcaguucacaacgugaagcccgaaugucuggaugccuacaacagucugacgugagugucuugaauugaucccagucacugcugggauguagggggguaggggcccucuuucccaagaaagccuucgaacauccucugccuguucuccagacacagucaagggauguagauucuagaucuagaagcccuaaggguaucuucccaccucugcuucuuagggaggagacaggcucagcccuggggccguguggucccuugguggccagugcgagcccugccccuucuuaugccccucccacagggaggcuguacugcccaagcugcaccuggaugaggacuaucccugcucgcuugugggcaacuggaacacgugguacggggagcaggaccaggcaggugagguucccuuaucuccagugccacugcugccacccagccuuugucucuaaaagcucucguaucugucugcccuccucucucucugcagcaucucugagggucuggggaaguguguuucuuucauaccccauugcccuacucaaacaccuguuggcuacucaguguucucaggcagcccgggaggucugagaguccauccuugcuggguccacagccggacuucuccacguccuccgcucacugugcugccugcccugcaucugacuccucaguuccccaccuagaaccguucgguuuuuccucccuuguuugagacaggucuuaccguguaguccaggcugaccucgaacuggguacuguuccugccucagccuccugagugcugaaaugcuuugguugauugucuuuuugcuuguuuuucggggucaggcuuucucugugucaccuuggcuggccuagaacucacuuuguagaccaggcuggccuugaacucagaggucugcuugccuuugccuccugggugcugggauuaaagcaaugguucuaccuuccuaaugcugcuacucauuaauacaguuucuccuguuguggugaccccccucccccaaccauaaagugauuuucauugcuacuagauaaccguacuuuugauauuguuauaaauuguaguguagauaucagaucucugcccucuguagagguuaugauccacaaguugagaaagaguggauuagacaugugugaccaugcuuggcuuauucacuugccuuuuaagguuauuuuccaaucugucugucuacugugcacgugugccugugugugugugugugaaugcacacacacgcaccaugcuauauccauggaggucaguggaccaugguucucgccuucaccuuguugaggcagggucuccuuuguuucugcugcugcacagcgugcacuccagucuagaucacagaugugcacuucugcaccuggcuuugucauuuggguuccggggagcaagcucaguuuguugagcuuguguagcaagaguccuucccugccaagccauuuuaccagcucucaccugucuuauuguuuuguauuuugguguaagacaagaauccuucugaaagacuggauucuuugcacuuuugcugggucagggucugucccuggcucucugaucucuacuacuugacucuucauuccuuggucaugcacccuauagcugccgauauacuugucugucuucucguauagguagugaguucugagggucagggccuauaucucuuuguaauauugaauaccuaauaaaaauauuuccucuuuuuuaaagauucaugcuguagggacuggagagauggcccagugguuaagaacacuggcuguucuuccagaggucucagguuccguccccagcauccacaugauggcuggcaaauucuuuaacuucaggaaaucccacacccucugcuggccucuacuggcacugcaggcacaugguucauagaggaacauguaaacauuucuagauauagaacaaaaaaguaaauaguccucagaaaaaucuuaucaaaacauuuaugcuaggucagcaguuacaggcaauauugcacuuauagaggaccugaauucaauuuuuggcaccaauuugguagcucacaagcauccauaaucuaguuccaggaaguucacauccucuucugaugguugccauaggcaccaggcacacauauggugugcuuacaugcauguaugcacguaggcaaacacucauauacauaaguuuaaucuugaaaaacaaagacaaaaaaauuuuuuugacacaggguuucucuguauagccccagcuauccuagaacucuauaguccaggcuggccuugaacugagaucugccugccucugccuccugaaugcugggauuaaaggcaugggccaccguugccuaacuugaaaaaaaauuuuuuuuucuaaguucaugcuggcucauccuguaaugcuagaauucaggagacugaagcagaaggacugcugugaguucaaggacagccuggucuccagagugagcuccaggccuauagaaugagguugugucucaaaaaaacaaaauaaagccgggcgugguggcgcacgccuuuaaucccagcacucgggaggcagaggcagguggaucucuugaguuccgaguucgaggccagccuggucuacaaagugaguuccaggacagccagggcaauacagagaaacacugucucgaaaaaaaaaaaaaaaaaaaaacaaaaaaaacaaaauaaaaccaaaccaaaaaacucccaaaaguuucaauuccuuggucaucucugacacacauugagugcuaacugauaggugugccuggcucacagcugcuguuggcagagagcuguaaacauugccagcgugguagaguaugaugugggaugguacagccgauacagccuucucagcuucgcucgacaacagacacuugguacccgucucaauccugauagguauguguuuguaaaaagagagagaaaaaucuaugagccuagcgugguggugcacaucuguaaucccaauacaggaaacagaggcagaaguucagggccagccugguguucauaucaaguuuaggccagugagagcuucacagagaaauccugacucaaacaauaaaguuaggaaauguguuaaagagaagagcagccgggcagugguggcgcacgccuuuaaucccagcacuugggaggcagaggcaggcagauuucugaguuugaggccagccuggucuacagagugaguuccaggacagccagggcuacacagagaaacccugucucaaaacaaaaacaaaaacaaaaagaagagcagcucuugguaacccucuacucugucuuggucauaggcauuggcaugauaaacaaggacaagccauuugccuucagcuuagcacuggcaguagaacuucuuggcugacauaauaccacagacucaaagaacaugagugcauucuucaucauugggagccagaaggcagaaaucaagcuuggcucuguccaggcuuccuccgcggcugcagggaaggaagaucccucugccucuugcaacuacugguugcuagaaacccuugacauucuuuggcauguggacacaacagucugagcguguucuguguuuccuggguuacaugguguccccuuugugugugaucuuucucuucuuauaugggcaccagauacuggauugaaguucuauccaguguuauauaggcuuagcucaguuauguacagagaccauguuuucagacuaggucacacagugaggcucuggcaggguacugaggggcuacucuuuaagcuggcagagaacauggggaaaucuaauaggacaaagggcucuuggagagaaagaggcuggcuucucccuggaccucuccugggcuucuguagucagucucuugagucaccaggaggucuuguguacauuggcaucucuguauguauccuccuaccccuaaccacacgcugauacauuccugguaucucaguuuaauccuuaguuugauuuuuuuccccauucccuuggugccuucuuccuucugucugucccucccuuaauuccuccuuucguuccuuuuuuuuuuuuuuuuuuuuuugacagagucuuauauagcuugggcuggcuuugaaccuucugauccucuugucuccugugugucgccagccaguccaguuuuaugcaguguuuggggauuugaacccagggcuuuguucaggcuaccagcugagguacauccccagccugcuuccuuucuuuuuaaggugggguuucccucuguuacccagacauuggcucaauauaucauccugcgucagcuuccuaaguggcugggaccacaagcucccuguuuccauauguaguuacaacuguuuuuuuuuuuuuuuuuuuuuuuuaagauuuauuuauuuauucuauuuaaguacacuguagcugucuucagacacuccagaagagggcgcuagaucucguuacggaugguugugagccaccaugugguugcugggauuugaacucuggaucuuuggaagagcagucgggugcucuuaccugcugagccaucucaccagcccccacaacuguuuuuauuugcuuauuuuucuuacguucauugccuuggaagguuccuguuuuguuauuguuguuugguuuuuuuugcagagauaauggauauuagggucuccugcuguuaggugaguggucuagccugagcuacagcaccagccucuuagaguguccugugucuguucaucagacuuacuccuccgguccguccagccccucauggucuacuguccgugugugcacugcuguuccuaggauggaagacacucugaucaucuuuugcuuaguuuucuuugugaugcuguagaugacagccagguccuucugcaugccaagcguguguuuuaucaguagccaccccucaccucaucugauccucuuguugcugcuguuuaaggaaugugaguaggauuuuguggacgagagcauugaguccuugaaggggucaaaggccaucaagcugagcagagcuagugcucuccugggcuugccacugaggucaccuccccaccaccuccacccagugcuacgccucaccaagacagauggagcuaggagaccuccgcucugcugccacauacaguccagcccuggugucaggcaggcaggaucccuguagcuccuucaccuguauuccuauccccaacaguacaccuauggcgguucucagguggcuacccggcccucauggacugcaugaacaagcuaaaaaacaacaagguaucccagcauccugugugcauguugcuuccagcccagcccuguguggaggggagugugggacaaauucccccugccacccauagggcacacugacaggguagcacaguccccuggcuauggugccuguaaugcucuuccuucaggaguaccuggaguuccggaaggaacggagcaagaugcugcuguccaggagaaaccaguugcuucuggaguucagcuucuggaaugagccacagccccgagcuggccccaauaucuaugagcugaggacauauaaacucaagguaccucacuuccaacaaagcugcccccucccccugcccucuaucuucucugcuauuguguugcuugcuuugcaagagcucaggguaggguggccugaugcuucuucagcuuuaugagcucagagcugagaugugugcauugguguguauagcugacaucaaaugugagucagggcccaggaacgagaggcccuccaggucaggggucagggaaaggcuaguuucccaucucugccccuaugauguugggaguccugguggggcucacuggcuucucucucugggucucuuucagccaggaaccaugauugaauggggaaacaacugguaaguuggcacuggccuugggaauguggcagucccugcuguccugggacauuagggaacccauuagguuccuagugggcuuguucugggcugugacccaggagcccagcaugcucugguccuugaagcgcucagagaaguuuccaccugagcaggacaaguucucuagaggaaagugcugccaaccagccagcagcugcacucccagaguucauucccuuggccccacuuuggaccccuuccaaaaaaauguggccaaggaaucauccgggccaccuugggggacgauuggcugagcuucuuucccuuguucucugccaucuccagggcucgggccaucaaguaccgucaggagaaccaggaggcggugggaggcuucuuuucacaaauaggagagcucuacgugguacaccacuuaugggguagguuggaggcacucaagccucuguuugucccuucauaaaacauguggaugcauuuguguuccgauaguucuuacguccuagcagagggagacugcauucucagacauaaacuagcacaaaggacccauuucacagugagacauacuggggaagacuaggcagggggagacaacaagcacuuuuuuggcuugaguaggcaagaucauucugaaggauaacauacaaauccugagcuguagggugagaacaccagcuaggaacugugggaggcaggagugugaggggagguuuccaguggaaggaggggcaguggaguggggaggcugucgaugaguggaugggaggagagauggguggggagcaacugggaagagugaagacaggcuggaggacagcuacagaucaggcuguggugggaggaguauguaugaguucuguagcuaccauguucuuugucaagagugccugguggugguaggaaaccaggcaggugacaugggcugacuuccgguagugguaccagcgugcucagacagacccauugcucugugaucagugggacaugagaacagauugcuggaggaggaaggggaggcuaagggagcacucaggcucaucccuaagcagccgugugcccuugucuguggcaaggaggucuaggagaggagcaaggucaugggauggaguguaauucggggaguauuauauauuuaggaugcggaugcugggcuagccagauggcucaguaggugagggcacuugccaccaagccugacaaccugaguugguuuccaggauccacuggaaucugacuccugccacuuaucuuccgaccuccacacacuccccccuaacuauaaaugaauauguaaauuuaguaagauaauuauaagauacauaugcauccaacuagaacuaucacauggguagugaauauaggaguccaugggagaauuugagacuggaagggaguugccaacauauguauaugcuuccaaacccuuaagcccuaccacagggccuuuguuacaugccaguccucccugccaccccccaaugcuuuuucccaacagucuacacuuggcuugcuuucaccugcuagcucugguacuuagaucuaauuccuuagagucauuguuuucuuguuacccaagaucuuuugucaucucuuuucccacuuguuuuuuuuuuuuuuuuuuuuuuuuuuuuuuuuuuuuauaagcauuguuuguaaucaucuggaauugaucuuuuuaauaugugugacuggaugauugacacagcaguguuuguugacaggcuaaggcacagggaucuggggaggaagagaguagggauuuggggcaaugcaggauucuugugcugaggacgggauuagguucucugaagaaugagccugugcccuucucacagccuacaaagauuugcaaucucgggaggagacucgaaaugcggccuggagaaagaggggcugggaugaaaaugucuacuacacaggugaguguucccucuggggguuaguggcaccguugcaaguggucugcuaggagaccuggggaugcagggcucugcaaguuucucugcaaggacagauaacaucacguggucaccuccaguguaggaacucaugguuuuauuugucuucugucaugugccccaucccuacccccucaccuuuugagccagugucuugcuguguugcccacgcucauucugaguagacauuuucccucagucucucaaguugcuggguuacaggcaugugccacuggguacaggugggaacuuacucugacaugagugugacauuccacacgcuccgaugaguccugaggccuuaggauucuaauacagaggugacauauaacccugggucaguucuguaccucucagaggacagggaguuagguuauggaaagugcuuugcccugauaacaucaaaacaugcagccaauuuuuugaguguauuuuuccugaaacuguugccacugcuagaagcccaaagaugcacacagggucaguagguacugaccgagccuucacuacaugcuggacaggcgggagcaugugagaagcaugagucugucccgcccuugaugccuuuagucuuccacucgucuacugggugggcaagagcauguguguugaaggaguggcaugagccuugcuauuccaaguguggucccagcggacagcaccggcauccacugguuacuucagaaaaaugccaacuuaguguuuccugaccgucugugaacuagauuuguagggguuuauauccacaucagagucugagagauuaaacacaggaagcaagaacuaaacucuaggcuggauggcucagugguuaagcauuauacuguucuuagagaggacccaaguucaguucuccguacucacugugggaggcucacagcugccuguaaauccagcucugguggaucugacguuuuuaucuccugaccuccaugggcacuguacucauguguauauacccacauguagauauauacacaugaaaaauagaaaauccuuuuuaaaaaaaucucuccuccugggggcucuccacugacauccguccccccacuggcauggccuccuaagcuguacgggggcaguugcaccaagucaaaccucaggccuuacagcucuuccuugccgguauauaccgcuauaguucucucuugcuugcuguuuugguguuggggaucgaguccgagaucucacucacacuaaucagcauacaccuaaccacagaaccgcagcccugcccguaggaucgaucuuguugcuucagccgaccucuguguccuuguuuucauagcauuaggcuuuguaugucuugcuuguuuuggaagcauugacgauaggaugcgaggguucauauaugcuagggaaguguacuaccacugagcuaucucacuuucacauacauagaaggugaauaaaaauuuccaaaauacuuggcuuauuaccaccuaauccugucucauaacuugggaaccaugggccucucucagaugauaguagggagcccucccugucacaggcuuuugugaguuuugggucagugaccaaggguaccucccuugccccgggcacccuguaaccucugcuuuccucccuguaguccccuugguucgacacauggagucacgaaucaugauuccucugaagauuucuccucuccagugaagcuggcacugccuccaccuccuucccuuucuccuguggacuagccuggaaaggaggcgcuucuaggccaccuggcacaguuuucucugaacucuggaagacuucugaugggugguguucagcuucgacaaagaugacguuuucugagaacuuaguccguccguacccagcuaaccucucucccaugcuggaugaagaaguucuuaacuucccaagcugcagaauagcaaccuuuuaagcuuucacacacuuuccucuuaagauccgucaucuccaggacauaaguccccagcucccaacuguggccauggcuuaguugcauaaaagcaggcaugacuggcuguuaggagguauggugugaaaggguaucaguccagguauggcccgggaacucucuggugucuacuuguuaaaaaagcaagccugagucuuuaaaaaaaaauaaauaaaaauccuggaacugccauaaagucugaagucgugacagucaggaggaaauccagaaguuaucagugucaguaggugguccagaagucuacuuaaagggcuaggaaaagggugggagugggaaggaucuggguacaugagacagccuugaagcaggaacccuucacaagugggcacauaggauucagaauuuaaaauacagaauugggaagacaggacagaggugacagaggaucuuaagggagcacccuguuccuagacagauggagaggcguauccauguuuuccuacauaaugugguuaaaacuugaauuugugcuucagcucuucuguacuucuuccuuccuacaggcaaaaacacaggcugagaccuauaguuccaucaaauucuuucuuucccuucuugacauugucccccaaacccucauuuugcagaaacacuaggucuguggaguagguugugauucuggggucucuucaaugaccccgguaccucaugaaccccugcuuagcaugguugugcuaccauccaggagaauguugauggaaccaaauuaaauauuuacuguacguugu

SEQ ID NO: 5862 - RNA, 33548 nt, Mus musculus
ucucuauggucgcgagccggaaguggcuacccggcuggaaggcgugaggagcauucuggugagcgaggguagagggcugcuggcuggggcugcagguccucgcugggcgauccgggcuugaugugcagacggcacggagcguguccgcgggcugggguccucaccugucggggucccccaggcucguggcgguuuucuaggaacuaaccggagcagcauccucuguccccauuguagucucccgagagugcugcugcugguggugacccucgucgaugguccucuugggcguguggcaaacgcuccuggguggcgguuggcuuucccggguuuuccgugccacccuuguggguuuugucagaugaguccgccacucguuuaccugucaccggcagccuccugcgguccucugagagaggcguuaccaucgucgcgccgcaccagacuccaaggagucgcagaaaagagcuuuuauugcuggagcagaaaggcugagagcgcgaagugcggacguuacaagggcaaagaagcuuggcuuggcuuuucuuuauguuguccgcucuauuuccuagcuagcuggcuggacuuaguguauuugcuucauuaaauauuuugcuuaucuuaauuucuaagaaaaggaaaacaagaauuuuuuuucuuaaguuauacugcaaagggcucgggcaguaagaagaggugccaccugcuccguuuuaaugaagauuuuaaaugcagucacuauaguccugucugucuggcagcuucuguaguccagguuggcuucacauugguaaagaucccucugccucagucacucaagcucugugauuccugauauuuaccacuauccugucucacagcccauccgccccuccccccuuuuuucuuggagacgagauuuuauuauguagcccaaacugacuuuugaacacauuauauagcaaaagcugaucuggaacaucucgucagccagcucucagucugaccuguucucauugcaggcaugucccgccacacaguuuuaugcaguccaggagaucaaacacaggcguuugaguaugcuaggccagcacucuaccagcugaguaauauucccaacuucacagucacuuuuuaaaccuauaguuacuuugguagaagaaaacuugggucuggucugcaugccauaaauaggaaauggcuuccacuugucuuaugauauugauauaacugcauaguauacauaguaugaugaaaacauuuauuaauaaauucugucuugguuuccuugucuaagauucugagagagaauccauuucuuuuuaaauuauuuuuauuuuauguacaucgguguuuugccugcgugcguguccgugugagguguuagaucuuguaguuacagucaguugugagcugccacguggauguugggaauugcagcuggauccucuggaggagcagucgaugaugcucuuaacuucagagucaucucuccaacuugagaaucuauuucucacaagaaccuugguguuuguaaauauuaacaauaaacuaggaaacuugaaguaauuagacauuucguuugugauuuuugucucacuguguagaccaggcuguccucaaccucacaaagauccacuugcuucugcucuccacuccuggagugcugaaauuaaaggcaugcgcccucacagcuggccagaaaaaugacagcacagcacugugacccguagcuauaaucucagcacuguugaggcugaggcagaggggucuccaguuuggaagcagugugagcuacauagacuuguccaaagagacggcgggcagguugaccuguccucugguguuuagcauaaugcagagucacuccagauccacccugaaucgaguuccucauccucggggaugugcuuugcgugucugcgccccuucaaucccagaaggacuauugugcauuuaauuugagagaaaacaauaaugaagugguucguugaggggcccaugggucuagaacagucaaauggagguucugacucaggcuucuccuacaaguauuggugguaaauuaaauaagggacaaaacuacccucccuugguuguuggggggacgauaagaggcagaaccucauaaaauguaggcuuuggucuuuacuuauuuuugcuucuuuugagacggagucucauuauuuaagcuuggcuagccuggaacucagagaucuuccuaccucugucacccgagugcugagauuaaaagcaugcgccugccaccuugccuugcucuucuucauuugaauauuagagccggacagggagguggcagggaugcuggugagacugggcgaugcaguacugcagguguguaagcauuggaguagcaucagaugggcccauucuagcugugcagcuuugaaaaaccauuaccucucuaagccuugcuuuucucaucuuugagaugauagagaugguagugguucuuaucugaauggcuuuguaaaguaaccaagugugaacauaucuguaguggcuauuccugguugucaacuugacuauauuuggaaugaauuacaauccagaauuggaaggcucaccagugacccuuaucuggaggcuuggagauccuuaucuggaucuugguuuggagaucuugagccauaguggcuauggauuccagaagauugaaucuccgaguuuaaggaacacaccuuuaaucugggcuacaccuucugcuggagacaauauaaggacauuggaagaagggagucuagcucuugcucuugcuccuucgccugcuugccgugugagacugaguaacugcuagauccuuggauuuccauucacagcugcgacugaacaauuguugggaauugggcugccgacuguaagucaucaauaaauuccuuuacuaucuagagacuauccauaaguucugugacucuagagaacccuaacuaaugcaauauccaucaagugcuucaaucaaagucuacuauucaguggccagucagaaguauuucgaauaggguuauacaccagacaggaauuaaaucuaaauuuaugaagugcuuugccaggcucaugaguaagagcagagcucauagucuuggcaggaacuugguugguuguuuugacuuaagauagggcaucuuuauauauccccgacuguccuggaauucaccgugugggccagauuggccucagacucacagagaucuuccugcuucugccuccugagagcugagauuaaagcugugcgccaucacacccagcugaauucugaaacaucuuaaagcucgcuuucuuuuuauuauuaugguugugagcuaucugaugugggugcugggagaggaacucaggucugcugcaaaacaguacaugcucuuaacuguugagucaaccuuucaaccccugacccuggaaagucuuuguuuauuuuccuuuuuuucguuuguugcuuuguuuuguuuuguuuuguuuuguuuuguuuuuuugagacaggguuucucuguauagcccuggcuguccuggaccucacucuauagaccaggcuggccucgaacucagaaauccgccugccucugccucccaagugcugggauuaaaggugugcgccaccacugcccggcuuauuuuccuuuuaaaguguucccuaaugagccucugaauuucauuagcauccaugugacuuuguauguuuguuucuaaugucaauuaauuuaggucuucucucuuucuugguuaguuugguuaugaguuugucugucugucuuugcuaagaaccagcucuuuugcugacauuucuuuuuugucucuuuacaugugauuuauuucuucuaaucuuaugugccuugguguuuuucuugcauucaugucugugugagggugugggauccucuggaauuggaguuacagacagcugugagcugccauguggaugcugggaauuaaaccuagguccucuggaagagcagccagcacuccuaaccccugagccaucucuccagcccuuccucucuuuuuuaaaaaaaaauacuuuuauuaauucuuugaauuuuucauacaguguauuuuuaauuuuuuuguuucguuuuguuuuuugagacaggguuucucuguguagcccuggcuguccuggaacuuaguuuguagaccaggcuggccucuaacucagaaauacgccugccucugccucccgagugcugagauuaaaggcgugcgccaccaagcucggcuuaaauuguuuuuuguacaauguuauguguauauauguuuuuccuacauguguauguauguuuuucauacauguauauuugugcgccacaugugugauugguauucucagaugucagagggcaucaggugcccuggagcuuaguucuagaugaaugcagggagucuaaccugguuccucuggaaaagcaacgagugcucccauugcugagucaucucucagcuucucggucgcaaacccugaaaagcuuucucuccuaacagccuuuucaccuggaagcacaaugucaucagaauccagcaaaaaacggaaacccaaagugauccggagugauggaaccccaacugaagggaaacggaaccggucugacacggagcaggugagcacgcugcugggaaacugcagacugagaguguggaggagcucagcggcaugugugccacagacgcacuucugggugcccacacuagaccagacgacuugaauucccacaauuguacaaaagaugaguguucacauccggugcuggccuguuggcuauugguauugcacagagagcaugucccagcgcgcuguucccagcuugccuaugcacugacugcacggcucuagagcuuccaagagaacucaucuuuggucccagaggcacgugcccccaggaguucugugguccaggagcucugucaccagcacggucuucucuuguuuucucuuggagucugucaagcugaucugugguguaacaugcaggagguuuugguuuguuguuuuuuuguugaagcagggucucagagagcccggguagccuugaacuugauguauagcugagggugaccuugaguuucugauccucuuuccuccacccuuaccccuguuuucagauccugcaaggcccugaauuagaaccucauaucaagagacauuacuuuuagugcuuguuuauuuguuuaacuuuuaagcaguaauuucuaaacaagugcaggaaauaagcccucuuuuacaacccagagcucauuuuuuauaaaaauguuuguuuuuguguguauuugccuuucuagcguuuuaagaacgucauugugugcagugccugccgaggccagaagagggcgcugguuccucuuguguuguuggagacugaagcugguugucugcacgauuacuccaaaccauuaggauuaguucuguauacauaaaugggaauuuauggacaaaacaaaguaaagagaaaaaugaaacaacagcauuuuccauaguuccaggaaaucaagauuaauguagagauuuuuuuuuucuuuuggcacugaucacagcauugcuaauuuguuuguuuuuugagacagcccuguuuugaagucaacaucacccugucuccaucucccaagugcugcaauuacaggaauaagucacaaugccuggcuaauaguguuuuuuacauuuguguauuuauguucacauguguguaagugucuuacugugccgcuagugggccaggagucacuguguagcccagacugaccauacacuggcaacuguaauguccuuauagaaugaagguuuuuauucuuacugucccugauccugucagggagacccucacccaggaccucucuuuuugccuucacaggaaggcaaauacuacagugaggaggcugaaguugaccugcgggacccuggcagagacuaugaguuguacaaauacacuugccaggagcuacaaaggcugauggccgagauccaggaccugaagaguaagggcagcaaggaccugguaaggagaaaggccagggaugcuacaccuggcauguuugcaggcuggggcuccuuuugcuauuaggggguaggguccggaagcaccagagaccugucuauuaacuuguuaauuaauuccauaacagccccaucuuccauuauaguaaugaaaguacaagauaucuuuuuuccuauagcuauaaugugauauuauugauuuaauauuuuuuacaugccagucauuuugcuaaguguuagaaguauaugcaaauaaaucauagagcucaaaauaaaguuaucauggauguuaaaugcauuacucaggcagauauaaaacuaaacaaugucuaaaaacuaaggugauuuaaagaggaauucacuuuuuuucucagcagucuuacuuauuuucauguauauugaccaguguuguuaagauaguuauauucuauagcucuggcacuauaaccaagcuuuauacagucagccugcucgcccucccucccucccuuucuccuucccuucuccccccacgccccuugcuuugagacuguguagcccugacuagccuugaaacucccagaguagaccaugcuggcauugaacugugccuccucauuacugggauuaaaguccuuagagugccaucaugcuuggccugacucuuucacuuccuuuaugacauuucucacugucccaggcucccuuuagacuuugcuuauggcccugcaugggguuggcuuggcagccagggucuggagaaaacugagcugucaucuguuagucgucguuacuggucucuuugugaacaggccauugaaauugaagaacgaaggauccagagcugugugcacuucaugacucuaaagaagcuuaaccgauuagcccacaucagauuaaagaaaggaagagaccagacccacgagguagaguugaaaggcuuaauaacaugggcucucaccccucccucugcccacuuuaacucucccuuugcccuucucugacuuuggugauggucagucccaccccauguugcccugcucaccucauccucucuucaggccaagcagaaagucgaugccuaccaccuacagcuacagaaccugcucuacgaagugaugcaccugcagaaggagaucaccaaaugucuggaguucaagugagugugggaggacggggcuuugacuuacgagucugugguaaugccuguucuuccauggcugggugugagccaucccuuugaaggagaaugggcgggcuuacaagauuacaggauuugggggagagaucaggacaucacuucaaauagagaaccucaagcggucauuucagaccacacagagaacuguggaagccccucggccccuuuugagguuugagcucagcacuugguaaaagcaguuuuucuccucaacauguauuguuauuuauucaccuucugugccauagaauaccaguaccuacuugccccauugaaaaaauaaugugccugauggcuaacaucucccgcuccagugcuguuuuuucaaaguaugacgguugagaauguauaaaaacagcauaaaagaacguuacucccuccuuguaaucuuugcuuaaugcaaguuggucaagucaggcuauaaugaacucaggcagguggccacaaaaaaggaucguggguucugcaguuaauacacagggucugccucucacuagcuguguaaucuugggcacauuugaaaaagugguggcucacgcuuuuaacccagcacuugggaggcagaggcaggcagaucucugugaguuugaggccagccugaucuacagagugaguucuaggacacccaggacuaacagagaaaacuuaucuugaaaaaacaaaaacaauagaaacccaaacaaacaaaugaaaaauggaagaagacuagaguauagaguauagguaaauuauacuauaauauaaauaauaaagcguaauagguuucaaauggagcuaaagcccccaucuccuaagaacaaugugaggaggacagaggugagccagcauguguaggagcguauugacuaugguagcugugaugccuauguggccauggcaugagcgcuugugccauuaauccugcagagaauucuuuucucuaaauaagcaaaauuuaaagccucuagauuuugcuuacuucuaguucggccaaacuggcuuuuucuugucuuacacaugugcagggaaaauguuuuuuuuguuguuguuguuuuaaagauuuauuuauuauuauauguaagugcacuuuagcugucuucagaugcaccagaagagggcaucagaucucauuacagaugguugugagccaccaugugguuucugggauuugaacucaggaccuucagaagagcagucaaugcucuuaaccgcugagccaucucuccagcccccaagggaaaauguuuuaaaguuauguauagacucuuagguuuaucuuuccuggugacgugucuugguuucaucaugauggcauaagcccaggcugcagggacucugagucucuuagcugauacuucuguucagcuaggaaaggccugcaaggucauugagcauccuccuccagccuucagcugauuuguggauaaguagggugagcaacaugggcaaaugacucugugguaagucacuaauaacuaucaucacacugaaaugccugucacugagcauugacugagauugaauuccaggauuuucaguagccauaggcuggggcugcauagacaauggaaccauugccccugcuaauccacagcuugggguucugaaaauggcugccugagaacuucauuuugcuuauaggucaaagcaugaagaaauugaucuggucagcuuagaggaauuuuauucagaggcuccaccaagcaucagcaaggccgagaucaccaugggagacccucaccaacaaacauuggcacguuuggacugggagcuggagcagcggaaaagguggugaccuuccugaccugguuaaccacacagugacaguccuuggucaugacccaggauuagccauuuucuccaggaccaagucucacuuucuuauuaauucacccuggauuauucaaaccugacugaccucuuucagggugggcugaugacugcuaagguuaccaguaggaagcuggaggugaugguauguggcucaguggugguaugugugcccaccaugcccaaggcucuugacucagugcccagcacugcaagggaggguggcucaguagauaaagcacuuguuguauguacaaggcuuuggcucugaauuuggaucccagguacaugugaaaaagcugguggaauggcaugaaucugagguguaguaguagauccccgacguuggcagccuaagcgugagcuccagguucagugagagaccuggccucagaaacuagcagagaguaaugaagaaggacaguuggacugacugccgucucugcgugugcacucauggaugaguguauguauccacacacacacacacacacacacacgcacaugcaugcacacacacacacauuauagagugaaguaagaaauggggagagauaggggaaagcagucagggugacaaacaacaagauaaaaugauaaauauucagaaaaaugucacagugaaacuuuguuguuuacuaacuguauuaguuacuuuccuuguuacucugacaaaauuguucucuccucccacccuuccaugaguucccaggguugaucucaggccauuaggcucgccaagcaagugcuaggauuuagauaugcaccaucacaucguuauguggugcuaggccagcacucuacccacugagcuaaaucuuaagcuccuaaauaccuugguugcuugucuuagauaggguguguuucuauugcggugauaaaacaccgugaucaaaagcaacuuagggaagaaaagguuuauuucagcuuagaacccucagcucacaauccaccacugaggaaagccaggcaggaagcugggguccuuaccuggagcagaggcagugaagggaugcuguguacuggcuccuuccccuuggcuugcuaucauccuagcuacaacuugacuuugaucccuggaaaccaggucguaggagagaacugacuagcguaaguuguuuucugaucuccacacgugccauaacacaagaauccucucccugccccacccccacaaaaauauaauaaauguuaaaaacuaguuuuaagucaauguauuugaggauuuauguaauuacuaagaauaauagugcuuguauggagcuuacuaaaggacuuggcacauagucagugcuggaacaggugugugcgcuaucccugcaaggcaugccugacagugcccuaugugccccuuuaggcuggcagaaaaguaccgagaaugucugucuaacaaggagaagauccugaaggagauugaggugaagagggacuaucugagcagccuccagccucgccucaacagcaucaugcaggugaguguggcuccgcuucaccacagaccagccagaguccaccacacaugugugugaguauguggccugauuuuuuauuguuugugaugccagauuuggucuaaauucuuauaguuuuaugaagcaagauaaauggcuaaugaggaggaacuuuguaaaaggaauggagagaaguuuaaaucuguuuuucuaggacuuggcaaggucuucacuucuuccucucagcucuggacauggaauuagaguugucagcaaaaacacauuuuucuaguaggacuucauaauagaagagaagagaaccuggggcugggcugcugaugggccugggaagcugcagcaggaagguuguggaucugaggcagccugcgcugagugaaggguagacucuguccuacccaggcuacauaacuacggcuguaauugcugguacauacuuaccuugaggcuagccuagaccucauaggaguuccaaacuagucaggucuucagagugggaucccaucucauaaucacacaggggggagagagggagaugaagggagagcagagacgagggacugggagugggacuaggcaguccuggcugcauuugauccuccaggcccuccgcauugcuguuacguguccgguacuuacugcuuaaaggucauucagggcauaggcacacagaucagaauaacuagagggaaaggucuguuaugaaacaguuacagugcacuuucauuucugugccuuggcuucuggugugucuguauggagaugaugugugugugugagguuuuuuugguuuuucgagacaggguuucucuguauagcccuggcuguccuggaacucacucuguagaccaggcuggccuugaacucagaaauccgccugccucugccccccaagugcugggauuaaaagugugcuccaccacgccccgcagugugugugaguuuugugugugcuuaggaaaaagccuguagucacaccaaaccauuaauaguugccuugcuaacugggagguuuuguuuuauaaaauaaauuugaauauaucuuuuauuuuuuccuuccuuccuuccuuucuuuucuuuuuuuccuuucuuuucuucuuucuuucuuucuuucuuucuuucuuucuuucuuucuuucuuucuuucuuucucucuuucuuucuugcuuucuuccuuucucucuuucuuucuuucuuccuuucuuucuuucuuucuuucuuucuuucucucuuucuuuuuuuuuuuuuuuuuuuuuuuuuaaagauuuauuuauuuauuguaaguacauuguagcugucuucagacacuccagaagagggagucagaucucguuaaggaugguugugagccaccaugugguugcugggauuugaacucuggaccuucggaagagcagucgggugcucuuacccacugagccaucucaccagcccucuuuuuuuuuuuaagacaugcuaucucuguguggcccuggucguccuggaacuugcucuauagaccaggcuggccucaaacucauagagauccaccugccucugcuucccgagugcugggauagagaugugccccuccaagcccagcucuuuucuauccuugcaugugguguguaucuguauauguguucauguguguuagagguugacacccaugucuucuauugguguguaucuguauauguguucauguguguuagagguugacacccgugucuucuauugguguguaucuguauauguguucauguguguuagagguugacacccgugucuucugucagccucaugagauaggagcuuaccuauuggcuagacuaaccggccagcaagccaagacuccucaggucucuccuguccuccagcacacagugcaggauuacagucuugucaccauguguggcugggacccggacucagacccucauguuugagcagcaagcacuccacugacugagccaucuucacagccccuugaacucacuucugauccauacauguaugcauuacuuuaaaaaaaaucuggguauguaugcuuguagccccaacaacuaagaagggggguuacuugagaccaugaauuugagaccaugcugggcaacauagcuagaccugauuccuaaaaaaaaagccauaguuuuggagcaggaaagauggcucaguaguuaaacauacuggcugcucuuccagaacccuuauggcggcucacaguugucuguagcugcagccccauggauccagcaccuuccucuggcgucuuuggaaaugcccguggugcacagccauacaugcagacaagacauccguguacacaaaagaagcauacauuuuuaaauuaaaaaacaguuuagugguuuuggguuuuuuguuuuuuguuugguugguuuuuuuugacacagggucuuacuauacagcaugaacucacagagauucuccugccuccuaggagcuagaauuaaaaguguaugccaucuugcuuggcuuaaaauaaaaaaaauauuuuuaaaauucuuaauuguuggaggcuugggaugcaauucagugauagauugcaugcuuaguaugcagaaccaaauuaccaaauuccccaucaccaaaaaauaauaccaauaacuuuacauauagaaaagcauacaacucauuauguacagcugggugacuuuuuaaaaaauauuuauuuauuauuauacauaaguacacuguagcuguuuucagacacaccagaagagggugucagaucucauuagggaugguugugagccaccaugugguugcugguauuugaacucaggaccuucagaagagcagucaguguucuuacccacugagccaucucacuagcccacgggugacuguuuauuaagugaacacaucuauauaacuauucaaaaucaagagaaagaacuucauuuuuuaaaaaaauguuaugugugugaauguuugccucauuaacguuugcaccacacgugugcccggugcccugggaaaccagaggggcuggagucccuagagcuagaguugcagguaguugugagccaccauguaacccaugugggacauauggaagacagacagugcucuuaccuugcugagccgucugucuagccugugcugucuuuuuauuuccagcucccagacacuauauucuccugccccucgguaaccauuauuuuggcuuuuaauaucauagacuagccuucucuggauuuaauaucauagacuagccuucucuggauuuaauaucauagacuagccuucucuggauuugaacuuuuuguaaauagaauuauauaaagucuuuggugucuaguuucuuuugcccauuggauuuuuuuuuuuuuuuuuuuuuuuugguuuuucgagacaggguuugucugcguagcccuggcuguccuggaacucacuuugaagaccaggcuggccucgaacucagaaauccaccugccuccgcgcccccccccccccaagugcugggauuaaaggcgugcgccaccacgccuggcugcccauugguauuuuuaaaauuuaucuguguuucucugagugucaauuuuuuuuguuuguuuguuuuuuuuguuuauaauaauuuuauuucagcuauuuucagauugggucuguuauaaauaauguagcuuugaguauuguuauacgugguccucaaacguacccauuucuguggaaugugaaccuaggcacaaaacugcugggccaugcauucugccucucauacugcuuccuaaggugaccacacagaucagcagcauggagcuugagauccgucaguguccuugccagugcuugcaacugccauugcucguagucuuagccaguccggagguucucauuugguucugguugucuuuaaaguuguuauuuguauguuugugugcauguauguguguguauguuguacguguguauguguaugucaugaaaguggaggucagaggacaccuugcaggaaucuguuuuccccuuccacccuguggccagcaggcuugguagcgagugccucucccugcugacccaucuggaugucccugcuucuuguuuuguauuuuucauuucaccagggucuugugauggugagcacaauacaugacucuuccuuucuuccugcucucccuccgccccuuucuuguuuuguuugccacugagccacacucucagccccuuaauguuuucuuuuuuuuuuuuuuuaaagauuuauuuauuauuuauguaaguacacuaaagcugucuucagacacuccagaagaggaggucagaucucauuacggaugguugugagccaccaugugguugcucggaauugaacucaggaccuccgggagagcagucagugcucuuaaccucugagccaucucuccagccccccccuuaauguuuucugauuccauuagaaaugugcaagugacaucgcauaauuucauuuucucacucucuugccuuuauuuuuauuuuuuuaauuauuuauuuauuauauaaaaguacacugucuucagacacaccagaagagggcaucagaucucauuacggaugguugugagccaccaugugguugcugggauuugaacucaggaccuuuggaagaguaaucagugcucuuaaccucugagccaucucuccagccccucucuugcuuuuacaaaaugcauguuuuuauacugagcuuuugucuugccauaguucuacuaguuuauuauauaucaucuuuguaaaugaauauuagcugcugggugacagagcucaguuucagaauguuugccucacguguucaaggcucuggacucaaucuccaguucagcaaaaaaaaaaaaaggaaagcaauagucacaaagccuccauguggguaggcuaaaaaccuucuguugcuugcaggcuucccugccagugcaagaauaccuguucaugccauuugaccaggcgcacaaacaguaugagacugccaggcaccugccgccuccccucuaugugcucuuugugcaggccacugcauacgggcaggccuguggugaguaugggggcugggcagggaggggggcuaugggagaagcagccauagugaggaagggcugccugccaggagagcaccccagcuuugcccagagcccucagguggcagaugcugccuccccucugcaccuucagcguggcugcugcaccagcucgccugaggcuugagcaaugugacggacgugucagaauggacggcuuuggauucucaugaaccuggcuguauagcuccuaggggcagccuguguuggcucucacaugcuuacucuaucagauacacuuggcagguggaccagugccuccuguuguguuuuggggguggggugcuuggugaacucggguccuaggcagcacucccaggcuuuccugugccggaaacagccugcgugguuuuagagcaucaccaggugagaggaaggaccccuggcugcucagcccagccuugacucugcuaaggauuuuaaggguuuugcucugccugcucagcucucacuuagcacuaaacuuuucuuccuuguucacaccuuaucccauggcaucagacagacauacacuguuccugugcaugccccgucccagccauggcaccaggacauuacugugucuuuucuugugucuccuugguccuuccgucuccuccucccccuuugcucucuuccguugccaucaucagcucauaugaaauccuccucccagcccccuagacagggugaguaacuuucuuuuguguuuaaaguucuacuguuugcacuucuauuuuccuguagaauuccagacuaaccuauuaaaaagacugcuguagguaaggacugugacucugguagcgugacagccuggcauguggggugaacuggagccucaaggcaguuagagcgcucaccugggguccagcuugcuugguugggaugggaugauuuaaccauuguuuccagcuauaaagcaguaguuggcuguuggaaaaguuguccuuccuucuucauauguagucaggcaaaugguauccgggaucuguggcauuccuacccuuaggacggaggaggaggagcugggguguagcuuaagcccugguuccaucucccacuaccaucaggaaagaaaaaggcagagaaaccagagugucuuacuugcucaccgcaguaggaucccagaguuccacaguaacauaccaagagacggacgacucaugucacauaggcagaguggagcagauuguugcugagugcuugagagacaagcucacuccagucagccugaaguggacugugcucuguguccugagugugguuuguuacuucaugacacuaaguuucucuacacgucuguacuacuaguaugcugcauacgguugugagacuuuagaguguguagguucacuuguguggugcugggaccagagccgcagccgucugcaugcuaacucuacucuucagggcugcaugccucagccaagucuacuguauguaaggaugcagccuagugcacuggucuccugcccccagucucucuuuuauagcugugggaacugagccuccucacgucaguaaguuuaucuuccaggucacaaacucaguaaugugugggacaggaauucauucgggucugccacugggcugcagcacccauguuccuaucugcucuucucugcgcccaguaaagaugggacaggcagaccaggugcuuggugacaugcagaacacagaacuuuuuacagaggguaacccaucaucucugggauguggaugggugcuggcuucugggugcagacuuucucaggacggcuggugaaaggguccuguggggugacaaaccccgggucuauguuccuggacuuugcacuagucucagggauguuuagcagggaagcagccauagagaaacgauuuuaggugcugucugcccuguguggagugugcgugcccucccacucagucaguucggagcuggggggaguaugcugaguuggcuugcacucagcaaccucuccagaagcuuuuccaagaggccuuuucucaccuccagauaagacgcuguccguggcaauugaaggcaguguggacgaagccaaagcucuuuucaagcccccugaggacucccaagguaaccuagugaaugggguacucacuagucacugcugaggucuugguccuuugagaaauagcuggacugguguaauauagcuggaggcuuggccuuaggucaguuuuaggguaggcccaagagaacucaguucccagaaucaccacaugcagccuuuggguuucagcccugccacccacuagcucccaggagcauuuugacccugaggaaggcagguaauguguuugacucccuguaaacgguagcugguagcuaguuauagguuaaugcccguaacccccaaauucuggagguagcggugagaaaauuuacacagauuugaacccagauuggucaauaaagcaacuuccagggugacauauugagauguuucaguguuccccuuuugcccccaaaaagagagacaauauuuuuauauagaaucauuguguggauuacaugaaagaguggucuugucuuaugcacacagcaaccgucuaacuguaccagcacuacucuuuaaaaaaaaagauuuauuuauucauuuaguuauuuauuuaaaguauaugaguauacuguagcugucuucagacaccccagaagagggcguuggaugaccauuacagaugguugugagccaccaugugguuggugggauuugaacucaggaccucuggaagagcagucagugcucuuaaccacugagccaucucuccagcccauacgcugcucuuaaaaccacaaagagcuuuaugcuccauaaaaaaugacaguuaaaagacccuugaacaccaggccuggaggcuggggagguggcucaguagguaaagccucgcugcacaaacaugaagaccugaguuuugaucccuagcacccacaucaacaaaacacaauaaaacaaaacacaaaaaccuggcuaugacggugugugcuguuacccucaaugcugcgggagaaaggcagaucccaggagcugcuggccagccccucuagcuggaauguccagcucugugaaagacugccucaagauaaauaaacaaacagcugggcgcacucaggaggcagaugcaagcagagcucugaguuugaggccagccuggucuauagagugaguuccagacagucagggcuacauaggcucuguuuccaaaaaacaaaaaugaaguggagaggugacugaugaguacgucuggaguacaauaucuggcccauaugggcaaacccacgcacacacaugagcacacacgugcacagaaccagggcugauggaguuauaagucauucuuuccaugguguuuucuaugccaagaaguagcuaguuaacucauacaaaggaccauguggauggccccucacucagucccugagguugaggcucaucagggcaccucugcagugaccucauuucucauugccuucucuguggcuucagaugaugagagcgacucagaugcugaagaggagcagacgacggugagcccacuuucugucgugggaauauuaugcagccaugcugguguuuucaagcaaaaggaggagggcugaauacgugucugcugggacaaggaccuggcagcaggguagcugagggagagggucccaggcagcugugcugagacuaugggagguagggauggaaaggggagagucacaugacucaugcuuggguuuuucuuuuguccagaagcggcggcggcccacucucgggguucaguuggaugacaagcgcaaggagaugcuaaaaaggcacccacugucuguccugcuggaucugaagugcaaaggucugacuguauucacguaccuccauaguaccuaagagccuggucaguuguugguacaaagcucuaguaagcuagagacucuaauauuucaguguccuauuucagguuuuccuccuuuaaaaaauguguaugugugugugugugcgcguguaccacugcagcaggcauauggaagucagagaacauuggggacuaauucucuacuguaugucucaggaauugagcugagaccaucagguggcacgugacuuuacccucugaacugucacucuguccauuuuucaucuuacauggugugguguuuuguuuuuguuuuuuguuuuuguuuuuuuaauuuuuuuuaagauuuauuuauuuauuauauauaaguacacuguagcuguccucagauacuccagaagagggcaucagauuucauuauggaugguugugagccaccaugugguugcuggaauuugaacucaggaccuucagaagagcaguuggcgcucuuaaccacuaagccaucucaccagcccauuuuuguuuuuauuauucuuuuuuuguuuuuuguuuuuuuuccagacaggguuucucuguaucgcccuggcuguccuggaacucacucuguagaccaggcuggccuccaacucagaaauccgccugccucugccucccaagugcugggauuaaaggcgugugccaccaugcccgccuauguuuuuauuauucuuuugagauggggacuuuaguaguccuggcuguucuagaacuugcuuguacaccagguggcugugaacguagagauccccuugccucuuugcagcaccccccugcccucuggugugcuugauucauaacugagcucuucucuuccugguccuguagacaacagugugcuucaucugacuuucuacuaucucaugaaccucaacaucaugacagugaaagccaaagugacgaccgccguggagcugaucacccccaucagugcaggguauggggaugggaggagggggugggaggggccugcgugccgagagcccugguuacuaguccuccugcuggcuaucagaggauccuuugccaugcugauuucuguuacuguguccccagaguuugggaauccugauggucacugaaauuuagaagugcucucugauuugcauuugugaaacuucuuacuacacagcagauaaaacaagcgauaacauuacauuugcuguuuagagcagagucgcaggcuuuuuacagccaguaaugcauguaaaugcaugaaugagguaugagacaugaccaaauugacacauuuuggcccuuuucuuguuuuugucccaagcugccaggauaucguuucccaacucagcucagucccggcauugguagucuuguugugcagucuagauuggaagaacagcggacagaaaggacagggguacaccagccugcaccuagaggaucgcugcccucuccuagcauuccuggcccugcugucagccugagagggaguccugaggcucaggaaggcacagguguggugccuccugcaguagagcucugccuagcucuugccauucugccagauggaaggagguccuggcuuuagagccugcacuuggugucuaccucuucuguucaggcuucugcggccuugguaguuuugggcuuccuagggcaugcugggugcaguuaaccuuguucccagcagagggagcccagagcuuguuucuucuaagguccacaucuuagccaggucuuuccuucugagcacuucuaggacucugucugucugucugucucugucugucugucugucucucucucucucucucucucucucucucucucuuucucucucucugggugucacuauguagucuuggcuggcguggaaccugcuaugaagaccauccaauucacagugauccuccugcuucuugaauucuugaauucaaguucuagcugggcuguguagaaaguuccaggcuaaaauacauaguaagacccuaucuacaaaagaguaaguaacuuuagagagguagaaaugcuaaguacaugcugggcgugguggcgcacgccuuugaucccagcacucaggaggcagaggcaggcggauuucugaguuugaggccagccuagucuacaaagugaguuccaggacagucagggcuacacagagaaaaccaaaaacaaaagaaaugcuaaguacucugaucauuacuuauugaauuuguuugucaaauuacuacaccauacccuacagauguucuaucuuuccauauguacaauauagagagauuguauacaccaaggaccuguacucaauggccagaucacuuauaaaaacuuaacugcucguguaaaauuauugcgguaauuauuucuggaaguauuauaacuucaugugguuuuccuacuccaaaguauugucuggccaccagaugacuugucugugugucucugugugugugcagaugcacguguguagagaccagaggcucugcaugagggucuuccuuagccacucuuccaccuuuccuuugaaacaaaucucacugaacuugaagccugcagauucaguuagacugguuggccagaaagcccgggauccuucggucccccuccucgggaguucuaggugugugcugcugugccuggguuuuauuuggaugguggacauugaccucaggcgauggugcugugcagcaagcacguuacugacuuauguacucagccccacaguauaauuccggaagggaucacuuuaaaaacagccaaacaaaacaaaauacuaaaggauccuguucucaguggccagggagauggcuucuuagauaaaagcacuugguacccuagcucagugaccugagcgcaguucccagagcaccuguacacagccagcugugaucucuucucccucagcuggauugcuuggaguagaccguacccagcagaagcagagagaccuuccucaauaagauagagcacaagaagugacuacuaaacacuguccucugugugccaccgugcacacaugcgcacaaaauaaagaaaaauguucuucuuucugaucagagaguggucugagcuucagugucccccuuuuaaagcuucgaguuuguaucuugagaaaugggauaaugguccuuucuguucacaaggcuugggaagaauccacuagcuugaagcacauaaauguuuugacucacaggaagcauucagugaaagaugucaguagaggcaggagugguggcgaacaccuuuaauccuagcgcucagaggcaaaggcaggcagaucucugaguuuggggccaaccuggucuacagagugaguuucagaacagccauggcuacacagagaaaccuuauucucccuccccccuccccccgaaaucaccaccaccaacaacaacagaaagacggugguugacauccugagagcugagugguacauugccacucuccaaugcccagguccacuccagguuggcaggcauuuucacugcggucuuuucuucugcagagacuuacugucuccugacucggucuugagcugcuuguauccgggagaucaugggaaaaaaacuccaaauccagccaaucaguaucaguuugacaaaguugggugaguaagcgugugcagcugcuccugaccuguggcugcaucuguacgcucaggccaggcugggccaggcuggagaccauggggcuggagggacgucuuccugcucuuacauugaaggcaaagggaugccaugggaagaugaaagcuugggaaguguagggauacuaguguuagggaggugauuuugugguacuauggugggguagaucccuaguaccacaaaagcaaaaacaaaagcaaaccaauaucaauaauaaaauguauggaagcgaccugaggugaagaugggucacuguucucuugacccagaaaccuuacaaaaucaugcaaaucaaggcguuuaaauuguccuguucccuuuacaaagaccugugaggcuguccacaccaucaaggguauacauaucuggaaagugucugaaagaugucacuuuaaaugagccaugggugccauugggcuguauaacauggagucaguaggugugcccuggccaagcaggggacacagggucaguggccaaaauaagaguguugaauucuugcuccacgugcuuaaaaaugcagagaauaaugcugaauaucgggauuuggacguaguuucucugucauugaacaaagugcguaagcugugcagaugaccuuacagagcucauggccacauuaaccugugcacaacuccccacgcagugaugauccuugaagaaaaggaacugaguuccaaagccagaagaggaugcugcacagaagaaaagauaucagugagaaacaaaaacuuaaggcacgggaauaaauccagcaaaaaguucaaauaaaaguacaaacaaacgaaaacaauaaaauaucugcauuaggccaggcggugguggugcgcaccuuuaaucccagcacuugggaggcagaggcaggcggauuucugaguucaaggccagccuggucuacagagugaguuccaggacagccagggcuacacagagaaacccugucucgaaaaaccaaaaaaaaaaaaaagucugcauuuuaguucucuugaguguuugagauuuaaaagcuguuuugcaaguggguauugcagugaggaggucaguauacugccguuugagaucugucuuaugacagaaagguuccaaggcaaaaagaaguaaagacuggagaugaauuccagggagcgaucuuaugcagcuugugaggcugggugcagggaagacugcagggaugcagggaggacuguagggaugcagggaggacuguagggaugcagggaggacuguagggaugcagggagaacuguagggaugcaggguggacuguagggaugcagggaggacuguagggaugcagggaggacuguagggaugcagggaggacuguagggauacaggaaggauuguauccuagggccaugcagcauucaggaugagcaucagucuugaugugaggacacuguuccugagcuacguucccaacucauaaaauuguuucauucugucuugcuuuuuuuuuuuuuccagcauccugacuuugagagacuauguacuugaguuaggucaccccuacuuguggguacagaagcuggguggccuccacuuccccaaagagcagccccagguguguauucugacccugccuccuuggcugagacgcuguaccuguccucccuggacacacagaaaggccucugagagcuucauagcauuugaucuaguagaacaucuucuuuugagguuaugaucugaccucacuuagugccucagggcauuaaaauacccuaccuagucuucaaguguugagaugacuuggccuucccuggaagcuuuguagucaucuaaaccaaagaugccagauguggcacagcuacagccuuugcugcccuuggacuuauguacaaggaugcuacaaaugaggaugggcagaauucuggggcagacaccuucgaagccugccuuuucuuagaagcuggccacagauucaugggaacccuggaaucuuguguuuuugccagggcuuagcauuuuaccugaucuagugggccaacucugccauucccaaacagcacuugucuuaggacauggucuggcuggucccgggggagauggcagucccugaaggaagaagggagcucuuacauguauccuucauugucauucacuacuagcaaacagugaugccugaccacucacagagcgccagccacauggagaccaccaugaaacugcugaagaccaggguacagucccgccuggcucuccacaaacaguuugcaucucuggguaagcuggggcagggacuagggccugacagccacuucuucaacauacaaacagaaaccuuuuccucagaacuuguaaauccugaucacagaucaaagagaccuguguuccuggccuuacugagcauuggaugguagggccgguggggagagcugcaggcccauucagacaggucugagcuccuugcagacuggucgguucugugucagcccuuccagaggaccccaaagccauuggcacaaguugacaggcucaacaaggcagcauuuccuaggugcaugcaucacagauccauaugcacuugguagguauuuagugagucuaauucaugcuggcacccaauagccuaagaggaggaacaaugggacccuguauccacugagcucacauucagcucacugacuguaguuaugcagggucaccccauuauccuuucccuaagaccugcugagcaaaugcuucuaagcacuucugagcucccaggcgauugcgaggaaccacugaccuaguagucacaugacuuuuaggucauucaauaaaaacuugauggguaucuacaagauacuaguaggguaggaguaagguuuuggagggugucagaucuuuuuugguauuaaagaauuacugucugcuggguguugguggcccacaccuuuagucccagcacucgggagguagagucaggcagcccucuuaugaguuugaggggagccuggucuacagagcaaguuccaggauaucuagggcuacacagagaaacccugucucaaaaaagccaaaaauaagauuaaguaaguaaauggaaagacucacuguuaggcgaggcauuggauuuccagggcccaucuggacauaggugcccucuuccuggcuucaagccaguucuuugguuccauguggaugcugaucuccagugaggcacugcucaggccuugcuccccacucagcacugccagcauugucaagguuggaugauugucaucagauagugucccuguguuagcagauuuguuuguuggaacagcagcagggaacugacacagaacacugcaguugguuuuucugucaaggucagcuaagaaaucacagcccucuggcuguuugaucuaauuagcaguuccugccgcagagacacugaugcuagucauggcuucaggguucugcuuugcuacaguugucugcauuaaggauaaagcaccaugaaugcagaugcugggucugaccccaggcacauaagcccugcgugcaguggaugucagguugagaugccucugucccuggagugugaugagcagguacuucuugagcaucagauguacuggacaaguggcgaggccaccucagcccugcagcaagccacaggcagaugcuaguccccaacuguggcucccgauuucuaccaguaaugccccugcuuuacucucucuuagaacauggcauugugcccgucaccagcgauugccaggaccucuucccugccaagguuguuucucgccugguaaagugggugauaauuacccaugaagauuacaugguagguagaacuguaguccuaugaucaugucaccucucgguuccuguccccagccccugccauccgugcagaggcuuuaaaggagcagcagcucacacugguuccuguuguaggagcugcacuucacuaaggacauuguggaggcaggacuggccggagacaccaaucucuacuaccuggcgcuaauugaaaggggaacagguaggugauggcucugcugaucacaggcagccucucaagugucacacaugccuggaaguugcccgaaaaaagcaaaaagguccuagaauccuccauggaauuuacacacacuagugacuaggggaucaccccuuucagugaggacuuguucuguaacauggccauaguuucaugucauuaaauccucacaacggucaccgggugguggccuuaucccacucacuagcugaggaaagucuggccggaucagagcuuggucccaccucagcuuucagcuuggcuuugcuuuguuuuaguucuccuucauccggcuaacagaagggcagagcuguuccuuagaugguaaagacuggauaacagagacccucccuucuccacagucccucuggagucauggaccucugugcuuccuuccucuucugacaucugauccugccagggccuuccacaggggucacugacaucaugcacaggcguuaggcuguuauccuaccccugccucacagcaacaaacacugggcugagaauguccuucauucuuugauagguugagugauguaauagcauuugugggcuggggauauaguucagggguaaaacacuugccuagcauaccugagaccuuagaugauuuccaguaccacaaaagauaaauuaaacagaaugucccaaagcuggaagcauuauaaagaagagcuuauuuagcucaaaaguuuguggguuugcuuguuacaauuuuuauuaaauuuauuuauaauguacgugugugcacucagauguaagacacacucgcacguaugcacacgaguuauauaucagaggacggcuugagggaaucacuucuuugcuucagccuuauggguucuaaggaucaagucgggucgaggugugggagcaggcacuguuaccuucugagcugucccacuggcccgcuuuguuuguuucuuuguuuguuucguugagacagagucucaugaggcucuagcuggucuggaacucacagagaucugucuaacucuguuuuaauuuuguccuugagaucagcucaagcuggccagaauccauuauguaguccaggcuggccuugaacuccccaucugcuuuuuucuuagccuccagagcacugggauugcgcacaugagauaccaugccugguuuagcuuuacuauuugaaggcugaaagucccaggugaccugaugacagccucguggcaggugauaauguagagauguggagaagaaggcacaggugaaaaggaaaccagagggaguugggagcuaauucuguucuauagcagcguucuagacacuaagcagagucccaaggcccuuaauccuuuuagaaggcaauucccucucauccaaaacccagcuaccucucacgagagcccgagucuucagauucaacugggcagcagcacagagcuaccagcuucuuguauaaauaucuuuggguaaugcauaugagccaaaucagaaggaccaauccaaagccgucugggagccaggagagggcucgagguuaaagcgcuugcugcacaaaccugaugaccugagcuugauucucagaagccacgucagcauguggagugcagugcagugcagcucuaauccccgcacuccugggggaagaaaggucaaaggcugucgccagaggggaacuuacuauauggagauaguuuauucaccgauuaugaaagcagauuugaugccaggcuguuccgguugagcucaguccuguacuucugcagcuccuuacugguagagaaguuucugucagagccucacagugacagaugugauaugaggagcugggaccauuugccgcuaguccuaggugggagucagagcaggaggaucaggaauucaaggccauccuugacuauagauugaacuugaagcuaguuugggcuaugugagacucucaacagcaacaacaacaaauucuugaaagaaagaaaaggaaggaaggacagggagggggagggagggaggaaugaaaggaagagagggagggagggaggaaggaaguggggagggaggaaggaagaggcuguagagauggcucaguaguuaagagcacaggcugcucguccugaggaccugaggucaaucccagcaccuacauggcagcucacaacugucuguaacuucagucccagggguccagugcccucuucugcaucccaaaggugauguaugcauguuggugccaauauacauggaggcaagcaaccaaacacaggcauacacacacaugcacacacgacguucucgaaguagcaggguuuuuaauccauugacaaaccccagcaaguagaacaggcucuuugggggaaccagagucguugugccuuacacuggggaccuggcagcucagcuugcauccuaaagcagucuauaccagcauacucagcagcacuucaguuagaggagccauuuguguuggcucuggacacguguggagaucaccauggaaugcuggguaaucacugaaugucugccucucccuucuucucagcuaaacuucaggcugcugugguacuaaacccuggcuacuccuccaucccaccgguuuuccgacucugucuaaacuggaaaggggagaaaaccaacagcaacgaugacaauauucggguaaggcccacguggguggcaggagaccagggagagcccuagagaggugagcaguggccaagccugcaguugcugaggcugugggcagugucacuuucaggacagggccuuaccaggauuuacagaacgugcucaccgcuuaauuucccugacccacagcuuuucccauguaguacuguuagcacuguuaacuggcagugucuguguaccacuccaguaccugacugggggugacgagggaaaaacagacacacagacagcugcaguccagugucugacucggcuggagaacccuuagcccacccccaggcccggcauguuuacuacguaagauugcauagggaagcagggcuacagagauggaucgaggaggcaggcuuagccaaccucaacaggagcaggcuguagggagccaucuccaggcuguaacuacccagaaggagaaagcugugguggacacuuuguguccacaccaucaacaucuacacacagaugagaagagaaggcucuggcauuccuccuggccucauaucaggcagggggaggcuuugcuguacuuggugggucuggggcuaggguccuagauaggccaguucaugucaacaacacacauccacucggggucuccugcacuuaggguuuccugcacucccuucagcaaggugugccggcacacacuuuuaaucgcaacacugggaagacagaauagacagaucucuaaucucaaggccagcuuggucuacauaguaaguuccaggccagccgccuagugagacccugccuccaaaaacacccaaaagguuucuugucaccuugggcuucugugugaugguaaauaagcucagaaguauuauagaaacucaaauucagugagagugagugcuguagugagagugagugcuguagcuacugucaaggacaagucucuugguggccacagaacaugucuuccucuacauguccaugguccuugcuggagguggcgaggugggugauaaucaggaggggcccauugucuugaggagacggggucucuggacgagguuguagcccagcuguguacagauccugugcaggcaucagcaggagaucuugugguaccgucaggcucagccaugagguaaaagugcucggccauacugcggaagcaaaugcugagggucuggcuucccacccacacaggcuauggagagugaagucaacgugugcuauaaggaguuguguggcccucggcccagucaccagcuccugaccaaccagcugcagagacugugugugcugcuggacgucuaccuggagaccgagagccacgaugacagcuucgagggccccaaggaguuuccccaggagaagaugugccugcggcuuuuuaggugaguagagggcugggcucuugugacuuuccucaaggaugugaacagagaucgcaguccucuagaagacuaggucucauuggacaggaccuggcacacagagagggcaucugucuuuguggcagacaauucugcagccagauuuccaggaaacacuuguuuucucuuuccugagacuucccugcaacugcagccuggcucaccuguucuugucagcccauggaucaagcaaccaaggagacugcccugacugagccaugcuacaaagcuuugacugaacuuugauuguuuuuuuuuugugggaaacagcagggccuguuuacuuuuagucuccaagcgagcacuuaagguagugcauccccacugucccuagugagugugcuggcaucuaagucccuuggugugacucaggacagugggcagucaggcagcauagggaacaaaagaaagcccagcucuuguagaaggcaggcugugugcaugcugaggagcgagcaguccacggcagccagcacugagccuagggccgacgugggggacugagaccuuguagagagcccagguagguucaggucauuuguguaaaguucccagaugauuccugcuccauguuuggggcucaggguaugcucuuggcaacuugcuauuuauagugugugggcucgcagugccucagaccaguuuuccaucuuuauggguauuagggcuucuuuccuguucauccccuaauguguuuuguuuuguuuuguuuuuucuuuucaaaacccuagagauuacuucuuagucucccuucuguuuuagacaaggggguaaagaagaacuguguuuggauuaucuuuauaaucuaucaggccugguguuacaacugaugccuauaaucuuagcccuuggaagcuggaggcaggaggauugccaugaguucaaggcuaaccuugccuacagaauaaacaaaaccaaaaaaguuccucaccuugcucucaguuguaacguaaagggaggugucccagcauuuucccucuugucuggcaccucugcugcccugguucaugguguuguuaauaauaaccagaaaugccccaaguggcuacaggaagcagagcugacugcccaaugccagccugagucuucucucugcaguggucugugugaagucucagcucuucucaccucuccucccacucccgcacauuugcaggaugggagcccacacagccugugcuuguuucucccaaaugguuccuggaagacucauuucuuuauguguugagcugugucagugcuguggcaagacuuagcaucagagcugauggguggccuggaguguagcugauugcugggguucggaccaucaggagacugagggcagagugcugcugugagcuggcaggcccuagcugccgcuuggccugagacuugggcacucugccucgguguaccccucugcuguuuggaggcuaaugccgugaauaacucucagcuccagcuuccuuccaccugagagggagucucuguauuucacccuccaggcagcuuauguuuccuguguuauggaaaaaugacacugagacgagaagucagcacaguacaggcugggaaagaagguuuuauacccuucagccacuggagaagaguaaacuuuccuuaccuuuccuacucucugcaguuccuuuuucacugugauuaaaaacaccaugaccaaaaccagcuuggggaugaagggguuaaucccgguuuacaguuagucuuucuugaagagaaggaggggcagaaacugaaacagagggcauggaggaaugcuguuuacugguugcucuccauggcuugcucauuccacuugcuucuucccaugugacccugacuuguguuaaguugaggaaaaacuacccuguccccauaguccuuagaccaagucccagagugucaccgguuacugcugucggagcccuuuuuguagauguuugucuuuauggagcuguguguaacauucccucugugaaguuuuugcuugaggacacagaauuacugcuaaaaucuuaggaaggaaguuugaacauagaucauggccugaucuguugcuuccuggccaugcacuauugugcacugucuugcuuccuuugcaguuguagaaauuaaguguuugcugauaaaguuauaagcaaugauccaaaacauguugggcacugggcacugucccuaaaaugucugauuaagggauccuccagguucgcacauuuguaagcacauagagacacuuuuacaaaggugguaucacuccuucaccaguguggucugcuuucucgccgugcccugggccugaacuaugcagcucuaacuuucccccgaugacagcuacgcgaccuucucuugugagugaacuguaauuuauuuuaucaguccagaaggcaugcuauuaacugcucucccucuuguuucucuagggguccgaguaggaugaagccguuuaaauacaaccauccccaaggguucuucagccaccgcugacuccccucgacuugucauuccccaaagcccuguccuggcuccuggguaucugcuuuuugcuuuggccacaugugguucuugauauuuuccaaagacaccagcuaauuaaaaugucaucugacaaauggac

SEQ ID NO: 5863 - RNA, 16156 nt, Mus musculus
agcacagugaguguaaauuaggugacuguugacuggccauugucuucacaacagaugaauuauccacauguggccccucaugcacagguacuuucucaucuaacacgcagaguccaugggccguucgacauccuccccagcucacuguucccaguaucucagcaucaguguucauuaggguaaacugggaucuggccaggugugugcuuucccacaucucccucagauugugaugucaauggugugcagucaggagucuguggguuuuucuguuuuuuuuuuuuuuuaauuuauuuaauguaugaguguucugcugcauauacaucugccugccagaagaggacaucagaucccuuuauaggugguugugagccaaaugugguugcccggaacucaggaccucuggaagcacagccaaugcucuuaaccacugagccuucucaccagccccguaugugaguuuauaaggcucccaggugaugcugaugaagaugcccuaggccaccagcacagaucugaugugacgucuagaccgccaucccuugccuucccagaggaagagaacaaguaaaaacaaccacaguuuuauuucagaagcacuugguuuuauugcauggaagcaauugaaaguggacuucaguggagaguacacccuggcgugguucaguggccagcgcccugccucaccugcugcagcucuuccaggagcguguacugggcaagggccugaccacuccuuuggaaaacaagaaggcauucaggaauagguuacaacauuucaagcauaaugcguuucuaacugcucauucauuauugcggucaucugucaguuggacauacaggaaauaaaugcacuuacuuggaaaggagggggcaguuuuuagacgcguguuuuacgcguagcguucagcauacaucacguucggcuacaagaagcuaucauaauuguccaucaccuggggaggguuuucggcgugggggacaaggcucaggguuaucuucucuugcuaacuuaaucuuaauagaaauuccuguuuggugagggcaggcccaccaucuaagcaguguuucuucuuacggagggaaaggaagaaauaaaauuuauuacgccgaccccugaguacugggaccguccugaguuucuuuggcuauucuggguguuucucuuguucucuuacuucucucccuugguggccuuguccucuguggucuucucugggggcuggcuuucuuucuggucugugcuagaggauuuuucagccuuuucugucuuggguuugcuaggcucuuuggaaaggcucuugucauccuccuugaccuuggccuccauuuugggcuucuccucaggcuuccuggacucuguggucuucuccuccuuggugucuuucuucucuggugccgcuggcaucuccucuuucuuuggcuuuuccgucucuguggguuugcuagguucuuuggccuuggugucuucugcuucugucuugguugucucugucuucucuuuggguuuagcuucuuccuucacacccaacuuggcaggagucuccuccucugaggccacggcuuucuucuucucuccagccucuuccuucuuggcuucugcuguagaguccuugggcuuuuccgugggaguuuccuucuucuccuccaccuugggcuucggggccuccuugggagcuucgucuuucuuacucuccuucgccucugucuuugguguaggcagugucuucucuucuucuaccuucuuuggggguucuuuggcuuuuaccuccuccuucacaggggacuucaccucuuccuucuugggagccaccuuuucagaagucuuggcuucuuccuucucaggggacuuggccuucuccuuggcaggacuuuucaccugcucagggggucugaugucuguggggugcuucgcuuccuccuguacuggagucugggcuuccggagacuucacaucuagaggcuuggccuucucaggaggcuuugcuccuuccuucacggggcucuuggccuucucaggggauuucgccucagcugggggcuugauaucuuccuucacgggggacuuggccuucucaggagacuuggccucagcuggagauuuugcuccuuccuugacgggggucuuggccuucucuggagauuuuaccucaauuggugacuuggccucagcuggagauuuggccucagcuggugacuuggccucaccuggggacuuggccucaccuggggacuugacugcagcuggagacuuggccucagcuggugacuucacugcagcuggagacuuggccucaccuggggacuugaccucagcuggagauuuggccucagcuggugacuugaccucagcuggagauuuggccucagcuggugacuugggcucagcuggagacuuggccucaccuggugacuugaccucagcuggagauuuggccucagcuggagauuuggccucagcuggagauuuggcuucagcuggagauuuggccucagauggugacuuggccucaccuggagacuucacuguagcuggagauuuggcuucagcuggugacuuggcuucagcuggugacuuggccucagcuggagauuuggccucagcuggagauuuggccucagcuggagauuuggcuucagcuggagauuuggccucagauggugacuuggccucaccuggagacuucacuguagcuggagacuugggcucagcuggugacuuggccucagcuggagacuugggcucagcuggagacuugggcucagcuggagacuuggccucaccuggggacuuggccucaccuggggacuuggccucaccuggggacuuggccucagcuggggacuuggccucaccuggggacuuggccucaccuggggacuuggccucuucuuucacacgagacuugguuucuuuuucuggagaugcagccucuucugcagggggagauguagcugcugcuccuuccucuucuucuuuuucuucucccucuucugcuucuucuccuuccugaccuugggccucuuuguccuccucuucugucacuccuuccgucacccggaucucuucugucuguccuucuacaaucacaguuuccuucucggauuucucuacuaccuuuaucaucucuucgcuuuugacuuuuaugugcguggauauggagggaauuuuugggaguccuucaguaagagagaagggacucggaccaaagccaauccgacacucuucgccuuccaggagcuuucuguggaguggauaaugggauacacuguuaccucagagcuggacuccugguuggcuuucugaagcccuaguaugugcagggacaggguuuggugaaugaaggguaugacucaauggcaggaaucucucucucucccuugcucccuccacuucucuucucuacugcucuuuuuuucagauuuuucauuuucauuccuaauagacuuuugaacucacuuauuuuuucuggugcuggggauggaguuaugcuaacaauacccugcccugagucacagccuuggcaggaagacuuugagaguuacuucgggaacuguuccgguggccgccuacaaagccugacccucaugggggcugcacugcugcuuaagggaggaacuuucgcccuaaagagugguccuccacagaagacccuacacugacaaaaguuacacugcgugucucucaacuaacacuuaauucaagacaggcauguuggcacgagacuuuaauucagcacuugagagacagaaacaaauggaccucuguaaguucgaggccagccuguucuacaaagcaaguuccaggacagccaagacuauacagagaaagccugucucaaacaaucccacccccccaaaagaaaaaccuauuucaagagaaaguuggggguccaggguuauagcucgguggcauauugcugguccaguauguaugagucucuggguuuggagagacagagagaaugacuccugaauguuguauguaaccucuacacgugcacugcacacacaacaacauaaaauguaagcccuucccauggcugaagggaaugaggaagcccacauucaggcugagggguuuccuaauggcuccuuuuggagccauucuuugggauuuccccucucacuuagcuccucaagcuacccagacucuaaaggccuccauuucuucauugguaaaaggcugaucaccagcauccuuaccucagagggcugcuucugugaggggaaugaguguuaagggcuuggcgggagaugagguggcugcuuaguggaugcauaggggcuucccccagaacaguggcuuccaaauuuaacagcuuacaaauuauccuggauccuguuaaacuacagaucuuaaucuacagccuggggcagggcccguguuucuaucucuaggaucacuguacuacacugaguuaccaagauuagagcagagcaggagguggacagccaaggacaccaaccagaagaagccugggaugucaucccugcuaggcugugaugucucaucuuuggggacuggucgucucauggcuaccauucagugagcaccagcagaaccugugucagcuggacaccucguaagcaggacuggcugagcucccaccaacccaugguuuggauguuguuucuguugucuccauuuacuucugcaaggaaugaaggccaagcaagcuaagaaacuccauagaguggggcuguaauagugucugacuagcuaagugccucuuuuccuccaaagcaacucucugacuagcugacuuugggauagagaagggucuuuaaacuguaaggcgccgucagaaggauaagaagucacuccugagucaaugauuuuggauggagggagaggaguguuguguauacaaauauaugcaaaugaauucaacaucacugacuuauuuuaggggggaggggguuucgagacaggguuucucuguguagcccuggcuguccuggaacucacuuugaagaccaggcuggccucgaagacauguucuuuuaaaacuguuaaauggccaauuuaagauauagacuuuauaauacuuuuuucuuauuucauugugcucgugcgcagguguggguacaugggcgccucagugggggagggagguuauggacaacuuucaggaaucaaaguucucucucuacaggagauucugcuggucaaacaugggcccucaggcuuuuauagcaagugccuuuacccacugaaccauucugcugaccauacaucauuaaaauauauuguacuauaauuaguaugggagggacagcugagcuuuuaaggguuaaggcucacaacugaaauacuuugggcugguaagauggcuuggugaguagagaggcuugcugcacaggccuuaaugccugaauuccacccucagagcccauguaaagguaggaggagagagacucuacagaggugucccugguccaugucuuuagcuagauugugaugacacacaccuuuaaucccagcacuugggaugcagagguaggugggucucugugaucuaguaagaucuguuuuacaaaauaaaacaaaauaaaaacuaaaagaccuucuguuucuaaaacgcaggcagccacccaaacacaaucugaaacugaaggcuuaguacuuuauggaggucaggguucuacccugccucgagcuccugggucaucuuaccuguaagcggcaaucucaauguccagggccaucuugacguugagcagguccugguacucucggagcugugcagccaucucccacuugguguuucucagcucacuguccagcugcugaauagcguccuggggaagacagaucagacaucaggagagucaucugccaagcaguaccuggcaagguaagcuggugcuacccugcucagccaccuggcuggaggacaaagccccacccuggcaaaguuucgaugugcauguacaaucauggaaaagucuggagcaaaacucucagccugaggaaaguucuggaaugaaauacaacagacacugacucagucagaaugaugggugaauuuuuacagaugucuuagaaaaugcucccuuaaggguugagacguagcuggggugguacacuccacagggauaccuggggcaagagcagucuuaguuacuuuguuuucuguucuuuccaaaagugccugcaagugucaacccuugcuauuugauucccuggcaagccagaggcuacccggaagcauacuggauacagaugaaacuucuuuucccuggaccacugcuuaaagcaguaguucucccagggguuuaacaaaccucuuucuccaaaaaauaguuacauugugauucauaacuaguaaaauugcgguuaugaaauaguaaugaaaauaauuuucugacuggggucaccacagcaugagggccuguaugcaaggacagcagugucaggagggcugggaagcacugccuuagagugaaccaucauacggcccuuuacuuacuccuuaauguuucuccggcugccagugucucuguagucuccacauuuacuuguuuaucagguucuaggaaagugacacuuuucuccccagacugacagaagaaaucuucccaggccacacccacagacacuggugacuagaaugccuacucuaaccgagauuaugcugagcauuuauacuugaguaguaaauucuuucuuagaugcuaggacggagcccaggaccucaugcacucgaccacugagcucuguccccaagguugugagcacucuaaaucucuuagaucuucacagaucugcaaagcggagguuuaugcugguuuucuuccguucacuccagagagggaauuuuaguucagguaggcagagaacucuccaggucacacaacagcagaugugaagucugacucagaggccagaguccugcucuaagaaggucagucagucacccuccccucugcucaccugguaggaggcaaugucugccugaugacgguccucuagcucagagcgcugccucuccagugacuccuuggugcuuuucagggccuccaacucugugguccuggcuugcagcugccgccgguacucaguuaucuccucuugggccgagcgcauagcaucuguguucacuuuggcugccucugagagucgguccaaccucacuaaguagggaaggaaucaggacacaggguuagcaacauaugaacuuggguugcaaucagaaaaguggcaugcauggguugaagaccuacugggugcuaggauauuuaauacacccuuuccuaugacaguuaaguaguuaugguccaaagccacacugcuagugaguggcaggauucaaauugagucuaucuggcuucagaaaacagacugugucucccucaacuugauccauaaaccacucaggagacaggaagcccccauuggugauucuagugccuggcagaguuccuuaacaaaggguuggcacacugcacugaagguucagaugggaagcuagcaugaggccuaacucugagcugggguauacaggcuugggaaggaaguucauauuccucugacuuccccagguaugaacacaagccgucaguuacaauguagccaugguaacuucauugcagauuucuacggaguccaaggucauaggagaguacaaggcccguccugucccagccucugucccuuccucuucugacucccuuaacacagcagccccagagccaguggagucucugccaccaacuggcaccugguucucagaucuuguccaggccaguggaaauaagaaaucggucuuaaucuccagaaagugaacauccuguauccaagagcugaguccggguggaaagaaagaggccagcuggugggaacacauauccugggaugcucugcuuggugaagggcaaaccuaaaagaagagaagagguccccucugggaggagccuugcugcagagaugggggaagggcacugccaccgcaaaggcguagaacaugaaaagggaaauuccaaccauccaaaucccagcauuccuggcuuuccaugcuguuagcaaaggcuuaaaagccacucaaguuaggauucuuggcuauuauggaucacagacacuuuugaaaagcgcagaugcucuguacuugccuccagauuuauagaugacuacaggaacgacuacagcagaugacugcagcugacacaaagaagcccaguuacucuuugccccaaucccaaaagaaaugagaaugagagaaagccaauguuggucaaggucacccugcagcuaaaggguaagguuucagggcaacugcagucuagcugacucagaaccccuguaaauuuugggaaagaggaaggggauauuaaauaacagccauuuacagcaaugagguccacaugaugguuccguacuggcuagaaacggcaugaaaaugaauggcuuucauuuuuacacagcaauuacuaaaauucgcgauguuauguacugagcaaguagugggacgaagccugguagaacgaauacuccuguuccacccacugcgcagggugcgcaagaaagggugggcagaguuggcauggcaagcggcugcuggauaccugauacgcuggguccagacggggcuugcuccauuucagaugggagaucagucugaaucuggggucuaacaguguguggggcacagggguuggccccgguguuuaauuacagacauaaaaaauguggagggugguuuccuuuuucuaaaggaaaauccagaguuggggcgccccaagggagggucuggguaaaaccgcuacuuugucagguggcaugcaccucgcagcgggucuagcuacuucugagaggaguccucucgggcugcucacugcuccgccaggagggggcgaccccuucccaccccgcgcucccgcgcaccucggaaccacuccucggacugcagcgugcucugcaccgcguggccuucgagcugcgcgcggaucucccgcagcgccgacgucacgucgcacuugagggcgucgcgagccucggccugagccugcgccugcgcggccccgcagcccuggaucugaccgagcagcucgcccaccuccuccuggugguggcgccgcagguagccgcacuccuccugcagcgccugcgccuucuucugcagcuccacgcgcgccgcuuccgccuccugcgcgaagcgcgccagggcgcgcgccgccgccuccgccuccucacgcugccgggccuccucguccagccgcuggcggacgugagcgauguccuccagcaggugcuccugcuccaggcgcagcugcccgcgcgccgccccgaggcgcagcacggcgccgcgcaucucgcgcaccucgcgcucguacagcucgcccauggcggcgcggccggcuugcugcugccgcagcgccgccgccucgcccuccaggcugcgguugugcgccucgagcugccucaccuugucgauguagcccgcgaagcggucguucagagccugcagcugcuccuucucgcugcgcgccgccaccgccgccaccacgcagcccucugggccguugcuuagggugucuagcgagucggugcucgaggcggcgccgcggaagcggcugggugaggcggacacggagcucacggacguccgcgcccacgaguggaagccgcuggaggagccggccgcggagcgcgugccgcccgggccugccuugcggcucagcgaguagugcaggcugccgccuccgugcagcggcgcgaacggggcgcccagcagcgcaucggcgcugccgaagcucaucauggccggagcaggugcggccgccagcggagcgggagugcggggcugggacggggcaggcagcacugcggcagcucugggacuccggcucuuuuauauccgcgguggcccgguccggccccucggcaguggggggcuggggaggagggccccacccucuccaccuccucccccgcggccccgggccgaccggcuucuccgcagugagaggggcggggcugggggggacgacccaggagugaaggggaaucgacgcaucgucaguagagccucccgaggucagaccaaggaguaaaggacuuccggagcggacaagugcagaccuccaggugcaugucggaagacccuauuagucagaauaagacccucagaauaagagagggcacuggaaauagggagaggauugcagaacugaugggucagggcgccuucggguugaagcagugggagacugcagugauuacuaugagaggacacccccacuugagaagcagcacaggguugguucccugauaguuagagaggaccuugagaugaggagugcagacugcagucacccacgaagggauucuguaugggguugcaugauggaugcuacugaugauaaauggggaccuucuagcuggcggugcaguguuccccagauacuacagcggcccugggccacccaaaggggcuuaaggaacuguacagcuggcuucgggguugggguuggggugggcguggaguuugaaaggaccgcaaagcuacccugagaaggagaacacugcagacggagaaagggagcgcugggugagaggaacguggugcucucuaaaaauuccaguggccacgacuggaaaguggagucuccucuugcccggaaaggaaaacugccuacgaagaacagggggucccucaguaggcagcaagagccucaacaccgaagccaaguucugccacagggugggguuagcuucugugcuucgcuagcugaaugaccuuguacaaauuguguucuccuauguuugguuuucccuugugugcaagagacaagaugcagcuccaagcucccaugugccccuaggagguucgaacuugggaaaugucuggcugauuuuggggaggagaacccacauauugccagucggaauaguaaccaguuccucucaccugagaacuuugucuuucucccuuccuugcccgauuuuucugcuuuaucuuggcaucucauuccuuuuccagaauagaugaaccaguacugccguaagcauccccuuucaugcuccgaggaagugguggagugguuuuucaguaccaaaguccaccgaccuccaucaugagcccuacugaggcuucaggugaaagggcggggacggcggaggggcuuagacuuggagcucuugcuuuauuauacggcucguucuugguuugguuuuccggucaaaagcgguguuaguggacggagccgcccgugccgcuaucgcuucagcaccacggacagcagccgcuccucggaugggaaggguuaaaucuaugccuaacggaguagggagguuccauagcuuuuccaagcagucccucugugcgguacaggggaggauuggaugagucauaugacgggcucgaaacgaccuacgguuguauguaagugacccaccccugcauguccuguccagugccuggcucucugugaaguucuuucucccugcaaaccucuucccggagcagagagagccccacuccaaugcccacugacaagcucuggaaaccaguauagacuucuucagaucagaacuucucccaggcaguuaccucaagccucacugcaccccaguuugcugugguuuucucuuuuggagggaucccuaggaggagaacugauagauucccuaaaagagaucccuuuccuguccugugucucauucccagccccuggcugcaggccaggagagugcacuagggaggagggggaggagacucuaguuuuucaugauggagcagaacaugaugaagcauuuucccaauuuaaagguccagucaugcugcucuuugcaggggucagaaaggcugggaggcacugcagaugccauggggaggggacugggaugcagaccucuacccccuuacgcccacauggcuuccccauuuaucucccauacugcuuggauuuuuguuauuagauucuuguuccuucgagucucuucaguugucugcagaaugcacaugcccuucuugggggugagaagucugacaagcaguugacagcacacaugaaugauaggaguggggugugugugaagguaaaagguguggcuuuuguggcuguaagguugucaugaaugcugagacccuggucaguccuucagccucaccuucccuucacccugagccuuguccccuccugggguucugugguccuugcccgcaugcugcuucccaguuugucauugugaguggauagauggaugaauucuaaucagcucucuagcaaaacguauggcccagagagagcugagaaugauucuuuuugcugugcagugguagcgcacgccuuuaaucccagcauucaggaggcagaggcaggcaggcagaucucugugaaucugaagucagccucacucagccugagugaguuccaggacagccaaggcuacaugugauucuuuucuaagaucuugcaguugaaauaacuuuugccuuccauccugcauucuuaacauuuagcagcgaauaagacaacauaacuauccauccauccaucccuccaucccuuaauugcaucccugacucuuuccuugcccauugagcugcugcugcgugugauaggcacacauuggaugauggugccacugaacucaguaagcccaccuuuccaggugucuccuuaggacaauucugaauucuucccagaucucagcccagaauguccuaggguaccuuuaagauguuucaugcuauguaugauuccauguuagcgauuuaguucccagggaguugccauuggacgauggugaagacuuuaagcaacgaaauccugcuuagagauauucagaaacuaugggcaugcuccuaagggaagcugugagucccagguccuuuccuuccucccuucuccuccuguucaccuuucuucuucucuucaacuuccucucccucccuuucucuccucccuuacucccuaacucccuuucuaucuucucuuccuccuccugcucuuucuuccuccuccuucuccuccuccuuuuucuucuuucuuuuuuucuuuucuuuucuuucuuucuuucuucuucuucuucuucuucuucuucuucuucuucuccuucuccuccuccuccuccuccuccuccuccuccuucuuuuucuuccuccuccucuucuucuuccuccuccuccuuuuucuucuuucuuuccuccuccuccuccuucuucuccuuuuccuuccuccuucucuuccuccuccuuccucucucucucucucccccucccuccaucccucccucucuuucucucuucacagcuuuugcuguugcuuucugucuuagucaggguuucuauugauguaaugaaacaccaugaccaagaagcaagcuggggaggaaaugguuuauuuggcuuacacuuccucacaguacuccaucauugaaggaagucaggacaggaaccuggaggccggagcugaagcagaggccauggagggugcugcuuacugguuugcucagccugcuuucuuagcccagggauagcaccaccggcaucagucacuaauuaaagaaacacccuacaauuagacugcuggaggcauuuccucaguuacgauucccucauuucagauaacuaacuugugucacauugacauaaaacuauccaaggauguucucuugcucucuuuuuagacaggaucuugccugggcuagcuuuacauucugcccuccuuucucagguucccaaguguugcuauuaaaggcaguuuuauuggcucauugaggcagccugucacuguguugcccaggcuggucuugaacuccugaucccccugcagaagggccagggccgcaggugugcgccuucaugucugacacuucacuucucuuuucuuucuggccaugaauugagagguguuugguuuuuugcuuguuuguuuuuuugcuccauuaugcugccuugccaaaugcagcaauacagugccaaagcaaugggcccaacugaucucgacuagaaucuugaaaacuacaaaccaagaugaacccacccccuuucuuguaagucacgguuacaaaagcgaacauauaccauggguauuccucuaacaaaaaggaaaggagaagccaggugugauugcuuacgacuucuaggauuugggaggcugagacagaaggauugcuguaaguccaagaucagucugggcuauauggcaaguuucaggccagcuuagacuacagugugugugugugggggggggaguguugugugucucccauaugcuaacuagaguuguuggaaccuuccagagccugcuacugugaagagccaugggaaucucccagauccaagcauacaugcugagggccugagguuauuugcuuucggggcccauccugcuucagguaucucccaggcaaaguugcaguggcccacagugaaggacuuggagugaugucucacucuuggcugggggugggggguaggggggcggcuacugccagcauacaggugagcuuguggcuggccuccucaggagcauaguugaagguugaaguugcagccuucccagcaggcacugcugcccccacuccuuucauucaguauugcuggcaagucagcaggaggagguugugguagaagcaggucccucagcucccgugugcacagcagagaauuucauaguacauugcugauacagaagcauugacacguggguuagugagaagucccugggggaggggauggaccugaguuuucuggagccgagacuggggagagggcuggcuucugccgagaguccugcggccagcaucugcacaucuggguuauguuuugguuuuagugaauucggacccucggagccaaacauucuuucucuccuuaaaaagagcaucacguucgucucauacagcugcuuuucugucgguuuucugaugaacaccgacaaggaccacguacucagauguccagggagauggggaaaucucauucguauccucacauauucaccuauuuacauacaugugcguaugugagugcaggugcugcacacaugccauagcacgggaacccaggucagaggagaacgugucucucuccuucccguccuccucccaugucgggagaccuacacugaccugaggcucauauacagcugagacugacguugaacccaugauccuucuguaucuacuucaaaugcuuuuuucucaugcguguucuggggauuggacucagauugucagacuuggcagcaagcaccuuuacccaaugauccaucucgccagcccagcugauuucucuucuucuaauuaggugugccugucuucucucacaaugaaaguuuuauguggggaaguacauguccauuuuauacacugcuggccuccaccagugcucggacuaaugguugcauccauaggagcccagcagggacuugugaaguggcagcaaugcucugcagggacaucucagcaccaggcauguggacagcuuccagugucagcuuugcggggcgcuggggggaggggagcaguggggggaggggcacaucagccccugcguguccccuuuggggaggcucaggccauccccacucugccaccuguagacucaccuuuuuuugguucagcaauuucaugucugacgucugcuugcuuguuuguugucuccaguggcgucacaccccaccccucugcuccuguccccuguccguuccuuucucuguccaucccaccucuccccucccccaucuccaucuccucuccgcucuucugcuccuucugggcugugccuccuccauucucccugguuucuauccgccugucccuuguaagcucuccuuucuaagaugugucuucuuuuugccugacucagauccgguuuguaguaagaagaaggcagccucuccacccuuccacgcuuuaggaagcaagcugcaaagacagaacagggugcaguuuuuauccucccuucauagcuccacccacagccuuaccccacccccucuggacugccuauugcccucagcaacccugccggcacacacacacuucugaagcccugggacgccggcccgccugcaguggggagagaagcugaauucugccucaaaggcugguugcugguggguggguucacaggucuggcucacagcauacccacagcuccaacgcuguucugagcucuucugguugaguggcuuucucauu

SEQ ID NO: 5864 - RNA, 16156 nt, Mus musculus
aaugagaaagccacucaaccagaagagcucagaacagcguuggagcuguggguaugcugugagccagaccugugaacccacccaccagcaaccagccuuugaggcagaauucagcuucucuccccacugcaggcgggccggcgucccagggcuucagaagugugugugugccggcaggguugcugagggcaauaggcaguccagagggggugggguaaggcuguggguggagcuaugaagggaggauaaaaacugcacccuguucugucuuugcagcuugcuuccuaaagcguggaaggguggagaggcugccuucuucuuacuacaaaccggaucugagucaggcaaaaagaagacacaucuuagaaaggagagcuuacaagggacaggcggauagaaaccagggagaauggaggaggcacagcccagaaggagcagaagagcggagaggagauggagaugggggaggggagaggugggauggacagagaaaggaacggacaggggacaggagcagagggguggggugugacgccacuggagacaacaaacaagcaagcagacgucagacaugaaauugcugaaccaaaaaaaggugagucuacagguggcagaguggggauggccugagccuccccaaaggggacacgcaggggcugaugugccccuccccccacugcuccccuccccccagcgccccgcaaagcugacacuggaagcuguccacaugccuggugcugagaugucccugcagagcauugcugccacuucacaagucccugcugggcuccuauggaugcaaccauuaguccgagcacugguggaggccagcaguguauaaaauggacauguacuuccccacauaaaacuuucauugugagagaagacaggcacaccuaauuagaagaagagaaaucagcugggcuggcgagauggaucauuggguaaaggugcuugcugccaagucugacaaucugaguccaauccccagaacacgcaugagaaaaaagcauuugaaguagauacagaaggaucauggguucaacgucagucucagcuguauaugagccucaggucaguguaggucucccgacaugggaggaggacgggaaggagagagacacguucuccucugaccuggguucccgugcuauggcaugugugcagcaccugcacucacauacgcacauguauguaaauaggugaauaugugaggauacgaaugagauuuccccaucucccuggacaucugaguacgugguccuugucgguguucaucagaaaaccgacagaaaagcagcuguaugagacgaacgugaugcucuuuuuaaggagagaaagaauguuuggcuccgaggguccgaauucacuaaaaccaaaacauaacccagaugugcagaugcuggccgcaggacucucggcagaagccagcccucuccccagucucggcuccagaaaacucagguccauccccucccccagggacuucucacuaacccacgugucaaugcuucuguaucagcaauguacuaugaaauucucugcugugcacacgggagcugagggaccugcuucuaccacaaccuccuccugcugacuugccagcaauacugaaugaaaggagugggggcagcagugccugcugggaaggcugcaacuucaaccuucaacuaugcuccugaggaggccagccacaagcucaccuguaugcuggcaguagccgccccccuaccccccacccccagccaagagugagacaucacuccaaguccuucacugugggccacugcaacuuugccugggagauaccugaagcaggaugggccccgaaagcaaauaaccucaggcccucagcauguaugcuuggaucugggagauucccauggcucuucacaguagcaggcucuggaagguuccaacaacucuaguuagcauaugggagacacacaacacucccccccccacacacacacacuguagucuaagcuggccugaaacuugccauauagcccagacugaucuuggacuuacagcaauccuucugucucagccucccaaauccuagaagucguaagcaaucacaccuggcuucuccuuuccuuuuuguuagaggaauacccaugguauauguucgcuuuuguaaccgugacuuacaagaaaggggguggguucaucuugguuuguaguuuucaagauucuagucgagaucaguugggcccauugcuuuggcacuguauugcugcauuuggcaaggcagcauaauggagcaaaaaaacaaacaagcaaaaaaccaaacaccucucaauucauggccagaaagaaaagagaagugaagugucagacaugaaggcgcacaccugcggcccuggcccuucugcagggggaucaggaguucaagaccagccugggcaacacagugacaggcugccucaaugagccaauaaaacugccuuuaauagcaacacuugggaaccugagaaaggagggcagaauguaaagcuagcccaggcaagauccugucuaaaaagagagcaagagaacauccuuggauaguuuuaugucaaugugacacaaguuaguuaucugaaaugagggaaucguaacugaggaaaugccuccagcagucuaauuguaggguguuucuuuaauuagugacugaugccgguggugcuaucccugggcuaagaaagcaggcugagcaaaccaguaagcagcacccuccauggccucugcuucagcuccggccuccagguuccuguccugacuuccuucaaugauggaguacugugaggaaguguaagccaaauaaaccauuuccuccccagcuugcuucuuggucaugguguuucauuacaucaauagaaacccugacuaagacagaaagcaacagcaaaagcugugaagagagaaagagagggagggauggagggagggggagagagagagagaggaaggaggaggaagagaaggaggaaggaaaaggagaagaaggaggaggaggaggaaagaaagaagaaaaaggaggaggaggaagaagaagaggaggaggaagaaaaagaaggaggaggaggaggaggaggaggaggaggagaaggagaagaagaagaagaagaagaagaagaagaagaagaaagaaagaaagaaaagaaaagaaaaaaagaaagaagaaaaaggaggaggagaaggaggaggaagaaagagcaggaggaggaagagaagauagaaagggaguuagggaguaagggaggagagaaagggagggagaggaaguugaagagaagaagaaaggugaacaggaggagaagggaggaaggaaaggaccugggacucacagcuucccuuaggagcaugcccauaguuucugaauaucucuaagcaggauuucguugcuuaaagucuucaccaucguccaauggcaacucccugggaacuaaaucgcuaacauggaaucauacauagcaugaaacaucuuaaagguacccuaggacauucugggcugagaucugggaagaauucagaauuguccuaaggagacaccuggaaaggugggcuuacugaguucaguggcaccaucauccaaugugugccuaucacacgcagcagcagcucaaugggcaaggaaagagucagggaugcaauuaagggauggagggauggauggauggauaguuauguugucuuauucgcugcuaaauguuaagaaugcaggauggaaggcaaaaguuauuucaacugcaagaucuuagaaaagaaucacauguagccuuggcuguccuggaacucacucaggcugagugaggcugacuucagauucacagagaucugccugccugccucugccuccugaaugcugggauuaaaggcgugcgcuaccacugcacagcaaaaagaaucauucucagcucucucugggccauacguuuugcuagagagcugauuagaauucauccaucuauccacucacaaugacaaacugggaagcagcaugcgggcaaggaccacagaaccccaggaggggacaaggcucagggugaagggaaggugaggcugaaggacugaccagggucucagcauucaugacaaccuuacagccacaaaagccacaccuuuuaccuucacacacaccccacuccuaucauucaugugugcugucaacugcuugucagacuucucacccccaagaagggcaugugcauucugcagacaacugaagagacucgaaggaacaagaaucuaauaacaaaaauccaagcaguaugggagauaaauggggaagccaugugggcguaaggggguagaggucugcaucccaguccccuccccauggcaucugcagugccucccagccuuucugaccccugcaaagagcagcaugacuggaccuuuaaauugggaaaaugcuucaucauguucugcuccaucaugaaaaacuagagucuccucccccuccucccuagugcacucuccuggccugcagccaggggcugggaaugagacacaggacaggaaagggaucucuuuuagggaaucuaucaguucuccuccuagggaucccuccaaaagagaaaaccacagcaaacuggggugcagugaggcuugagguaacugccugggagaaguucugaucugaagaagucuauacugguuuccagagcuugucagugggcauuggaguggggcucucucugcuccgggaagagguuugcagggagaaagaacuucacagagagccaggcacuggacaggacaugcaggggugggucacuuacauacaaccguaggucguuucgagcccgucauaugacucauccaauccuccccuguaccgcacagagggacugcuuggaaaagcuauggaaccucccuacuccguuaggcauagauuuaacccuucccauccgaggagcggcugcuguccguggugcugaagcgauagcggcacgggcggcuccguccacuaacaccgcuuuugaccggaaaaccaaaccaagaacgagccguauaauaaagcaagagcuccaagucuaagccccuccgccguccccgcccuuucaccugaagccucaguagggcucaugauggaggucgguggacuuugguacugaaaaaccacuccaccacuuccucggagcaugaaaggggaugcuuacggcaguacugguucaucuauucuggaaaaggaaugagaugccaagauaaagcagaaaaaucgggcaaggaagggagaaagacaaaguucucaggugagaggaacugguuacuauuccgacuggcaauauguggguucuccuccccaaaaucagccagacauuucccaaguucgaaccuccuaggggcacaugggagcuuggagcugcaucuugucucuugcacacaagggaaaaccaaacauaggagaacacaauuuguacaaggucauucagcuagcgaagcacagaagcuaaccccacccuguggcagaacuuggcuucgguguugaggcucuugcugccuacugagggacccccuguucuucguaggcaguuuuccuuuccgggcaagaggagacuccacuuuccagucguggccacuggaauuuuuagagagcaccacguuccucucacccagcgcucccuuucuccgucugcaguguucuccuucucaggguagcuuugcgguccuuucaaacuccacgcccaccccaaccccaaccccgaagccagcuguacaguuccuuaagccccuuuggguggcccagggccgcuguaguaucuggggaacacugcaccgccagcuagaagguccccauuuaucaucaguagcauccaucaugcaaccccauacagaaucccuucgugggugacugcagucugcacuccucaucucaagguccucucuaacuaucagggaaccaacccugugcugcuucucaaguggggguguccucucauaguaaucacugcagucucccacugcuucaacccgaaggcgcccugacccaucaguucugcaauccucucccuauuuccagugcccucucuuauucugagggucuuauucugacuaauagggucuuccgacaugcaccuggaggucugcacuuguccgcuccggaaguccuuuacuccuuggucugaccucgggaggcucuacugacgaugcgucgauuccccuucacuccugggucgucccccccagccccgccccucucacugcggagaagccggucggcccggggccgcgggggaggagguggagaggguggggcccuccuccccagccccccacugccgaggggccggaccgggccaccgcggauauaaaagagccggagucccagagcugccgcagugcugccugccccgucccagccccgcacucccgcuccgcuggcggccgcaccugcuccggccaugaugagcuucggcagcgccgaugcgcugcugggcgccccguucgcgccgcugcacggaggcggcagccugcacuacucgcugagccgcaaggcaggcccgggcggcacgcgcuccgcggccggcuccuccagcggcuuccacucgugggcgcggacguccgugagcuccguguccgccucacccagccgcuuccgcggcgccgccucgagcaccgacucgcuagacacccuaagcaacggcccagagggcugcgugguggcggcgguggcggcgcgcagcgagaaggagcagcugcaggcucugaacgaccgcuucgcgggcuacaucgacaaggugaggcagcucgaggcgcacaaccgcagccuggagggcgaggcggcggcgcugcggcagcagcaagccggccgcgccgccaugggcgagcuguacgagcgcgaggugcgcgagaugcgcggcgccgugcugcgccucggggcggcgcgcgggcagcugcgccuggagcaggagcaccugcuggaggacaucgcucacguccgccagcggcuggacgaggaggcccggcagcgugaggaggcggaggcggcggcgcgcgcccuggcgcgcuucgcgcaggaggcggaagcggcgcgcguggagcugcagaagaaggcgcaggcgcugcaggaggagugcggcuaccugcggcgccaccaccaggaggaggugggcgagcugcucggucagauccagggcugcggggccgcgcaggcgcaggcucaggccgaggcucgcgacgcccucaagugcgacgugacgucggcgcugcgggagauccgcgcgcagcucgaaggccacgcggugcagagcacgcugcaguccgaggagugguuccgaggugcgcgggagcgcggggugggaaggggucgcccccuccuggcggagcagugagcagcccgagaggacuccucucagaaguagcuagacccgcugcgaggugcaugccaccugacaaaguagcgguuuuacccagacccucccuuggggcgccccaacucuggauuuuccuuuagaaaaaggaaaccacccuccacauuuuuuaugucuguaauuaaacaccggggccaaccccugugccccacacacuguuagaccccagauucagacugaucucccaucugaaauggagcaagccccgucuggacccagcguaucagguauccagcagccgcuugccaugccaacucugcccacccuuucuugcgcacccugcgcaguggguggaacaggaguauucguucuaccaggcuucgucccacuacuugcucaguacauaacaucgcgaauuuuaguaauugcuguguaaaaaugaaagccauucauuuucaugccguuucuagccaguacggaaccaucauguggaccucauugcuguaaauggcuguuauuuaauauccccuuccucuuucccaaaauuuacagggguucugagucagcuagacugcaguugcccugaaaccuuacccuuuagcugcagggugaccuugaccaacauuggcuuucucucauucucauuucuuuugggauuggggcaaagaguaacugggcuucuuugugucagcugcagucaucugcuguagucguuccuguagucaucuauaaaucuggaggcaaguacagagcaucugcgcuuuucaaaagugucugugauccauaauagccaagaauccuaacuugaguggcuuuuaagccuuugcuaacagcauggaaagccaggaaugcugggauuuggaugguuggaauuucccuuuucauguucuacgccuuugcgguggcagugcccuucccccaucucugcagcaaggcuccucccagaggggaccucuucucuucuuuuagguuugcccuucaccaagcagagcaucccaggauauguguucccaccagcuggccucuuucuuuccacccggacucagcucuuggauacaggauguucacuuucuggagauuaagaccgauuucuuauuuccacuggccuggacaagaucugagaaccaggugccaguugguggcagagacuccacuggcucuggggcugcuguguuaagggagucagaagaggaagggacagaggcugggacaggacgggccuuguacucuccuaugaccuuggacuccguagaaaucugcaaugaaguuaccauggcuacauuguaacugacggcuuguguucauaccuggggaagucagaggaauaugaacuuccuucccaagccuguauaccccagcucagaguuaggccucaugcuagcuucccaucugaaccuucagugcagugugccaacccuuuguuaaggaacucugccaggcacuagaaucaccaaugggggcuuccugucuccugagugguuuauggaucaaguugagggagacacagucuguuuucugaagccagauagacucaauuugaauccugccacucacuagcaguguggcuuuggaccauaacuacuuaacugucauaggaaaggguguauuaaauauccuagcacccaguaggucuucaacccaugcaugccacuuuucugauugcaacccaaguucauauguugcuaacccuguguccugauuccuucccuacuuagugagguuggaccgacucucagaggcagccaaagugaacacagaugcuaugcgcucggcccaagaggagauaacugaguaccggcggcagcugcaagccaggaccacagaguuggaggcccugaaaagcaccaaggagucacuggagaggcagcgcucugagcuagaggaccgucaucaggcagacauugccuccuaccaggugagcagaggggagggugacugacugaccuucuuagagcaggacucuggccucugagucagacuucacaucugcuguugugugaccuggagaguucucugccuaccugaacuaaaauucccucucuggagugaacggaagaaaaccagcauaaaccuccgcuuugcagaucugugaagaucuaagagauuuagagugcucacaaccuuggggacagagcucaguggucgagugcaugagguccugggcuccguccuagcaucuaagaaagaauuuacuacucaaguauaaaugcucagcauaaucucgguuagaguaggcauucuagucaccagugucuguggguguggccugggaagauuucuucugucagucuggggagaaaagugucacuuuccuagaaccugauaaacaaguaaauguggagacuacagagacacuggcagccggagaaacauuaaggaguaaguaaagggccguaugaugguucacucuaaggcagugcuucccagcccuccugacacugcuguccuugcauacaggcccucaugcuguggugaccccagucagaaaauuauuuucauuacuauuucauaaccgcaauuuuacuaguuaugaaucacaauguaacuauuuuuuggagaaagagguuuguuaaaccccugggagaacuacugcuuuaagcagugguccagggaaaagaaguuucaucuguauccaguaugcuuccggguagccucuggcuugccagggaaucaaauagcaaggguugacacuugcaggcacuuuuggaaagaacagaaaacaaaguaacuaagacugcucuugccccagguaucccuguggaguguaccaccccagcuacgucucaacccuuaagggagcauuuucuaagacaucuguaaaaauucacccaucauucugacugagucagugucuguuguauuucauuccagaacuuuccucaggcugagaguuuugcuccagacuuuuccaugauuguacaugcacaucgaaacuuugccaggguggggcuuuguccuccagccagguggcugagcaggguagcaccagcuuaccuugccagguacugcuuggcagaugacucuccugaugucugaucugucuuccccaggacgcuauucagcagcuggacagugagcugagaaacaccaagugggagauggcugcacagcuccgagaguaccaggaccugcucaacgucaagauggcccuggacauugagauugccgcuuacagguaagaugacccaggagcucgaggcaggguagaacccugaccuccauaaaguacuaagccuucaguuucagauuguguuuggguggcugccugcguuuuagaaacagaaggucuuuuaguuuuuauuuuguuuuauuuuguaaaacagaucuuacuagaucacagagacccaccuaccucugcaucccaagugcugggauuaaaggugugugucaucacaaucuagcuaaagacauggaccagggacaccucuguagagucucucuccuccuaccuuuacaugggcucugaggguggaauucaggcauuaaggccugugcagcaagccucucuacucaccaagccaucuuaccagcccaaaguauuucaguugugagccuuaacccuuaaaagcucagcugucccucccauacuaauuauaguacaauauauuuuaaugauguauggucagcagaaugguucaguggguaaaggcacuugcuauaaaagccugagggcccauguuugaccagcagaaucuccuguagagagagaacuuugauuccugaaaguuguccauaaccucccucccccacugaggcgcccauguacccacaccugcgcacgagcacaaugaaauaagaaaaaaguauuauaaagucuauaucuuaaauuggccauuuaacaguuuuaaaagaacaugucuucgaggccagccuggucuucaaagugaguuccaggacagccagggcuacacagagaaacccugucucgaaacccccuccccccuaaaauaagucagugauguugaauucauuugcauauauuuguauacacaacacuccucucccuccauccaaaaucauugacucaggagugacuucuuauccuucugacggcgccuuacaguuuaaagacccuucucuaucccaaagucagcuagucagagaguugcuuuggaggaaaagaggcacuuagcuagucagacacuauuacagccccacucuauggaguuucuuagcuugcuuggccuucauuccuugcagaaguaaauggagacaacagaaacaacauccaaaccauggguuggugggagcucagccaguccugcuuacgagguguccagcugacacagguucugcuggugcucacugaaugguagccaugagacgaccaguccccaaagaugagacaucacagccuagcagggaugacaucccaggcuucuucugguugguguccuuggcuguccaccuccugcucugcucuaaucuugguaacucaguguaguacagugauccuagagauagaaacacgggcccugccccaggcuguagauuaagaucuguaguuuaacaggauccaggauaauuuguaagcuguuaaauuuggaagccacuguucugggggaagccccuaugcauccacuaagcagccaccucaucucccgccaagcccuuaacacucauuccccucacagaagcagcccucugagguaaggaugcuggugaucagccuuuuaccaaugaagaaauggaggccuuuagagucuggguagcuugaggagcuaagugagaggggaaaucccaaagaauggcuccaaaaggagccauuaggaaaccccucagccugaaugugggcuuccucauucccuucagccaugggaagggcuuacauuuuauguuguugugugugcagugcacguguagagguuacauacaacauucaggagucauucucucugucucuccaaacccagagacucauacauacuggaccagcaauaugccaccgagcuauaacccuggacccccaacuuucucuugaaauagguuuuucuuuugggggggugggauuguuugagacaggcuuucucuguauagucuuggcuguccuggaacuugcuuuguagaacaggcuggccucgaacuuacagagguccauuuguuucugucucucaagugcugaauuaaagucucgugccaacaugccugucuugaauuaaguguuaguugagagacacgcaguguaacuuuugucaguguagggucuucuguggaggaccacucuuuagggcgaaaguuccucccuuaagcagcagugcagcccccaugagggucaggcuuuguaggcggccaccggaacaguucccgaaguaacucucaaagucuuccugccaaggcugugacucagggcaggguauuguuagcauaacuccauccccagcaccagaaaaaauaagugaguucaaaagucuauuaggaaugaaaaugaaaaaucugaaaaaaagagcaguagagaagagaaguggagggagcaagggagagagagagauuccugccauugagucauacccuucauucaccaaacccugucccugcacauacuagggcuucagaaagccaaccaggaguccagcucugagguaacaguguaucccauuauccacuccacagaaagcuccuggaaggcgaagagugucggauuggcuuugguccgagucccuucucucuuacugaaggacucccaaaaauucccuccauauccacgcacauaaaagucaaaagcgaagagaugauaaagguaguagagaaauccgagaaggaaacugugauuguagaaggacagacagaagagauccgggugacggaaggagugacagaagaggaggacaaagaggcccaaggucaggaaggagaagaagcagaagagggagaagaaaaagaagaagaggaaggagcagcagcuacaucucccccugcagaagaggcugcaucuccagaaaaagaaaccaagucucgugugaaagaagaggccaaguccccaggugaggccaaguccccaggugaggccaaguccccagcugaggccaaguccccaggugaggccaaguccccaggugaggccaaguccccaggugaggccaagucuccagcugagcccaagucuccagcugagcccaagucuccagcugaggccaagucaccagcugagcccaagucuccagcuacagugaagucuccaggugaggccaagucaccaucugaggccaaaucuccagcugaagccaaaucuccagcugaggccaaaucuccagcugaggccaaaucuccagcugaggccaagucaccagcugaagccaagucaccagcugaagccaaaucuccagcuacagugaagucuccaggugaggccaagucaccaucugaggccaaaucuccagcugaagccaaaucuccagcugaggccaaaucuccagcugaggccaaaucuccagcugaggucaagucaccaggugaggccaagucuccagcugagcccaagucaccagcugaggccaaaucuccagcugaggucaagucaccagcugaggccaaaucuccagcugaggucaaguccccaggugaggccaagucuccagcugcagugaagucaccagcugaggccaagucuccagcugcagucaaguccccaggugaggccaaguccccaggugaggccaagucaccagcugaggccaaaucuccagcugaggccaagucaccaauugagguaaaaucuccagagaaggccaagacccccgucaaggaaggagcaaaaucuccagcugaggccaagucuccugagaaggccaagucccccgugaaggaagauaucaagcccccagcugaggcgaaauccccugagaaggccaagagccccgugaaggaaggagcaaagccuccugagaaggccaagccucuagaugugaagucuccggaagcccagacuccaguacaggaggaagcgaagcaccccacagacaucagacccccugagcaggugaaaaguccugccaaggagaaggccaaguccccugagaaggaagaagccaagacuucugaaaagguggcucccaagaaggaagaggugaaguccccugugaaggaggagguaaaagccaaagaacccccaaagaagguagaagaagagaagacacugccuacaccaaagacagaggcgaaggagaguaagaaagacgaagcucccaaggaggccccgaagcccaagguggaggagaagaaggaaacucccacggaaaagcccaaggacucuacagcagaagccaagaaggaagaggcuggagagaagaagaaagccguggccucagaggaggagacuccugccaaguugggugugaaggaagaagcuaaacccaaagagaagacagagacaaccaagacagaagcagaagacaccaaggccaaagaaccuagcaaacccacagagacggaaaagccaaagaaagaggagaugccagcggcaccagagaagaaagacaccaaggaggagaagaccacagaguccaggaagccugaggagaagcccaaaauggaggccaaggucaaggaggaugacaagagccuuuccaaagagccuagcaaacccaagacagaaaaggcugaaaaauccucuagcacagaccagaaagaaagccagcccccagagaagaccacagaggacaaggccaccaagggagagaaguaagagaacaagagaaacacccagaauagccaaagaaacucaggacggucccaguacucaggggucggcguaauaaauuuuauuucuuccuuucccuccguaagaagaaacacugcuuagauggugggccugcccucaccaaacaggaauuucuauuaagauuaaguuagcaagagaagauaacccugagccuugucccccacgccgaaaacccuccccaggugauggacaauuaugauagcuucuuguagccgaacgugauguaugcugaacgcuacgcguaaaacacgcgucuaaaaacugcccccuccuuuccaaguaagugcauuuauuuccuguauguccaacugacagaugaccgcaauaaugaaugagcaguuagaaacgcauuaugcuugaaauguuguaaccuauuccugaaugccuucuuguuuuccaaaggaguggucaggcccuugcccaguacacgcuccuggaagagcugcagcaggugaggcagggcgcuggccacugaaccacgccaggguguacucuccacugaaguccacuuucaauugcuuccaugcaauaaaaccaagugcuucugaaauaaaacugugguuguuuuuacuuguucucuuccucugggaaggcaagggauggcggucuagacgucacaucagaucugugcugguggccuagggcaucuucaucagcaucaccugggagccuuauaaacucacauacggggcuggugagaaggcucagugguuaagagcauuggcugugcuuccagagguccugaguuccgggcaaccacauuuggcucacaaccaccuauaaagggaucugauguccucuucuggcaggcagauguauaugcagcagaacacucauacauuaaauaaauuaaaaaaaaaaaaaaacagaaaaacccacagacuccugacugcacaccauugacaucacaaucugagggagaugugggaaagcacacaccuggccagaucccaguuuacccuaaugaacacugaugcugagauacugggaacagugagcuggggaggaugucgaacggcccauggacucugcguguuagaugagaaaguaccugugcaugaggggccacauguggauaauucaucuguugugaagacaauggccagucaacagucaccuaauuuacacucacugugcu

SEQ ID NO: 5865 - RNA, 181075 nt, Mus musculus
cagaugaaagggccgcggcgcgacggccgggggagcggagcagagccugcgacccacaaagccgccgccgccgcgauggugcugugaggcgaccgcccgcgcucgguccuccgccggcccgcgacuaugcccggccgcgcccgcccuccgcgcccucccgccgcaggaccaugaggccacgcucgggcgggcgcccaggggccccgggccgccgccgccgccgccuccgccgcggcccccgcggucgucgccugccgccgccgccgccgcugccgcugcuucucgggcugcugcuggcggccgcggggcccggcgcggcgcgggccaaggagacggcguucguggagguggugcuguucgagucgagcccgagcggcgacuauaccacccacaccaccggccucacgggccgcuucucgcgggccggggccaugcucagcgccgagggcgagaucgugcagguagccacccgggccccgcgcuccgccgccacaagauggcuccgggggcugcgcccgccgaccccgccgcgggcuagcgggcgggcgggcgggggggaggcgcggagcccggcggcaucccucccaggcgggcgggacggggccuccggggcacggcggcugaggcgagcgcacgugggggcucggccuccggugggugcaccgcgccgggguggggguggggacgcugagcugggcaugggcgccugggcggcacucuugaguuggcgggacguuuuucucccucaggugaaagucccgggaacuaccuguugaaugccaacuuugcaaaggcgagacaaguugaaggauggagcgacuucuuagaggucgcaggcuuugcuuuuccauccacguuugcuccguuuucggagcgacccaguugccggggugcacaucuucagguuauuuuugcugaaaucuacuggcagccuuaccuagacaccaacccucuggcagggcucuggacgggcagcagcaggaagggagcaggcggagcuggcugaggagugggaauuggcagagcacugucguggccgugccucagauuacaggggaugagaaagaccgcaggcucgccccugggucaaggacuaauaccgaagaggccugcaaacccgagccagggucucucacugacagggccuccaccuugcuccaaaugaaagagggcugcgucccaaaggaggcuggcuagggagagcuuugagcuguccccagucuuugaggagggacucucagucgaagccucagcggauggauagcugcauagauuucccgcucccucgacgaugguuuuuauccacuaccauguuccagggcagcgcacuuaugguuguuaggcgcaccucugguaggagugaucugauacgguuggcucgucuuugaaucuuuuggaacuuuagaggccuauaguuuggaucuccggugcuuugcucuugggugaauuaugaagagaaaagggacugugugggaugacuucagagcagcuccgaguguagacaggagggugaagcugcacgcagagcuuugaguugaugggacacgggccaauacgguguagcuccuuaaaggugugugucuuuccaaagcuggaggaggacccuauggcugugauuagaaagcauuguuuuguggugcucuuauucuuaucuauagaaagcgaaauacauguuugaccaauuucugugacuacagauguugcuaacggugcuguucuccccccccccauguuauuguuacugucauuaauauacaagcuuuagagaggaugcuuggcugaagauaccuaaacaacucuauugcaggcuuuaagaagaguuugaauuuuaagucuugcuucuugugaguccuugucguucuuugaggcuuucccugugcccugauggcuuuagaaauguuugauuuacagccuugaggguggggguugcagcugaggggaguauguuuuaacguggcacuucacuuuuugaaggagacuuuugaaguuugagauuuuuaucugcaguguuuaaacuugagccauucucugugguaguuugucuggggagcuauucauuaugcauaaugcugugcuuugcagauauucuuggguucacuauuuaauacaaaauuagcaguuuaaacacaccauuuguaacuauuuuauccugacaaguagagagauaaugugugaguuuggcaggacucuguucucuugagaaguuuuugaagugcuuaucuaauucuuuuguagucuacuagacucgcaccucccuuucaaauuaagucaacagucacuaaggggagaaaaaugacuuaaaugguauuuaauaaguuuaccuguuaagcaaucacuaaugauguccuuaauuccuuuauaacugcagugauauuggugggcuuaucugaacucccugaagagauaguuugucauugguacacuccauagcuuuaauaacuuuguuguggucauccauguguccagacaagcacaguguggcuuucagagcuguguguguacacacagaccggcaugcuuuuauuuguucugugaauacugccagacuaaaggaacucuuguagcuccugccuaccagcucuggaauaaguuuuguaaggaaagccaauguuuuaggauugcugagagggaauauaaugagagcauguguaauaaaaguguagaagaaacaaagccagucuuuaauuucagauuaaucauguuuucuaaguacucauugaacuuuuaaaaaccaccuuuuguuuuaucaccugaaaaacuucauguuuugcccuuuaaugaacguuuuauggucuucuguuuauuuucugauaacuagaacuaaauaguaguauguagguaacauugcuuuuauucucagugugauucuauagcaauauuguucuuaauugggaagagaggaaaaaagcuguuugaauguuucacuuuaaaaauuauaagaaauauuuuguaguacugacuuuuuuuccuguuacuugccaaugaauguguguguguguguguguguguguguguguguguguguguauguacacacacacacaauagauuacuuaucauagucuggucagcccaaggaccuguugaguauuuaucauggguuaggguaggaggaagccuggcugugugugcuuguugaggagugggauuaguaguucagacuuugggauguguguauuguagguguaaauuaauuaucccaaggucauuaguuuagucuguaugaagacaggguuguuuguguguguuugauuuuuuuucuucuuuucuauuuugauauuuccaguugugaaaauugugaauagacuauuuagaugugaaauuaguugcuuuuauuaucacgcagcagcauuagccuguuugcaucuaagcaggucaggcauauagcuaagcacuagaagaauuacccuuuuacuguacuuuugaaguguggaccucuaaagaacuuucagacauacugguacauauuucaucuuuaaaccaacguguugauguuaaugaaauuauuaucugaaacuuuuaaacuugucugcacacaugguugguguuguuaaauaaggggccugauuaaacacuggcuagugguguguaaauuggcuaaaccaacaagaaaauuugcauggcuagaaaugaaagcuuguuuuaaaguggaaaugccuauuucucccauugaagucaaauaguuagaaacaucaagaaauucauuuguacaaggagugagaaugauggguucuguccaacuuuaaaaucaguuauucuggaucccagguuaaacguuugaugaacuugaggcugugaacaugaacuaaggaaguucuuuuagcuguuaaagagugaaaggagagcuguguggugauuagauaggcuggguaacuaaagguaucacagggaauaauuguaggaggcuaauuccucugccuuguuucccugucaguguguuuuuacaguucagcauuugaucaagcacuuucuuuucaucuccauuugaaguuaacuuaauaggccugccuccaaaaauugacuuggccuaauagaacaauugcacgcugacagcugacuuggauuuacacagaaagggccugccgaccgucuugucagaugguccuuuauagguuaaaagcaagcauuucauuguuggggggugagggggagguugguaaauuccuaggaucucuucucugguuuuauacccugagaucucaugugaauuaccaguaauucugacuggggauaagaagcagccaugacuccauuuuguguguguguguguguguguguguguguguguguguguggugugugugugugugugugugugguguguguguguguguguguguguguguguguguguguauauacaggggacugugccaagcacauuaagcuuguucauuuaguccuuaacauuaauacagauuuagauacuauuguuuauucaguuuuacagaggaagagacugaggcugagagaaaguuuguuucucuaaccugacagcaaaugguaaaaccugaauugaaaccauggucuguccuuauucuugucaaauaaguagaacugaauuuguuuggauuugacauuuaauucaaaucuaauuucucauaauuuguauugaaguucuugaaggccugugccaaccccucccacccccccaugaaauuauucacacauucuugugaauggguguguucacuuuccugauaguuucccaagaggaaaagaaguuuccaccuaguacuugucuuugacugguccagcacuaagaauuuaaguagaaggcccagaagauaacucaauggauuaaggugcuugcugucaaggggacuaaauuugauccuugacauccauauuguagaagagaaccaacuccugacaguugucuugugaccucugccuagacucuguggcacacaugcccuuccuauaaauguaagaaaaaaaaaguugagugagguaauaggucucuugggcuggccaggguuggagggaagccugcagcagcuuugcaaaccuucauugagcguauuuauuggauggaugucuaccaaaaaccuauucuguacagaacaaugcugcagugcuguaguccucugagauagacugguccacagauaaucauccuuaccaacugaguuuuuuucacaguauuucacccucaugcccauaggcaucugcaucucaacugaguuugugcaucuauguccugcuaguucuguaucauccuugggagagagaaaaaagaaaccaacacucaaggaauuuucuacauuuaguaguggaggaaguggaaguacaaugacuuggaggaagaagagauggaaaugaaagaauugaaauagaaaaaggguuagaugugucccuuucuaccauucacugcacagugaaguggaacagcugcugguguuggaaggcugcaagaguagccccugccuucuggugaacccaaauuucagggagacaugucuucauagucaaaagaaucaaaugugugggcugagaccuagcucaggggugcagagcacuugccuagcaugauugaagcccugaguuucauccccugcaauggaaaaaaacaaaaguaccaaauuuaaugaaauagauuuaaugcaaggcuagaaaggugaagugccuuguuugggccguaugugugugguaaagguagggacaacuacaauuaacauuuaauuccucugagaccaaggcuuggagccucucuguccacccugguauagcugggcauugucucauggaagaguggauacgaaaaauauggcuuauaauuagaauaaggagaaccaugcauucuucaguuauauauugaguguaagugguugcuuuucuccugauuauuuaaaauuugagucuuuucaguauuccucugucagagcuuuuaaaaauagcuaucaggaaguuggguagugguagugcauaccuuuaaucccagcagggguaggugaaucucuggguuugaagccagccuggucaacagauugaguucaggacacccagaacugcacaaagaauccuugucuugagaaacgaacaaaacaaaacaaguagcuaucagggacuggggagauggcucagugaguaaaguacuugcaauguaagucuggggaccugaguucaaauccccaggacccaagucaaaagcugggcugguaacacaugccuguacucucagugcugggaagguagaggcaagccaggcuaacugaaucaacaaacucuaggucagggagagacucuguuucaaaagcuaagguagagugcagcugaggaggugcccagcauugaccuaugacacucacaugcacauauaacauguacauacacaaagaaguagcuaagaaugaagccagacacuguggcugugguuguacaucucuaauuccagauauuuaggagacugaggcaggaagagcacaggagccaagagucucagguuagccuguacagcauagugagaaacacaaaagacaacaauaacaaaacccaaaccaaaacagaaauaaagcuacuaauguucauguaaguaaggccuuagacacaauacuuuguuuuaauuuuaagggauauaguugauggcagguuuuagauuaggaagucaguagcaaagugguaccuguaacagucacugagcaguucuguagcagaucagauucaaacugaucuuacuggugcugagauuuuuuuguuuuuuuuucugagcuugucucacaugccacuucuuuuugugauaagauuauauggacugaucuuggaauucaaauuuggguuuaaaccuagaaccauugauggagaaauguguuuguaacuuagaaaacccccuagcuacuagagaagugguuuccuuucuugucacuucucccagccccacaaucacagaaggcucauuccaacuuguuuuuuuccuagagccaagcugaccaguuucugaagacaguggcuggaaguaucuagcuaucgcuugauggcacuugugcugcuuugggcuguuagcaaagcuggaauggcugaagcagccugcccuuuagaaagauuucugaugugagugagacauaccucauccuguggcugacuucagagccagucaugagucuguaccacugucuuuagagagauuaagucccauguacauugcuucuuuucuuugcgcaggcuguacauucccugaugauuaaaagauuuuaagagcugaagcuguggacugucccugcucuuuccguuagcagaauucagcagugccuugcauucaccagauccuggauggggcauagcagggaacaugacuaaggcuuugcuucugucuacaggcagaguguggggacaagacaguaagcagagaguacuaccuuacccugaaacccugucugguaggacacuggcccuggugcuaaguuuggaccgaacaagcuguuguaugucacaguauaguauguggauuugagcagucuggucuuuucuaacuaauuuuuacuuaucuuugagguuaaaguugauaaaccuuuuguggagacauuccuuuguaccuguuaaacagaaaggcaggaggcaaagaguggaggcucuuuguucuguuuguaggcugaacuagauguuuuaaaaucuuacuuuuagcagcucuguugacuuaugauagugugaaaagaauaaggucagcuggcccauugugguucaaaggagagcuuuuuauuuuuauuacucuuaagacaugauguaagacuugcuauuaauucccuucucugugcagcagccagguugauauggauauuuagaaaccaaaugugugaguugacuuggugaaaguaacuuugaugauacuagaaguuugaagagaaaauguuggauugggagcuucuggccucuugaggacugcugcauuuugaaacugaaagaguaaggauggcugaauuuuagguacguguaagaucccauccagugcuguaagaucugaucaaagcacaaauuaugaggcugggagaugacucaguugguaaaauguuugccaugcaagcaugaagaccugaguuuaacucccagcacucacauacaucaaagcuggaugcagcacugugugucuguauucucagugcuggcagggagggaaaagcagaucccuggagcucauaggccggcauaucugaugaaacccugucuaagagaaaauggaaaguaguggggaggacuccaugccaauguugaccucuggccuccauguacauacugcuuuucccaugaacugauugagauuuuaaagaaaauuggaaagacguagugaugauagaccuuugucugcuuugaguguuuaauuguuauuaaauagucugaaacauuuucagagaccaugucacagguuauuauuuucuguuauaggacauacuaucagggaaauccuuagagugggugaguaugaacauguuuaaaaaucucacaggcauugucagauaccucugcagaagggcuuguauuaguuagcauguguggagaauauguaccuugugguacauauauguuucuuugaaaacuaguacaaauaaaccagauaagguggaaauuuguauauuccugucauuuaguaaauagcaaauacugcuuuuuucucuauuagcguucugagcgguagcuaguucugcauagagaugugcuguugguagccucugagugccuucccugcgugugucugugaguuugauucuggagcaacagauggugucccuccuuugagcaaggugguuguccacuccaaguugacugcaugguacgugauaaagcagcuugguucucagggggaugcuauugccuuggauguuuuccuuuuucuuuuuccuuuuuuuuuugguuuuucgagacaggguuucucuguguaguccuggcuguccuggaacucuguagaccaggcuggccuugaacucagaaaucugccugccucugccucccaagugcugggauuaaaggugugcaccaucacugccuggagggauguuuucuacuagaccuguuaucauagaguaguucucugcaugaccuugaauucuaagugacacaguuaguuauuggugagaagauagagucaagcauccggcaaacucugugggcugaaagcaacuuuuagaaaagugguuucucugaaauaucuaguguacauagagaucagcucuuagugagaaaaggaaacaucugacaacaccaggucacagucacauaguggaagaacagcuagcucuuccuuugaguuggucaggaacccuucagcucauaagucccauggcaucaccuggccuguguuggacuuugcagcuuaauucucaaaccccuuuuggaguucugugagaccaaagucuuggggucauuuggccuguuuguagggaaauucucccccaauccuuuacaugccuucucucucucucucucucucucucucucucucucucucucucucucucucucucugucucucaugugugagcaugcauguggguaccugguguccuucaaggucagaaguggguuuuaguucugcugggacugguacagauagauggguaucagccaccauaugaguucuaggaauugaacccaguucuucuguaagaacaagugcucuucuuauagcugaacuaacucucuaacccuguguguguguguguguguguuugaguuuaggucucacucuguaauccaggcugccuuggaauuuacaguguaguuuagguuggccucaaacucaugguaauucugcuucagucucucaaguauugggaucacagacaugaauuaccaugcucaggucuugcuuucuuuuaguuacaagagaugugcugaagguugucuugaaagugucaugacucauuucuccuuuagcauaagugaacucugugugaggauauaagagaggcugugcuuagggcucccuuacagugcucuuucuagaacaguucuaccuugguucaguuccaggaaaucuuuaaaugagccuggagcuuuagaguccccagugcacuuugacuuguauugucuuuauuauccuuuucugggagugaauucugcuccagaaggcauucugucauuuaagggggucuugguugccagagcuugucuauacuugauacaaaauacuuuucuuuguaccuaauguguauuuuucuuuaaaugcauuugacauuguguauauaucagcuuuauggaugccccccacuaucaauggguacccagaaacuuggcaccuuuucacaaaguaccucagucuuggaguagauggugagcagacagcuagugguauguaaagaauguugcaagcuugauuagcaaaacuuucaaaguagaagucaaguuagcuaggaauuaagucaaaaagguguccucaggaugauguuugguuugcccugucucuuagugaccuuauuuccucuacuuuaaaaguaauauuucuauuaguuuuaauuauguguaaccacugguguaugaacaucagucuguggagauuggaggugucaaauccccuggagcuagugagcugccugaggugggugcugggaauugaguaagguccucuucaaggguaguacaucucuuacugcugagucaucucugcaguucugcccuuaccuuuugcccuguaaugcuuuagucuccauucaccccuuuaccucccuuucccaccacauuugucuuacugugguaacuucugagcccaucagcccuuggucagaguccuugauugcucucugaaggauggguccugugcuuucuuccaccugugcuuuccuucucauugcuuucccccugaaaacauugcugugugucagcagcauuccugcucccugucuugccucuugauucuuuuuacccucucccaacucauaugaaaccaaaacuuccgguccaucccaucgagugcguucuaguuccucuggcauagcccuugaggcagaacauugcaucccuccagugcuuugcauguauaccuuuaagauaauuacugaacuaaaauaugucuagauauaguacuuuggaaaaggggaguguuaguguaggaaaagacagccugugacagagaacuaucuauaauuguagaaacuauucacaagcaguguucagacaugaguguguccuaggcuauuccaaauaguugggguagaccagacucuuaaaauacuuucaccccacuggguaugauagcauucuccugugauccuagcaugaggaagguugaaagagaaggauugugauuugaggcuagcuuaugucaaaaccagucaaccaaccaacaaaaaccaaccaaccaucauccaaccaaauaaaaccuccaacuugcuugugcugucuuuaacacugucuaccuccucccagccuggaaugugacugacugccuugggcauguguugugaacuuguuggagaagcaaguauucagccugacucuagacuuuaaggauguauuuauuuaaauuaguauauuuuagugucacugauucacuaaacuuaaaaacaacaacaaaaccuggugcuuuggggaaacugcucuugagugaccuaucagcagcagcuauaugugaguucuuaaaaauaugcugcauguuccuucaaauaauuuuugcccuuuuggaagcugugucaugggccuugaucaaaagaugacaguuuuguuccugaggacuauguauuagucuuauauuucauuuugauuguuuuuacucuauggggccucuauaaucagaaaauuaugaaauuauugcuucauuguacuuguuggagcgcuaagguuuucuuuuugucccucuugcuguuuuguaugagauagugugggaauacauggacaccaguaucuucaggacuauuccagaagugauauagaguguacuguauuuuaccaguguuagaggauuuucauggcugcuuuucuguggcaugucuuuuccagauauguuccaaugcccaucaguaaaugcuacccuuacucuaguuauuaaaauaacagauaaauacaugguuuugaaguuuugguguuacuagauuuaaaugucuaggacacauauguacugguuugugguguugaaugugcaguguggaugauuucaaguugcagaggcagugguaguuuuugcauuuccugauacuuguguuuaauuuugcagucucaacauuuuaucaccauagguucucacauuuaaugaauauuuauguugaacuguauucuauacaaaugugaagguuuuuuacuugauuauaacuugcuauauacuguggccaggagugcccuacagacaacagaguuggcacauguuucagcgugccaagccucaacggaugugguuagggaccauggugacuggccuugguugcuaugccaacccuguuuuuuggaaagggagacucuaaaacaguucaugguguggaggcagaauaguuuuagauauuucaaguaaagugauucccuucaaagagauguagaaaaaacucaauucaauuacuauuaucauauauauuuuaaauguguuugaauguuuugccugcauguaugucuguguacuaugugcaugccuguugccuuugggcuucagaagaggaugucagagccccuggaacuggaguuacaggugguuguaaucuaccauguaggugcugggaauugaacacagagacccuuuggaaagagcagcaguguucuuaacuggugagccaucauuccagcccugaaagccuuagaauucucuuuugcauacuugacagcauuaaauuaauuuucuuuugcaagcuuguuuuaaauuaucuuuuuguaaaucuggggaugaucuauauugacuuuccgauuaauguguauuuuacauuuugggguaaauggagaaucucuuauaucuaauguuaugacuaucccucccccucccccauauccuuguccucugguaccacuaaucuagugauuacugauuggagagagggaauagaacaagaggaaggguagaugggcucugccccucacugcuccuuauucucauuucuucccuuaccuccuguaccaggaggccuucuagcuuucuguucuuauguaugagcauuccaccaaguaguuggaaugcuuuuguuguuucuuuugagcuagggucucacucuagucuggucuggccuguaauucacuaugcaacccaggguggccuugcauguugauccucuugccucagccugccuagcuggguucacagaacucuccaaccaggucuggcuauacaugggaucuuauuuuuuccugcccuuagcuguugggaaagcugguauuugggauaaacuacaaagcagaugguguccuacaugguacuucaugucagagagagauugaucaggccuaggaagccagauagaauccaagagugcagguagggaauagguuugcuggugccaguuuuauguagcaccucucuucaagaggccugacagccacuggaggcuauacccuguccagguucaacagcccaggcaguuuguaguguggaggccuuuguccucaagucucaucacugcuuggauuaaccacacauaaucuuugcuuuguuauaacagagucuacucugacacuauauuagaaugaaacacccuucccaaagggccucugggaagauuacaagaagcuauuuuggguuuaggaugaggacagaugugcagaacauccauuaauguugugcagugcucaggcugagugcccuugaaaugucucugucccuguggguguuggugcaccugucuauacguuguuacuuccaagucugcuuuguugcuucugauuucugagguuccuuccuagaaaaccaggaaaccauguaaaaugaggaacuagacaccaaggggaaugucagauuuagugcauagagucuuggcaucugcuuugucugcuuuuugaaacacuuugugccaacuuuuugaacauaagcugacuaaugcaugggauccucagaauuugggaacauauuuuaauuauugguuguuuuagacaacucuggcuaucguggaacucauagagcuccuccugccucucaagugcugggauugaaagugugcccuacuaugcucugcugaaaauguggguuuuuaaauuuguuuuguuuuuguuuuuuucaagacaagaguuucucuauguaacagcccuaacuguccugaaacuuacucuguagaccaggcuggcguugaacucagaaaucuaucugccucugccuccugaguucagggaucacagugcugggauuaaaggaaugcaucaccacgccuggugaaaauacuuauucuuaaucauuacuugcaaauuaaguuuuggaguauaaucugcuugguaacuauaucguuagccagcuguaucugaagacuuggaaggauauuuacaucauuagcacgaguauagcuguuaaaccagugcuuaucagguuccuuauaauauauugugaguucuuuagagggcugcaguuauuuguuuccuuugauaaagggaaagucugcucaaugccaugucugggggcagacugucugguucuacauucuuacacugauuauuacuacugugauauugcuugacuuugccuggagagucuguuucuauuuacuaccagcacauagggcuacaacaggccaaagagauaauuccauccaguucuaaccuggugaaccaaugaguuuaauugaacacuuauagagcaugagaaaaggguuauuuucaagagcaugagccauuuacagguuucugcaccaccaagggagaauauuucuguuugcuuauugguuuggauuaguuuggguguguaugugcguauuuguguguguuggaguuguuaacugccuguauauuauugagaagggaugaacccacagcuuccuguccuuaugagccuuacaagcuucaugacacuuccugaugaguagaugcuggugggcccaaccuugugaagaacuaaugugaugauaucaagaugguuagaggaaacauguagaaggugggcuuugcuucucuggcucucaguuucuucauccuuccgagauuugucucaaggaugacuugaguuacugacagaaugcaguggagucagggugagaaugaaaauaucagacauaguuuugagacauuuuccacaugugccuuacuuuugugcugugguucccagugguugaucauuuuuacucuaaaggccuaaaagauaacacugacugaggagugauaucacacacacacacacacacacacacacacacacuccccacucugcccccccucaauugggcaggaagcgcaaugcacacuuugcgcagccuugaggucugcauuuggucaaggcugcucuaaaggaaagcagagugguugauuuuacccuuuagagcacugggagagcuguguauagugaggccacacugugggccuaauuauguggcagacacaaauuacuucagcacuugguucaguccagcauuaaauuugccaaagcaaauaguuuauuaaucuuaccucucccccccaaauuagacacauuggcuuuuucuaaaaaugggaaugauuggagugcauugugggcuuuuaaaaucucuccuucucuaucugcccucuacucccauccucaaaggugagcagugcguuccucuccuugaauggagaaggugauuuucauuacugccuacuuaccucuucucacauuuuugaaacuaagugauggaaacauagccugugaaggguguguggauuuuaagacagggucagacuggcuuuggacuuggcuauguagcagaggaugaccuuaaacuguugauccucuugcuuccacucccaagugcugggguuagaggugugcuucaccgugcuucacucauucauuucaaggccaaagaaagagucuacuguuagaauggaacuuuacugacugggaauucuuaggauucugauugaggcuacaugcaaggaaaacuguugggugaguucuguuagugaccuugaaugugucugggaagaucagcuauaauuuuauauguagugagggaauaagugaugucagcagggcuuccuaccugacacccugaaucuggccacaaagacugcuggguaaaggaaaauucacaggguucauaccuaguauuaugguuuguuccuaucucuaggagaaaaaacugccuguaaacaagcaugcauccuuaccuuaccucacuccagaaaacagcucuguagccucccagauagccucuaccugucgucauguccagauagccucuaccugucagucauguccagauagccucuaccugucauguccagauagccucuaccugucauguccagauagccucuaccugucauguccagauagccucuaccugucauguccagauagccucuaccugucauguccagauagccucuaccugucauguccagauagccucuaccugucauguccagauagccucuaccugucauguccagauagccucuaccugucauguccagauagccucuaccugucauguccagauagccucuaccugucauguccagauagccucuaccugucauguccagauagccucuaccugucauguccagauagccucuaccugucauguccagauagccucuaccugucauguccagauagccucuaccugucauguccagauagccucuaccugucauguccagauagccucuaccugucauguccagauagccucuaccugucauguccagauagccucuaccugucauguccagauagccucuaccugucauguccagauagccucuaccugucauguccagauagccucuaccugucauguccagauagccucuaccugucauguccagauagccucuaccugucauguccagauagccucuaccugucauguccagauagccucuaccugucauguccagauagccucuaccugucauguccagauagccucuaccugucauguccagauagccucuaccugucauguccagauagccucuaccugucauguccagauagccucuaccugucauguccagauagccucuaccugucauguccagauagccucuaccugucauguccagauagccucuaccugucauguccagauagccucuaccugucgucauguccagauagccucuaccugucauguccaggcugaccuguugggaguuaucagcuuugaagucuuaaggugccauuuuaauacuuucuuuauggugcagguuucgagagcaauuuaacuagauucuggggggagcuuauuuuacagcauucuuaagagcuccgacaaucuugaaagaguuaaacucuaauuagcucauuccuaagguauuuaaugcccuuauuaaaacucaacugcuuguucacuuuuuuucuuuagugaaucagauuucuugaggagcugagcccucgcuccucagaucacaggcucacauguugaagcuggcagugcuagaggcuaguuccuaucugugugacagcauuuuuaauuuaacaggacugccuuugauguucccaaauauuuauaggcagcuuuagaucauuucaguauguguuucuuuuucucuucuucugucuugcucuuaaaaaaaaaaaaaaaaccaaaaaaacuggagcaaaaguuauuccucaugcaacagcuuucuuuuuaucccgcugguuuauuuuugcuugcuuugcagccuugaugaagacucuggcugcauucacacauaggaggccaacucuucuucuggccucuacaguaaaggcuaucccuucuguaucauauggcccacuugaguuugcuugaggcacuucuguuugucccuugacuuuuuuuuguuugucucuugaccuucucagaguuccuuuugagaauuuguuuucugaccaccugaaagcauucagacucucguggcgccuuaugcaguuuuuguggaagaugaucaauguccaugucuugcucugccugucugcuuucucugacucuccagaaggugggacuuacaaagggcccuuggagauaauggucucuugauuguaggcuugcuucauguggcuguacuagacuugucuaaaacacuagagaaucaaagacuuaagacucaggaaugggauaaacaagguuauagcggagagacuuguuaagccacuaagaaaaauaaagaaacuuuguaccaauggaaacauguggcagagagagagagagagagagagagaggacagcggcuugucaguguaggcucagguaaacauucugcuugugaaacaauccaaguuuuugaacucuuggcucucuguuacuuaccuggcugggacaggcagaaaccaggacacuucaugacugccuucagcuuugcuggcucugccugcuacuacaugguagcuuuguggggcugaaggucaaguaggugguugaugaaauguuugaaugaauggaugcucuguuaaggcacuguccuugggcuuuuacacuguguccccagauccucaggaggacucugaauggugagguuuccucccaugauuuuggaugaggacaccaaagggcagcguaauuuaacacagcuuuaauugaaucuggaacucaggacuguguagccugacuacaugguaguucuggguagguguauacagugguggucugcuaggcucuuauggguagcuguauacaauggugaucugcuagguucuuacagguuuuaaaaaagaagaaaaaaaacccuugaagcuaaaaucuccuguguguugugucccaagauuucagagcugaaagguuuuugccauauaagagccacacuggugccagauagguguucaccggcuuugccacugccagcaguaugaccuuggccaggucaaccucugugaacuauuuuccuaucaguagcaugagccauuuagcuuuuaccucaaaagaauuauaaagcuuaaaugaaauaauacacuggugacuugguguuaccaaauuaucauuguuugaaggaguucauaguccugugggaggacagguaaaucagucauuagaagacacuauggcagcuaaagcugggaggucugucauuuacaacagggauucaggacagagccacugauagagagcuuuauagcaucuuuaagcagaugcuuuugaggccucuuugaagccagaugaugguaggugggaccauuguguuggucgugugucuccccccuccccccaacccccuuguccauuuccuucuuaggagaauaugagcugaaaugcuaauugcuaccugaagaaagauuuccugaagugaaauaaaaucccaagguguuaaauaguuuguuaguuaauaguuuaucuuauaugacccugugcuguccuucaacuauuuaaucuuacccaauuuccuuaaauuuucuagucucuucuauauaagaaccuuauaguacuugagaauauacucaaaaguugccaagggagcagguggugacaguuugguuccccacagugcccagaugguauccgugcuuucucauagucuggcuccauggggauuuguugauaagauuuugcuuugauuugauuuucccaccagcaccauguucagauucaguuacagccuguagcucuuuucucugcaaggcuccaaggguucagucguugacagugcugacacauaggcccugugcuguaucccuggccuguuuuggcacaaggugagagauggcuacaggacagauuggaccagugucagugugcuuuucauuuguucaguugauuaggaacauauuuaaucuagaccaaaagauacaugaaaaucaguugcuauuauuucuguaagcuaguuccuaaaauagacuuaaggucauuucuauguuuuuccuguccaguuggaagcuagaaaacucugaaauaacauugucuacugugcaagucugucaguagauaauauggcuaucacuaacuaguaacauuugaguaaaaaauagaucaagacgauuuacuuaguaucacagggacccauguguggugaugauugcauuucuuucucuuuuaaaauuuuauuuuuuguuuuguuuuguuuuguuuuguuuuguuuuguuuuguuuucaagauagggcuucuuuaugcagcccuggcuguccugggccucacucuguagaccaggcuggccuugaacccaaagaucugccugccucugccuacccaguucuggaacgaaagauguacaccacugcacuuggcuaaagauuuauuauuuuaaguuaugugaauauuuguguuuguggccacuaguggaugugaccauugagggagucagauuccgauggagcuggaguuagaagcauuuaugaaccaucugacauugaguccuagaaaagcgguauaugcucuuuuacauacacugagccauaucuucacccucugagguuugcauuuccagugauaucagaguauccguuugccccaugucaugaaguacuucugugccuguguuugccccuccccccaaaguaguaacugaagcaaaauccuuccugcauuaccccucuucaugcuuagguggauugucggcuguucuaucaguuggguguaguuuguguuugcugaggaaaagggaagggcuuucauucauaguacaaugaucaugcuugcuuuccacuuagguuuaaaaauuggugauucauuuugucucuaggagcaaagaugaaacugaugguguaguauacagaucacagauaguaucuuaguugguauuuuuaagugaagaugauuucuuuugaauuuugaguuauuuucuaaagcucuacuaaaggcuuuugugcucuuaacucuuugucguuuggggaaauuugcugguugggaacagacagcuacuggagccaauggcuuugaagcugggacccuuccuaaggggcucuguguaucaaucccacucugcaugcauuuuccaucuagauccuuuagaccaugaugauuuuugugaaaauccucaaaccaaaccaaaacucacccuagcagguauagaauaauuuuacaaaucgaaucuauaugcuugcguccuuagagaugccaguuuucacaggagaagacagcaccuuugcuggagcuaugcacuuuccuccucauuucacaugauaaauguuaaaaaaucuggugucugggaaccuuuguuuguuuagaucuaaaagacaggaagaaagcaaaguaacauuucuuuuuccucuuuguggaugaaagcuauccugaauaucuucaguauggacugccuuguaguguauuauuuggauaccaagauaggaaauuugcagcagccugggguguuucaagguaugucuggccucacuguucugagccccaacccuagugaccucuuucuuaaagaagguucaaggauguagagcuuggguuuucugaauagugcucacggcaugguuggucucuuguuggggaucuucugagguaggcuaauuggucauuggaaaagacaggaacuuuagaugguugcaguguuacuuacaaaggcugagugcuacaugccuaaggccaagagugucuagaaaccagaggaugguccugggcuaugccccauuuaaggaaggccuguucuuggauuugcccugauaccccacuucuuuugcugagauccaggcuggguuggcacugaguaggggcuuauuuuugcuguguauaucagagucaucugguguagauaagcucaaggcaaagcaggagaaaggaaagaccaugugaggaauggccagaaucauaacagugaaaugagaccuaagggggaaccagcucuucucuccugauccucaguccugccaucuguagacuggcaggcaugugaacuuggggcauguggccucaagucagaguccugccaggaaucugagaccuguagcuggauuucaucuaagugggaaagagcaccuaacuagagagggaggacacauagcuuagaaguuaaggaugacuaugaauacaaccaggcagaggugagccccucaggcagaacacagauggcauccauguuuacugcuagaguuuugauggcuugaccucccuccugcccaugcucuacagcagcaguaugcaggggcuguucuagcaguuacuccuaugaagaaaauaauuuggaaugucagggagucacguucuuuugacagucuuaaauucacuuuauuaaagauaaauacaacagcuuuggcuuuuaggauuauuuaugacaaauuguuuucugcuuguacacuuagccacucacagcaccuugggagaaaauugcuguuguauggcauuugaccuuggcucaacuuauuuucugagguuuugaaaguagaccaggagaguguggugacuucuggagaacaguugaucaggcaucuuucaaguucugcuccucacccuucagucuggggaugucaaugggcagaccucgguuuuagcagagagcuuguaagcaugucccaccccuagccuuaguauuaggcaauagagugauagguugguuuggacauuuuucuggcuauugauggguguuauuguggcuucuccaaauugaaugaggauuuuuuuuuucuuuuuucuuuuuuucuuuuaauacagcuagugagccaaaugagccacacugggauaaacucuguuuguuuacaaauuauguaagagaagggcccgccauuaaauucucugagccagaauuucucucccucuucaaaguuguaaucaaacuaaacaaacacuuuucugcaggagaaacaggagcagaugcuccugggaggccuucagcaacuguggaauguuuaaaguagaaacacguaaccaagguggagcuguuccagaaacagugcuuguucuagccagaacugaagcacgugucagcuuuuuuauuuagggcaagaggugcagaaugaaccaggccagugcaggcaggguuuuccucggaguguuuaacuggguuuucuuauccugcuucucacagugucagcuccauuggauguuacuuuccuuugccuacuccuuuuuuccccuuagaaaacagaagaaaagaaaacaacaacaacaacaaaaagcacucccaagucuuuaauuauuauuccuuauuuuuuagcuguguuggauuacaguugaaccuuaucuuuuuaacugugcuagauuuuacagcugggagucuaaaagcccuucuguuagcuccauucucacagggucauucagggaagugagguggaagccuuccuggccuuugcuagugucucagugagccugggagauuuaguucuuuugggcaugggcaaagacuucuaggcucaaggacacuuuuuuuuuuuuuuuuuuuuuuuuuaaguucucacuaacuuggaucuuuauugagugccuugauuuaagauuaauucauuuuuauucauguguauaugucuguauaugccacaugagugcagguuccaauggggucaaaacagggugucagauccccuccuguaagaguuauaggcaguuuugagucucaggacuuggguucuaggaaccaaacuuggguccucugaaagagcaguaugugcuuuuaacuauggagcuauucucucauccugaaauggcuugauuuaauuuggcuugggaaauuauaaaauuucaggacaucaguauauaaauagauguguacuuuuuuuguuuguguuuuugacacagggucucuauauagucuuggcuaucauggagcucacugaacuugaacucagagaucugccccugccucccuagugcugggauuaaagguguauucuacagugcucgauuuugauguguacucucuaagccauauguagguuucugugaagugugcccaagaugagcuuuucucaagguaucuucuaaaagauagcaauacugcagaaugaucuagggugaaagaauuuuaugaacuuacuuugagaaaugauguuuauuuauuuuauauuaucccugaaaguccuacuggaggaaaaaaaaucuguuuaaucugacauuacucaaauauacuugaucacaaaacuuuuucuaaaaggacuugggaagauucuguacuauguauauaguaccuguguaagcugguuuaggguuugugccuguggauuaugaguaggauaggucaagagcacauccacuuuuaccuuaaaggcccugggauauagagucaccaccagcuagaaccaagggcacaccuuuugaagaugauaggagugcuuuuucauuucaacucagcagguuaugaucuuuaugagugaugauuugcaaggaauuagaagcuaugccaugccagaacauaugauauaaccccaaagugauucuagcccuggacccacgacacuuguucuguggcauuuugggggauggggauagcaagaagcaaagguggguuuuauugugaaaauuuaauaagcuguuugcagguuaugugugugugugugugugauaaccuguaaggaucacuggcugauauucaagccucacuuuguuggguuaucaucuugagguugguugguguggccguguuucccaaauuuacuuucaugcuguaaguuugguagucugagguccagucaccuuggaggugcuaggcuguguugaauggaugcauuuuccagacuugucuaccuuagugaaugcaugaaauuuggaaagaguauauggcacaagcucggcuagguuagauauucauuccucuugaggcucaaaggagauaaacucugaggugagaaguuuaaauucuucuccaacuaaguccuauauuuaauagaguguugacuuagugcacaccuuccuuuuucugaggcaggguuucacuguagccuuugcuagccuggacugggcuggcaucacauucaaagagagcugcuugucucugccucccaagcauugagaacauaaaaggugugcacuauaaucucuauaaucuucuuauuccuccccacucucuucucccuaccccccagggauaucagcagcagcugauuccacagagcuccguuucucuacagaaugucucuguucccucucaucaucucuuauuugcagagagcugauuguuacaaagcuuucuccccacccugccaaguagaauuaaaugcuucauuaucccacagcuaccuccuaguguguauuuuagagcaggcauaacaaguagugcagacuggguagguugaaaagcagguacauuuauuauuuuacaguucuggaggauagaaguccaggaacagggugauggcagaguugguuucuucugggcccucucuccauggcuuagaagaugaggucuauauuauuacuaguuauucuuguaucaugccacugaccagaguacccuagagaacaacugaaagaggaaagaggaaaauguauucggguucauuauuucagaagcugcaguccauccugccaugauaagucugguagaacuacaucaugguagucaggaagcagagugucagggauaugcuggcuuuuucuguucuuuucuucucuucagucuggagucccauuccauggauagugccaucuguguccaguguggaucuucucccuuccauuaauucuuucuagaaacacuagcaugacacaucuauauauaugccuugucagucuccuagguacuucuaaauucagucaaguugauaauuaaagcuaaccagacaggaguauaauuuuccccuggucuguccucuaacugugcagauuuuccuucuauaaacauugcagucacuauagcuagagagaugguucauugauuaaaagcucagacuguucuugcagaggaccucaauuccuaguagccauaucagguguaacucuuaacuuguggugauaugaucugauggacaccuacauucauguacacacaaacaaauauguacauaauuaaaaaauaaaacuguaucaggacuauucuacccuuacuguuuuuuuaagacccuauccucaaauagucauguucucaagaugcuaggagaccuauauauuaauuuuuuugcuuguuguuuuuugagacaguggcccucuauguagcccugucuguccuagaacuguauguaggccauacuggcaucauauucacagagaucugccugcuuuugccucucaggaggcagugcugcuaucaaaggcauuuauccucaugcuuggcuucauacuaauuuugagagauauaauuuaacuauaacagucacuaaggcaugaugauccuucaggcuuuugaagguccugaacaauaaaaccagaaaauuugguuucucauugcugaguaccccaaguucuuucuguucuucauaggagaugauggcuuuggggucccuccucaucuugaaacuggaacuuuguuuuauugaggaaggaccauggacugcuugauauggucaauauaauaaccauucuaauguucuaucucacagcaaaaaggcauuuuagugacauuuggaggagggagauacaguguguguugaggaugcagaguuuggguugcagcuaucaccuucacuugccugaguuugagugagcacuaacagaugacuugcaguaugggaugcuagaguaauccuccacuauagcuuuuuucccagcagccuugagcuugaugcugacuggacauuucugacgaaagcaucugugcuuagaguaaagcacacagccacauucacucaccacucuucugccuucuucacagucuucaguuuuagaaaaucuuuggggauaguuauuucaaacaaacaaaugagggcuggagggauggcucagcgguuaagauugcucuuccagagguccugaguucaauuuccagcaaccacaugguggcucacaaccaucuguaaugggauccgaugcccucauacacacaaaauaaaugaaugaaugaaugaauaaauaaauaaauaaaucuuuuuaaaaaagaacaaaugagcgugagguuuguuuuguuguguuuuguuuuaaagucugacugugucaggagaguguagaaguaaguuacugagaauaacuuuuuagugaaauaguuuuaugccagcuuguaguguaguuagguuuuuuuuuuuuaacuuuuuuuuuguuuguuuuguuuuguuuuugaauuaauuuuuuuguuagguauuuuccucauuuacauuuccaaugcuauccaaaaaguccccaacacaccccccccuccccuacccacccacucccacuuuuuggccuuggcguuccccauaguuagguuuaauaccauaaggcuuccacuuuauuuuugggggaauaguuuauugucauuacccaucuucucuauuagacagcauuaaaaggcucuuuguucuucguacuaagggugaaguucagaaaaaaguuuguugaauggcuaaaugaauccucuuauuugccuugugcuuauuuaagcagggauagccuuauguuuuagaagccuaaaugaaguaggaacagcaacauaguuuaggaauuugucugcucucuuccucccaugcuggaaauacaacccagagccuaggcaaagcucagugcuuuaccaccgagcuauacucccauucccuuuugcuguugaauuguguggagcguucauuuaaaaaacaaaacaaaacaaaacaaaacaaaacaaaacaaaacacauggugcuccacugcuaaccugugguuuggaaauccugauugauaguuugaacagucuuucuccccuuauacugucaugagagucaugagauggagugcaacacucuuggaguaacagucuuugaagaugcuuugacugcaccgcccaggauuuccaaauucuagcccuuugaaccccggagcccugauccccacuaccuccagcuguuaggcccccucucuucuggaggccugacaacauuaaaaacaccagcuauuuauagcuuacuuuucagucucaguaaauuauagguugccuuugccagugggaugggacuaacauucaucugcugucgcugacugccuaguagcaucaaccaggugacaggaggugacccccaccugagugcuucugaggucucaccuggugcuauacagaauauuaaggcuuugugaaaugacaugguguuucuaguuagaguccauagucuuugugauggagugguggcaacuuaaaaaaaaaaagaaagaaaaaaaaaaggagagcgaguaagauauauguacucuugagagaggcccaggcugguuucacugccagcuucuaccucauagacuuguuguggcuguguaagugacucaguugguagaggucuuucggaacaugcacagagggccagacaugguggcaaaugacuguaauccuagaacucaggaaaugggaaggcagggaucagaaguugauaagagagguugaauuccuccuuguuacauaaagaguuugaggccagccugggcuucaugagacuuugucucagaagaaaagguggaggaugacuuaauccuccacuagugaacuggaggauguccugugcaauguucauuugggggaggauccucaaaauucaguaacugaagacuauuuuaaaugugggucaaguaaucugugcagugauggauauuaagaguaugggaaggcucugaggaaggcccucaaggccuagagucuccugucagccagauccuggcauaccugacacccggagggguagcccuucuaccagacacuguuuagaaagggauuguuguuagaaggcuguugaagcuguauugccuuauugaugucauaccagaucagacgucagggagcagguuuuguccugguagcuuuuugaucucugcaguucuuagaauggcucagggaaggcucaggcagcaaaagaggucuguguguuuagcuggauuuuccacugaagugcuaacugcugcguuuuuugaccuucuagccgaagaggguauuuauaacuagcuguuuguaugcuuagaggagccuaggcccugccuuucuguagugguuuaagaacugugcccuugguguggucugaaagggcaggccugaugaguguggggacucaugaccugcuccccaugaacuuguucuccuacccuccauccugccaagccagcagcccuuucaggguuaauuucucugcuuugggagcagcuggccaguuuacacuccucccugggcuguacaaaaauacuuccuuugaaguguuaugagaugcggugaaggguaaaaccuggugaagaauaaaaucuggaguggggcucaaaugcacucucucccagggcguuugcugaggaacagauugcuuagccuucaucugaaucucccagguggaguguauccucuccuguaguuugcagcuuugaguuucaguuuuaugcucccacccccauguguucuuuuuucacggagaaauauuucuucccaagaggguuaccaugcagccaccagcuuacuugguagcuggaauugaaggcccuucuucucucugggagugcuccaucccucccagcaggagugaugccuuagaguauacugugaaguucuagugcagccagcccuagcugucauggaucccaccucugguucaggucuaaggcuaguagugcaaaugagcauugaccucagagucagaaauucucacuuuuaccuuggauuucccuuugguaaaauggagucagaugcaaggguguuuguugcaaggaucuguggaaauacugaaguaggggccuugaaaaugccaggcauuuucucuaauguaggccugcuaaggagcagaaauggcauuuaggauaaagaagccaaagagaaugccagagcagaaaugacacagaacaaggcuugaaugucuucuuaaucccugaguauuugcagccgaagagggguugggcaagagcaggaggaaggacagcugcuauguucugaagaagaaugccaaccugcugcuuuccacaaagggggccacacagacuccuucuuaaccugguuugcuguccuuucuucuucugaagauguccucauuggaauucuagcaucuucuuacauggcuuccuauggcucucagacaaggaauaaggcacacagauuuaaaaauaauuccauguggcuagcauuuauugcugauuuuugccauguauuguguuaaacagcagcaugaaugaccucauuuauucuaccccauaacagcucagggcugcuaacuauucuuguccccauuguaugaaugaggauggaaacugaggccagaagaaacaauuugcccaaaguuuuaguuuguuuuuauuuuuugggggggggggguuucaagacaggguuucucuguguagcccuggcuguccuggagcucacuuuguagaccaggcuggccucgaacucagaaauccuccugacucugucucccgagugcugggacuuaaaggcgugcaucaccaugcccagcuuucccaaaguuuuaauuucuacugugcagggguuggcuuuacaacuucacuucuuuggguuuuuguuuuguuuuguuuguuuugagacagaguuucaguauuuagcuguggcuggccuuccagccuccugagugcuaggauuucaagagugugccacacuuuuagcccuuuauucauaauaaaauagaagcuguaauaagugauggugguaagauuucauucugugcuccagacuuguucaggaguuguuuuuaggggaagaaguggaacauugaccucuguucauucaggccauuuugucagguucaucaguuggcuuauugauccauuuguauuugaauaaacacaaaugggaacuaaguuuucuauaggaaugccuuuucucucccucugacucuaguugacuggcuucuuaguugaaggucugaguguuggggguaaagagguagccugugccuucgcuauaagcuuuggccuuaccuuagucuggaaccagaguuugcacguuuuucaaggggguuuagagccuucauugcuccugagggguauggggguuggggugggagugugggggcugggaaagcuagagggauuugcccucccucacacauggggccugacccugggccaggcuggcagguucucaguguacuggccacaugccuccuucccaccugaauuucaaacaggaaaaaagaugaaagggcuagaaaugacaagucuggagcaggaaggcucucauuugcaaacuguuucuuuucaucuucaccccuuuguuucuuuaaacgcacacacagagggacucccccuccugaaacugguagcccaagcauaugacucccucuaguucacugagggcagccacuucuccuuuaagcagggagaccugcucccagugaucuauuuuccuuagggcccugauccccucuucugucugcuguucugcugccagaggucacauucucuuuacagauuucucagagccuuuuacugauggggucuauaccuucauauccuaaauuuucuuggcuguuugcuuugucagucauuuuugcauguguuuagugucaugcagaccucucucaccccagucagugguucuuccaaauauucuuugagcacuuucugcccuucuuucuaggcuauagcugccacuaccaggaagcugucuuggagcucauugcaguaaaguugucucugccaucucugaacuuguaacaaccuugccuggcuacucauuugacauuuaauaauauauuaucuuauguuguuuaauuuauagguauggucuuuuaaucaccuuuagcuguugugaggacauacuuuguuuucuugacccuuucuuuuaguuuguauuaugugcccugccuuuuggcccaugugucugagaucuggccuugaacauaccuaguagugcugucucauguccuuuuccaguuagcagcucucuuugaucuguauguggcaccugagggaagaaccgcacuugcauuccuuucuuuuuggcacuucuuucucuguuauccuccugugucagguguauaucagaggaagugccaauauuguagcucuugauuuaaaaauguagaaacaagcuuagagagguuaggcuacuuacucaagaccaaauaguuaaucauuggagcaaaguugaccuugugguauguagcccaaggaugugccaugccccaugcuggcucccuauguugguguugggaauccacuggcuugucaaguacugcaacauuuaggaaggaguugcaaaguaaagcuuuaccuaccccuccaggggucauuucuaaucuggcuccuacagagccgacuguaggaccuucucccugauguccauucauggauaguucucugcauggaugggcuccccaaaguauauugcugugaagaugugacagugauccccuaugcucuacagggacuguacaggaaaacuggacucaguggacuacauccucuuuauuuuuuacuaacaguacaggauacaguaggaaugccaugacaucuacccucuaccuuccuucaucuagucucaaacuacuaaagaucugugaggaaauuggguguggugcuucauccuuguaauuuuaguacugcugggaggcuaagguaggaggcuuaagagaggaagucuagugccagcuuaugcuucauagugagacugugccuuuaaaaaagauuucaaaggguaaagcuagcagaauuagaggguauagucauuuucaggcucucauuguaggacauauuugcauggauguauauauacuaaagaaaacuguagggcauaagauacagugaaccuccauagagacuucacucaagcaguugucaagccuggcucagcuugucucauuccuguauuauuuugaaguaaagucagccauauauuuuuuccuguuccaguaaagagaaaaaaauauuuugaaaaauaaaaccucacauuggaggucaauguuaauuuagugaugucucuuuccuagagcuauuuuuucuaccucgcuccccuccccccagaaaaugugugcccuucaguacuuagcaggggguggggguggcugauggccauuggccaaugggacucaaccugcaaggcuuggcccuggcccuugugaucaggaucugggauccugccugggcgccuugaugguaucagcuuugcuguaagcgggaaccacaagaucaaaggcuccgaacucugaggugcuucaaagccgccugagcagcucggauugauguggagaaugagagcgcccuacugauguaaucauagccugugagacagguucuccuuuuuuuuuuuuuuaaauuuaaacaaagacuccccuuguuuauuuagcaagguaaagcgggugcugugcagggcacacgugcaguguguguguguguguguguguguguccguccauucuagccugguugguuugugaaggggcagcuaguaguggcuagucugcaggugggcuuggagauuuuccauaaaagacaacuuguuuguguuaggagcaguuaauuuccucccacuuuuuuaggaugcuaagauuuguuccuggguuauauuacuaaaaucuugaaaguaccaucccacaaaggaagauacaggcuucaggccacacuuggugaagcagguagggaaacaggucaaaaagggggaagucuggggaaagcucaucuuucccuccccagaggcuguugggcagaagccuaagcaugugaggauuaaccccuccacauaccugaauaguuuuccagucucuauaaaaacugcugacauuugacauuggcugaucuugcaguguuccuagcuuccaucagucccucuacuuuuaauagauagguacacaaaucuuuuaaacccuguuaaacuaccucuaugaauaaauauccauauuuuguuuucuugccuagugaaucuuacaaaugaccacauagauuaagcaaccuuccaauugauccaggcuggcggaugcugaguucuuucccaagauaccccauaacccccaaucagaguucaaacuugguggaguuucuggcauucuuuaguuugaaucgaagucauagugacugaggucuauuuuuaugucuugcauuggucucaagcagacauauuguauguaaaccauauugcucuucucucuucccaugacuguuucucuuaggauaaccaguguuuguuacuuagauaagaagcggacaaccuucuauuuauccucaaugagguauccuuuuguuuugccucaugcuuucucuguccuuauacauaugaacccuagaaggcaagaaugaaauucauucauucuuucaagccuuccucuuucuucuccauuuuuucuaaauacaaauaaauguuuucccuuaucuucuguauaaacacguuucccaaauauuuuauugugaaaaacacuggaaauaauuucacagcuaccccuuauacauacugacugccauucguguuuuaguuuuacauauuuaccuaugcauacaugauuccaauccccaaccccgagacaggguuucuuuguauaaccugucuugcuuguccuggaauuuauucuguagacuacaauggccuugaacucagagaucuaccugccuccugagucccggaauucaagguauaggucaccacuuauacacaauuuuaauauuuacaacauaaguacuuguguauccagcucagguaugcuuaccuguuccagugacugcagggggguugagggccucuuaaauaaugcuaauaccauuugaauuuguagauuucuccugcccacacacagguugggaguagauaugaagauacuauuucugucuucaaacauucaggggaccccaggaaguugguuacaaagaccaaaggcuaccugguagcuggguugacugucgagguccaguuauucuuaggugucuugccuacccaagugucuggaauaaagcgugccuaugugcaugcugauauuucaugacaaaguuucuguauguagcccuagcuggccuugaacucacagagaucugccugccucagccucgugugcugggauuaaaggugugugccacuaucacuuggcaaguauguauguuuugagacagcaucucucuauguaguucuggcugcccuagaguuugcuguauagaccacgguggccucaaacucacagagaucuuuugugccucuuguuccugaguacugggauuaaaggugaaauccugugccuguccuguguuuuuuguuuuuuguuuuuucuuucuuucuuuucuuuuuuucuuuguguguguuuguuuuccaggaacuuuuaaaaauauguguauaccuguuuugcucaaacauacauacauacauacacacacacacacacacacacacacguauauauauacguauguguguguguguguguguaucaugugcaugccugauacccauaaaguucagacaucauuguuguucccuggaacuggagguagggauaguugugagccaucauugagggugcugggaagccaaccgggaucuucugagucaguggucuuaaucacaaccauccccauuucccccauugugccucuaaaucuuacuuucgguguggacuagagagauugcucaacaguuaaagucuagagagauuguucagugguuagaguguagagagauagcugagugggaaaaagaacugacugcuuuuccagaggacccagguuuaguucccagcacuaaaagcagcucacugccucuuguagcucuaguucuccaaaaucugacacccccuucuggcuuccuugggcacuacgagugcaccuggcaaacacucauauauauauauauauauauauauauauauauaaaaaaguaaaaauuuuaagccgggcaggugugguggugaacaccuuuaaucccaguacucgagagacagaggcagacagauuucugaguuccaggccagccuggucuacaaagugaguuccaggacagccagggcuacacagagaaacccugucucgaaaaaacaacaaacaaacaaaaaauuuuaaaauaauuuuaaaccuggaacuuuuagcaggugugguagcacaguccuaguacuugagagacugggguaggaggauugugcuuuugaggccaggcuagacuaaacaguaaaacccugucucaaaaaccaaaaaguaaccaaggggggaaccccacgaaaacaaaaguagagcauguauuugucugggcacagagacacauccguguagcugugcugcuugggaaacugagcagaugugauggggaucacuguggccugagagucagaggcaccccucagcaucacagcaagacauucuccuuaaaaugauuuguaaaaacagucuuggcagugucucauaugugaaguaauuuuuauuuauuuauuuauuuuugagagaauguuucauguaaucauagcuggacuagaaugcgcagacacaggccugcuucugccuccccuauguugggauuaauaaaaguauaugccaauauaccaccaaucauuuggaaagaaauuuuuguuguuguuuuucuucaagacaggguuucucuguauaacaucccuggcuguucuagaacucauucuguagaccaggcuggccuugaacucauagagauucaccuaccucugccucccaaguauaccaugacacuuuuggaaaguaauuuuuaaaaaguauuuuuguuguacucauaaacagguauauagugcuaaguauaaggaaaaucucccuaguuccuggaaccaugacaaacccaauuaaaugucuuuuuuuuaaucucucuuccuuuuggggugggguggggugggagugagacuggguuucucuauguagcccuggcugucuuggaacuucuuagguagaccaaguuggcuccaaaugccucagauuugucuuccugugccucccaaguugggauuaaaggugugcacuaccauguccagcuuccaucucuuuauaaguacagauuuugacaaacuuuaaaaaauuuuuauuuucauaaccacucaugagauaaguaaagguauuguggaauguaaaaggaaaaaaacaaaaaaccaaaaaaacuggcaagcuguuuucuguuuuauccccaaagcagaaacuauugaagaauuugaguuuuguuaagaacaccaagaauccagcggucuuugaguaauauuugaauauagaagaaaaaggaaaucaacucuuauauuaggcucuucagaagcuauuuguuugugauguuguagaagugucaaguuccuaggagucccuuuuccacaccugccaaggucucccucucaguacuaugcacuuuuaagugaauccaauuugaacaucagaaauuucuagauguugugagccgaaggaucagaacugguuagcagaugacagcaguguccuuuucaugauuuuuauucuuuaggaacagucugguugucggagacuguuaggaucuuuaagugguugaauauuuguaaacaauaauucaauugaagcacagaauaguuuaaaaugauaguuuaaaauuaaaagucuggaagcaggcuuagugguaaccaccuguaaucccagcacuuuggaggcaaauggaagugagguuugaacgaguguccaagcucagauuuuuaggaacaagaccaccgauuugugcuuuuuagaacuuuguauuagccuucaccaugauacaucauuaaaauauacaucuuuuuaaauagaagauccuaaacuuaaaggcaguuauaaaguuaccaggaaccuucuggaauuucaucaguuuucacuuuugagucuucaaaaguuucaguuuguuuagcaauuaaaaggaaaaagguuuggagagcagguaaggaugagggaucaggagauaaagguagugggguuuggcuggaguauuagacagccagaguucuuaccaauucuauaaguuuucuuuucccauauuugaugugcacacuaaguaggugauauugugaagaucagucauuuuagagaaaagucauucagugagccauuuuaauuuuuuaaaaagaaacaguuauuuuacuaagauucuguugccccuuuucuacuguuucucuagcaaguuaaccagagucagagccaagagcuugcaccauuaaacaguuaaauaaaauuuucacaucuguucauaccucaaaggaccuuuuguuaggauucaugauuagagauucagagcuuacuuucaguaaacacaucuuauuuacucuuuauaacuuuuuuucucuuggcucucaagaagagcuagaaucucccaguuuugguccaauaggugaauguauugugaguucuggaguaacccaacggaggcuuacauagaaguuagcuagguggugauggggguccugggauuaguggcccaaaccugucauagguauagcacaaagucugcuguuaaacuaacaugacuguucugauguugcaaaugagaauccaaagagagugcuacccucuuagggaguaccguguaucuacccaauaaucuauccguccgucaugcaguaacacccagcauucugcagugggaaggaguaauguaccaaggaaacuugggucucaggacauuaccauucugggaccagagauugcuaucuaguguuacaggguugaacauauaaaaccuugugauucaggaauaauuaaguuuugguuaaguggcaaaauacagaugaggggccuaugguuagagaaggcaaaaggguaggugagacaugcugagcucaguguuacgcacaguauauaguuuauaugacugcauuaaggacaguguagaucacuggccaggcauguggaaaauacagguguguguggcaccaguagcuaaagcauagcugacauuguaauuuugcuuaaauagaacccauucauggaaucaccagugaaugcuuguuaguagccgaggaugaaagcauagaauccgggaggcuuuauggcucuggacaauggaagagguuauacuuagugggaggcagcccuucccuggcaauggcuuccucauaugcaaacaaugacaucuguaucgcaaaaaggucuuaacaaauucaguuuuuaaaaaacaauaauaaagcuggacauguaacugguuacuucuugguuuugaucagugacccacaugaguugaaggaccugacacuuuguuucccacuaccuuugcagugagugcauggcauccauuuuuacugaugacuuaaucccuguuggcaaguacagaauuucacaguguuagagucuagaacaccuaguaauaacacuaggcccucuuauuaauauacugguaaucugccacuaggucauuacucucauuuugguugguuaguugguugguagguugguuuggaguggggugucauuuagcucagggcuagccuuaaacuugcuauguaccugagauuggccauggauuccaaaucuuccuaucuuuaccucccuagugcugggauuauagauaagugcugcuguuuuaauuaguugguggugauggaaaguuaucucacuuuacaggcuauaguucuuugaggaaagucauggcaggaaaucaaaacaggauuaugaaggcaggaacuggaucagauacaguguaauggugcuuacugccuugcuuuucauagauugcucaauuugcucucuuauaaaacccaggaccaccugcucagagguggcacuaccuaaaugaguuggguccucccacaucaauuauuaauuaagaaaauggcccacaagccuggaaaaugucccuucaguucugggucucuacugcaauugaggcugcacuuuuacuaauggcuccucuggccuuucacgauggacaauaaagcucagcuucccuucaccuugaauuccauauacauuaauccagcagucaggaggcagaggcagguggauccugaguuugaggccagccugcuggucuacauagugaguuccaguacagccagggcuacauaauagagaaccugaauaaaaaauaaaacaacaacaacagaagggagggagaggagaaggaaaaugucccaaguccauagaccguugugauagagacaguuccucaaugaaguuaccuugucucaaauaacucuaguuuguuucaaauugacagaauuaauccaaacaauccugugucaacuugguacacaaacauaucacgauuagaccauaacuuacuuugcuuaucuaaagaucuuguguucauaucacaauauaaaacauaauaaaacucuaauaaaaguccuggucuuuaaaaaauucaaacauuuuuaaaaguuuagucuccuugaaauaaccaaagucucuuaacugaguuucuguauaauggagggagaacaaagcaacuuaaguacuuucuacucuaaaggggaagagccaggucauaaaaccagcuauacuuaaugaaaaccaaaguccagcaguguagcuccaaaucuugcugcucagugccuaagugucugggacuaaacacaaucuuuggggcuccaaagggcuugggcacauccaugcuucuaucugugccuugagaacauacagcuugucuuagagguucaggccagcugcacuccugcugcugucuuuggucaguccacaggccugacaacucuacuaugcugggucuccacugcagcugaggcuucgccuuagccaaaggcauccuggccucugccaguuccaagccucagcuucuuuccaugacuccuucaguucuggcaucucuccugcaacuuaagcugcaccuucaccaacggccccucugaccuuucaugaggaguaccaagucucagcugcuucccaugaccccuucaggucuucaaaaucaagugggagacuuuuauacacuccuguguccugcuacuagcuuuaaaugcagcuguggccuucucuggaccacagcuucugugugcugacccugaggaaauacacuucccagaagauuucaccucagugaugcuggucccuuaauuacagcugauauuucagccccagcucaauagcaguuccugugaaacauggauuuuacuuccuuagauucuuaaugccaaaaaucacacaaauauuccaacaguuuuuguuucccucugaaacgucauaugccagacuuccaucaucuguuuuuucucaguauuaucuuucagauuuucacaacagcucauuaagcucagagcacuggcugcuggcugcuccccguccucccccaacagucuaaaagguauaaaaagaucacagugacauccuacuuucugguaccaauuucugcuccagauugcuuucuguuuugacaguaaaacacugaccaaaagcaaccugggggauguaggauaaaaguuauucagcauacagguuagagucugucauugagggaagacagggcaggaguuugaggcaagaacugaagcagaaaccaugguggaaugcugcugcuuacuggcucacuuccauggcuuauucauuuugcuuucuuauacaacucagaucaccugcccagagauggcaccacccacaguggucugggacucccccaugucaauccgagucaagaaaauguccuacagacaugcccauaggccaguuugguggaggugaguccuuaauugagguucacucuucucaggggacuguaguuugugugaaguugacaaagacuaagcuacauagucaccaugcccaguucuacucaucuuaacccagagaaguuucuccucugcucugcugagaggcggaauugacagaaaugcuucuguaauuggaacccugggguccagcaggccugaccggauccuucaccugggaguuaauggcugccugucauagaauagcuucacuagauacuugcucaucgggaguuucuguagcuuuccucagccuuccuggagagaugcccuuuucuucucucuacucaugccuucuuucuucacucuucauuuauuguaauauaauggagcaaacuagcuaauaauauuaaagcaaagggaugcuagagagcauuaggaugaagcuuuggagggcaugccuauguagugcccaaaucuaccagaguacaccaucuagacauucuaggaugcacacgucccucugguaggaaagcuguauuuuaauaauacuuuguggcuuuaaaaauaucaucuaaauuaaaaaaacaaaggcauucucaguuauacucaagcuuuaccauaaucuucccuuucuauuccuuaauuucucagaggcauuguuggaaucuaaagcuaggaguuguauaaaaguuguuuaaacacaaaucaauugagguuugaguuuuagguguaauuuagauuguuucuaaagcauauccuaaaccugaaugaagucacagcccaaaccugaaugaagucacagcccggugagccgacgacaguuagcuagugcccaauguaacuacuauuaaggaguuaacauuaccucugccauguuuaaacauuaacccaaggguuuccccugucaugucuguuauuaacaaugacuuggaacacuuucuggcagucagcuuuguucuucccuugaagagaugcugggacaggaugagacuagacauuaggccacaacaaaggaagguucuugauuauguccaaaggaacacuggcuuuguguugcauaguuugcucuguuaacauuuugaaccuccugucaaagaccuuucugcccccuguuuaccugggucugggcuagaaagaggaagugauuauuuuauugugaaacagaaaauaguacuuuuucuauugggggcgauaacuugaauuaauugauggacacagugacagugauacuggaguacaauucaaauucagcaaaucacuuagacagucaagugcuuuccacuuaaggaauugggguauugaugcugccuaggcugugcauauuuuggagaguggggaaaggauuuccugcuuuacugcacauguggucauuugguuauuaacaaaaggcugcgugaccuagaagcuuuuuuuaaaauagggcacuggagaaugaacguaggauacaugcuaggcaaggggugugccacugagcuguauucccaguccugccuaagaagaacagagguagugcuuagauuacaaaugggaaggucuuggaggcucugaauagugccucugcuuugcugccuacugcuuuggagcugugguagcaauagcuugucagccuaauaggucccauaaaacuuuagccuguuucuauauagagugccuuggaguggccauuucucugccucuuguuuacucucagaaaccccuuggaaaaagagcugaugaggugcaucgagacuuggcauaaaaagccauucauggaggccuagagagauggcucagugguuaagagcacugacugcucuuccaaagguccugaguucaauucucagcaaccacaugguggcauauaaccaucuguaauaggaucuuaugcccucuucugguuugucuggagacagugccaguguacucacauacauaauguaaacaaauaaaucuuuaaaaaaaaaaaaaaagccauucauggguaguuuuaauucagcccuccugaacucuuguucuuuuuuuuuuuuuaagauuuauuuauuuauuacauguaaguacacuguagcugucuucaaacacuccagaagagggcgccagaucucauuacgggugguugugaaccaccauguguuugcugggauuugaacucaggaccuucggaagagcagucaaugcucuuaaaugcugagccaucucucuagcccgaacucuuguucuuaauuuuucuuucuucuucuucuuuuuuuuuuuuuuuguaaauugcuuuagagaauugcccguguaauuccagaaggcaugcuuauuaaaaucuaaauagugaguaauauauaggagcccgcuguccaauuuuucuuagcagcagauacacuaaagccaccugggauuugguuuuugcauuucagagcacuuguggcuacauucuuaugcuucugcauggacagacuguccugugcacguguuaaaagacauggcggucugggccuccuuggauacgagugcuuuaaaauacacuacaacaaaaccuuaugauucagacugugaggcaggacaugcuucuaagcacgugugggagaauggcauuaacaugguuucuuugagacaagguuucacucuguaguccugggacucuccaaucugacggugguggcugccaucccacagagcuccaccugucucugccuccugcguguugggauuaagggugugcuaccaugaacagcuuaagcaacauuuacuuuaagcccccaguuucucuuccagaagcuucagauauugucccacuuucuggacauggauuucaugaucuugauuuuuugucccgugauuuuuuuuuaaauaggacuuuuuugguauagaauuucuguauugcucaauucccucaaaccugucuuugucuggauguaccacuguggauauucuaaucagaugguuugguucccuccagcucuguagauucauaaagccccucugcacaggcuugaagucuugcucuucaucacuuuuauuuucucauuuuucguucuuuaccugaacuauacugaccggccuucucucccugggucacagcugcauucugucuuucuacaucugggaacuaggcugucugucugcuguugagugcugugugcaugaaguauucaaacugcuaacaccaacacuccauguccuucaagauuuguuaguuuuuguuuuuauuuguuuguuuauuuuguuguuguuuguuuuuugagacaauuucucuguguagccuuggcuguccuagaacuugcucuguagaccaggcuggccucaaaccucuccucccaagcacuggcauugaaggcaugaagccuggcuugguuuguugguuuuuaacuucucauagcuucauaaaaugauauuccacaguuagucugcaacuucaccagcaaugaagagcucucagcauuugcaaagcgacuccucacacaacugcuaaguacccaagggaaagagagggaagugucugguuuugcuucagagagcucugccuauauuuguuguccuucaccauuaaugaggaaucugaacuggagcccccaccugccaucuuuucuggugcuaucuucaguggaagggggagcucaguaaguacuauguggauacacagcugaugcaauuuagaaagcuagucgcuguucucuagguacagaugucacaugucagucacucccagguaucuucccuuucauucaccuugaaguauuucuuaggugucucuguucauugaugcugccagacucaugagaaggucuuuaauucauaggucuugguuuacuguauagcugaaagaccugaccucauucagucaccacccagaccagaccaacccccacuagucuuucuggcuugggugaucucauccaugguaguugugaccaucuuacccauccaacgugauacccuaguauauaguuucuuaucauuucaacuuuccuacucuuguuuagaaguucaucaacagcccugugguagaacaccuaagucccucuguaccuggacgguggccccuguuccuugggcucagaaaaguccccagaauagcuguauugucucaagagguuuacucugacugguucacaccuucuccuuucccaacccagcaagucucugcucuagccagucauaagaaggaauaaauugauugguuauaagguagauauuucuagaaguugcauuucuuuuucucuuuuccauagcaugugcaaaguuucauuaauggacaaaagcauccucuugguacuuggaaaaguauagaacauucucucaaaauugaguugaggggaaaaaaaccccagcaaccauggguuuucuacccucugcaguagucagucugaggaugauucuggugggcuuuaaauacuccagcuacaaaacaggcuugaaggaggccacaggaggucaucuccaaagcauggcccacugccucguuccucccagcuguacuaucuacaaguuugggaguuuccagguuuuaaacuguuacaccucagcuagugcuguuaauuucaaacugagacuagaugccauucauuuggagaugaagaucaaaaucugccaauggacuugucuuuugcguaacuuuuuuuuuuuuuuuuuuugaaaaaaagaaaaaacccaaauggcaaacuugauucagccaugucucugcaggcauuccagaaguuccuccuaagcugguuuggguuugggagguagacagagcugcuaggucacuaagcuugagaauugcugugccugguauauaccauguuugggcauguggugacucuuaaauccaucagcacacugaccccuuuucccagcuucauuguucuauuguuuugacugugaaagugacacuuguuacaaaaccaguuucuaugauguaggacacuauucucuagcuuucucguacaucagaaucaucuggccccaccucuugggaggcugauucaguagcucugggguggggccugagaauuugcauuucugacaaguucccagcugcugcugcugaccuggcauucucccugugaugcagagggacaaggaaauaaacaucauuuuuuaauguucauauucagaggaagcaauuguuaacaucuuaagguauauauuccaauauagacauacuuuuauaaaacaauggucugugcuguacacaguauuacuuuuuuacacaacuauuuuauuuugggggcaguuuagauuuauaggaaacuugugauacagaacagauaaccuaugcccuauuucuguucuuaguacgcagauccaucuuauuuggggauauacuuuuuuuguuucauuuuguuuuguuucuguuuuuuuuuuugaaacagggucuuuauguagucuuggcuguccuggaacucucuguagaccagauuggccuugaacucacagagauccaccugccucuaccucccaagugcugggauuaaagguguaugcauuuagcucaggucuaguuccuaguauuaguuuccauccuguacaguagcaacuguuacagagccuuuacauuagaacuauaaagaaucuaaagacaaguguacuuuuuuuaacucuaauuuuuuuccuuaucagcaccucuggauuugcuucacuguuuuuuaaagggcagugcacaugguuuugcuugcuuguuuguuuuguuuuuguuuuuuacccuuuuaaauuuuaauacaucuuaucuauuuucauaucuuuuuauuuauuguaaaucuagcagaugaaagguagggauagucacaugucccuuuuaucuuauauuggagauuagagauuauuuccuggccucuguggaggucuuagcauauucuagacacugccaaccacuuaacauauuaucucaaucauuuaucaaacaauccuaagaaauugguaucauuauuuuccuguuaacagaagaggguuagggagguuaauggaguaaacgcucugccggcuuucuucuuugacacuucggggguugugaucagaauacaguacagcggagugugcacuuugcuuguuuguucagcuucccagugccauccuuaugcugcuuuaggaaggggaagaguauccuugaacuccaguuuacuucagacgugaaauacauagaaaaauaagaauguaccuuuaaguacuuuauggagcuggagauacaacuaaguuguagagccuuguugagcucauggguucauucucaguacucuaggauggagaaagcauuaugugaaagaccgugagucguaagagcuugcaaagccuucaaaaguccuuugaaggauaagguauacaugugcagcuucgauggugcagcugagguucacaugcucacagugauuauagauaaacccaugauaagucggaaauaucauaagcugaaacuacacagaacacacacagaugauuccuacuuagcaacacagcacacaguagggucuuugccauugcuuagccucuuuggagaguuuuguacugaauuaucaacagcuuaggaaaaaaaauccagauucaaaauuuggggauuuauacccaauauauauauauauaugacuuucaugcuguuguaaagucagcacucagccauuagacuuggaaaugagacccauauugaaauucuguguguuacugugugcuuguucauguguaucugggugcauguagaagccagaggacaaccugagauaucauucaucccucuuuagaagcugcuguugggccgggcagugguggcgcacgccuuuaaucccagcacucgggaggcagaggcaggcagauuucugaguuggaggccagccuggucuacagagugaccaggacagccagggcuacacagagaaacccugucucaaaaaccaaaggagaaaaaaaaaaaaaagaagaagcugcuguuggacagguuaauggaugauaccaacuguguuugucagacagguucagacauuacuugaguggguuuuuuuguuuguuuguuuuguuguuguuguuguuguugguggugguuuuuuuuugguuuuucgagacaggguuucucuguguagcccuggcuguccuggaacucacucuguagagccugccucugccucccuagugcugggauuaaaugagugcgccaccaagcccggcgccuugaguguuuuaaaccaauguuuggaggugcuuuuagaaucuuguguuggugacaagguauugauacuugugacucaccauccucugcggcugcugccuacucuccccuuuccagcucacuccucagcugucuucauugucuuggaacucuguguagaccuggcuagccuugaacucaccugccucuccuccuaaguucugaaaggcuuauacaaccacacugggcuggcuuuucuaugcuuuucuaugagucucuuguuggccuggaacuugccagguagguuaggcuggcuagcagagagcuccugugaugcaacugucucugccucuccggugcugaaauuaaaaguuuguuucaucacuugggacuuuuaaaacuauuuccauucuuugagaauuucaugccaugaucuuuacaaaguuuucuaaugaguauuuuaaagagucuaucuugugaguauuauggguuggguuuauguagcccaaacucugauccuccugccucugccucucuaguguugggauuacagaugcuugguaccaugccccaguauauaauagcaauaguuaaauaaguuugguuuggagagaugacucagcaguuaagaucauguacugcucuuguaauugacuccaguucaauucccagcacucauguuggauggcuuauaaucaucuguaacuccggccucagcaggaucuaauaaugccucuugugcaccuguacuucuaggcaccugcacucaaacauacauacaacuacauauaauuuuuaaaaaaacuuuaaaauaccaaauaaauuuaaauccagaacuaacauucugccccauauguaaaaauaaaugguauguuuaguguaaaugcaguaucugcuacauugauuacuaagugaagagcuugccuuuuaaaguucucgaaaccaaauccagaagccauccugagaacuucuguccuuaucuuuggucuuuaaagcauccucucaauggauucauacccuccaaccccauauuuaucguguucuguucacauugacucuccucugcagcuacaauuucauggagcuaagaucugugccuuuugacccuguguccccuaaacuucaguuauagaaacagauguuagagaauuggcucaagucauguauggcagguugagauuaaauaugauaguuuuguaagguuuuuuuuuuuuuaacuucugucuuuuucccuuugguuuuaaaagcauuagccuuugccacccaaccuugagcuuuuaacauuuugucauugaacauuuuguugaacaagauuuuuuuuuaaugaauuauacuugauauaugaacauucuucauuauaaguugucuuguccuuagcucuuuuucugugaaggaagauuuauguugauauuucucucacuacuuagaaaagcagaacgcaaccuuagcaggccugagccuuguauaaccagggcauuuuuuuguuuguuuguuuguuuuuuaaccagccugccauagguuagauaaauacuuuucuugcucuuugccguuucugcucauguuuggagcagagugcuuucccacagggaugcuaugucagcuaugcugggagauuacuauaaagaaacuugcugaagaugggguagguagaagaguuaaaugaccauuucuucacuauguaaugacuugggaaaguuugcaaauuuguccuaggaagacugguguucaugggaagugccuugucagucucaccuguccacgagugugauaguguuauuguccuccuccuccuuuuggaaguuagaugagucuguagagcuugugaaaacccacucuccuaaguuugagcagcaggacucucaguuuugauagacguugagagccacacugggguuguuuuguuuguuucuuuuuuuuuuuuuuuuuuuuuuuuuuuuuuuuaaggcaguugcucuccuuugagagagccaacuauucagaaaacuuaaucacagggucuucuuccauucagacuuaaucuggucauucagaggccccugccuucuuccccuuuagaggcugcuggcaccugacccagggccaccaaggucuuccucuuaggacuucagaaggcucccaggacaggaacaagcacuucauucuuuggauggggaguuugucugagucuucuaaaauuuaucucugguugugcacuguuacuagcagggauuuacucuugaaaaaaaaaaaguuaccauugcagaagccuuugaugguuuuagccaaaaauuuaaauaaaaagaaccaaccuguaaugggacugauacuacugagauuguucauuuuauggacaguuguuccuuuucaggcauuugacucacccucaugacccucaugacccccacccccaaugucuucgguucuccagcauucgaccacagaagugaaaggcccuuagguggucugucgucaugguaauaaacacaacauuucuccccucuuuucuguucucugauauuaaggcaacaguauauauaguaggcuucuuagcagucuugucgcuguagaaaagauuagcuugagauggugagcagacagugguggcuacaauuagggaagaaaaucagaagucacuugaauguugcgugagcaguagcuauuuauuagcuacauggcaccaagcaauauggaguaaugccaauuuauguugauauggacugagagguauuucuuuauugcuuuuuauuuuaaaaaucaaauuuuagcucucuuuuaauugacagugcugaaauuuuauacgggcuauuuuaaccucaucacacugauaaaauaagauuguuuguuuguuuguuuugagacagagucucacuuugaagcugcagcugaccuagaauucacagaggucugccugccuguuucuagcucccaauugaugguauuaaaggugugugccaccaugccuggcaagauuguuuucuaaauuacauguuuagucuuuugugcuuggcugaggacagucagucauugagaaaaacucuuugccaauugaacaagucauuaaaguuuuguuuuuaaccuagggcauuuuaaguucacagaauaugaugaagacagguccauugauacaaaaagaugucuuaagucuugaguuccaggacagccagggcuauacagagaaacccugucuugaaaaaaacaaacaaacaaacaaacaaaaaaacccaaaaagucuuuaacuucuaaguguuuaaauugaaauaaacaauccaggccauuuagcuuugccccuacauggaacauugggcucugguguacucucuagucugucucacuuuuuuuuuuuuuuuuuuuaaaaacguauaugaguacacggucucucucuucagacacaccagaagagauuauuguaucccauuacagaugguugugagccaccaugugguugcugggaauugaacucaggaucucuggaagagcagucagugcuuuuaacugcucagccaucucugcagccccucuagucugugauucaggcacugcuucugaccagacguuacucucugauggucugagcaccuuuucagcagagcucagcagcagcuaucgauguguaguagaugcagggagcuagagccaaggcugguuaacaucuaacuguauauaauagagacaaggaacuggaucaaagcacacagcagugucuaccugucuauagccugacuucuauugugaugauuuccuaaaagcuauaggugggcagguuuuuuuguuugggggggagguaagagaaaagcccaguacuuucaaagaagcuauuuaauagcaaccauaaggugagcaagaagaucaacucuuaaagauuuauuucugugaguacauuaucgcuuuccucagacacaccggaagagggcauuggaucccguuacagaugguugugaaccaccaugugguugcugggaauugaacucaggacuucuggaaaaacaguccgugcucuuaacugcugagccaucucuacauuaggccccuccuucccuuuuuucuuuccuccuccccuuuuuugaggauucucuguuuagcuccagcugucuuagaacuugcucuguagaucaggcuggcuuuaaacucagagauucccugauugcugggauuaaaggcaugcacuaccacugccuugcugaagaccaguuuuuaaacucuccuucugauaccuaagucuuagaguuguagcuggcccuuagaagggguuguuucucaagaguuggggagauuggccucuugauaagucggugaucccaagccuuugguuuuucuucagggugagggaaugguacuauucaguuccuagaggccaguguuauaugaagaucucaaaugugaaagggaauauuugagguacccacuuaggggcuguggacucuuaucucuuuuacuuggaaaaacaaaagcagcuucagauuccucucagauucaugcacuuagauaaguacauuuccaugagccagcaucaggaaggggcauuuuagacuaaaaauugugagcauuuucauuaagagauggucauauuuguucugguauauucucaaagcuuuuccuuuccuuguaucacuaguguuugcuuuuuccauagcuaugaccuuucucuaaccaucucagguuugcuggaagauuuggguaguucuuuaaaaggcauuuucaggaaauguuaguuuuuguuuuuguuuuuaaggcuuuuuuuucuuucuaguuucuucuuguugaacaguacgaaacuaccagguuuaauguuccacagggcagcugcugaguguguuuccccuccuccucuucuuccucagucccugccccuuccugcuccacuccgaagggaacuguaccuuugugguucuucugcagcugcuggacuuugauggggacaugcuugcagccucuauacuugcuucccuuagcaaccaguccuuugacgaugaccucuugcuguuugccuguugucucucauguuggauuauagaugggagguuuaccaagcuggggguaggggccugccauuagugcauuuagucuaggguucccagugucccucaguauggauuuuuuucugucuaaaauuggagguuugggagagggaaggagagaguagaagagagagaaagcagcucccuucauguuccccccauaagcuuuauguuugcaggcuaguccuaguuaauuuggaaacagaugcugcagugguuguuaaaacuacuuaauugccuucucaucuuucuaauagcgugauuaacauaaguaagaggagaagggaauaccacuuguuuucuuuuauucuuuccaaggucugcaugcuggcaguaaacuugcuuucuguuguaaucugaggucugggaauugcuaaauugccuaaaucuuuauauacuguaacaucucuauuuuccccaaaacaucaucuuugcguuuuuuuuuuuuuuuuuuuuuuuuaauugggaaucccaugguucuccccugaaugcccuugugcuagggacuaugugcuggggaaauuuuugcauuuggcuucaacugaguauucuugccuuggacaagauagggacauuaggacuuugugaaacagcgaggauuccaaaagaacccaggguuauaauuuuuuagaagaagucuuaaaaaaaaaccaacaaaccaaacuauccaaauauuaaaggcuacaagaaaaguuucauuagaagauagaagaaaacagguucccauaauuugugcacugcugcugguggagaaacucaaguacuccuauuccuggaccaacaccuuuucuucugggaauuuacucuaagaaaagaaaauuaaaacuccuaauuuuguuuaacuaggaaauaaggggaaaaccccugugugauacauauaaaaggguuccuuugguagaggguguuuaaugauuucauuuucuuuaucuuacagaugguacuuuuauaagcugagaacauucauuugaauugauucuguuugucccacaaagcauuaugagaaaguuuuuuuaaaucuaaaguuaaaugcuuacuuaauaggugauuuguacaaauaaauaccucuguucauuuuguuguugauaauugcuaauuaccaaaauuugauaccuacauuugcuuuaaaaaaaaaguagccuaggcuagcuuugaacucccucuggaguauaaccuuacauuucuuucuuccugcuucuaccuccuaagugcugggauuacagauauauaggcauguaucacuaugccugauuuaaugucguucugaggacugaaccuaguguacacuagauaaagcagucugcuaagugaacuaccaucuacagcccugacuuugcuuuuuacaaguuaaagccacuaucauucuuugagugaaaagaaugucacucaaagaaugacaguggcuuuaacuugcauuuuacucuauuccuuagcaguuuucuguaucaccuuccugagaucaugcagugguaccagaugucagguguuugaaccagguguaaugacaaagucuaggaggucuggcuaaagguggaugagaauagugguggacuugggagcuagucuauuuguuauugaaauaauucugauaccugaauuuggauuucaaggcauuagagggaugagaaaaggauucaggaaauuucaguuguggugguagcuacugagggcuaaagucugugcuguauguuaagaugcacuugguuauaaaguugauugaguucagagauucugcagcugugaaacccugagcucagccuuuugguucuuuggaacucauugucaccagccauuugagaaaucuguaaagcuggaaaagaugagauauucucagacauguggaaguugagaguucaagucagagcacugggauauggauaaacuacaggacaugcuucuucuguuggguucaguauuuuguguugauguacaugugguuuaugugugugguauaugugcuuuauaggaggguacaugagugugugcauguggaggccagaggacaguguuagaugucuucuuccauugcucccuaccauagucccuugaaggagguccauuacugaacuuaggacuccccauuuuuucagguuggcuggccaguaagucccagcugucuucccuaguacugggguugcagaugcuugcagccaugccggcuuauuaugugggugcuagaaaucugaacucagguucucaugcuugggcagaaaacccuguuaccuacccagugagccaacucacgacuggcuguucaauuccaacaguuuugaaagaugaacaagguuagaguuggcucuuuuugagaguuuuuaaaaaucauccuauagagccgggcagugguggcgcacgccuuuaaucccagcacuugagaggcagaggcaggcagauuucugaguucgaggcuagccuggucuacagagugaguuccaggauagccagggcuacccaggaaacccugucucgaaaacaaaagaaaaaaaaaaaaagaaaagaaauuagggucucacauauauugggcauaggcccugccagaacuuccucuaaucccuucguuuuauuuuuauguacaaagcauuaauggcuaucaacucaaauaaaaccucaaaauaccaacaguauucuaaaguuuaaagaaggggguauggauauauccagugucgcagaaacugcggucguacuugccugucaacccagacugagaagucagggauaaggagaccaauacuucaaggucauccuuggcuacauaacaaacuggggccaagguaugagacacuuuuucaagaaaaauaauuugaggcaggugugguggugcacgucuuuaaucccagcacuugggagacagaggcaggcagauuucugaguucgaggccagccuggucuauagagugaguuccaggacagccagggcuacacagagaaacccugucucgaaaaaccaagaaaacaaaaccaaaaacaaaaaacauucuacaguaauuucauacaugaauaaaauguauauagaucguauucaccaccuccaacuccuucugaacacacccacaugcugacucacagauuucagucauugcugcccauaugcaggaguucauauuuuuuuaacacuuguacuuggauuccuguaaauaaacgccugagaacaauauuuuuuuacuagucccuuguuaucaaacauugauugcugauuacuauuaaacuguggauauuccuuauucuugguuacaagguuaggcgaggaauuucuacuucauauagagucacauuuugagcaguuggcauaccuuuucaauguggcuggcuauaccauuugauguuccugucagcaagaugucuccauuaacuaaucuuucucuuuuuuuaaaucaugauuuuuuaaaaaauguauauaaguguuuguaaaagucucuagagcugggguuauagauggcuaugagccaccaugcuauugcuggaaauggaaccugguucucuuguuacaguauuaagugguucucuuaacuacugaaaccucuauccagccccugugauuuaucguuuaaaacagauuuuaagggcuggaugugguggcacacucuaauccagcauucuggaaggcagaagcgggcagauuugaguucaaacccagccaauucuacaaagccaggcauguuacacagagagacugucucaaacaagcaaaaccaaaaaaugaagaagaaaacaaaaccccagauuuuaacuuuuaguuauaguauuaugauuuuuuucaguguaggguguaugcauguggaugcaauuacugacaggccagagaaggaaggccuccaauuccuuuaguucuagagcuucuaggugugcugcuaguguaugcugucucuaguuucuuuuuggaggcacucagggcuuugaguuuuccucuucggccugccuucauugugucccauaaguuuggguauguuguggcuucauuuucauuaaacucuaaaaagucuuuaauuucuuucuuuauuucaucuuugaccaaggaaucauugaguugaguguuguucaguuuccacgugaauguuggcuuucuauuuuguuuucuauuuuguuguuauugaagaucagccuuaguccauggugaucagauaggaugcaugggauaauuucaauauuuuuguaucuguugaggccuguuuugugaccaauuuuauggucaacuuuggaggagguaccauguggcacugagaagguauauccuuuuguuuuaggauaaaauguucuguagauaucaauuaaauccauuuguuucauaacuucuguuaguguccaugugucucuauuuaauuucuguuuccagggucuguccauggugagugugggguauugaagucuuccacuauuauugugugaggugcaauguaugcuuugagcuuuacuaaagugucuuuaaugaauguggcugcccuuguauuuggagcauagauauucagaauugagaguucaucuugguagauuuuaucuuugaugaguaugaagugccccuccuugucuuuuuugauaacuuuggguuggaagucaauuuuauuugauauagaauggcuacucuagcuuguuucuuuggaccauuugcuuggaaaauuguuuuccagccuuucacuacuuugagguagugucuguccuuuucccugagguggguuuccuguaagcaacaaaauguuggguccuguuuguguagccaguuuuaguuuauuagucuaugucuuuuuauuggggaauugaguucauugauauuaagagaaauuaaagaaaaauaauuguuacuucauguuauuuuuguuguuaguugguguucuguucuugcagcugucuucuuuuagguuuguugaaggauuauuuucuugcuuuuucuaggguauaguuuccauccuuguguugguguuuucccuuuauuauccuuugaagggcuggauucucagaaagauauugugugaauuugguuuuaucauuaaauacuuugguuucuccaucuaugguaauugagaguuuugcuggguauaguagccugggcuggcauuuguuuucucuuagggucuguauaacaucuguccaggauccucuggcuuucagagucucuggugagaagucugguguaauucucauagucugguguaauucucauauucgccuuuauauguuacuugaccuuuuucccuuacucuuuuaauauucuaucuuuauuuaguacauuuguugucugauuauuaugugucgggaggaauuuauuuucuggucagucuauuuggaguucuguagacuucuuauauguucaugggcaucucuuucuuuagguuugggaaguuuucauaauuuuguugaagauauuugcuggcccuuuaaguugaaaaucuucauucucaucuacuccuauuauccguaguuuuggucuucucauuguguccuggauuuccuggauguuuugagucaggaucuuuuugcauuuugcauuuccuuugauuguugugcccauguucucuauguaaucuucugcaccugagauuuucucuucccucucuuguauucuguugcugaugcucgcaucugugguuccacuuugucucacuuuggguuuucuuuauuauuucuacuucccuuuuuaggucuuguauguuuuuguucaauuucaucaccuguuugguuguguuuuccuguauuucuuuuuuuuuuuuuaagauuuauuuauuuauuacauguaaguacacuguagcuguccucagacaucccagaagagggcaucagaccucauuacggaugguugugagccaucaugugguugcugggauuugaacucaaaaccuucggaagagcagucggugcucuuaaccacugagccaucucuccagccccuuuccuguauuucuuuaaggacuaauaccucuuuagcaguguccuccuguauuucuuuaaugaguuauuaaaguccuucuugauguccucuaccaacaucacgauauaugauuuuaaauccaagucuugcuuuucugaguguguugggguauccaggacuggcugaggugggagugcugcguucugaugauggugaguggucuuggauucuguuaguaagauucuuacguuugccuuuugccaucugguaaucucuggaguuaguuguuauaguugucucugguuggagcuuguuccucccaugauucuguuagccugucagcagaccugggugggagucugucucucuccugagucucaguggucagaguacucucugcaggcaagcucuccucuugcagggaaggugcacagauaucuggcauucgcaccugccuccuggcugaagaugaaagcccaaaacagggccugucccagaagcuguguagcuucuguauucugcacucuuaccuccgcagacuagucucugagggaucugggacccaagauggcucucccaggugcuccaauuuuuuucuuuuaauuguaugugcauuaguguuuugccugcauguaugucuauuaugagaguccucuggaauaggaguugcagacaguuguuagcugcuaugugagugcugggaguugaaccuggauccuuuggaagagcagccagugcucuuaacugcugaguugucucuccacucccccacccccaccccuaguauauauacucaacucccuagccuuuucuccaguaccacccuucccacuucgauuaucuuucugauguuagccauucaguaguagaugcagaauaguaucuucauuauagaagauaauuguuguuauuguucauuuguuuuucuuuuuucuuuuucucuucucuuuucuuuucuuuucuuuccuuuuuucuuuuuccuuuuuucuuuuuucuuuuuuuccccaagacaggguuucucuguguagcccuggcuguccuggaacccacuuuguagaccaggcuggccucaaacucagaaaucaccugccucuaccucccaagugcugggaucaaaggcgugcgccaccacacccagcucccuaaacuacuuuuuauuugaaaauuuaucacuggaaauaaaauuuuaaauuaaauuucuugacguuaugggcauucuuuauucauuggagaaaaugucuguccuauaccuaccuaaaucuaucugcccuauaauuaucaauauaucugagauuuaaucauacuugucagguauucuuucuuuuuuuuuuagauuuauuuauuuauuauauguaaguacccuguagcugucuucagacacuccagaagagggagucagaucuuguuacagaugguugugagccaccaugugguugcugggauuugaacuccggaccuucggaagagcaguugggugcucuuacccacugagccaucucaccagcccagguauucuuuuaaguaaaauguagucucuaaaaaauuggcuaguuuaacuugcgacucaaaaucacacaauuugaaauagcugucaaguuucauuauaaaucagaaguaguauuacuuacauuuugucauacaauaugaaaacaagggauuagaaagaugccucagucaguuaaaaugcaugacaggcaggcacaaggaccugaguuugaguccauagaaaagccagguauggucaugaguaucugugacucuagcacugugggcuuggaggugagaagggaacucccuggaacucucuggcuagcuaaucuaaccaguuagugaacccugggucaaaagaugagagugacagugacagacauccuacauugaacuccugccucuaccuguaugugugugugcaugcauacauaugcauauguuacacccaaaagaaacaguaugaaaacaagugaguuccauugggauguauaaaaucucaguaucgcuuuaccaacauucauuagaaaaugucacuugcauguguauaguuaaaagugaagugugguaacacuacacuaauuucauucagcuuuuuucuuuguugcuuagaauaaaugccaccaacauauaaaaggcaaauguugucuuuguauucugacaaaaaccguuuugccuuuacauuuuaccugaagagauugaagcaguucaccuuacagauuggauuuugagaauugauggccuaggaaguauuuaauggaauuguggcuaauguguuaaaagcacuugcugcuucgagacugguaaccuaaccuuuuaaauauccaauuuccuuaccuucucagaauuuaaaaucacaaugcuauuccuguugaagcuuuaaggaaaaauaaaauguuuucccaguuucuucuuuauuucucuuugugcuuuaaauuugcaaagguuguggcccauaagaaucuucuuccaugucuuugucuuaggacacuccucacacuaagaaacuuuggaguguauaguucagguccaggcuaguggcuggcaaugacccguuccuugcuauguaaauccucacugaauggcaugagacuccaacuuagcaauucauggaauuguaaggugagcccaguuucccagccaauuaugacuccaucugaagccguagcugggccauuaguguauuuugcaccucaaccucuuuuauaucuugccaggcuuuuagagucuacuguauagcuacuggcaacaggccacugccaaaacaguccagaaauguauuguuuaacaacugauuugucuuuguuucccucugagguggcacuuugccuguguuucucucauccacauauuuucacccacuuuaaaaaauuauuuauccaccuuauuccuucaucaugacauuagaggucugacuucuguaguuacuuauuugaaagacguguuaaaaaaugaaaauaaaugcuaaugucuucgccaccccacccccucgaaaauuuuuuuugugaguuaaaacccuagcaggagggcuggagagauggcucagauguucuucagaggaccugaguucaauucccagcaacuacauuguggcucacaaccaucuauaacgggauuggauaccuucugguuuguuugaagaugguggcaguguacucauauacauaaaauaaaugucuuuaaaagcaaacaaacaaauaaacccuaacaugaagugccacagaauaugacuauguuuggagucagagucuacauaaaagggcuaauguagguacuauaagguuaauagaguccuaauucauuauggguaguauccuuuaaaaaaggauaggauuuggacagacacauggucagggagaaccucuggugaauagugacuggugauguagccaagaaucauucauaguugccagcaagccgcuagaagcugaggaagcauggaaguugucucuguagugcucagaaggaaucagcccaugcugauacuuugacuuuaggcuuuuaaaauuuuagaugguaaguuucagugauguaagcuacucaguuuguacuacuguauucuacagccaugagaaaugacuauuggcucaaugccgacugcugucugucauggucccaugcuuucaguuacugugauacuuuguuucauaaagcuacuucauuguuucccagggugaccugugccacugucacacaagguucuuucuuagagugauacucuguauauggucacauugaugaagaaugugaccauugaaggugaugauucuagaaggaugcuggagaauguugaugggcccagagacaagugacugugugugucagcguccaucuuucuucuugcucugcacugguccuggucagaaauguugaacuugacuggccuccaccugcuucccuuuccugggaccacagagccuugacccugcauggggcuaucuggcuauauuuucuccaagugcuuucaccaugguauccuucuguggguucccagcugacugacaauuucaaccacacagcugggaaaggcagccaagaaaagcgagcugcuggaaugcuuagggccccgaaacauuacccuucgugguaguuugguucgugccaggauguccuuguaaaacuuuuaugaagauguuguuguacuuacaugggagguuggagauugcuguuaaccuuggugagucccuugucccccaggaaugcagggcacugaagaaauguuuguggcccucccuucuggaugggcacucuauuacgcagcugccuaugcagaaaguugagcuggauggauggauuaagggacaucagcuaggccuuuguuuaaaaauauuuaaaauauguuugaaccucucuuuaucaacagaacagcuccuuucaguguagacaaguuuuuuauuuccauguuuuuucacgauuuuguuugguucuuuuguauauuagugacuuugggaaaguauucccauucacaguuuugagccccaaacacaaaggcauugcauaguuguucugcuuugcuugagggaaaagagcagucuauuuccauuaagaguguuugugaacacucaagucucuggcuugaguuaauuuuuucuggugugaacuuuggcagugaaaauuaagaacauguuugagaauguaacauuuguauguacauaauugcucugaguuaggaauugaugaacuauauuaguuacaagaaugagguuuggaaguucaaagaaauaaaaauaaaagagguucuuacauguuuggauuuuuuuugguaggacugcuacaguuauuaacccacucagacagugucuuagguaucaaacaagaauagugaaguguaaugguauugagguucucuuagccuuccuccuugaugaucauaguguaggucagguuucugcucaacuucagauugucuuuggucaucuucccaguauuauuagaaaccugagcuacuucugcauacauguaggagggaccagcauguugcacaacuccaguggccccauucaucauugagugcucagaguagaccuuggcaucaagggcgucggguaguguguaguccugcacagugauacuaacaggaaaggacugguggguggaggacccuguuuguuuggucaacuaauauguaauuauucuuagaaaccaguccuagccacgucccugcuguucuguccauaagccagaucauucaucuuagggaguauuuguccacuucuggcuuagagcucuauucuagcagccacaggcacagagccacugcaggcaacaggaacaaagcuacagcccgagagaggucagucuggagacuucauugacucugaagauuguuauaaaaaccauaggcuagcccugacacugaguaaagcauguguuccuguuuuuuuuuuccuucugccccuccccccaaagauuggaauaucaaugagaaagaugaagagagcuuuaaguuaagcauucuagaauauuucaaaagcuucaaggcucugagauaagcuuuagugauguguacuaaugaccaguaugccacuauauccuaaaaggauaauuuuucugcagccugucauuaaucagacucuugacuaauggcacuuagauguguugaauuuuccauucuugaaagucagaauugguaaaauauugacucuuguggauguacauagaguaguuuagaaaaacagggaucuggggcccacauauuuauacuuugcuggaauucuuauuuguuacuuguucaugacucuaggcaggucacucaccuucaugcuauuuaguguauuacucugaaacuggcaauguuggugguuacaugacauagguuuguuuuaaagaugaaauaugccucauauaaaauggauccauauccaaccuaguacauaacucaauauggccaccacugggacagaugcaguuucuuccauauuugucacuugaguaaucacagucuuaauccacucagcuucuccaacagagcauuacaaacugagcugccuaaguaggaaccauuuauucuuuauaguucuggaagccguaacaccaagacuaguuuaccaguauggcugauuucugcugauggcuggcucgauggcugccugacauauagcugucuucuuguugugucuucaggagguagaagaaacaagaauaagaccugucuggugccucuuccucgaacacauuugccccauuacaacagccucgccaugaccucauauaacccugguuaccuuguaaagcccucagcugcagggauacuuuggggaauaggacuucaucacaagagucuagggaagacaguucaguucacaguggcauaauuuaauaguuuucuuugaacuaggcauggugauacacacuuuucaucuuagcacuuaggaggucaguuugaucuacauaauucuaaaccagccaaggcuucauacuguccccuaaaaaauuuaauuuaaaaaacaaaacaaacuaacaaacaaauaaaaaccuacaugguacuggagaaauggcccagugguuaagagcacuggcugcucuucuagggguccugaguucaauucccagcaaccacaugguagcucacaaccaucuguaaugggaucuggugcccucuuuuggugugucugaaggcagcaauaguguucucauauacauuacauaaauaaauaaaucuuuaaaaacagaaacaaauuacacauacugcccuuuaaacagugauuauaauuugaaaaaaugacaacuuauuuugcugauucuugugcuuuucucuuuuuauauguuaucaacucugaaacuggaauauuuuaaaacuaguugaguagccugguuuauauaacaauuucuaggccaagccagggcuggccuuauuuugagagagggguguguguggggguaaguaaugaucaauaauauuuuagauuugagagagcauuauguaaauuugguauuauuuuuccuguuugaguuuuuuguuucuuaagacagucugacuauguagaucagguuggcaucaaacucagaucuuccugccucugucucccagugcugggaauuaaagucacccaacuacacuggcucaguuuguuuguuuuuaagaacaggauuaggcugggaagauauuucaguugguaaaguaaagaugaggacauacgugugacacaucaacccccuccagcagauguauaaaaugcaagguucagggcauauaucccagugcuggggagacagacguggagauuccuggggcucacuggccagcuuaaccuagccuacuugcuucaucccagguuuuggugagaaagccuauuacaaaaugaagauagcuccugaggaaggacauccaaaguugaucuuugaccuauaaguaugcaccuguacacacguggacagauguaugcauagccacguauauacacacacuaaaaauaaaauaaaggguaggucuuacauaacccagacugguuuagaaccugucucugcgguacucuuuugccaugucugacaaagauuguucccagggaaggguaagggcuuuuuaauguuuguuuguuugucuguuuguuuugagacaaagucucauguaguccacacuagcuuuggacuuccuucugguccucuugccucuguggggaaagauugggauuacaggcaugcaccaccauccucaagucaaagauaguacuuauuuuauuuuauuuuauuuuauuuauuauauguacagauguuuugccuguguguauguauggguaccacaugagugacaaaggagggcuucagauccccuggaacugugagccaccauugugggugcuggaaguugaaccuggguccucugcaagaacaacaagugcucuuaccugcugagccagcucuccagcccucaaagaugguauuuauaaaagaaaaaauuuaccaggaauuugugcuggcuaucuuuuuucuaauuuauguuauaauaaguaucuuuucucaagcucaccuguauacucccuugaaucucugugucagcaguggcuauagccuguguuuugagaaucaagaauuuuaugaauuauuuucagaucguguuuuguggaauaguaugaaggcuaccaccaggaacaaggaagcaaaaggaacagccuugggccucuuucauaguucagcguuuuuuuacuagucuuuaugcacugggguuuuacuuuaggguuauuuuauagaaaggacuucuaacucuuaacauggcuugaaccagagugaguauacaccacugguuccaccuacugucuguggaggacacacagcagucaggauggagcagagaaugcugucuuccuccuuaggacagaagacuaggcucauccacuguuggauuauccugagugccacagagacaaaggauguuauaguucaggaaggaauguguccuuuacaagcugcuguuuuggagggaagugagcugauaaagugaugagugagguucaucuuaaaauagaagggacuggacaagcauguaguucuuaccaacaaucauggguaguucuugcuuguaccuggaagccuuccuauuagauagagugguagcauuuugaagauuuucuuaacagccuuaauuuccauuuauugauaacccaacuccaaacucccacacaacaguuccuuaaacuaaguugaaugaaagucagcagaguugcuucuggauucuucugaaccuuuccucuuccagaacgggcucacaccuccaccccacccccuuuucuucuucugugccugccucucuccuggaacaaggucuuacucuguagcccuggcuggccuugaauucauguaauccugaaauuauuaauauaagccaccaggccaaaugggacuggcauuuuuuucuguguguuugcguguagaauuguagaacacaguugaugugcauggauuaucuuggccaaucacaacucuuggcuuuaugguuuagagccaaggacagugcuuuucaaauuccaucacugggaauuuugcaguucugaauuaugaguuguaaagaccacuccugaauuaggaguugauuaucacucaaagagaacaaguaguagacuggcuuucacgagagcacagaagacaccaagaaccugagcugcugugguuggcuguguuugguucuucucuccugaguacccucaccagacguuucucaguuuggcuucucuuagcucaagguaaacauaaaacuaacuguucaugcucaguggauugcauuugauagcuuuaguucuugggucuuagagugaaccuuuaauagaguuuucaacaauaaaaaugugagaauucuagaggaaagcugagcauucuuuagaaugcuuucaaauucagcaauuuauuuucuuuuucuuuuuuaaaaaaggaacauacucaauagauguguuuacauacaauaaacuuaaggcugugcguguaccugaguugugacacucugacuaccacagacccuuaccacucaaaguguuuugucucuuuauagucuagcacugagugccuucacuccagaucugucaaucacugaucugccuucugucuauagaguaguuuacaucuucugaaauuccacauaaguggaaagcaugcauauguaguuuuugcuguuauguuagcaggaaaagaggaagucugagauugcuuauuaagugugauguuugaaguucauccuugucauagcauauauacaucacuguucuaugcugaauaacaacaaucccuuguauggguaugccacagcugauuuauccauuuacuuagauugcuucucuuucucuuuuccuuucuuuuccuuucuuuuccuuucuuuuccuuucuuuucuuuucuuuucuuuucuuuucuuuucuuuucuuuucuuuucuuuucuuuucuuuucucuucuuuucucuucuuuucuccuuucccuuucccuuccuuuuuccuuuuuccuuuuuccuuuuuccuuuccuuuccuuucccucccucuccuccuccuccuucuuuuugucuucuuuuuccucucucucucccuccccccucuccuuccuuuccucccuucuuucuucauuuuuguuuuuugcuuuugcaaauaguucugugauuauuuaaauaaaaaauguguauagauaaaugguuuuuuuucuuguaugaauaucucguagaauaugguaggcuuaacuauuuagaagugccaaaaucuuuuuucugaagggacuacuuuuuggaaaugcauucacaaaugcaguguuuaagcauucugcugcuucauauucuugccaacacuauaucuuuacauuuuagccauuuuaguggcuguauaacaguggccuguugcgguuucagugugcauuucucugaugaauaauguugucagacaucuuguuaucccugcuucuuugugaaauccuacuuuuuacuguguguguuucggggaagggagggaggacaccuggggauuauauuuaggguugcugugugcuaggcacauguucugccuagguauauccucaauccuuuugucgcuauaguuguuguucuucuuauuuuauucuuauucuuaugauucuuguuguuguuuccuuuuuuuuuuuucuuuuuguuuuuucaagacuggauuucuauggguagcccuggcuggccuagaaccagcucuguagaccaggcuggccuagaacucauagagauauccuccagccuccugggugcugggcuuaaaggcaugugccuggcuuuucauuuugaaguagguucucaaguuuguucaggcuuugaaccucucuguagcccagguuggucuugaacuugcaauccuccugucuuagccucccaaguuacaaucccaagugggauuguaggcacuaucauacccuguauuuuacuuaauauuuuaauauuuaauauuuuagcuaguuuugguugacuuguugaugcucuuaccauugaguuuuaagaauucuuuauaaaguuaggugugaugauacacacuuuuaauccuaccaccugggaggcagaagcagauagguuacuuugaguuugaggccggccuagucuacauagcaaguacaaccauaagagccagggcuauauaaagaaacucuggggacuggagagauggcucagcaguuaagagcacuggcugcucuuccagaaguccugaguucaauucccaguaaccacaugguggcucacaaccaucuauaaugugaccugaugcccucuucugguauguuugaagauagcaacagugugugugugugugugugugugugugugugugugugugugugugugugguguguguguguguguguguguguguguguaaguaauuaaaaaaaacaaacucugccuuaaauagaaaaacaaacaaaaaagaaacuuucuauauguucuggauuguguuuuaaaguacuuacuguauuuuuauaguucaguaaaaagauuauauuuaguguuuaaaacugaacucccuaacuggggcauagcucagugguagaguaucugccuaguaugcucaaagcuuugguucuauuuuuaacgcuaaagagcaaauaaauuaauuaauauuaaaguuuuuggaggaggagcacuggcuuuuauuuucucaucuugguuaugcagugucuaugcagagagucauuucuugguuccuucuuauuucccaucugucuuuaacucaucaacaccccaccccaccccaccauucuacuuucacucucagagccuaacuaaccacuucucaaccaacaccuuuacuuuacuaccugauuccacacugcuauugcuucuccucaagccuccugccuagcuuuccuuaugcagucccacuuucuauggucuuccccauaccaauucuuuccaaguacagcagcagcuauagcaauccaguuaaaagacacgccagaccacauuacuucuguccucagaauucaccacugauucccuucugaaggcuuauaaagucuuugugguuuggccugcuguauccacuuucccuuuuucuaaaauacucucccucuugccuauccuucuaucuccauugcaccaugccuacuucagguauuuuguacuuggucuuguuuccuuggcuucuuaccccuagacacaaaauaccacccauuucaaacaucaaacauaaaaagaaaauuagaaaugcaauuauccuuagaaacuuuaagauauaaacaaaucuaugggcaaaacuaaccaaacaaaaagaaacaaaaaaaucagaugcugaugccauaguccuaccauguugaguuugaaaguagggcguugucugggaaguagugguguguaccuuuaauccuagcacccaaaaggcagaggcagguggaucucuugaguuugaggucagccuguacuacagagcagccaggggugcacagagaaacugucuugaaaacaaaacaaaaacaaacaaaaaagaaaauaggcauugaugcuauugaagcuagcuuuauucugggaguccagggagaccucagaguacucuguguggggaggacuguagucagguguauguacucaugccugacuuucccagcuaugaaaguagguaaaaaccaaacaacccaugcuucauucacugcucagguacuuuuagggcauuuggaagacacagaaaaaacauugcaccaacaugagugcuauggccuccuagaggccugaagacugccaguguuacucuguccagguuuaaggauccuaguaaaguaaucacaaagcuguugaggaagaaacgguacauacagggaacaacuuucuuugagguugucuuucaauuagaucugaguauaaguuuguagaccauaagcauacuugaggaaaauagccccguagaaagagaacugggccuagaggguguauguagcucagagguaaaacaugcauuuugguauacaugaagcuggagagguuuugauccccagaacuguugugagcaaacuuguagauauauuuaguauaacaaaaguucuauaguacuccaaauuccuaacuacaguccugagacaaucucgccaaggcugcuugcuuaccuuuuggacuuaucuuagcugaaggucagguauagacucuuaacagaaguguuugauuugagggucaggauccuaggggagacuuguaagccauaggacaggucaagggggagucuuuccagauguguaaagcagagcacugcuccuggucucugcuaacauacugucuagugagugucauggaguucuaagccugugucucauuuucuugagugagugaugucacuggguucugguuaucaugugcagcuuugacuaagcuauuuuuacaugucuaaaagguauuguuuuauuaugcuuauuacauuccaucucuugaucuuugaggcauacagagugcugaugaggaccacaucuaaggaauauuaacaauuucacaguauuugaaaauuugaccacagcaggaaaaggagaaagcaugcaauaaauauuccaaucacuaauugacaaauauaggaaaauaaaucucagacacuaaaacaauuaauaagcaaaaugguccaaacaauguagaucacaggauauugucuugaucccuauggcauauauguauuuucccaaguuuuuuuuuuuuuuccagguuugcuaugcaccaaguugaaaacauauucagaaauaaaaguuaaugcaauuacuuuuaauaugauagcuauguuucaguauaaucuacguucuauaaaauacugugcaggcagucuggcugucugcauggguuguccuuggauagugggacuucaguaucauaagaugugaaagguuguggcagcaggucagucaagauuaguggagaucuguaaugugucuccagucugcaauuuccagacagucauuaauaggugaaagcgaauaugaccaucauaccaaaguagaguaaguuaagaaauuuggucacauccauuacagucacuuuggccuauucaguuguagguauaguccaaaaagugaauuugggcuuuugaauccauaugguggguuguacgguauucuaagagagaauauacuuuaauaguuuucucuugucacugucugggucaaauguacaauucugccaaauuguggauccaucuggguuuauugcaguugauguugaugucuccucagucagguaaccugccuccucauucuggucccaaucuggauaaucauagacauuuucaucuguaauccuaguaguuuuauuguacugauagccagacacaagguucaugugccauauguauggggugaagaaugcugagaggaauuuuguguuugcugcuauuucacagucacacguggaguuuuccauauauggcaucucaauuuuuaaucacuguacuggcugguuuugugugucaacuugacacagcuggaguuaucacagagaaaggagcaucaguugagaaaauaccuccaugagauccagcuguaaggcauuuucucaauuagugaccaagaguggagguccccuuguggauggugcuaucucugggcugguagucuugguucuauaagagagcaggcugagcaagccaggggaagcaagccaguaaggaacaucccuccauggccucugcaucagcuccugcuuccugaccugcuugaguuccaguccugacuuccuuuggugaugaacagcaguauggaaguguaagccgaauauauccuuuccuccccaacuugcuucuuggucaugauguuugugcaggaauagaaacccugacuaugacacuugccccuuguucuuuguuguaagguauaaggaugauuuagagauauuucucuccaguggaaguuuagauggcugaugcuguggugauauuucucuaauucuaugcuaugacauuucagucgguuucuuuccuuaaaaugguuauuucagcuuccucuugaucauuggugacuauggcucucaaaauuggugcaaaaugaagauuagcuuuucucuagucaucacaauagcuguaccaaccucucuuuccaauagcuucacagugagcauuuugaccauaguaugguaagucaccaauaucauauuuuacauuuuuauuugcaaucccaguaguuuuauuguacuaguagccaaauacagggcucaucugccauuacaagcacccuagcaggggaggagggaggaagaugauaaacaacaaaccacauuuuuaaagcuagauuaguacuccaugucuauaaucccaguacucucgagggugaagcagaacaaccagcauauccgagucuggucuguacgauauauaagacuuggauuuaaaagcaauucaucugaaaaaaaguuugagggagaugaaauaaagaauaugaacaguaugaaacacagcaguaaaaaguaaauacugcuagcagcuaugaaugagacuagauagaugcauuagaagugagaacagagcaggacuggaggcuuaguacuuggaagacugaauucagcaagagguucaccaggagugcaaggacagucugggcaggaaccugucucacugggaugaggguaagacauuuaauuggagaguuacauuaaaaaauaacaacuuuugagacaaagucuggcucuggcuggccuggaguuuguggcagucauucuuugagugcugggauuauaggccucugccauuacacuuagcucaaaauuuguaucuucauaaguaaaacucuaagcugaacaggaaggcaucuaguauuggugaagugaaaguuguccugaagaacuuaccagaauacauagaggaaaaguaauauauuuuaacagaguaguugaguaaccaagagggcagcucuaagcuccuaacccaguucugauuuguguuccagagcacagagaggguugauaggagacaagaauuauuuagaacagugguucucaaccuuccuaaugauacaacuguuuaauaauaauggucuuaggcaauccaaaaggggucucaacccacauauugagaagcacugguuuagagagaugaaaacuuuccagaagugggguaagacaggcuuuuauaauaaaauaguguuuggauuagcagggugaguuggaacacauauagauacaucgcagcagaacagccccgcgcaggguuaagauaaaaccugaagggagaagacaagcagccugugcaagaacaagcuugaaggcacuuccucuucuuaaucugccagccucgaccuuaaacgcugcagcgggcagagggugccgcuucucacaaaggacugugcgugugcuuacaccacacagcuuuagaggggaagggccaugguuuucagagucugcucuguguaacccuccucggguggauuguacacaucagccaaguagacacucaaacugcucaggaguugguuuuaagcucggaugugauuuaaagaucucuagcugggguuccuguuguagccuuucaggucuuggucaaggcuauguguuauuucuugacuucuuacugugcuguccuaaugaaggcguuagauggccugguuauccucccgaacaacagacuagcccagugcgugcuagucuugcuugcuuauuuguuaacuuuaaaagaaguuuucuuuaaagaagaaaagaaagaaagaaggaaggaaggaaggaaggaaggaaggaaggaaagaaaggaagaaagaaagaagcaagccuguuuuuuuguauugaugcuagaucaaguuagugccauaaauauauguuccuauguauuacuuguuuuaggcauuacuuuuuccuuaaaaguacccauuuguuuccuaugcuuguuacccuacuaacuuuaaaacauuucauuuuugucacaucucucucuuuuuucuuaaauugagcaagaccuggaacuuugucagaagucagcuuuggggaaaguguuggaaacagaacacauguuaggaaaaucauuaaugaaguggcagaauguguuagaggugaaggugccauggguagauuuaguauguaauacaguugucaaguugaugcuuuuuuuuuccacauugaaccuaaggccucuugcaaguuaggcaggugcuuucauacucagcuuuacucuuaucccaguuuaugucuuuuuaauaaaucagggauugaggcuggugagaugucucacuugcugccaagcuugacaaaccacaaggugaaagaaucuaaccaacuccuaagguuccccccacccacccccgcugugugugugugucugucuauauguaaaugugaaacauuuuuagaagucagagauuauacccauuuauucacaaaucuuuuucuuccuacaaagugauauucucauuugguaaauuugauuuucuauugcugcaucucagcauuuggcugaaaauauuuuacauucuuaaauuuggaccuuugaccuauggccacuuagggauuuuggaguuaguuuuuccuuaccugugaagcaguuacuuacccauugcucaucagugcagaagccuucuccagucagugcuugucuuugcuuuauauuugcuuuuuacucaagcucaaccuaauaacuaagaauaugugaagucaagaacuguuuuuagauuagacugaauaaaaugcagcagcagugagucauggcaagauuuuaaugucagcuauggcaguuggugaagagcccagguucagaggcugccuggguuuaaaucccaaacuuguagcauccuuauguaugacacugaacuugucuuccucauccauaagacaauaguguauguuccagaagugauugugagggccagaugagucagugucuguaucauaguggagugaugccuaugaccuggcaagugugcaacagaugucaccagacauuacuaucucuggugucuugguaguugugucaggcacugcucuagacaagguauagguguuuuuuucuaaucuuaacaacagcuuuagaauuccagcauugaucuuuucauguggacaaugaaacagauaggaaggauucuggcugugggaggggcugauccaggaguuucuaaauuuguucacuguccuggguccuguccugcuauuccauugugacagauccugggaagcagucuugauccaaucagggugaguguaggguaaucuuguuaagacaaaggggcaaggccuuuuugaugggcugauaccuguacacaaaaaaagcuacaccaugacacauauuuuuuuuuuuuuuuuggguuuuugguuuuuugagacaggguuucucuguguagcccuggcuuuccuggaacucacuguauagaccaggcuagccucgaacucagaaauccgccugccucugccucucaagugcugggauuaaaggcaugugccaccaugcccggcucaacaugucacuuuuuaauucauacagauuauuacuuacauagauagcugaagaaugcaaagccacuggugucaugucucuuuguccuucauacuaauaaaguguggcauagaaauagaagggucaggugcuaucuuggauagugcaaggugcuccauugcugaagaaucuauucaagauugcugccaagaagguuuccccuucugcagcuuuguuuggaguggccugaagcagacagucucauacucauaagaaccuacaggaaaaaagggauaagugggagaugaccuugaagugcaccucauggucacuucagugacuucucagcuccauagguaugugucaagaagcugugauugagagcucccugguccauagguccacuaucaaucucugcaucuuuugucugaggcacuuggaucucuuccuaacuuuuccccuauuaaauaucaaaaugugugaggauucuaggaauaaaugucaaguuuacacaguuggauagaggacagcaucaaugauuguuuuuuguuuuuuuaaaacacauucacacaauuuggccuugccuucguuuuagaaacacaauaaauauagacuucucauaaguguagagccagcucuuuaucuugauaccuugaaauuugacacugucauuguuggaauaccuaagauuugacugguugacugagggaguuucucuggcaaccuggaaaccagcccuuuaauaccugcaaagggggaaacaaagcaaagggucucacaagaaaaacuuuugagagccacuauuucuugaaacaacuuuuuguuuguuuuuuugacacaagguuucucugccugacuggcuggagcucucuguagccuggacugcucggagauccaccuucugcugccucccaagugcuggggauuacaggcaugagcgagccaccaugcccgcuuucuuuaaaaauuaauuucuuaaauuauuauuguguauaauacauaauauauggcaugcauguugaagucugaggacaguguuaugguuaucuccuuccaccuuuacguguguucuggggaucaaccucaggucaucaggcucauacagcaagugcugugcuuuaccccuugagauagcucacuggcccacgacuuugaaucauccauuacuggcauuaaaggcuaaacacuauguuagacucucaggguaucccauugcuaacaaaugaaggguuagugacucucaagguaucccauugcuaacaaaugaaggguuagggacuuaaaaucaagcaggguagacccagccuugauaauuaacucauaagcuuacucuuuaugggguaagaacuaauccuaugugaagcuuuaguuuggaucaagagcgcuugugacuuuccuaagagaguugugaacaggcaucuguuaauaucagauaggacaccaaccucaagcaaagaaacaguuacaccuaauuuguuagaacaaugaguuugauugcggcugcuuuaauuggggcauaagcaacuuuggaacugcugcaucacugaagagauucugucccagcaauuguaaacuucagggaggggagaaaccuccuguguuuuaugugcucgccccuagacaguagguaggguuuuauugcugugaagagacaccaugaccaaaguaacucuuauaaagaaaaacauuaaauuggaguuggcuuacaguuucagagauucaacacauuaucaucaaggugggaagcaccauugucuaggcauacauggugcuggaaaaggagcugggaguucuacaucuugaucuuuaggcagcagcagaagacugccacacuaggcauaacuugagcauauaagaccucagagcccaccuccacaagaccacaguguugcgcgcgcucaacaggccaggaagaacgacgcugcuacaggauccuucugcacacguuuauucaguccuguuucuucuuucucuauaucucccuuguucauaucuccccuguuuauaucuccccuguuuuuauaucuccccuuguuuauaucucccuuguuuauaucucccucguuuuuauaucucccuuguuuauaucucucccuuguuuauaucuccccuguuuguaucucucccucguuuauaucucccccgaacccugggccucucacuccuuuuauacucucucucauccacgcaccgcaggccacgcccccucgccagucacgaggcuucagcuaaucagggcagcaggggcaaaucuccaccaaauuggauucaccuguauccugguacacaugcgcagcacucaagauguuugugucuuauaugaggaagucaggugcaagucauaugacuuagcugcagucccuggcgccuuuaggacugccgccacacccgcuccccacaauucccccuuuuuucuuuuuuggcagagagaaugucuguagauagccccucgcagccaugccccuuacccguccuugggugacaaacagcauugguuugaucccugucuuagguuggugacaugcccagggagucuuaucacugacuaccucucuaucaugccaagccacaccuggggagauuguguuuugcuugcggcaggugcaucaaaaggccaggauguugauuaaucuauggccagaucuuaauugcugcaagcaagccucaugggugaagguagaggucugauccccagugugcaagcauaggggcccuacacaaaaccaucccuuaggcucaucacccagagaggucuuggccagcucccgugucguuuuuuccugagggaagggaacuaggacacugaaccuucaugcaaucagacgugccuuccacaggaugccaacagcaagcuauccucugugcagugcuuagccucgcaccccacggcauaacgcagcauaauuucuuuuagaguggcaaaccgaaucugaggagauugucccgccuccacugcagcaaaagccuacgcuaccauggcgaaagugcgggccgcacacucugcaccuaacacaugugccaaacacaaaaaacacacacacuauaacaagcauacaucccagggcucucauccccgcucaucuucccugaagcaagggauagauagccagaggggcuaucucuuuaagggaaauucagggaucaaaaagcguggaaaaauuugaaugucaugucgagcugguaucggcuucuggaauaccgaaaggaucucucaucucggcuccauccuuugugcuugugggaucauccaccacauccacaggggcaacuggaucaggauccucauucuugcagcgucucaccaaccucuccagcacccaaagagguuccgucugguccuguggaaacacacaaacagacccucucgcccacgucaacaccugaucuacucgauccucuccaaaucuccggacagaagguccaccuacagguggcugcugaggaggcauagggaggcggcacaaaagcuaauucgccuuccuccuccaccucggcucuuuuguuuccuccuuccugaccaccugauaacacugugucuccuuucuuuuuccuuuuucuuuuuaagcccuucuuuuccaacauacuuucuuguugcucuguaaggauuuucugaccugucuugacugccucuacacacaguuucaaacaguaacagaguccauauaucagaacaaacaagaccaaaacuaucagaccuacccacaaagggucaaugggagaaaaaagcauaacuacacagcgaggaucuauugaucacuacacugagguuaucauaguuccuuaacuuguccccaaacagggaaccuuaacuugucccaaagccaggaaccuuaacuuaucccaaaaccaggaaccuuuuguuaccuugugccugcuuccuggcaacuuuaugcuugccucuauuuuauccgagguccuucccaaacuccuggggucgcaaguuucacucaccgugaacuuacccugccggcaaccacugacugcugaaaguucugaacucggugggggagucgguuccccguacgggccaccaauugucacgcccacucucgaccagcaagaacgacacgaccaccaguccuucuaacagcaguuuauucagucuucaucucucuucuuucucuucaucaguaccguuccccagcugaagaguucugaauccacgccggauccuucucaacagucuguuuuacaggaacacuucauuaaccccuucuuccccguuaugcaguucugaauccucccuguagcagggggucuucgcucaugccugaagauguuucuuuucccggguuucagcaccaacuguuauuagacgcguucucacgaccggccaggaagaacaccacagaccagaaucuucugcggcaaaacuuuauugcuuacaucuucaggagcaggaguguaagaagcaagagagagagaaaacgaaaccccgucccuauaaaagagaauucuccuucgccuaggacgugucacucccugauuggcugcagcccaucggccgaguugacgucacggggaaggcagagcacauggagugaagaaccacccucggcacaugcgcagauuauuuguuuaccacuuagaacacagcugucagcgccaucuuguaacggcgaaugugggcgcggcucccaacaucucccccuuuucuuuuaauaagagcaaauaggccacccauauuaaugagaguggagauagaggucaaauccccaguguguagguaaaggagccauguacaggauuagcucuuaggcucacaggcuuuuacccagagcaacccugaccugcucccgugucguuuugccuggggagaaggacacuuggacacucaaccuucuugaaagaugacaugucucccuagaauaggcucauauaugccgcagagccuuuccauugcagugcuuagccgugcaacucucucgggcugcugaagcacacucacucuaucccgugcaaugagucuagccucaugggauauaagagcugaguggccagcgaccuauugccuaagcauagauaaccauauaucagggggagcaccauguucuagagcugcaagcgccugggcaauaaccaccuugucucuccuaguuugggccuuaagcuuacagaccaaccaaagaagcaacacuaauccacagcaaaguguaucuccacauaaucccacccccauccauucuuuaaagaaggaaaaugcugaggagauccaauuggguaauccuuugaucagggacagguccaagcgcuuggaguugaccugaaugauggcaagucucaauucccgaagggucuguucaaauucagccguccaauucuguaacauauacucguaaagcuguacucacugguacucucguuccccagcugaaaaguucugaauucauacaguugaauccuucuuaacagucugcuuuacgggaaccuuuauuaccgcgacccgcaguucugguucuggaaugagggaucuuccuugcgccagucccgaguuuuuuuucucgucccggguuucggcaccaacuguugcgcgcgcucaacaggccaggaagaacgacgcugcuacaggauccuucugcacacguuuauucaguccuguuucuucuuucucuauaucucccuuguucauaucuccccuguuuauaucuccccuguuuuuauaucuccccuuguuuauaucucccuuguuuauaucucccucguuuuuauaucucccuuguuuauaucucucccuuguuuauaucuccccuguuuguaucucucccucguuuauaucucccccgaacccugggccucucacuccuuuuauacucucucucauccacgcaccgcaggccacgcccccucgccagucacgaggcuucagcuaaucagggcagcaggggcaaaucuccaccaaauuggauucaccuguauccugguacacaugcgcagcacucaagauguuugugucuuauaugaggaagucaggugcaagucauaugacuuagcugcagucccuggcgccuuuaggacugccgccacacccgcuccccacaccacaguauuccaacaaagccauaccuaauaaugccacuuauggcucuauaggugccauuccuauuuaaaccaccacacccaccuuccagcaggaaauguuaauaggccuaaucuugugaggauuuuauacugauaaucacaacugaucagauuucaagacagcaccaaugcuaugccaugccgucccuguagaacagaguucuguaauagcauuaguaugcauaugcacuuucaccccuuggcacuugaugauaauuagaaucuugcucuuuuuucccccccacuuguccuuuauucacauaguucuuuaauaauaacuuuguugauacaguucauguaccauguaauucuccuuuauaacauguacaguuccauggguauuaauguauuauauagagagcuauauauucuucaucauaaucuguuuugcaacauuuuaaucaccugaaaaagaaaccccaaaucaggcauagugguguacaucuuuaaucccaggacuugaaagucagaggguagggaaggaggggagcucugggcucaaggccuuccugaucuacauaguguguuccaggacagaccugucucaaaagauacaaauaaaaauaaaagaaauuccauggcacacacuguagcacauaacuuuuuuuuuuuuuaaaaaccaccccuguucuucagucuuaaacaaacaccaguuuuaugcuuguagaguuccuuauacuggacugugaaggcaugaauucuucugccuagcuucuuuuacuuagcaugauauuaagguuuaucaggauuggagcaugucccuagugcccuguucccuucuaagacugaacaguaaauaauuccauaauguauauauaccacauuuuguucaucaguugguaaaccuuuguguuauauauaaccucuagacuguuaugaguagccuuuaaaacauucacauacaagauuuuuuauguagcuaggugugguagcacacaccuggccagguuggucuauauaguaaguugcagaacaacaagggcuauguagagagaugcuuucugccgcccuaccuuccccacugcaaaaauuaaaauaaaauugcauguguaucucuuuugaguguauaccuagaaauuucugggugacauaauucuaauugaauuuggcaaaacaguaaaauccuucuugguuuaaauuuuuuauuuuaauuuuacguguauaaauguuuggcuccguguauguuuguacaccauauuugugcaugguggcccccccuacccccaaccccagaggucagcagagggcuggaacuagaguuagagaugguuaugaaucacuaaggguaauggaaauggaacccagguccucggaaagagcagcacgugcuguuauccagugugcuaucuccccagucccaacucuucacuuuuaccagccauguguuaagguuucuaauuuugcuauagucuaaccagugcuugguguuuuuaguuuaguuuuugcuuuuuuuuaaaggaauuuuuuuuuuaaguacaugaguguuuagucuauguaucauacucauuccuggugccugaagaggcuguuggauccuccagaacuggaguugcagacaguuuugagccuuuauguggguccugggaaucaaagcugggucaucugcaagagcagucagugcuucuaaccacuggacuaucgccccagcuccacaaugcuuguuaccauuuuuuuuuaacauuuauuugcuuauuuguuuauuuguuuguuuguuuaguauuucaagacaggguuucucucuguagcccuggcuguccuagaacuuacucucuagaccaggcuggccucaaacccacagagaucuuuuuuccuuuaccucccagaugcuuagaaguaaaggugugcacuuuuuuuuuuuuuuaaaugauacccauccuagcuggugugaaaugguauuugauugugguuuugacuucucuucccuuaggauagcaaugagcaucuuuucagugcuuauuggcaauugcauaucuuuuguggguaucuuugucuuuuuuauuauugaguuauaaaaacuccuuuaguauuuuagguaugaguaucuugccagauguacaguauacagcacagagcuuggaagcagaguacuuuuaguauacacaagguuuaguuuggugccccacauugcagggugaggggaacaaagauuugcauguacuguuauauacugugguuguuuucacuuucuugauccuaucuuuuauaccuuggaaguuucuaauuuuggccagguaugcugucacaugccuuuaauuccagcacuugggaggcaaaaacauggagcucugugaguucagaucuagucuagugagcuccagaggaccaggccagguggcccagacuuagccuuauaucuagggccauaggaagcagcagagcugggaccuaucucaugccacauggcccaugccuagcucacaucugcacucagcacagugaggguuucugguuauauuccugaccaaacacuuaaaguucuugcugucagugccauucagccugaauacccuucccuaacuuagcugcucaacaggugcugcauucuucuucuucuuuuaguuucucuuuuucuaauuaaagagacuucauggaaauaggaaggaaggaaggaaagaagaaggaaagaaaagaaaagcaaagaaaagaaaagaaaagaaaagaaaagaaaagaaaaaagaagacuuagaauuuuaauuuaggagcaauggaccugccugccauccaauggccuccuuucuguguauccagaaaaccacucagguugacaaaaauccuggccauaucaugacccauuaaguucuuauaaagaaaucuccaaauagcaaaucucuagucuucuuuauuucauacaaaaacuuuuuuuaaaauacaaggucucaucuauggcuggcugggaacucauuguguagcucagggugacuucuucagguuuguagcaguccccuugccuuuaccuccuaggugcuggauucacaggugugagcugcaugccugcucuuuaaaagggagcuugacuugcauuucauuguaauuauuggcauguguuaaaauacccaauuuuccauuauaggaacaagcaaacaaaaauacaauaugcuucugaagaaaccacguguuccuguccucuuguauccucugacuuugaccguggucuccugucuggacuugccuuucagacuugucuuugaaaacauccuuguuauugacaguuuuaucuaagaggauauccacagaaccucuuaugggcauagagugauuguuauaagcauuuaugaaagacuugacuuuuuuguugcucuauaguaguguuacuuugcaugaauagcagucaauuucaggucucaagaauggcugaagaaguggugugaggugucaucaguauucuucacagugacaacuuguauccagaguaguguccagccaaaaccacauuacuuuccugagucuuaggaacuugucuguuuugacagcaaccagaagcaaaaagaagugaaagcuuuuuuuuuuuuuuugguugguuuugaguaauguugucucuuuuguuuguuagauuaaggaaaugaaauaauuacuagggcccuagaugugagcaaggucugggccaugugcccguggugcuucuauaguuggauaauccuuuugaaccaguucaaaguguuggaauaacuggagcugagcacugucaucacugauuaaauucauauuauuguugguuuccccugugagcuguuaguacucugguguuuuucuugcugagagccugcaggcaggcuacacaugcagagguaaccagugugugcauccagugcuaugugucuggcucuccagcuuacaggaguacuuucuuuggucacucagccccugcagggaagcccaucaaaggccauauauaguauuuguuguaagacaggaguaugucuuuuaaaaacacauuacuaccagguagugcuguguuugcuuuuaagcuguauuguguuuuggguuuuaguugccucuuauugcagcagauagguacauuauagaaucauuuucaaacagcugaucaaacaucaugauuacagggaagguucaauacuuaaaugcauuuucucacuuagugucuauccacuuagcauaauuuuuauaaaugaauacuaggaucucugucuuuuaaagcuauuauccaggcuggagagaucguucagcgguuaagagcacugacugcucuuccgaaguucaauucccagcaaccacaugguggcacauaaccaucuguaaugagaucugacgcccucuucuggugcaucugaagacaucuacaguguauuuauaauaauaaauaaaaaucuuugggccggagggagcggggccgacuggaaugaacagaaguacuaaaaccaaucauccuuauuuucuaacccauuaacuuuuguauuuucauuuucaguuuuugaccagaaauagaugacuuauuuucgguguccuauguaucacuaggagagcagucuucccacugagucacaccccucaguuugacugugguuuagaaguagcacaggcugugcccauuaacuuuauuauuuuuuuuaaugugaguuuuuccugggguguuauuuuuauuauccucuuuugguacagaggaaccauagauuauagaagcauucuugguuuuucuuuaaaaagcaaaguugauuggcagagacuccagcugagcauucagaaaaccugugccugaaguggaggagugcugguuuaccucucagacuguucccaguuggaagccuccacacacagccagagcugcggagcuccuuugcugugucaguuccuuauccuuauuaucacaaucacuaugacaacaggaagaaaagaaacuguucuucuauguucuggauuccaggaaaaauaguuuaggccauugguucaaagagcuagagaggcauucauucaggacaacuuucuaacauucuaaauggcucagaggguaaauuauucggugaacaaacaugaagacuugaguuuggaucccccagaagguggggagaauacuacaagacugugauuccaauacuuguaaguuaaaguaggcuguggaaucaggagaugccccaggagcuuaaggccagcuagccuggcaugugcagugauaaaacagcaaaagacaagauagaaaacaaggacugacaccugaggucacuuccgaccucuacauacaugccugugcauguacaaauacagagcuuucuaauuuuuuaaaaaaggaauuauguauuuuuuauacauuaaaaaaagggugaaaaaaaccuuaugauucaagagaaaaguggaugggguugucacccuaucccuucacauaauuuauaagccuugauuuuagcuaccacacuuuuaagaaaaggucuggaccaucuugcauccuggaccacaaaggggaaaggacaacaggagggaaauuucccuuuaaauccucaggaacuuuuggauaaggucuuauuaccgcgugaguuagcuuguccuacuaguauagcaaguaguuccuauguuacagugacucacuugcaugaagaugauccuuuugaaguuauuguaaaucuucagugagauauagaaguguuauaaccuugggcaaaagcaguuaguccaugucucucuccuugagacauggggagacugugccaguguguuucaacaauuuguguugaaagcuucugaaagcuacucuugguuucagagcuuggcagguggaccaucucaagggaacaguucucuccagacacuuaugccugguaacacauugucuuuugacuuagagguuccuguagauucuuuguccauuaagaaaacagugaaccugugauguaaucagucucagugggcccugagaaaucugaagaaggcccauuuucauauuuuaucucaaaacaguuguuccauaccuauaccgugccuuggucuggugcgcaugcuccuuguuagccaugcugcuuuagcagccccuuauuuggaaaugcagauggauguucauuaccuuuucuagauaucauggggucugucuguugaggagaaaauuagaacuucucagguuguucauccugguuguagcuguauauuuguuguagcuguaauacccaaauccaugucagacuuuaguaucaccgagaguuagcuuuagucaugugggugguaaaacugcugguucuuucuucacugugucugccugagucaucccacaugcucauuuccuaacugucuacagccauguccuggauggcucccaaaauagcugucccaaacagucucccuucaagugaacacugacugucccaugcagggagcccauggguagucucuccuggaauucucuauguagaccaggcuggccucagacuuacaaagguaugccugacuaugccugacuuugucuucagugugcugaaauuaaaggcaugugcugcuauguucagccucugcaacugucacuaaacuacuuggucuuuucuucucuuuuuuuaaaccuaauuuugcauucuuauucuuucauuuucaauaccucuguuuccccuccucccacucauccuuuuuuguuuuuuugagacaggguuucucuguauagcccuggcuguccuggaacucacucuguagaccaggcugaccucaaacucagaaauccgccugccucugccucccaagugcugggauuaaaggugucauccuuuuuucuuuuuccuucagaaaagagcaugccucucagguauaucagccaaacaaggcauaacaagauacaguaagauuaggcacaaacccucauaucaggguugugcaaggcaacccaguagcuugugaguuagagacacccucacuuccacuguuaugagucccaccaaaacaccaagcuaacaaccaugaugcauauagaggaccuagcacagacccaugcagacucugugcuuccugaugcagucuuugugaaagcccugcuugguugauucugugagccauguucuccuuggguacuugauaccucuagcucuuacaguuuuuccuccuuggcuucugugggguucccucagcuacucucuaauuugagcuuucucuccaccuaauguuuggcugugggucucugcaucugcucccaucagcugccagcagugccucucugaugacaauugggugaggcacugaucuaugagaauagcagaauaccauuaggaaucauucuauugauuuuuuuuuucuuuuuucuucuauccuaggucucugggcuauccaaccucugaguccuaguccaagucauugguuggccacuaccacaaguuuauacauccauggcccuagcacaucuugcaggcaggauagauuguagguggaagguuuuauaacuggguuagugucccagucucaccaucagaagccuuaacugauuaaagaagauggcugguuaagucucuauauccucauagauuccugggaguuucuacuguacuaauaaguuuccacaucacccccaucaccucauuccagugcccccaauucuagugucuccuaucucucuccuucccccuuccccugauccccccccuguucccaccccuaccuguccccaguccacuagcacaucuaucuauucuauuuccccuucuuagggcgauccaugugucacaccccagcacccauuauuuagccuuucuaggcuugugaauuguagcaugauuacuuuacagcuaauaucugcuuaaaagagaguauaugagucuggguuaccucacucagaaugauuuuuuuuuccuaguucauuccaucuauuuaccugcagauuuaaugaugucauuucuauaaauagcugaguaauacuccauuguguaaaugugccaaauuuucuuuauccauucuucaguugaaggacaucuaauuuguuuccaguuucuagguauuaugaauaacacagcuaugaacauaguuaagcaagugguggaauggaauguucuuugggugugugcccaagagcaguauagcuggaucuugaggaagauugaugccccaguuuuuugaggaacugccugccacauugaugucuauaguauuuuuacaaguuuacacucccaccagcaauggaggacuauuccccuugcuuuacagccuugccagcaugagcuaucacuuauguuauuagcuauucugauuggcauaaaauagaaucucacaacaguuugauuugcauuucucugauugcuaaggauguugaacauuucuuuaaauguuucuuagccauuugagauuccucuauucuugcgcgcacccaacucgccagcaagaacuacgcugcaacaggauccuucugcacauguuuauugggagagcuugauugcagaggugaagagaccccaagcccagaacuggugcugcuuauacaggccuaggagaggcgugucucacacccggauugguuaugcauggguuaugcuuaccacuucauuugcaugucucacaucugauugguuaacuugucucucaucugauugguuaacuugucucucaugugauugguuaauucucaaaaccucaucuuggcaaaaaaacuuuacugccuauguaugcgugguggccagcgguagccagcgccacccugcaacggcacauguggcuucccacacucuauugagaauucucuguuuagaucuguaacuugguuuuuggguugggguuuguuuguuuguuuguuugcuugcuugcuuauuuguuuucuuaacaauguuuuguuuuguguugagacaggguuucucuauguagcccuggguguccuagaacucuguagaccagucuacccucaaacucagagauccuccuaccucugccuccagagugcugggauuaaaggugugcaccaccacugcccagcuuguaacccaguuuuuuaauuggauuaguugauuuguugaugucuggcuucuugaauuuuuuauguauuuuggauauuagcccucuauuggauguggacuuggugaaaaucuuuucccauucuguaggcugccauuuugucuuauggauggugucuuugccuuacagaagcuuuucaguuuuaugaggucucauuuuuuuuuaagauuuauuuauuuuauguauaugagugcucucauauaugagaguaugagaguucugcaugccggaagagggcaucagaucacauuauagaugguuaugagccaucaugugguugcuggcgauugcacucaggaccucuagaagauuagacaguguucuuaaaugcugagucaucucucuagcccaaugaggucucauuuauuaaucguugaucuuaaugcuugugcuauagguguuuucuguucagaaaguugucuccuguaccaguguguucaaggcuauuacccacuuucucuucugucagguucaaugugucgguuuuauguugaggucuuugaucuauuuggacuugagcuuugugugcagggugauuaaauauggaucuauuugcauuuuucuacaugcagauacuuauacuagugcuauuuguugaagaugcuuucuguuuucauuacgucuuucuggcuucuuugucaaaaaucaaguauccauagguguguggauuuacuucugggucuucaauuccauuccauuaaucaacgugccuuuauaugccaguaccauguguggguguuuuguuuuuuguuuuuuaaauauagcucuguaguagagcuugaaaucagagauaaccgcauaaaguucuuuaauuguugagaguuguuuuagcauccugguuuguuuuguuuuguuguuuuucauaugaaguugaguugucuuuucaaggucuauaaagaauuguguuugggauuccauugaaacccuaguuugcuuuugguagaaugaccauuuuuacuauuuugaucccaccaauccaugagcaugagaggucuuuccaccuucugauaucuucaauuuuuuuuucuucaaagacuugauguuuuuauaauguaagucuuucgcuuguuugaugagaguuaacuccuacauauuuuauauaauuuguggcuauuaugaaggguguuguuuuucuuauuucuuucuaaaucuguauaucauuuuuauauagguggauugcuuuauaauaaauaaauauauuuuauauauuuauugaguugaucuuauauccagccacuugaaugaucuagcagggaacuucuacauuaugagcuguagaaguucccugcuagaauuuuuaggguugcugaaguaucaucugugaauagagauacuuugauuucuucuuuccaauuuguaucccuugaucucauuuaguugccucauuacucuggcuagaacuucaguuacuauauugaauaaauaggaggaaguagacagccuugucuuguuccugauuuuaguggaauugccuugaguugcuccucguuuaauuugauguuagcuauagacuugcuguaaauugccuuaauuauauuuaguuauauuucuuguacuccuacuccaagacuuuuauugugaauggguguuggguuuugucaaaggcuuuuuccugcaucuaaugagauuuucauguuuuuuuuucuuucaguuuguuuauuuggaggauuacauugacuuacuuuguuauauugaaacauuccugaaucucuaggaugaaguccacuugaucaugguggaugaucuuuuugaugugugcauagauucaguuuacgaauauuuuauuaaguaguuuugcaucuauguucaugagagaaaucuaucuguaauucccuuucuuuaaguuggguaucagggugagugugacccucaaaaaauuugacaauguuucuuuuuucuuuuuuccauaauugaauagaacugcaugacauuuuauuuagguuccaaauacaaaugcaucaguguuucuuuuguuucucuuuuuggacuaauuugaggaguauuaguguuaccucuucuuugaaagucugauagaauucuucacuaaaacugucuaccuugggcuuuuugugauuggaaaacuuucaaugacugcuucucuuucuuuaugggguuauaggucuauuuaaauuggguuucucaucucacuuaauuuugggaaauggaaucuaucaaggaaauuauccauuuauuuuagguuuuacaauuuuguggaguacagauuuuuaauguaugaccuaaugauucuuugcauucccucagugucuguuguuauguugccuuuuuuuucauuucugauuuuguugauuuggauauucuuucucuaccuuuuaguuuguuuggauaaggauuugucuaucuuguugauuccccccuccucaaugaacaaacucuuugugucauugaaucuuuguauuguucuuuuuguuucuugcuuacugauuuuagugauuaguuuauuugcuauccacucuucaugcuuaugcuugcuucuuuuuguucuagagcuuucaggugugcggcuacgucacuaguaugagaucgcuccaauuuuuauauguaaacacuuagugcuacacacuuuccucuuaacaccacuuuccuuguguugcauaaguuugaguauguuggcucuuauuccugcucccgcuuguuucucucuugcccucuuggacucuuuccuuuccccuucccuucuucccucucucuccauguggccauggccggccucuacuuugcuucucacucccucucucugccuuucucugccucuacuacccucuuaacuccccuccccaugcccuaaauaaauucuauucuauacuuaaaaaaaaaaaaaaaguuugaguauguugucuguugguauucauuuucauugaauucuagaaagucuuucauuucuuuauuuuucuguauugacccauuuuucauucaguagacacuguucacuuuccaugaguuuguaggccuucuguuguuccuauuguugaaacccgcuuuaauccacagugaucugaugggaugcaggguuuauuauuauuauuauuauuauuuuuuaaucuguugagacuugcuuugugacugcauauguggucaguuuuggagaaaguuccaugaggugcuaagaagaagguauauucuuuucuauuaaggugaaauguucuguagaugucuguuagguccauuuaguuuguaaugucucuuuaugccaguaguucucuguuuaguuuuuggcuagauggccuguacauuggugagaguuggguauugaagucuccugcugccaauuugugagggucaaugugugauuuaggcuuuaguaauguuucuuuuacaaacuugggugcccuuguguuuggcaaacagauguuaagaauuaaaacauuaucuuugagcauguaauauccuccaucucuuuugauuaauuuuuguucaaagucuauuuuguuagauauuagauggcuacaccagcuuguuuuguccuuuuagggucacuugcuuagaagaaaauuuuuuuccaaccccauucucaagguaaugccuaucuuugauguugagguauguuucuuguaugcagcagaaggauagauugugacuuugcauccauuaugauucucucucucucucucucucucucucucucucucugugugugugugggggggggguugggauuauuuucuguguuuucauggguauaguuaaauuccuuggguuggaguuuucuuucuaguacuuucuggggggggcuggcuuucuggauagauguuguuuaaaugugucuuuaucauggaagaucucguuuucuccaccuaugaugauugaaaguuuugcaggguauagggcugccauucaaggucucuuagagccuguuagaccccugccugaacuucuggcagcugucauagccucugauaaagcagaaagucuuuguccaaaguggagacugaaacauagcaacaaggagguugaggaacuggugaaagguuggggagggggcaacacugaaagugugggcaauaucugcagaugggcagccaacuuggacuuuugguagccuguguagucucuugucccucagggaucucuucuugaguugggagcugggacgugguauugcuuaggagguggaaauuagggacaugaagggaaguaccaagaguguagggaagguccuugggagggcagccuaccuggauuucuggcagccuguuugaccucugguagaacagcuucucuuuucuuugaauguuucuaagcuuauuuggaaaauguucauguugcuguuucauauucacauugccuuuuuuacuucuacuaugugaaguggaagguuuuagacuuccccccaccaacccuacuuauaucuuucuaucucucccccucccucccuccuuuucucccucccuucuuuccucccucccuccuuuccugacaguguuucucuguguagcccuggcuguccuggaacuugauuuguacaccaggcugaccuugaacucaagagauccaccugccacugcccccccaccccccgagugcugggauuaaagauguaccccaccaggccuggcuucuguauuucucacaucaugcuuguuccuuacaucacauuauuguugcaguaguauucucagcuggaccugcauucuuagauguaaagucugccuuucuuugaauuaaggagcuguguuguuauucucucuucuugcucucaguuaaucccuuaguuccacauuucauucucuuauucauaacuguaaaacuccuuaguauuaacaaucuuauuuggcagggguucaggguuucauuguuuguuugacuuuccugcagcugucacccucugagccaucguuuugggguuuccuuuauuucuccucucuguuggaguucuuggaccuggaucuuauuccuaccucucuuuggauuuaguucuuuucuuuuuguuguugcugacaguaacuuugugaguuggacauaaguaggaaaauuguagauguggaauuuucuuuuggaggauucauacuuuccuucccuguccacuggccuuucaaaauauggugaccagccuacgugagugaagggcagcaggguuguguucucugaguaggaaguaucagcuuccugugccagucugugccagugagucuuuuuguuuggaaaugacuuugaugaauuggcagucaacacuuaagagcuaauccuuaaaagguucaugcuacagguugguuaaauccugauuuauuugcccucgacccuccauuagcuaagcagagaccuaaguggcuuuccacaaacaaagcaggcagccaaauagagaggccaaaggcuuuguccagcaaucauuuacugagcaccuguugaugucaagguuaaaaguaggguggucggaagcucugaguaauaguguucuagaagcagaugcucacauuaggugggggguagugagcaguaaaagggacugguaagcaccaugaaaguauuugguaucaaagauauggaagcagucuuugugagugcauucaagaaagcuccaugggaagagugacauugaggcugucuugaagggcagaguguucuuggcaaaggcauaaagcaaaagugaacuagacagauguagagaaaauaaagaggacuuagucacugagcaccuacugugcuacuuguuugugucacaucuuauuaacuccuuucccauuaaggcauugggauuaguaucaucccuguaaagaacgagagguguucuuccauccuugacucaugccauacugagcaucccagguuacucuucccaaaacacagggucaguguuaaacacagaacagaccacacuuucuuuuauccuugaguuuaauuauagcuuauuauuugccugauauucucccaugaaucugucucagaaaacuugcuugucuuuuugcucuaggcaguggggcuguccuuucauuuccuaguagagaauuaaguacuuuaguggaaucuucauuagguuccauucuagguuucugaaccugugaaauccccccaccccuuuugugauguuucuggguucuuauauguaauuaggccuuuuaaaacuguccuaaaaauaguagaguaaaagcuuuugaaauuucagccaugugguuaggcaaacucucuuucccuaaacauuuuaagaaaaauucggggccuuaggaaaaguauuuacuugcaagcaaggaccugaguuugaauucccagcuugcaucuagagagcuggcacagcugcccaugccuguaacugucucuaaggagaggacagcagagacagagagaucccaagagaucuuagcuagguuuggcuagcuaaccuaaccaaagcagaagcugcugguucagggacgagcccugucucagggcagcaagguggagaaguaaaaguuaccauguuuccauacacugcaggguccuaaugcuaauuuugaauaauaaagugucagaaguauacauugguccuguguggagugaccugauggcacugacugaacaggaacugaggcuuuuacauagugguuguggaguaaagauguagaaacaauaccuaguugggccuuugggagacuauuugaauuccuuauguagaagguccuuguuuuguguagaugauuacuacccggaaaagggucuggaaucuuuuaaaugggacuaauaucuuagauaauaguaaugagucugauugagacugucuugaaaaacaaggcugaaaauaaaaacguuuagggcgguuguuguuguuuguuguuguugaagacccauucugagauggaauccauacaugauacugugaauguggcugaaagaagcugaagcuaaauagguugagaauuuguuuuuaauuuaacaaauuagaauguaauuauagccucaguaucuuauacugggacugcacaauggaucugggauggacaguguuagaauauugucaggagaauugucuaaguggugugguauccuuuauuuauguuugacuucagugauaucauuuuccaauugagaaaacucucauuuccccauaguuccuuuucugcuuugcucauucucuguggaagcacccaugcauaauuuaauuaacuagaucauuuuccauugacuuugcguaggaucuagcuguucauuggcugacacaauuuuugugguaccauucauucauuuggcuucauugcugacuugcaguuucaguuugcaggcucuuuauguacuccaaucacaaucauugcauauucaacaguuugcuauaagcauggaaugagauugaaauguaaccuaguaacacgcucagaugagaaguucacuauuucacccccccacacacauacacacacacauagcauagcaugcucauuugcauuugaugccuaucuuugccuaggggacaucauucuuuguaucagaucaucccacuaguacguauuuucaucauaugacuuuuucuaguuauuugagaaauauuuucccagccuggccauggugguacacaccuuuaaucccagcaccggggaggcaaguggaucuuugugaguuugaggccagccuggucuacaaagugaguuccagggcaacauaaagaaacccuguggggcagauggggagcguuuuccugaucuuuuaacuuggaccuccuugagugaaauagaacccuguguugcuacagguguuggacagacauuucugaaagcuaguacuauugucagagaugaacugacagcaaccugaauuuacaauauuaucuuugacagaugaguaaaauuguuauaaccaauaauuacauuaguuaauugugguagcaaacauugaauuugcaggguggccuaccugggggaguuaaaaagagugggaaccugggguagaaauguugacaucaucucccuuuuguggagaagggcaggguuucaccguguagaccaggcuggcuuuaaguucauagagaugugccugcuucuguugcucuacagugauugacuguaaaguggguuuucaauccuaugagaauuuuuuaugguaucuuuacaaggaaaagugaacaaccaguggcaacugauaauuggugcuuuagaaaaguccauuuuaguuuugaagacuuugacacuauuugguaaucaagagucaugccaggagugccaauaguuacccccaugucagcaagaaagucuguuaaggggucuuagagaaguaugaaagaaagagccagcccaguaggaaguauuuuucagagugcuggccugacagacucuaagggacccuugguugugcuuggcauuuauguauuuuacguuucuucauaccugaguacauacucucgacacaccuuccuuaauguuaggucccauucucauaguggcugcagugagucaaguuccaaccauggcuucugcugcucuugguuccuguucuggguuauccgcucucccuucuguuugcugcccucccaugacucucucuuuccagugucuuuuauuuacucuugagucaugguugguucuucgauauuugaggucauuuagcucugcuuuguauuuaauguguauguguucucccuucuagcuuguucucaaaauguguuucauggaacaaugugguuacauuaaacacaaagcacuuuuaggaucagaauaggaaaugauggauuuagcagguuaaacccaucucacccccauuuucacuagcuggguaugauggcauaugccugaaaucucacauauuuagaagaugaggauaguucaaggccaacuugagaaacucacagacuguccuagaccuauaaauaaauaaauaaauaaauaaauuuguuuugaaggauugggauuauagcucagugguaacauacuuggcuggcaugcuugagugauuccccaggcaugugugugugccugcacacacacacacacacacacacacacacacaagacaaagugaaagaagaaaguagccuucuguagaguuucaguuuacaaauguaaugaugaauuucugugaaguugugaaguguuucugaguuuuacacuguuuuuuugggggggugggguggggucaggacaugauuucugaagggccuuuauaauuagcuuauguucuggaaggauucaaaccacauugcccuacacuguggauacccacauucaccaagaccagcaguaggccagcaauaaauccuuucugaauaaacaauugcuugguuaaaaaccuaccauuuuaaagcauuuggugucaggcaugguggugcaugcuuuuaaucacagcagaggcaggcagaucuuucugaguuccaggccacaugaucuacauaguggguuucaggacagccacggcuacauagagagacacuugauuugagcuguguguguguguguguguguguaauauguuguguuauaaaccacuaugagguuccaucacacucaagaagaacugauacccacagaacaguugcuucuuaucacuccaagcccaauaaccacuaguugacuucaagucucuuuauuugccucuugaaauuuuaugugaauggacuuacaccuguuugaccauaucugcuggccucucuucauugaaguuuugaaaaagacucagcuuuuaggucugccugagaucccugcuccuucaaagcuguuuucuaucacugacuaaaccccauagguguaguugccuauuuggaauccuccaagccacaugaucagaagucccaugaaauauaguaaaacagggucacaaguauuguugcuuuuguaaugucuugaccugagacuuuuggaaacugaagcugggcugaguugauuucuccguuuccugaaggucauaggugacugaacuuaugguauaauuugaugacccuuguuaaucuuuuuuuguuguaggaggucuuggcauuuuagacuacuccucauuuaauaccuagaacauuccaggauggguaucuuagaggaaagguuauacugucuacuucacugcagaacccuuguugguucuacucugaaacucaaggcuuaugaaaaaaauaggacucuucauccuuugccuuggaauucccaggggaagggugcucacuaacuacaaagacagcugcugacacccccuuuauccucccagaccuuaagaagugcuaagcgaauaggugccacaccuuccaugcagugguaugcuugaucuccagagaugacaaugaggggacagccuagugacucuuagaaucugaaucccaugcaacacugugggacugucuucucuucugugugccauuuacugcuugguauucugacccugucuugaugucuaaacuccauucuaauuuuuaagaucuucucuuugucuuguagacugugacucuuuuuacuacuggucagucucguuucauucuuccuccuccaucuuuuauaucucuucccuaaguuuagaaugacgaaucuuauuuuuccuucaguuuacuuugaggcccugcagcuucacagacacaugccccacuuuccauaucuuagcuccuuuugcugccugcauuaaauagcacucuguccuugaccacaacagauuuaaagauacaaacauuuuuuuccugaagauuuucucuuucagucuuuuucucucagauagucaacucucaaguaaggaggcauagagcaagugagcagaguggaaagucccccgguggaaucauuugaguugugugugcuacuugcugcccauguugucuugaaaaacaaggucauuuaccuugaacuuuuguucucaccuguaaagcaaguaagaaauaauaugcauuagcuuucuauuugcuguucuaaguuacuacauacuggucuacugguuuagaacaauacuaaucuugauauaccugccuaccuggagaaugcaggaacucuccaucucaucaugcuuagucacauaugccagugugucuuacuauguaagguaaaauguaugaagguuaggauauagaugucuuuggagcugcuaucccuucuauaguggaaucgagaagguuguuuuguuuuguuuuguuuuguuuuguuuuguuuuguuuuguuuuguuuucccaggacagggucucacuauguagcccuugcuguccugaaacucacagagaucugccuaccucugccucccaagugcuggaauuaaagucacaugucacuacuccuggucuuagaagguucuuaauauaaaucuaaagauaucuuuaaucuuaaagaguuuagcacauugggcuggagauauggaccagugguuaaaagcacugaugcucuucuagaggacuaaaguucaauucccagaacccauaaaguggcuuacaaucaucuguaaguccaguuauagaggcucugacuccuccucugaucucugagaagauuaggcaugcaccuggugcacagguguacaugcuagcaaaccacucauacacauaaaaauaaaaaauaucaaaggggagaucuagcacauacagugcuaggcuuauaacuuagugaguuaucuaugaggauuuccucuuuccacauuguucuugggcucuggauccuaugguguauaauaguguucuuuggagaaucuuaaacaaugucugcucaucucagauagggaaucaaggacaaaccaaaauacagaugcuaccuagguacauguugacaaaccauugagucuugggaaggggggucacuuacaggaguauuaggagcuauguacaggagcaggaauaauuuuaaagacagcugcauuuccaaagcccacccuaacauggaugauggcugacaaaagcuggaauccuggaacacaguccuugacuuacagguaacucaccaggucagaugguaucucugacaggccacuaaguagucugggacguuuaggggcagcuugaugggucuauucugcuaggcaacauaguuggucucuguguccuugcuagucuuuaugauuuauguaagcuuagaaaaggaggugccuuccugagacucuaaauuuuacuuccugaaucuugaugaucuuuuauuuuaaagaucuauuuuuauuuuaugucuacguauguuuugcuugcauguauguauacaauguguauguccauagaggucagaagaagauguugaucccuaggaauugguguuaaagaugauuguguacugucauguagauacugagaauuaaacccugguccucuguaagagcaacaaggagccuaaccacuaagccaacacucagcucuagaacuucugaguuuuaaugagcuucccuuuagaacuuacuggaucuuaaagaacauaugagaaauugcuacagaauagucugauacaagucaaugcuagaauucuaaacauagaccuggggauuuuugugguuuucaagcuucuauaugagaaaauaagcuggugcuccucucucuaguuucuauuuugugauguguaacagauuuugaaaagacuuaaugucaucuauuuaguaaccauuugcaaucucaaaauagccugcuaauuauacugccgcauuuccaguucucucaaaguccugaauaugucucuagaccauuaugcauaaguuauugugaccuuaaaaccuagaagcuaaauaggauauuauccugguuaguuuuuggguuuuuugguugguugguuuuuuaauaauugcuuaguguuagauuuaugauauuucauaguaauuuagauuggcauuuauauaaaaugcauuuucucccuauuaucagguggcuuccaucuuggacaacuauuacuuugaaggcagagagaaaguagcuauaauauauauuuauacgggcuaaaaucauggcugagucuguaaaauguuugcugugugaacaugaggccuuaaauucaauuuccagcaccauguaaaaaccaagcacuguggugcacaccuguaauccuagcauugaacaggcagagacaggaggaucucugagacuuaaagccaaucauucuagcgagauaagaaagcucauuuaaagacucugucucaaaaaaauaaggugaagggagguugagaagacaucugacaucaaccccugggcuccaugugcauacacaugaauauauguguauauaguauauacauauuuuuauuucaucuuauuuuauggguauggauguuacguuugaauguaucuguauagcagcauaugcagggcuggugcuuaugggugccagaaaagggcaucagauucuuuggaacuggauucauagacaguugugagccaucaugugcaugcuuggaauugaaccuggguccuuuggaagagcagucagugcucuuaccuguugagucauuucuccaccccuuauaauaucuauuucuagggguuuuuuuguguucucuucagugcucagcucacaguaauuacuugaaauuccccguggauuaaaaaccuguucccugccauaaaguuugaaguuuugaagugacuuaguauacaauaacaaaugcaugaagugggucaaaccagucuguaaggcagccuguugauaucuucuuuccauuuugucucuuagaugcacccacuaggccuauguaauaacaaugacgaagaggacuuguaugaauauggcuggguaggaguggugaagcuugaacagccagaauuggaccccaaaccaugucucacuguccugggcaagguaagcaccaggccuucugugucacugccguugugguugauguuuuccacauaagcauuuuccugaguuucaaauaucagguucugaagaagagccaugcuggcauaguacuccuucugaagcugugugaggagacauagcaccauagaacgcaugugcuuuggcgcuucagagucugcuguaacccugccuacuauguggucuugggcaaguugcuuucccugggagucucaauacuuaucugugaaauggguuaauguuagaaauccauaauacuguaccuuacaucuuuggggccagagguuuuagaccugagauuugggggugggggcuucaggaaguauuaugguauauauauauauuuuuuuucuauaaguaacccuggggccauacucaauaaucauacacauucauauauguguagcauaugcuuauggauauucacaucaaaugggauaacuaaagccuaaauagccuccucuuagaccacaacugcuuuacuuccaaaugaguucaaacccauuauuuuuugcugucaaguauguuauggaaaaacucuugcaauuuagagcuuccuuaguuucagaauagcagacagcaauuauggcccugcauuagaacuuauuucacaagugacuaggaagugaguugagaucuaaugccuggugccucaugugucacuauugacuguuggcacaccauuuagaagcacucacaaacacaugcuuuuuagcugcuagggguuaauauaacuucugacuguaguauaugauagaaauaaauucacuuugaaaauccauccaucaggaacucuuaacaugauagguuauaaccuguuuuaaaguguaucauuuuguuaaaaggaaagauuuuguaaaaguaauuugaauuuuugguugggagaaagauagucccccuaagaauagucuuacuuccuggacauuuuaugguccccaaugcuacggcucuguguacuguggaagacaacugcauccuguuccuggaagcugagguuuuuuguauaugaggcaagaggaaaggugauguugguacagagagcugucacaaaaucuagagaaucuucugccaacuacuccuaaaaagucuuugguccuggagauccucgugagccuaauuugcuuguggcuuuuaucccucuuaggccuuuugagaaacugcauggcucuugucaaguuuuccugcccuuucauugggggagaaaccugacaggacuuauggccuguuugguuuaugguucacuaaguugaauaaagguguuugagguggcucagccuugauaccucauuguuuucacuuguccaaaguggcuuaaugaugauuagaagagacccucaugagaguauguuaguguuuuccuaggggaaauugcuagcuacauccaaagggcaggaacagugcucuccuuguuaggggucugcuucagcuacgccauuugcuucuagguuuaagcugcugcugcucuaugcucagcuuauuggcuucauugucucccuccccacgaaucagggcccaguagggauccaucucuugugucuauaaauggguuggaacacggucccacaguguaacccuuauuguccuuugauaguuuagugauggguacuuguugaagucacucagaaccaaacuguuuccgccacuaccugaaccaacuacacugcgguuuacuuggugaguuucacaugguuuggccugcgggucuaugaagccagcggaauggaaaccuuagguauauauugaauuacugagcacuuuuuguguuuacucaucaggaaauaguuauugaaugugggggccuacaagcucaguguauggcucuaccuuucuaggagcacuuuauuucuguugggaaaggcugagacuggggcguggcacaagguagcacagggguagcacacauuugcugcuguugucugucuuaagaauugucuggcaccugaguaaagucauuaguaaagaugccuggaccaaacaaaguaaaaugguuugaugagucagaacaaucucaucuuccuccuuucuuccuccuuccuguucacaacuuuaauuucauugacuuugccaacucuguuuucuacuuuccuggguucccaagaguagagacaaaaugucuggugggggaaggcacagugacucacauucucugcagcucagcaugccaguccccugcagacaguaugguuuccuucuauuucugacuuucaguggcuauagcaaagauugauuggcaaggagaagcacaaaggcaaagggauugggcugggaacauagcuuggugacagagcuccugccuagcaugugaggcccuggguuccauugcuagcacugaaaugaagaagaaauuaaaaggcauaggaagaaagucagccagccgagugugcaguugagaaugggugagcugcuguuaauggacguugaaacuugucucuugccacagaaaagccuaugggaaacuaggagggcuagacacaggccccccuaccuuaccagcgcacagaaaaucaugagcugaaaccccaaagauuuuaaaaaacauaagugcuucucuaagaguccaaaccaaguuuuauuuuaaaaguaagagacauaaaugcaucaccuugguguauuaccaagggcuuuugaguucaacacuuuaaaacucaugagagaaaaauaauuuaugaucacauccuucuaaucuuucaauucuauaaagguacugacaaaaucaacuaugucaguagaguuaggagaagaaguaggccaggcccacuucagaugcccgccccccccccccccccccggccucacuucaggccaggcucaggcagaucucugcagcaauuucucuuuuucucuuuuacuuaauguuaagaugaugcucugggccuugcuugucugaaauucugagcuucaggaucaagguuaggaucuccccuaaugcccucauuacagaacuuaacccugugacaguaaaacaguagaauugacauuugggggcagcuuacuuugagaagagucauaaauccuucccaaagugcaagagucgguaugccucaggcauuucaucccuucauauucacagagacucucaugauguuucuagcagaauucacuuggacugaauuccgaaauuccaggcuagauaaaccccaaacaccagauagaccaauucugugcuagcauuuugaaauacaguaaauccagcaggcuuggaccugccuguguccaugcuucagaagaugguauggggaaguuaacguaaagucauuuagaggauuuuauguuagaaugccuugccugagugaccuuagaaaagcaacuuuaguucuugaugucuuguuccuuugugaaaaacugccucucugauugcuguagggcugugagauguaagcagagcacuuagcucagaaccugguguaugcacccauccugaacacugccugcuaggagcuguaguugccuuugcuugucacauugacaucuuguccacauucccauguuauggugaggaaacugaguccuaguaagguucuccacaugaucugagaucauacagcucacaagacccuggagcugaaacagaacuguucugugcuucaccaguguugaauuuugucuccucuugucucggucagucuuuucuagauaauaaacaccaccugcuuucaguaucaacuggguguggucaggacuguugcuucugcaugguagaaucacaaucauggacaaggcauuugcucugaagguugaacugugucauagaaccaacaucugguacugcuccuccucaccacauaagcagcuuccucuccagaucucuuuauagaccuguuuuaucucccugccccuaccuacucaggagauauaaccuccauauuccugguuuugagucuaaaaagauuccaggaaagggauucauugacucauuuugagucaggcacucuucuuuaggcuuaccaguuguguuauggggcugaagacucuaugaaacuaagccugucucaccuugucaugugugaggguaggaagaaaauguguucuucagaaagggguaggggcuggaguugugcugagcugcuaucccuaaguagaccccuguaguugcuaggucaagaaugcugucacaagcuagggggcaauguucucaguuuaucccaggucauuugaagugggucuauugagagaagacuaucucucaauaugagagcaaauuugaucucaaaggugcuauugaaggauucuaauagaaugacauaauuugccuuuggcaguagcauccaggcugcacagagaauaugagguacccuuuugcugcagucuuaagugaacuguauaggcccacauaucaaccauuuuuagccaagggaguuggugaggaguuauguuugccucuguccuggucaguuuucacacauagacauacaggacagagagugaagagucuacagagugacagggaagaagccuaaugcagguuucaugagcagaagaacugcucuaaaaacuggcccuucugaugaacuacagagaagccaaggguaaagguugacagagaauugcacccugcugcuuuucugcccccuuuuccagaucaagaguuucagaaaugucauugcaaagaaaaauaaaaaucucgucguuuuaguuuccuuucuguugcuaugauaauacacuggcaaaaaacagcuuggagagaaaagggacacguuggggggggggggcgguuauguuucucuagugaacccugacucacaccugaugaccaagaugcuaugaagucagagcuaagggauguuucccuaucaauccagguuuaaacuucaguuuuaacuguuuguuuaauuuccauauacuggggauugaaacuagucagcuccccccaccccccauacuauaugagcacucaaccaccaagcaauagucuaacucccaguucagcagucccaggcucugacccuggcagucacucagcccucuacauguuccaacuucccuaaauaggagcaggaucuaaaggagaguacaucuauuguuagucauuguuccuagcacagaugaauauacucaacaaaguggcuuuuguuguccauauucucuuccucucucuuucucucuuaccucauuauccuauuucuuuuagcaucccaaaguuguauuacuuuuauagugaaauccagaaaugcagagagugaaauaauugcugguugccagacucugucaucuuaggagcaggaaagcguuucuuauuuuuuguuuuuuaaacuagguguagaauuucaguuuggaaggaugaaaagauuuggagguuauugauagccaugauugacaauauuucauucugaugaccugugcacuuaauaauuaaagugauaaauuccauauuauguauuuuacccaaauaaaguaugguaucuuuuaaauaaauuauuuuacaguauauagacuagaauggcaguagguauaaauaaguauaauaaaguggguugauuuaugucugcuaucccagcacuugagagaucaagaggaucauuaugaguuugaggucagcauagacuacauaauguauucuaggccagccugggcuccaaaacacaacaaaauagcaacaacaucucuaagguuuuguuuuuguuuuuuucccccaaagugauaaaguauagucccaugaaggggauaccugauaauucugaguccuaguauauggaagaaaaggagacagaaaugaccagagagccucguccuccucugaauaucagucuaucucaggaaagugucuucccuguucaaaguacagcuuucaaaauacacaaguuuauggguuuuauuguuguugacaacagaccuuccuuuuuuucauaauaauuguuugagaauaucauauauuauauuuugaccuauuaaucccucuuccucaacucuuccagaucauucucuaccucucuaacaaccuagccuuauguuuuaucucaaucuuucccccauugaaugcaguuuguguuaucauaauaaauacuucuuaacaugaggcccugcccuggaguauggucgguauaccagguaccacaccauuaagggaaguugacuuucccucuccuggcagcaaucagaugucaauagcuccucaacuaaggaugggacuucaugcccaccuggacugguugguuuguguggcaacuugacacaagcuggaguuagcacagagaaaggagccucagcugaggaaaugccuccaugagauccagcuguaaggcauuuucucaguuagugaucaaggugggagggcccaggccauuguggguggugccauccuuaggcuggugguccuggguucuauaagaaaacaggcuaagcaaggcagagaaagcaagacaaguaagcaccuccccuccauggccucugaaucagcuccugccuccaaguuccugcucuguguaaauuccuguccugacuuccuuuggugaugaacagcaauguggaaguguaagcugaauaaacccuuuuuuccccaacuugcuucuuaggucaugauguuuugugcaaacccuaagacacuaccucuacucuuacauucugggguuuuguccgauuucaauuuuugcaggucuuaagguacaccugccuguugugccuggacaacaauuuucuuuaagucauccaccacagugacucuuagucuuucagccuccucuuccagauagaucccugagccuuaaggggagugguguaauauagacauccuauuuaggacugagcacucugaagucucuuauucucuguacauugacccauugugggucucuuuguuaauugccagcuauuauaagaagcauuucuuccugaaccucacuuaggcaacacaguagagcuaguccugguggcauaggcaggagagagcugguggacuguccaacucagcucccacccagggucagauccaggcuuccgaguugguccaccccaggacccaccccaucaugaacuccggaaguacaugacagggcccauccugcagauccaaagcuguggcauguucacagcacaaagcaauaacaugaugucugaggaguccugggggaggauccaguauugauaguauagcagaagccagaggcuucgaacaagaccaacaacuuauugcaaugaacauuuguaagaaaagaugugcagcacacuuuaacaccacagcuuccaaggugagauguuuugguuuugauuuuugguuguuaaguugguuguuuggcugguuuaguuuuauuuuuuuguuucuuugguggggagguuacacagguggaaagauaguagaaaaggacagggagaugagugggauuguggugcaugaaguggaauucuaaaaaauuuuaauuaaaaagcagcagcagcagcagcagcagcagcagcacgccuuuaaucccagcacucgggaggcagaggcaggcagauuccugaguucgaggccagccagggcucaagaacucaagaaugugucugaaagcaauagguucuuacugucauguucuggaugguaaccaacaguauugacuauagccuguaauagacacagggagcaaaauuuccccaaagugccagugaccucaugaugaugaauggguuuuggcaaauaccuuggauuuagggcuguucucuucugggagaugucucacugacuucuccaguaaaacugagccuaguaagguucuaguguagauuuuuuuuuaagauuuauuuauucauaauguauguguguacacuguggcugucuucagacacaccagaagacggcaucagaacccauuacagaugguugugagccacuaugugguugcugggaacugaacucaggaccucugugacuguuacugagucagugcgaauaaguaggcacacaagccauagagggcuguguauaaauaauaaccagacgaaugugaggacuucuuaguaucuuagaacauguuaguaucuuugaggcuugcauugguauauaaccuucagccaugaccuucuagaaacagggauucucuacgugagcaggaauuuuuaguuggcugguaagcugccguguucuuuuugaacccuguauguacugagguggaaggaaaggugcuuauccucagcacacccacucucauuugggguuuugcucagagauguuuccaggaauacuugaguguccugucccuuuuugucugagacagaguuucuccauguagcagcccuaguuguccuggaacucacucuguagaccaggcugucuggaacuugcagagaugcaccugucuuggccucccugcuaggauuuaagguaugcgcugcuaccaugaccacuaccaccagugaguguccuccuggucuuuaacccaagcucagcucagcccauuucaagaggaaugauagaacugaaauccuugucuccagcugcuucacauugcagucuuuaaccucagcaggcugccucucgucagcaaaacaaguagguauuugucacauccuagcacaggugacaugucuauagcuuauugcccuggcauuccuggaagcauucuaugaaaugcguagggcaauuccuauaucaaugguuauuuuaaagauucauuuuauuuugaauuauaaauauguauuuuuugcagauacucacagaagccaaaagguuucuauucccuggagcuggaguuacaggaagcugugaccauccagcaugggugcugggaaucagacuccgguucuguccaagaacaguugaacugcagagacaggucuccagcccguguucauaucuuuuuauagaauccauugugugugacauuguuuucaacgagguauucauguuuggggacaucagaauacaggccaggcuuguugcucagcauccuauuguucauaggauagucgccaccacagagaguucucuggccccacaaaaugaacuguaaaauuauuugucagguaaaaguaaggaauggacuggagcgaugguucaacaguuaggagcaucuguuguucuucuauaagauccagguucaguucccaggacccacauggcagaucacaaaugucuguaauucaaguuccagagaauucagugcccucuucagaccuccucaaguaucagaugcacacuuggugcacaggcaugcaggcagaaugcuuauacacacacaaaauaaaaacaauuuaaaaaauagaagaaaaagaauaauuugaccucaaauauucauaucaauagaaagcccucuuuuauuaugacaugcaaacauuuucuuuccaaaauauguuaguuacuuuugggaagcuaauucuucugucauucccuucugugccucauucucuguacaugauacuucgauacuucuauuuuacauuuuauugcauuuugcacauugagauguauguaugcagaaccuaagccaugaagccaaacagccuguauauaaaugauaauuccccucagcaaaaagccagguaucuuuaagccaauuagugucucuuugccuagaauucugcaagucuccuucuguaaagaguugugacggacuggcaagauaguuuaguuaacugcacaagucugauagccuaaguuugcucuucuaagcccacaguaagaggagagaacuaacuaaaaguuauccuuccagccuccacucucacauacauguauauuuacacguaacacaugugugugugccaaauucauagaaauucaacuucuccugagcaaaugggaguucuuuccuaaagugaguuucucauugggugcaaguuuggaagacuguacagauuuauuuuaaggaauguauggguaaauaucucccauauuuggcuaaaaaagcaagaaaggaauuugguaaaagaaaucaaaccagggggaaaagauuggcuugauaugaauggaaauuuuuaggaaauaccacuuuguuuuugaagucaugaggcuggucugaaagucagaccuuuuaagugauugaugcuuuucauuuacacccaaaucuuccauaaagcucuugauuaaaagacuauauuagggcuggagaggugacucagugcucaagagcaccgacugcucauccaaaggucgugaguucaaaucccagcaaccacaugauggcucacaaccauucguaaugaggucugaagcccucuucuguggugucugaagaacccuacaguguacuuacauauaauaaauuaaaaaaaagacuauauuaagcaagaauauguuguuguuuuuaaaacaaaagcccaacuguuugauuuuaccaaaggaagacucagaagccagucacugugaugaaagccugcuagcucagagaggcaaagaaagcacccagcugagcuuccuacuccucugaagacagagaaggaaaaagcucuucauucuucaugcugucuaaauucccucaacaucauccuuuuucuuuuaauucccucucagccaguuacuugcuccuucucuugaccuacccuuaaauuuauuuagcuuuuguuuacagaaaagaaagcucuugguuuaaagguguacgcuagggcugagccacuucacaacaaggauuuuccaguucacagccuugggguuuccaauacaaucaaauaucguguguguguguguaugugugucuguguaaaaucaaucagauacaucauuagcuauaaaagacugaaaccagcuuaaaggaguuuugaagacacaguuaagugaacagagcaaauacugugucugcuaaccaaggcauacagacagcuugcccccugcaggacucagggaaggcugccucugucuugguaguccuuagcauuguccccagccauugaucugcuuuuaccagagcugcaguuaagcuguucuagaacacaagaggugguagcaaggcuguccaaaugcucaucaaagauagcuacugaauuugccugcuuugagaaguugugacuccaaugcauuaugucuucauacuauauaaagugcagcuaccaggucagcuguccagaaccuuucauguggacaagcccacagucccaucugcucuccauucucaaauagagcaaccucacccacgucugguuuugcacaugcauuaacuugcuuaagugucagcuccuggcuauggucaaaggugauaugagagccaccccgacagcuaccaaggccauggaaauuauagauauuucuaacacacacacacacacacacacacacacacacacacaaacuguccuuguauagcauaggaacaaaauucugcuauacuccucacaugggcauagaauccccuggagacaaaguaggggggaauguaggggaacuugucugcuggccuuggucaccagaccucagauuccugacacaaauacuguaucuuuucauuguuuuacuuuguucuccuuucuaaagauacuaacuuaaacaucagacacaugcaugggaagcauucugguccauaauauucuuuuccuaaucuaguuauauaacaauaaaagaggacaaugagagggcccagcagguaaaagagucugccuaaaaaccugaguucgaccccugggaccuacaugguggaaagcaaaccaacucuuuccuacaauugucuucuaaccuacacacacacacacacgcacacacacacacggcaugcccaaccccacuccccacauaccccaaauagauuaauaaugcacauucuuaauuuaagaaauacuuuauuaguuucuauaaucuagcccauguagaugaggcuuuaucuaguacaguauguuauuccuguaaaaaauaucuaauaaaacuauaaacauauuucacaagcaguaguugcacaugccuuuaauuccagcacuugggaggaagaagcaggcggauuucugaguucgagaccagcuuggucuacagagugaguuccaggacaaccagggcuaaacaaagaaacccugucucgaaaaaccaaaaaaaaaaaaaaaaagggggggggaguugcuguaaccauuguuagagccaaauaagauuuuagucauccugaaaaacugugcuauuucuuguucuaauuaaggaacuuggcuuacucucuuuaguacgaaccuguugcucuaguuuuuuuacaaguuuacccauauucuuagcgaaaaauugaucacacaaggaaccuguugucuucauuccuagcuccaccugugugugugugugucugccauaucacguguguagugucagaggacauuuucugguguccucuguacuuucccugugagcaaucucucaacuauugauuuuuuuaaaauaaaaauuuggauuacuauuuaaaggcuaaaagcuuucagcuuuaucuauuugugaacaacagauuuauuuguaaaaaaucagauuucucucuccuuuuaaaaauuuauguauguauaugagugcucuauuugcaugcaugccugcaugacagaauagaacaugagaucuguuacuggugucugugagccaccauaugguugcugggaauugaacucagguccucuggaagagcagccagugcuuguaaccacugagccaugucuccaccccuaccucccccacuucuuuuuuuaaugucacuugaaaucucagguuuuguuugcuuguuuuguuuuuuaaaacuucuuggguuuugugggauuuuuuguuuguuuguuuguuuguuuuuuaagacaggguuucucuguauagcccuggcuguccuggaaacaggcuauccuggaacucagaaaucugccugccucugccucccaagugcugggauuaaaggcgugcaccaccacgcccggcugugggauuuuuuuuuuaagauuuauuuuuauugccgggcaugguggcgcacgccuuuaaucccagcacuugggaggcagaggcagguggauuucugaguuccaggacagccuggucuacaaagugaguuccaggacagccaagacuauacagagaaacccugucucaaaaacacccaaaaaaaaaaaaaguuuuuuuuuuauuguauguguauaaguguauaaguguuggccuaaaugucuguguguaccacgugaauguugagugcucaagggaaccagaagagggcguuggcuccgcuagagguagagacaacagguagcuaccauucguuagugaccuuuuagggucauuacauaguacuccucucacucacacuuggccacgugaagcucugguuggaggaagccugucuauaccugcuacuuuucauuuguuaauuucaggagucgucuuuuuuacagauuauucuucuucugacucagcauuuccaauggcuaugggagugguggucacuggcuucaacagagguaucaucuagaucuccuaagugcaggcuaaggucaugucauguccucagaccagaaaagcuuugguuauauccccauacaggccacuaaauauguuaccaaaaaauuuuaaguuguuucuucgugguugucaaaugauacugaggaaaucuggguucucaucuuagaauuauuagucucaauacuaaaagaauuuagcaauagacucaaaugguaguaugaggacaauuuuaaauuuaaaagaaaaacccaaggcaggaaagcuguaaauuacagcagccuccuaaagaagaagaagaaaaaaaugccauuugagcuaagccagcauagaguuaggccacaugacugacaagcaggaugggggauuuagagaaugaguaaugaaacccaaagaaucagagggggaaaaauugucucugacauccaaagagaaacagagauaagaagaaaaaggaauggucagaccucugaaucuggucuuagaaaggaaggcaaaccucauggcaaucuuggaacucacuuuguagaccaggcuggccuugaacuccaaucagugugucuggauaggacaaacuuuauuucugauuaagagaaugugcucagaaaggcaaauacagagacaggaaauacauugguuuuuggguugguugguuugguuuuucaagacaggauuucucugugucccucuggcugaccuugaacucacucuguagaccaggcugucugggaauucacagagaaccaucuaccugccucugcauuggguuuuuauucuaacuuuggugauugugucuuuuccccauuggcuggguuccaaccucacaagcuuauucaauuggucagucugaaaagaauuggcacagcggaaacgaaggaggaggaaagggaccaccaaagagaaaagggucacugcuccaggccaucacuugucuagaauugagcuguggccuuugcauaaagaaaggcuuuucaggguggagaggauuaaaacauuugcaugaaagucuuauuuggugggggagauaaaaaagauuuuaauucuuugucccaaacacaaguuuuauaguugauagaaacaauucauuugauucucccuuccuccuccucuucuuccuccuccucccucucucucucucucucucucucucucucucucucucucucucucucccccucccucucucccucccucccucccucccccucucuuccuucuccgagacauggugccuauuauguagccuuggugauugugcauaugugugugcuugauauuugauacaugccacgauggcacauaugucagaaaacagugcuugcaagucaguuuucuccuucuacccauguugguacugggaaucaagcucaugucccuggcuuugcagcaagcacauuuacccagugagccaucuagcucucccuguuaauguuucuuuuaagauuaaaaguaguuauuuucaguugcauaucuuugguuaucauacaauaucacuaaacauuaaacugggaacauuuuuuuccuauguucuaguuuaauuuccuuuuuuguuaaauguuucucuaagugaagacacaaugaaaccauccaaccggaccacuccauggguagaaaguuuuauuuggguuggagcugcuacuuucaagaggcagauagaagaaacaugacggaaaaacaaauggauuuuauaugauagucagccagucaacaaaauggaggauuuuugaacugauaccagcuguugggacugaccaagaacuagaugcccuuccccuggguaguugaccuuugagggcagaauaagggaggcuccuaguaaacagaaacccaccguuaggcuucugcuugccuaguagcaaucuuccuguuuaccagucaaaaguguuucuguuuaggacacugucaacagcacuggcaugagggugggaggcugcuuuggaccuaacgguuuccuucugggcuauaacccauuauuuugcauggguaguaauguagguuuuaaaaaauaaaacuguauaaguacccaaguguuguuauuugcaguggugaagcuggaacccaguacuuuacacaucagguagacuucauauauguauguauguauguauguauguauguauguauguauguguauguauguauguacacauuuuagccacagcuucuccucccagucacuucaccuccccucuucacauacacccucauccucuguuucuccaggcuguuuuguaacuggcccuuuuaaucaucuuuuauuguuggauguacaaaauuucuguguggcucuuguuauuucuucgggugccucuaaucucaauauauccuaucuuuaaaucacuuaaaacuuaccuuguuauauaaauguguaguaucagaaauggguauacaaccuggguaaaaauucucacauucuuuaagugauuuccagccuuguaugugccccagucuucaauauauauauuaagacucuuagauagcuuagcagccugagacacuugccaccaagacuacugaccuuacuucaaauccccagaacccacaugguaggggagaacugacuucuacaaguuguccuuugaccucaacaugagcauccugauacauguguauccccccauucacccaguaaauaaaugcaguaaaaauaauaguauguuauaauauauauuacauuaaaauucuguauuuacuaucaaaucuggauguuaugcuacagugauuuuguuguuguuguuuuaaagcauucauuuuggggaauggagugauaguucagcagcuaagaguauguauugcuuuuacugaggacauggauucuauccccaaccccucuucugaacucuuaggaccccuguacucagacauauacauauaauuuuuaaaacuggaaaacucagaaaacugucaaaaaagaaaagaaggcacucaguucuagugcuaagugaaccaugcuuguaaguacauuuaaaauaguugauaagugggugccugguuaugcuuguuugccuagaacaaggaaucuugauuaauccccaucuaccaucuaguguaucacaucugugcaccagagugucagcaugggaguuuucagaaccucugucugcuguugucaucauuucuacauuuaaugcuuuguuuuccccccccccggggguggggggcuuauuuuguuuaaaauauaggaugucacauaggccagccuggcuuuagagaguaacugaggguaaccuuugacaucucaucuuccugcuucugccuuccaaaugcugguguuauaggccugcagucaccaugucuggcuuuacacugugacaggcagcuaaguccacaauauauugugcugguauucaagcaucugaauaauaucccuggcuaccacacucaaguuuuauuccucugugcugcaagagcagcaggugcucuuaacaacccuagccaccuccccagcucccccuguggucauuccugaauaauauuccauuguauaggaauuaucaguugcuucuauuuguuaugaacauugcuacugugagcauuuucaagcaaguuuuuugucagguuugguuugguguuuuguuuuucgagauagggcuuuucucuauuagcccugauuguccugaagucacucuguagaccaggcuggccugccucuaucucccgagugcuaagauuaaagacauauuccaccacccuaguuuuuguacaaguuuuuacgcacacaaguugguuuucauauuuuuuaggaacugcuaaacuuuuaaaauggcaguaccugggacuuacuuagagugcaaaaguacuuagguuuaauccccaguaauacaaagaagucaggauauauaaacaguccucaccacuggugaggggggguguguguguguguguguguguguguguguguguguguguacuucacugcucuuccauucuuucuaguaaagguucugaguuaucugcacccucacugacuuccugacuuuggucauugccauccugcuguggauuuugauuugcuuuuuuuuuucagugguuugcuauguugagcaucuuuucguaugcuaacuaguaauuuguuuuguuuguguggugcugcuggugguggugguggugguggugguggugguggugguggugguggugguguuugagacagggucucacaauauacuucuggcuggccuagaauuaacuauguugaccaagcugaucuugaacucacagaaaucuacuugcuucugccucuggagugcuaggaauuacaaguguguguuaggaucauuagcaaauacuucuuccuacuccauggguuuuuuuguuuuuuguuuuuuguuuuuguuuuuuugccaugucaccuuuugaugaaguccuuugcaauacaaaacuauuucauuuugauaaaaucuaagucacuacuucuuugguuguuuauacuuuuucgaugagaucugcuaguuauuucugugguauuuuauuauagacauauauuugagggucuucuggaauuccuacaguuucuuuccucccuccuaaagcuuuuaaauuaauagagaagccaauaagcauugaucugccuguaucacuagucccuguucuaauuugcuauuuaggaucccuugauucaaccuggacuauuuaaccacaguagugggaggguggcaggucuguagacaugcaguggucaggucccuucaguucuuaguaacagaauagcuagguuguaaauauagaaaggugaaagaggcaccauccaggagccucauuuuuagguucaugauaguacuggaaaauacuuccaagaaucccagaaagucuucaugacuguggauguuccugcuggccaaccuucggaccuuauuuccauggacuuaaaaguacguucuaucauuuguaauaaggauaaacaggacugccuaccuaaauaaagguaacagaagugcugccaaaaaaaggauguuggcuacugacagcugucaguaagccucccacagcugcugugcuuuuagugcuuuugaaaagagaacagcucaaaaaaguucuauuuagaauguucaagaucucuuaagguuugcugaugaacagcagaguguagauuauuucccuaacugaugcccaggcucuucuaaggaggguuuggggccugagagcuaaaaggguaaguagggucauuaguugggauucuggagagccugagaugaguaccaacagguagugcggagaccuuuucauugagaucaacccaugucaauuaaauggccucauugagaaccagccuauauggaaguaggccacucagccuuggcaaaugggcucauagacagacacacaugacaaagagaaaugggcacacauaguuucucacccacuagaccuguuuuccuaaguucuuuuuuaaaaacuucagaagacuacacacccucuccccaguuuuauuuuauuuuucagcugauugggcucuuuccuaucaucugaaauuaaucuaaaguaaguucagccucugugguugcagugucccuuucugccugguccaugguccccaaucugguguuacaaggcagucaacuuugguagaauaguuaauguaguaguaauauuaauaacaacaacaauaauauuaauaaugcaguugacugccacacagacuuuuacuuggcauagaaacugacucucuccuaaaagccaaauaaaauccauuugauuugcaaaaggcucaccuguaaaaucugcugguuauuuauguagcccuggaaaccaccaaccaccccaauccacagcuacacacagaagaguccagguuaccuaccaaccucuuaagugacugaaugaugcucaaugacaccucuuaccagccuuccuuucuuccugccuccuucaugauauuguuauuuuugcuuagauuggacugucuuucacgaguuagaaaaaaauaagaaaauugccuguuuucugcaauccagguguguuucagagauucagaguuaagaagucaaguaaauauuuuggcagcccaacaaagguaagaaagggagaauguaccuaacuggcuucucaaauugcaggccuguccaaacacugccuuucucuagagaaguuggucuaaugaagucagcccugcucacccagcagccgggucaguggcuaaaguggacuugugccuuuuucuggcgccuucccugguuuggugcugagccagauuugauuuugauucccucuaguacaagacagagauacucuaucuguaagccaggaucuuuccuccuuaacacacucuaaucacauuguuuucucaucuugcugggggcaaaaagaaaagccacccuauuuucucucccucuuuuaaguuggaacccugacaaaauuaagcccaaaacgucacaaagacucucagauaacauggagacuucaguguaacuucaucccaggaagaggcagacagcugugaaagggaauccagaaguaccauguacagggcugcuggucucuagggcuucaaagaucagggcaccagagcacaccccaggugccaaucuaggugacuaccccuucccccaaugucuucacuuaagaacaaccauucaucccagaaguagggaguuauggccugcuaguccugucuugcuaugcuuugugacuguucuaaggaaaagacagacaugaaagcugucucuuucucacccucccccaguggcuuccauuggaucaccuuggcaggggccucaucccaagggaggaggggguggagugcgcuguggugaugguuccuuugaucacuucuugcuagaucccggccuggcugccagcaggccaacuaaagguccuacuaugcugaccugauaggugcugaauaaagcccaagggacaguaacuagugagaagaaagccuuggaagugaaaaggcucucccucccccuuuccugucaaccgucgaagcuucauagacuggauuuuccugacagggagccucucgguuccugccagccaggcuacguacccuuagccuuggccccugcuuuuuagaucuugcgugcccuguguauguuuuguguuugaauccaggcuggcucucccugguucucaggcugggaacccacugugccuguuuccauggucacugggaagcucuuaacgccaugugcuucaaagggauccuuucuccucccagacucccugcugccugccuagggagugcaugcacaaugagaggcuccucuggcaggccucugaagaccuauccuuugccaaggaaggcugugcuaccucacaguacuaggaagugcucccaguccuuagugagcccccuuguagauguuuauaguuuguagauugguguuuucccuacaucucuuuguuuaggaaaucauagaaacuaaaggagaaugcaaagucugagguccuuguaagagguagcagucuucuaagugggcaagggggaaagaaaaugauggguuggggaagggagacuaauguuagauauccuuggcuaaacuccuaucuuuuuugggccaggagagaaugaaguugaaagauggcucuugucaugcuuucugucccuggagacugacuggggaagggaugccugcucacucaccuagagccaggcuuccagguuugacaguugcuuucauucauguguuucagaaugugcggaacaggcucucccagcugaaagaagauaagaagaacuuacaguuuagagauuuggaaggugcuccaagcugaggcuggaauaaaugcagagcuccugguuuuaaauuccaagccugaagccuagcccucagagcuggcagcuugguaucugucugagcuuaccauacagcagagggcauguggaccaguuguuuuccagggauagagggauugaaaaucuuuuuuuuuggggggggggguacaggguuucucugaauaguccuggcuguccuagaacucauucuguagaccaggcuggccucgaacucacagagaucugaccaccucugccuccugaguacugggauuaaagguguguaccaccaugccuacccaugauugaaauucuuuauuugggcuuuuauccuaguguugcuuuccugauuccuugucagccuucagaauaccucuuuccuccccuguaggauucccuguagugauaggaauuuaguuaacaggucacagauacucuuuauguaacuagaagagaauucacuuugaugggguuaacuauauuuucuacuuaaaacaucuuggaaagguuuuuagaacuuggaauucugagggugauaaguuuugcuucccccaaaaccuaugcucacugcauauggaacaucauuuaaaggguggauucuaagaacagcucauuuugugcugcucuguuggagcccuaaagcuggugcccuuggaauaccuaugggaaauaaaauggaaacuauggccccuauuauaggcaacauuccuaauagaaaggaaugguacuagacuuuuuucagugaguauagggaugaaauuccaggaugaccuaacaauguauguaaccauguagcuaguuucggcaaacagggaccacuggaccaucaacucuuccaccaaugcccuuagucugcugucagaguagaaucuuucuagaaagcaaauaccuuauuagugcuuaaauauuucagaggcuaauaagagaaagaaacaucuuaaagaacuauuuaaaaaaaaaaaccuacuaguuucuuucauguagauuauaguuuccuaacaaucuaucccuuuuccuuuuuuuucuuaccugcccaaaccauauuugguaaggaaagagauaagaagacugaauguucaaaaaugucauccuaacaauugcccauuuggugggcagauugugcuccuaacuguguucuuaaucauuggaguuggagauccugaaauuucaaaguccacaacuuugaauauuacagcacugauuauagaguccuggugaugguuuugugaauuacauguucugagccaauucuuccagauucuuugucuaaccuuaggcuuucuuagguaucagguauacaaccugcagagagugagagacagacagaagacaggcauagauucuauauauuauagauauauaugucucacuuuuguccacucaucuguugauuaauccuugggucacuuuuuuaucucugggugauuguaaauaauacaaccaugaauaagaacacauaaauaucucuuuaagagauccugcuuucaguccucuggagcauacacuguaccuugacaugaaauugcugaaccacauggucacucaugcuuaacuuguugaggaauccguauacugcuuuccacaauagcuagaucauuuuacuuucccaccagaaauguacaaaaguuuauuuugcugggcagugguggcacaugccuuuaaucccagcacucgggaggcagaggcagaggcaggcggauuucugaguucgaggccaaccuggucuacagagugaguuccaggacugccaggacuacacagagaaacccugucucggaaaacaaacaaacaaacaaaaguuuauuuuacacaucuuguuaccaugugcauacauauauacacaggcaaauaauggccaguuuauugcuauagacuggugguucccggugcuuugauuugcauccucuuacugaucaaugaugcaguagugaugcaucauugauaaucaaugaugcugagaagcccuuugcauacuuuuugucuauuguccauuguccauucucuuuggagaacauuuaaaauauuuugccuguuuuggagucagauugauuggguuuugcuguugacuuuagggaugcuuucuauauucuuguaucaaucucuuaccuggugcacgguuugcaguauuuucucuuguucuuugagcugacuuuucauucuauugauaguauccuuugaugcacagaugucuuuaaucuugaagaagucuaguuugucuguuauuuuuccuguugccugugcuuuggugucuguuuuuuguuuuguuuuuugccuuuucuuuuccuuuuuuuaaauaauauuuguauaguuguuuccuuuuguuugguugguuuugcuuuuuuuguuuuuuguuuuuuagcacauagaaaguuaaacaaauauauuugucaauuuaauguuauccugagaauuccagaacaaaaaagaauuguugcauccugggccaggcucccagcagcucucuguguuagaagauguccacuuugggacaugaagaaugagaaggaaauacacaggaagugcccuaggcuggcugucaugguccagcuagcuggccacacuguuuuguguccaaccucuugcuaauggggaauuacugucuugucuccauggccaguugccaccagcccuauggugugaauggcaaggaaauggggacugguggcuggcugaaguccaggaugcagccuuugcuggcagagaaccaaggcagaagggaaaaacacuccaugcacaagagaaauaaugccaguuccaaaaccuguaauucccaaguuaaaaaaaaaaauuuuuuaaagagauuuuucaaccaaacugugcuuuuaucuuuaaguucugaauggaagauuguucauacagcuaagcuggcugcaaaagccaggccaguuaaaacaguaugcaggcagcacuccuucuaaauaaccagaaacuguuggcucagaggagccuaaacugaggaaccaaccugcugggagacguuuuuccaaguaacuccaagcaguggccuaaauguaaacccuccugcggggaauggcacuuuggcaaaugaagacccuaauuagaaauggaaggguuucuauuuuguuuuucuuuaauccuuacccuggggccuuugcagggccugccaugucucugcuugugugcaaagaaauuuccagcuccucuuuguaacaggauccucuuuugggaaagcagcaacagugugggcccaccacagccagaggacccugcagccagccuaauccaaaacaaagagcgugggcuggguuaccuggauuggcuagucaucgagguugugcccgagguggaucguaugcugccucuuaagacucagacacaugcuuagguggaaagugagcuuccuccauccuagagaauagaacagaggcgugagcaaaaugcagagcgguaaggaagagcuguggcuccgaccugccaggccuaggagaacugaacacacugcaagcuguuacauccagauggugggucaauuagcuuuugauccuuaagaucaaauccauggagacugugccuggacgcaucagugcuaccuguccuacuguccuacuguccauguauccuugcccugugaggcaccugugggggcucagggcaaagagucccuucaauucuguuuuucuucaauucuguggcucuggaaagacagaugaacagagcuucucuggaccuaaaguauugaauaacugguaaguuauagcacugguuuuacauaauucuaagugaauucuagugauguaccuuuuaagccucagagagcaguucuguuuuuaggcaacaucuucacaucagugagugugguguggcaagagagcugggaaguuucauguguccuuuguguuuuaagcaccaauuuauggaugcuagguuuuuuauuuucaucaucaucaucaaaaucaugacuuaguacaaaaugcuugugccuaagggacuuccaaaaacuuacugggggaaauuacacauuuuuuugagccaaauacaagaaauauaugucucccaagcagcuacucccugaaagcuggaaacccuggaagcuaguucaaagauuagugaucccagacuuggggagagaagcuuggcugcagacucguccaggacccagguuagcaccagccucacaagcucuuuuagaccacugcaguucuuggcgcaucaauucugugcucugguuuguggagccucuggagaguuccucucucuaguucugcauauauaacaggauggguuccugggcagucuacaccccucucauuguugagaaguguauugcugucaacacaccuaucuccggcugcccacugacagaagaaugcauaucuggagcauuuauuuuccugaggugcccccucuguaacuucuuaauuacaagggaucagauccccucuucuggucuccaugggcaauagucaugcauguaguacacagggcauacaugcagacaaacaaaacucccacauauguacauuuaaaaagauuguggagcuggcaggauggcucuggguagaagcccuuacaacuccgaccauaguagagagggcugacuccauuaguuguccucucaccucuucacucacucacacacuuuugcgaaagaaaauuaaaaggaaagaaaaacaaauucuaccacagauaauuggauuagcuguguagaucauaaaagcauggguauguggaauaacaugaauaauccuggauuuauaaaggcuuugcuauaguagcagggcccugauagcaccuaccaugggcagguggaauacugggaauagccuuuaccaggacagguuaguauugcugauacugcuaaaaaugucuuuacucagagaaaauaaugcagagggcuuaauagucuucagaucaccccucagcaucuucucuccauacuuuccuuucugcccuggccauuucuuuauuucuguuguccuaccaugcuaaaugcuauuguaucagcagugagaguacucuugaaaaucuugucacccaaaagagcuaaaaaaagacauuccaugcaucuugguuuugaguugcuguccccuaguccucuugagcaaugguguauuugauguuacucaguugugugaauauaugugguccucuaggcugcugguacaagcuuggauuugguguuccucaugucugugagaucuuugaaccaagaacauuucaacagcuacuuacuacacagcaguuagacucacagcccacuuuguaccacauuguugaacaggaugcagagaaaaagccccagccuccuagcuaagguaacuuagacaugaacuugcagaaguugaguaacaguguaaaacaaaucuugucuguaauucacuuauacauuuauuaaggcucuccaggcagugggcuagacacuccugacaccauggugguuagaguagacaaguacccugcccucaugagauccuuggucaguaaagggauuacagagacaaccaacacaugaacaaacacauacauacacacaagagaguuggcuaugggccaugaugugguugcaagaucaacaagguaaaagggugaaucucugccugaauugcauugagccauuagccuagagucaagaagaaagagacacaucucccacaaugagcuugccuaccuaccucugcuuuaucuucuguucuuaaguaugucggcugccuaaggugugcuuuguugcucccugucaucucuuucauuuucaaauccaucagacaguucuuugcucccauauaaguauuagcgugugauaagaaugacaggaaggcacuuagucuuacagaaaguuagcugcuguauuuuaggaaccucauuaaauauuaucuacuugucuauuucacguagauacuuuuuuuuaaccucugaaaguuguauaauaugcugugauauaaagagguaugguaggguauccccuaagacucaaccuuugguauuguuuuagagauuaauguaaccuacaaaguccagugcaguguuuuguuugggguacucauucuuccuuaagauaccuuuccuucuucuggugacuaugaaaaggggaggagggaggaggaaucuguugaaccuaagguucaacugucugacuguaucuuauacccugaaauaucguaauuaagagaucauuagcaaauaguaucucuggugcuaguaaagguuauugucauaaaaaacugccugcuguaccaacuuuguguucacaugaaaauccaaagaccagcaguccucuuaacuggugagagaugcauuggagaaggugcgaaggugaagcaguguucgaccuucuugagaaaagaugaaagcauggaaauaaacagguuuugauagacuagaaaacuuucuccuuagaaaaaaugaaugagaaaacaagacuuuguguggaguggggggaucucuagccaauauaagguuguacuagaacccauuuccuuuguuccuuuaaagccugaaguaggcuuucaguuguuugaugaacauugauuuaaggacacgggagaacuuaggaugcagcucgaauuuagggacuuuucuacauuauuugcaauagauuacagaaacagaagaguguugguucccuaggauauggauaaccucuuaacauuguauuuaagaguaauacuaauuaaacagggagcugcaaguaggauaucucuguauuuacuguauuuaaaggucagcaagcugggcaugguggcacaugccuggaguuccaguguuuggaaggaugaagcaagagaaucaugagaucuagacagcaggacccuguuucaagaaaagaaaaaaaaaaagcgaaagaagaaaagaaaguuaguuguucuggugagaguugcaagcagaaaagagcucugugauuuuagggcacugugacuuuagggccaaguggcaugcagcaugcuuuuauccaaaagaucugaagagagagggaaaaguaacauuuuccuagaaaggaaagccgugugcuucugauggucuagaugaaccugggauagcagccugccacagaugguuuguaacagagcuacugagugacaaaccuaccuuggcuucugaauaauacgcauggggucagcacuagcaugugcagggggugagaagauggagcauuugagggcagaggggcuggaaagccauuggauauggaaacucaguacaggaugguagcugaaaagggaguuugcuuccaagggcccuuauguacauaggguugagcaggcuagauguagaaaggaagaacgggggcugugagaggagggaaggauauguguuucucauguaagacaaugguuucauaaaugugagcuuuaggagaaacuugaugacuuugauuuugguuuuguuguuuggggauuuuuguuuuguuuuauuugguuuugugggguuuuuuuuaaaagacuuauauauuuuguguaugugaauacacuguugcugucuuacccauguuaaauugcuugggaaaucagggcuggagaugguguggugcaaaaugagcuuguccuagaagagaauguagagaaaagggaccaagaauagggcucaaugggaaaggaauuagugggacuuugaaggaaucuaaaacuaagagagaggggagcuggcacaaagcacagaagauagguguguaagggagcaggcccugugcuuucacuuagcacaaguaugucagguuugcuacaauagcaacagccccuaagacuuaguaugaaaaccuaccaaacaaaaacuacuccuauuucugugauuuggcuaaguguuucugguuggggcuacccugauugaugucuguggucaccugguaguuuacaauggcugaauagucuaggauggccccaaucacauugggaccuugcccgagacaacugugccuaugucauccaggagcuuaggguucuagacagggagggagggaaggagggaagggggagggggagagagagagagagagagagagagagagagagagaagagagagagagagagagagagagagggggggggggagagagagggagagagggggggggagagagagagagagagagagagagagagagagagagagagagagagagagagagagagagaauauauaugaaagaaaaugaauguaagcaugccugagucuuauauucaggccugcuucaagagauggaaaaacaaccucccaucucuaccuaggaauagacacaaaauauuguggacuguuuuuucuucaguccacucaagaauguaaaugagauuguggagacguccuuauuuuucuuaaaccucagaugauggcagaaaagugaaguaauacagcaggaaaucaacaccagucugguucaugacgccaagcaaacgaggcugacaaugccagauguaguggcucaaucagccaagagccaaggcagacuugccuaggcuacaugaugaauucugggccaaccuggucuauauccugucucaaaaacaaaaccaaaaccagguagagguauacugcuaggccugaccaccugagguuaggcccaggaacccagaugguauaaagaaaggauuaacuuuuggaaguugucuucuggucucuacaagaguacaaacaugcauauacauccagcauacaauaaaugagauuuaaagaaaauaagaaauuuauaaucaguuacaaacucaaacugaaacaccccugcucagaucagcacugucugaucuacaggauucaacccuuuacugcuaauauucauguaagacuagaccagugaaaagugaucauagcuacuauuaguuuguagcuacuguguucccaaauugugccaaguauccuauaucuaugauuauuugauaaucuuaacaauucuauaauauauaacaauacuauaacuaucacugucccaguuuuaaagauggggaaaugaggaucaaacuguaauugacuuggccaaaaguaucagugcaguccucuugcguuagucuuccaaguccugggauuacaauuauguacaaccaugccuauuucuggaucuaccucucccccuuguuuggcucaucuauccaccccuuccuuucuuuuacaaguucauacacacacacacacacacacacacacacacaauacuuaaaugguuucccuccccauugucuucuguuaucccuuuuuccccucauacggagcucuucccccaauaagucccccacuuguauguuuguguguaugcacuuaauuaggauugcuucaugaauaugagugguggguuauuugcuugaacaaaggcaacuuucuacuggcucuuacacagaagaauaugauucuccuuuccucagagagagguggugucuuguacagauagccacaacuguucugaguucaugaaugcaguggcaguccaacaagcagaagacacuggccggcagcucuccuccccaucccuggcuuucccauucucccugcuccuuuuccacaguguuuccuaagcuuuggagguaguacaguggauguccuguuuagagcugaguaccuagcagccacuuguucucaggauuugaccaguuaugagucucuuccuuaaccacugcccacugcaaacagaaacuucucucaccaagcuggaacacacacuaaugcuauggauauaaacagaaauauuuagaaagcaauuugacaccauugaguauccauuuguuuguuuucaaggcaggucuucucugcauaucccugacuguccuggaacuugcuuuauagagagaguagacugccucaaacucaaagaucuaccaugccuggcuaucaucccuuucuuguuuuguuuuguuuuguuuguuuguuuguuuguuuguuuuucgagacaggguuucucugcguagcccuggcuguccuggaacucacucaaaguuaguuucaaaaauuacccagauugagcaagauaauaccuccuuugauaucucaaacugacucaguaucugaaaucuacugccaaugcaucuggaugaaggguaaguuuaagggcaguguagaucccacuaggccucugggaagcaagcagaucccaaguaaguagacagagugaauauuucauuaagaaagggaaagaaauccaccugccucugccucccaagugcugggauuaaaggcgugugccaccacgccaggcuaucaucccuuucuaacuuugaauuuucuucuauuaucuagaauuaauagcauucucacucuaagugucgaauccuggcugagcagugaugacuuuuaaugccagcacucaggaggcagaggcaguuggaggccagccuggucuacagaacgaguuccaggacagccagggcugcacagagaaauccugucucaaaaacaaaacccaaccaaaccaaaaagaaaagaguggaagccuggggaucguaggucaaggucauccucagcagcagcuggcgcuagagagcgagcaccggagauaaggacgucgcugcucuuggaggggaccagcguuuccaacaguucaacauccucuucugcccuccauuggcauccuuccaaacauacaugcacauacagacaaauauauacuaaauguaaauaagucuuuuuaagaacagcauucacauggucaaaugucaucaguuucagaauaguuuugcucuuaagcaguaaugggaaaggcuaauuuuggguuguccacccauuucaucuagaacaaacuuuaggggccagcaagauggcuuagcauguaaaagugcucacugucaagccugaugccuucuguugaauucucaggguacacaugguggaaggagagaacagauuccugcauguuguccucugaaaucugaccuauacacacaccuacaaaaccauaaccuggcacaccaaaaguucccuacguucucccuuugaaaucuccuucuucuaugcauuccuucccagcugcuagaccacugauucuccaaguauaaauuaauuugcauuguauagaauuccauauggaaucguguguguguguguguguguguguguguguguguguguguguguguguguguguguaacuuaagaugucaggcuuauugaaagugucuugauuuacugagccauuuugcuaccccaguauaaguuuaaucuuggcucuuuaacucaguauccuuguuuaagaucuauccauccauauuguaggucaggcagcgcccccuccucugugugugugugugugugugugugugugugugugugugugugugugugugugugugugagagagagagagagagagagagagagagagagagagagauuuuaaaauuugaaugcaugugagcauucugcuuuuuaaacucugaacuugggccagaacuuguaaaguuaccugugaauuguacauuaaccaacuaauggcaaugaugaguuaaucuauaacuucaucuguuagcuguuaacauuacccccaagucuaacuuccucuugacuaucugguucuaagcacaccuucucuugaggugguaacugaaggcagccuagagaacuugggggaguggguauguauauguauguauauaucagaguguguguguguguacccuaauauguguagcuuuguggacagcagaauagcauggaccaguguccugcaaaaacuuaagguacacucugacagauucaagauaugcaaauuccccagcauugccuuggggcagaugauugcuacaaaaguauucacuuuacaaucuaauaauggucagauauagugauguacaccucccagcacuugggaggcaaggcaguuggauaccuauaaguuugagguuagccuggucuauguauugaguuucaggacagccagggcuacauugaaacccuaucucaaaaaaaaaacaaaaccaaaaacaaaaaacaacaaaaaaaaaaacauacaaagaaaggauuucauagugggagcugaaacaguggcuuggugguuaagaaaacuggcuacacucuggguggugguaacacacaucuuuaaucccaacaugcggaggcagaggcaggcagauccugugaguuugaggccagucugguuuacagagugaguuccaggacagccaaagguacacagagaagugagagagggaauugaucuaacuuuggguucucucaaccccaagcauaaacuuggauuuugcaaagccuaaugguagggugagaguagauccucaggaaaagcauggccuccuuugcaaaucaaagaaauggggcccugacucccaaauagaagaaguagacuccuugucucaggugcacugcaugagucucaggacagaagcaggcucacuaucuucagauaugccacauaggcucuggggaccaagaguagacugucuauauaggaacaacuggccagaacuccuucaaugaaagugguuuguggcccuuccucuagaguuggcucacuaaucuuucuauguguuacagacacccaaaggauguguaguuugaucucuuuaaccucaaggcuagcaagaggguauaagcuuggugauccagcaaguucaauaccuaaaacucccacauaaaaauguaaaaagaaaacagaaucuacaaaguuguccucuaccuccauauauucacuguggcaugugcacccacaaagacaugguaauaauaaacaaacaaacaaacuuuuaauuaaaaagugcuggguguuggcauacagcuuuaauucuagcaauccagagucagagacauaggcugaaugucugaguugaagaucagcuuggucuacacagggcagugguuuucaaccuuccuaaugcugugacacuuuaauacaguuccucaugguaugaugauccccaaccaugaaauuauuucauugcuacuucaucauaacuguaauuuucuaguuaugaaucauaauguaaauaucuguguuugccaauggucuuaguugagacccacagguugagaaccacugacauagggugauccaggcuggccaaggcuacauagugagacccuuucucaacaguuacaaaaggagcaaauagugugugugacucaguggauaaacacuuuugcuacaaaaaccuaauggcccaaaaucaauuccuagaacccacauaaaaguggaagaacagacuccccaaaaucguucuuuggcacuuuggcauuuacucuguguguguguguguguguguguguguguguguguguguguguguguguaaauaaaguaacuuuuaauuuuuaaaaaagaaaauaguaguagccacuuuuccaggccugccugauagcuggguaccuccuagcuaacacugccauuuccuacaauuauugacuuguguuugggguucuacagagcaugugguacuagcucugcuugccuacaaacccacuggcaaacucuuacaucauauaaagcagagcauacacaugaucuacuguuuuuuuuuuuuauuacguauuuuccucaaugaaauuuccaaugcuaucccaaaagucccccauacccucccccccacuucccuacccacccauucucauuuuuuuggcccugguguuccccuguacuggggcauauaaaguuuguguguccgaugggccucucuuuccagugauggccgacuaggccaucuuuugauacauauguagcuagagucaagagcuccgggguacugguuaguucauaauguuguuccaccuauaggauugcagaucccuuuagcuccuuggguauuuucucuagcuccuccauugggggcccugugauccauccaauagcugacugugagcauccacuucuguguuugcuaggccccugccuagucucacaagggacagcuauaucuggguccuuucagcaaaaucuugcucguguauguaauggugucagcguuuggaagcugauuauggaguggaucccuagauaaggcagucucuagaugguccauccuuuugucgcagcuccaaacuuugucucuguaacuccuuccauggguguuuuguucccaguucuaagaaggggcacaguguccacacuuuggucuucauucuuaugaucuacuguuugccuaacuuugcaacaagaaggguucuggguagauguuagugauugccgcugauucccuugguguaacuuuucuuggaaucaagcugucccuuugcaagaaguucuuuucuaguggcaguuauuuacauguuauugaccaaaggaagugaugggcccagucauacuucuccaaguuucuuaaugaaaguaaugauuuuuugaagguaauaacuaagaucuguucauaugucugucuuuauucaauguuuuguuguuguuguuguuguuguuguuguuguuguuaaaagcuaccacauuauacuuuaagacgaaucugcccuaaaacuguuguguuuugaugugcuaauggaugaguguuaguacaaguauauguauucauauuagcugaggcaggaagggcuccuggggaugcugcuuacaguguggccggccugccagguggaugcacagguaccuuaagcacuaguuuuccucucucccuuucuucuugcugaccuaugaaguucaacuccuucagaacacuucugauuguacuuacaaaauacaucccuaaaacuguagaagcaccaugagaagagaaacuggagcuuuagggacuuggagucguacaguuguaguuuccugggaaaugcccaguaaacauugauuaaaugcaugcaucuuaauugucuagagacagagccacagaacugaguguaagaguuagagaaccccuuccagagaacaaaauuccauauagagauccaagguguacuugagagccuacagacagaaucuagacuuuugggcacacugacugcuacugagaguaagacaagguggcaguagguaguaaguuuucauguuggguuugugaaaacuauaguacaaaacuaccauaucccccagagucaccuuuguagagcccuucuuccgugcucauugaugugaccaugagugucaguuuuuaggacuaagcuguuguuguucuguccuucccuuuccaucaguacugcaauuguaguggcucuuuaaugaggacuagaagaauuuggacaaugagugugcauuuaaaaagcagucuucaccuauuggucuauagguaucugauuauagcacucacucuuuaaacuagacccugaauuacagacuuuccaguuuaauucauucuuuguuuuauaaccucaacuccuacagcugacagcucucaccacacucacuguccccaucacuaggauaaccccugaugacagaacuugggagguuggcuuggaaguacugugaguugauaagcacagcucgugagugugcuugaaagcuuaauucaagaaaguggagacuugaagucaaaauggugaccuugagguucuucuuccugguuuuuaccaucuauuaugcuauuguucuguuugaccaguaagaaggaguccuagacaagguccugagcuccuguggaauagaaaccaaaagccuggagccaggaaucugcccuucauuaccaaagcuugccuuguucaugcccacagcuauauaucguccuagcauuuauguaucuguuggauugcaggugcugugucagaagcugugaccagggaugagaguggggugggucuguuuaauaacuucacaaggccuugacugugaaggacccagacaucugcuuuagagagguaccuuucccagacauuacaaaagccccuauuguuugguacccuaaaagcacauugucccuuuaacagggcucuccuuuagucugaguuagaauaguuaaguggauuucuugaaaaccaaaaauauagcugaagaaggaauuggguuauucuaggugggaaaacaagccaaggguuuggugaguuagaguaaggggugcauacccugccauaauuccaccuccacuucuuaaccuccaggucugaagagcuuucagaccuaauaggucccaguguaccucuaccucuagcaggucuccucacuugucucugggaggaaucuuuuuuucuccuugggugguuggggaguguguguguguguguguguguguguguguagacuauguauaugcagcugucugcagagaucaggagggauggucugugcaguguaaacuuccagcaaggguccugggaacaaaacuggaaucucuggaagagaaguaagcacuauucaccacugagccaucauucuagcuccagggggaaucuuuaacaaguucccuagacaguccccacugccacccugccugugccuggucauuccauggcuuucuuucuuuauugccauuuugugauguuccugugguauuaggaguacacagugugucacaucaaccuccagaaaucgucaggucaacucacugugguucuuaagggccuuccugcuuugugcagaccccacaccuguaggaaggaucagagaaugaauuucucucuuucuucaagagaauacauccuguaugcagccaucaaggggaagggguaaggauccaucaagaacuguagaguguaugcuguguucauaggagggagaugugugugguaaucuucccagguucuuggaucugaaucccuguaucuguugggucagcccucccaaccacuaugaauguguuacuaauuuuaccccugaggacccagaguaaagauaggcuuucccacacauaucacugccauagaauuaaaacagugagucgggauuuauugcaauuccaagaguuucaacucccuucccuuccuccauggcagagcuaaaauaaaagccagguggccagccugagcucauaucaccugaccuucagccugugcuaguccgaaaggucaccuuaguacaguguuaucaaacuaguuguagacacauaagacuagcaggaugggaguagggagcugggagaguugugacuguacuucccuagagaaagaugugaugcugauguugcuauaaauuaccuuggugagggguuaagguaauuaaacaaucauuguuaaacuucucuaauaauaauguucagaauugaaacaauauugaaaaaaacguaaguggauauauccucuuaaaaaggggagggagggaaagaggaagggagggagagagagagagagagagagagagagagagagagagagagagagagagagagagagagagagagagagcgcgagagagagagcgagagagagagagagagagagagagagagcgagcgcccaagcacuagcucagcauugucacacaggcauuuaaccccagcagaggagguagaguggaucucugugaguucaagguuagccugaucugcauaacaaguuacaggacaguuagaaauacagagacuaugucucaaaaauaaaaaucgauaaauaagcaaaaaaacaaguaguaagggugagaacugcccuguuuaugaacuuacacuggccuaaauaccaauggcaaucacaccguugaaugaaacagccuugucugaucagaacaguccuuccaagcugcucugcuagccugaaggaaaagaagggaacuccuucagcaccucccaagauggccucuuaugaggcaguguaauaggcaacuugagggaauaagacuccuuucuauguugaagauuugauuuauaugacauuuuuaacaaguuuuaaagagaaagaagaccaaaugaguuaaauaauaacuaagugggggaaaaaacgaacuaaguggggccuggacagggcucuggaaagauggcucagggaccaagagcacuuacuauucuuguagaaaauccaggcuugguucccagcauccacauagcaauucacaaccacuuguaccuucagcucuagggaucugaugcccucuucugaccuauauaaauguuuaaaagauaaaaaugaaguaauuggaauuauaagucugcucuucuaaacuuggccaguauaacacuuguuuauuuaaacuauaaaugaaauauuuugagguucagcauucauguuuccaaaugggacaaaaugaaaacuuugaugggaugggaugggaugggaugggaugggaugggaugggaugggaugggaugggaugggagauaggaugggaugggaugggaugggaugggaugggaugggaugggagauaggaugggaugggaugggaugggaugggaugggaugggagaugggaugggaugggaugggaugggaugggaugggaugggaugggagauaggaugggaugggaugggaugggaugggaugggaugggaugggagauaggaugggaugggaugggaugggaugggaugggaugggagaugggaugggaugggaugggaugggaugggaugggaugggaugggaugggaugggaugggaugggagaugggaugggaugggaugggagaugggaugggaugggaugggaugggaugggaugggaugggaugggagauaggaugggaugggaugggaugggagaugggaugggaugggaugggauggaauuggagaugggaugggaugggagaugggaugggaugggagaugggaugggaugggagaugggaugggaugggaugggauugggagagguuuagguuaaaugucaacccucuaauucauagacaagauauauaacuuacaagcuucuggcucuguaguggagccagcugcccuagccuugcaguugcgcacauuuggaagcacugagugucucaccucaaacauuaaugaguauuuuacuuucccuucugaaguuucaugcuuccagucacuguugcugaugacaagaugugugguguuagcagaagaccuagcuuaucauccccuuaauccacacccaagauggcccugugcuaguucccaguccuuccuauagcuuccuauccuccuagggacagaugacuauggcaacauaggucucuaagcaaggugaagggaacuugguguuugaagacugagaggccaccugcauguguguaagccccuuccaaguggcaggugaacugugagcacacucuaaugaggaacugaggaauaguguauauuccucaguauagucuaggauauuuugugcuuaguguuaaaguuguauagucagaauauuucuguuuugaauuugcuuuuaaaucuguuuaccaccugauucaagaguauuguaauuucuuuuccuucaucgcaaguauugcuggguucugcuuaauuagauccagauuccuacuaguccaucagcaucagaacauagggaucaaacuaaacuaucaaacuugauggcagauguccuuacucacugagacaccucaccaggcagugauuuuuaguuuauuuuuauuuuucagucccccaguuucucucucaguaggccaaucuuaagaacaaagccccuugcugcaagaaccuacccugauucuccagagggccgcugaggugcucagacuuugcaggcaagguuguuaagucugguucugccaccuaauuaacacuuguuuauauuaauuaguugccacauguacagaaggcagugguccuuuuuugaaguuuccaguuacagaccuaauaagaucuggccugaaaugggacuuugagaaccucccaaggcaagguaacagcuuccaaguccucuacaaguuucucuuucaggcauagacagcucuacagccauuuuuccauaacauccuucauuuacucagaaggauggauggaacaggagggugugcacaggcucucuuugaguuuuuggugcuccuugucaggugucaaaacaaaggggaccauuguguuucuuggaacugaucuaaaagucuguguuugagauuaagaucuaaggaaaugcauuuccguuuaacacccaguaguuucugauugugaaaagacucacaaccuguacaucggcgccguacaugacuacagacuccagccucuucuguugguuccuuuaauuaguaggaauuaaguggaggcugcugcauauuuugagaauaaauaacacuguuuaaacuuaggcagccuuaaccauuaacuuaaccgcuggauucucgcugcuacaugucuccugaauagaucagcauaaucuuaacuaggacuuaaaaauccuucauccgcucccucgcucgcucacucacucacucucgggaacuuagaacuugaagcccaugggagccuuuggagacuuaaugacuuuaauuauggcaagaaguaucuugugguggguaggaguacagcuggugggagagcccuuucucagugcagccggaugggagcuggcagaaaggcagucaugggggaggggacugagaggggugacuugggggggggggguuggccgcagggccucugaauucugaacuguguuuguggcuucagagcuuugaucacuugccagggaaaccuggaaggucaggccaggcugcagccaagcccuggaaugaggagccaagucaguggagcgggcaacacuaugucacugcccucaccucccacccuagaggaaguaacccuaucugcaaccccauccucugguccucuuucugugguggucuucuuuugaauuggggucucuaaagccugcaauaagccaacaaagugccuuccaaaugugacuugguaaaaucagauaugcuauauguacuuuuagaggaaaucaggacugguuuuuguuuguuuuuaauucugugugugccuaguacaaauuacucuagagcacaggugaucucuccugguggcuugugucagguuuccccauuuuuuuuaacauuaccaucaccaccaccacccccaccuuguuucuuggcaccaaguuuuucucacugguucccugugugcccuagugugugaccucauuuccuauguaaugaaaaguuucugucggaaaacagggcccuuggugagugucuuugagccccuuugccuaguaugacucacacuuuagggcacagggcugugcagaauacgcaagagccuggugccuggguggucacugccuagaggcagugaaggaaggagaaaguaaggagugaagguuuaaaguccauuuagugaccuccagagagaagggguacacaaggacccagugagugggcugcuuagaccaggaaaccccaccaagagagagcuggugguggugguagguauggucagguccacugguugaccuccauugguaugaccugccccuaccacaaccaccaccacuuuccccuacaugaccucacuggcaguaggcacaggaccccauacaacaacagaagcuuguuacugccacucugcaagucuguagacugcagaaaagaauggugucucucauguugguguuuaaaaauugugacgcugugguuucugcagccaguacuccuagagagccgugcucugugucucaacagguccugugccuuguucucucuugcaagugguaggauagauuccaucaguccucuaggccagaggaaggccaagggcacauauccaaggguagucaucuggcuagcuuuuccucauuggaauucuauggaaaguucacuuuccuccagagagagaagggacacagcacacacuuuaaauguacaggaauuuuuuuuuuuuuuugagagcuuugaaauccagagauguguguguacaaaguccagggccuaagagccacaggcagagccacuggaguuuaagacuggccagaaacaacaugugugccuuagaagucaaaagccuccuuagcaguacaacagaagauggugcagauaagaaggcaggucuugaagucugaagugugaagacuaaaggcugcagauugcagaguaccaaaaagacauagcuaaacagacggauccuaauugaagaguuggaggauccacaggauucccauugguuaggaguuggcuguagucaguguugggagcaggaaagcccaaguauggugcuuacuaccgagugaaacugaugcugugugagcgcagcaggguacuguaaagaagucugguggccaggcugcccucuugugugggaagcuuuugaagauuggugcugcaauauggagcugggugcaaguguuagaaaaugccaugaagggcaaguuaagugagguaaagcugagcucuagaggugcugcaugcuacauccugcagugggaaggacaaucagaaccaauaggaggacaugguaaaagggagcaggcuguugaguuuggaagcaguuagcaagggaagucaaauuuuaagcagcccuaaaagcaauauagaucccugacugagaaagguccuugugcugugcugucaguaagacaggcuagguagggagagccccagggauaaacuaguuauaacucacaagguagugauaggguugcaacaguggagaaaaauaguaaguagauuuggaaguuauggauugguaagcaguuaaauguaagggugaagcaacagacuaguuagcaugcacuaccuugagagaggagcccacguuguagggaagaaagaauugcuuuuauuugguuucauuucuuuggauuuuucaagacagugucucaccaugcauucauaaacucuuuauaccucugacugacucagacuugcagugaugcaucugccccagccuccugagugcuagaaugacagauaugcaccaccacaagcaacuuaaaacuccggauugaaugaaucauaggcccauggcacccacauuguccugcucaagaaauggcccacaagugucugagauaauauacucuggccugcucuggaaauagcugcagaaguuuggagaaacccaaucugaagcagaaaguuugugccaagucaggggaagcaguccuugggccuccagaaccaugaauuccccacggucgucauuucugcccacuuggguuaagcugcuaucuguaagcccaucugagagcucugucaguguguucacagggugaagggaggagaccccagcaccuccuugccuaagaaagagugcuucacucggagauuaugaaggugcauuauaguagaugcuuccaaaauguccuuguuugugucuuccuugaaguuccuauggcacaauuauuuggcugucuuaaauuguucacagauguaacuguguaauugaauguuuucauaccaguaaccaccauuucuguuaaguuguggauguacguguuauuuaguuauuggcuaccagagcaaaauaucaguccuuccaccuacgagaguaagauaggagagaaggguugacaauccuuucauccaggcugcauaccauggagcauugacccaaacaaagccugcuucacagcaggaaaggucuaugcauugcuuuggaagacuuucuaaugcugggcagucuggagaugcccaaacaugaauaugcuucacaugcgucacagauagcucuagaacaugcagagcuuccagaugaaagcagccaggaaaacagaucauuucgggaaagccacucuagauacaggauaagcaaucuuguguucuucaccucuugcccuauaccccugaacuaaacaccaaccuuccuggugcugcccacaggagugguauuguuccacaaucaucacaugcagacgacgugcuccauaaggacaaagaucugucacugucuucuguucagugcuauauauguucccaggacuuagcacacguaguaacugacuaauaacuacuguugaacagcuaaauuaguaaaugguaaugcaaauggaauuagaccauuccucacugcuauguuaauuauguugagauggccuggggacaucuguuuuguuaggccuuauggaguauauaaaugcaaccuauaacaucuaccuuuugaccccuaggagucucuguuauccacagaacauguauaguaccugagugagguguuugccuguaggaccacucagauauuuuaaggacaggugccacagagaacauagcuaucucuugccugccuauguuguucauuuaugucaucuuacuuugucauuaguacaauugaaugaaaucuaagaagcauauucugugaagauucuuaauaaucuuccuguuucuuuaguaguauuucucuaucuuaaggaaauuggaaugaaagucaagauccauuuaauguaauaguagaaaacagaaauaguacagauaucaaaaauacaugagaaggauccaggccuaauggugaaggacgagugagguccaacuacagcccuccaaaaggaguagucuaugaagggacauaucaucauuggcacacaccuuuaaucccagcacucagagacagaggcaggaggaucccugugaguggaaaccagucugguguguaccuaguaaguuucaggacagccaaggcuacauagugagagaucuugucucagaaaaagcaaauuuacagcaugugguccauaccuguaaucucagcacuugaguugcuuaggcagcaggaucauaaguucaagagcagccuaggcuacaaaauaauacucucuuuaaaacaaacaaacaaacaacaacaacaacaaaacagggcuaaagagaugcuacugacuguucuugcaggcgaucuggguuuccauucucagcgccacagaggagcuuacaacugucuguaacuccagcuccaggggacccaacacccucacagacaugaaugcagguaaaacacuaguguaauacaaacacauaaucauagacacacacccacacacaaguugauuggaacucuuauauguuagaauuucccauaaguagcugacacauacaucagcuauggacagcuuguuacccuaucauccagaacucagagcaaugguuuguuacugcccucuccugugaacccagcuugccagugacccuccccuggccagggucaccaggcugucuuucccauccuuucuuucagguagcuuuaucuugagaguuuuuaaagcauuagggguauaguacuauaauauaaauacuggucacaagacuggaaaucuucuaccuagguuuuagauuaguuugaaauacaaauaggcaggaaguugacuagauaaaauuggaaauuaucuaagauaagaaaauucacucaaagaauuugacccuucagguuuuuaaaauuauauugagucaggaggaaaaguguaaccaagcaauauuugaugauuuuaagauaaaacgaaaaagaaaacuccguuuguaaaugaagauuacucguggccuuuucuugaggauuaagcaacucaggauuacauccccugccgucacagucuuuucuaaagccaucucucaacaggcaagauuucaauaggaucuccucucaucaguucugauaugugcaggaaauacagauuaauucaguaacauauaauuuuuguuuuguuuuuuugagacaagguuucucugaguagcucuggcuguccagaaacucucuguugaccaggcugguccugaacucagauucgccugcccuugccuccugugugcuaggauuagugugugccaccaccaaccagcuauuuuacauguuuuaaaaaaaaaguuucacaugguccaaacuucccucaaacucucuauguugcugggaugaccuugaacuuuggaauccuccugccucuaccucucaaaugcuggaauuacaggcaccauaccuagucuuaugcaguacugaggaucacuuuauauaaagugcuaggguuucaugcaugguuggcaaaucuacccacuguguuacaucuccagccucaauaaauauaauuuuaauauaauucacugaaaauuaagcaucccucagccacaauauuugcccuuagaguccgugcauuagugaauugugcuguagauggaauucaagcaguuuauucucuaccugccugccucaccaaagaaagcaaguaugcuuuaaagcaucuucuguaaggcugcaaguggagcccaguguagagcacauaccuggcauggaugaggcccagggcucacccccagcucuguggugucuguccugaauggaccgugccucuggaacgaaugaacauccauguuccuauggaacaagaaaugcugggaagcccaggaggcccucuggcugugaguuucccugaggcacauuccaggaaggcauucccuacccaggugcugcagucacugccaaccucuccaggugcaccagcaucaaagcuggaggaacaagcacucccagucaggacaucccugaacucacacucccacagggacucucugauaugcuggagcccuggcugaaagcaagguuaaaaacaucagaggcucucuuuauuucguccucuaggaauggaauuugugaagaagccuaggguaccacuggggcagaaacacuaguaccugcucagaaagucucugagcuacugcccuagggagcuuaauggaagagaacaaacuugccaccuaggcuucugcagggccauggcuguucugagguugggacuacagagauucagugacuuauguacgaugcagugauagagcacuugcuuggcauaaacaaagccugggcuugacccccccacacacacacagcccgcgcuaucuagaagaaaaagagacacugaaccucacuggucacuugggaucacugacuguaaaacaaugaggugguccucaggcaacuuucugauuguucagccucaguuaguuuuuaaggaagcugcccauagggcaaggacaaauucuauagcaccguacccaggauuccaggguuucuuaaacuaccaaggaaaauacuuuauccccaauaucaccgaauuuugacuugcugguccuaaguucagggaauuggcuuaaaaagcaacggggugacacugcccucuagugguccaguaaaguauuugcccguuggguuugugcaccugucagcacagguuauuucuguggaaagcauuuggauuuauucucauacucuugggcccauggugaugugacuucugagcacuggcugaaauugcccauccguuagcuguuuugggaauuugcuuuguuuucccuguauuuuuuuuagaguggcugucucuguuacaagaguucaaguccuaaaagcaaggaucaaucucgugucucuucugaagccucaacucuguuguucacuuagcuggagauaaaauuagaaaguucauugagguagaaaggaaucuuuucucccucccugccccaacaacaaaaaaauucuaucacuucucauuuguuucuaagccuucuugucuuguuccucugaccucuaguuuuccagcugguaggauuaucugagucccugagagcuuacagaacucagcuuccugggccugccuccagccccacugaaccagucucugugguuggagccaggaaaucugcuuuacaaacuucccaagugguuuuugaugugcagccuagcuuggcagccaacugcucuaaauccccacuuauuguuuauuauaacucccccccccccagacuccagaggucuucaucuugugucacaaguuaaaagugaccaucuugagauucauucagaaauagucaacaugcuaucuuaacuggauggcaugggaaggaagaaaggaccacaagagacaaaccaaaagcauuuacucugguugccaggggcagcauguuuauagcagaaauaccaaaccaauaccgcugugcuggcugggcaggcugcccaucuauagucuuguuuuuaauguuccagcuagaucgggggucggggagagacaggcuucugcaggagccagugacucauucccacccauucuaagucuucaggcucuuaggaagagaggacaaaguagguggcauugucuccuguuuugcagaugagaaugccagagcuuagggaagaggaucaacuugcucaggggcacagacauugcuuguugucccguugugcauucugaagccaugccugauuuauaaggccaguguuggcagucagaggacagaguugcuaaccugcucuuuuucacuccaccaggccaagagagcaguucagcggggagcuacugcaguuaucuuugauguaucugaaaauccagaagccaucgaccagguaaaccaccacuacagccaguccuaccaucugccgaagaggcauuugcuuuggccaucuugaguggcaguguuuugacacccuugucuaagauccuuguacuugucugcugaaguacucugucuguguuugaguaucagguaugauaccugagagaggcauauggaaaggaguuguggguggaggguuaggcaugagggacauuuucagaguuucuggguuuugggguagcucagcccaucuuaaaacaaguauagcauccuauccuagccuuucuggaaaccccaaggcuauaauucuugaagacuucaaggauucccaaauagagauguagcauucuuuucuuccucucgugugugugugugugugugugugugugugugugcgugcgugugugcgugugcuugcccuugcauguacaaaccaagagcucuaccccugagccccauuccaaauccucuucuuagauaagcaugucuuuaacugugccgcucuucuuugucagcuaaaccaaggcucagaagacccucuuaagaggccagugguguaugugaagggugcagaugcuaucaagcugaugaacauugucaacaagcagaaaguagcucgagcaaggauccagcaccucccuccucgagugaguggcagccucuguguuguccugucugugcuuuuguuuccuuugagcuuucagccuucucaucccuguaucuacaaugcugguguaauguagguuccuacagggugagcucaacuauggcacaggaggacagagagauuuucacccauguuucuuuauuuguaaaacuguguaaaagcuuauggaaacagacacuguaugcuauaaagucugguuucuccaaccuggcauagccccuuugcaguucauucuuuuaaggaacaagccgagaaaaaugaaggaugacacuguagcacuuggcuuucuuuguuuccuuuucuccaucugaucuagagaugagaaaaaaccuauacuuccuccuuucaaucauauagauuacucacuugaaauucccugacucacaaauaagaauguuaagaauuacucaaaacauuagaaauuacucaggccucauacugacauuuuggugacaaguaguggccagacgccucuucagugugcugaagcaguauuacugcccacugauacuucaccccaagaaaagaaaccagggaagcaugcagaacugacgucaucuccucagccuuggacuaaagcauucuagaagucuggggcuagugcccugcguauguuuucuuuccucuccacgguuacugaacuguuccuaugugggaugauucuucccuguaccaaguaucuggguagcacagcaucucacuaggguccucuucuuauuggcuaaaugcauguuuuaggugaaguagcuucaggugacagaaggcacuguucugcacagaagagauaaagacagccgggugaaccucaguugguagaaggcuugccuaguauccacaaagugugaaggucauuccccagcacuauauaaccacuaugguggcacaacugugaucucaguacuuagaaggugguggcuauagaguuagaaagccauggucauuuucaguucagcuagguagaagaccaaccuagaauaaacacugccuugcacccccuacaucaccccaagaaaagaaacaagggaaguuuacagaacuggcuugcuggcuucuuuuugaaggaaagaggaacauugguaaaugugacucauuguagucgaagcugauauuuguggaagaguguacaauuuucuaaguuguuguaaaccauuaaauauaucauuaguaaucacuggucccucaaaacacaucacuccuuugucuauacugugauauuuguguuuauaaucacaguuuagaggggcuuuucucacuaguuauaccaaauguugcaguguuuuaaugggaggccaaacucaacaaauggcucucucagcuacuagaaagaaagccuugggccauuuuagcuccccacccucauccuggccacacuaaaggcaccaucacugugcaugugagcuuccuacacacugagggaccuguccucauccuucuacuccauuucccaacuaggacugacaaccaugugcacaccaguuaggccaaagagaacaugguucauggcauuuguguucuauucuagcaacccaccgaguacuuugacaugggaauuuuccuggccuucuucgucguggucuccuuggucugccucauucuccuugucaaaaucaagcugaagcaacgucguagucagguaacccuaggagugaccugugaaccccauuacccuguuccugaugacagcuggggaaccagguguaguggcacacucuuuuaaucccaguacuugggaggcagaggcaggugggucuccgaguucaaggccagcuuagucuacauagugaguuccaguagagucagggcugcuacgcagagaaacccugucucucaaaacuuaaaaacaaaaaaaagaaaagaaaguuagggaucugaccagccuguugucuauggcacccaaacuaccucaguggcuuggaggguaccagaccucaaguacugagcccccauguggagaagagcaggcuuguccacaaaggccucagcauugaggguguuccaaacuaguauuuugagggaacuguuuaaauaaaugcugcuuuggagcaugagaccuugcuccuuuaguagaucugagguugguagaaauaaagacggucaggcuccuaggucuuaugaugaaauuugccucugccagguccaucuguuaaauguugaugaacagguagcuauagcuaguacucuagcaaucccaucacuguggcuuacaagagagaaguaccuauaggcagaggauggugagagggaaagcaggagacuagacuuugagauauguggcggugugacaucuugggagaaagggcaccuuagauagugacugucaaaaggagguuacaguugucaggaggguugaggggccaccaccagcaagacaggacuagggguuaguauuugugcacucacaccgcaugucgggugcugagcacucacgucucauuucccuggcuuccuucaacaaggagggacauuugaccuagagccuucuaaaacccaauguugcacagaauuaaguaucagagacagggaauugccuuuccucuugaaggcaagacuuuguaguagagucagugucgugggcacuguuggucuaggaaauacagugcaauaugaauuuggaacagcuccucagggaucuguuugaccuaagugagauuaguuuugucugucacagugucaugagugccauggccugggguaugccuaccacugauaaugugucccaacacugaccaugcucugccaugcagaauuccaugaacaggcuggcugugcaggcucuggagaagauggaaaccagaaaguucaacuccaagagcaaggggcgccgggaaggaagcuguggggcccuggacacacugagcagcggcuccacauccgacugugccaucugucuggagaaguacauugacggagagguagcugcaggaucagggccugccuugggugggaagggauguacagaggccccaggaggugcuggggacuaccaugaccaugacuagaguucuccacaaccuagauucagugcguaagcuucuaaaggcauuucuuccuggggcugggaaaacacaauacucuauagauggucuagcuaauaaguacaugguuggccaggguaguagcacaugccaguaguuuuagugcuugagagacuacucaaaagaagugugaguuuaagaucccggcuuugccaaaaugcacaugguugaacagaaaauauauagauguaagaucaaguugcuuacuuugcuuugaagaacugguuaaguaaugaguuuacuuggagaaagucuagaaaugugaugccuuuuguuuuuuccuguagcucuuuauuaagaguugcaaguaucaggaacagcacagaaccaccauucacauauuuugcuaccuuuaugucugucuucagauggacagguacauacauaguggagaggaaacugccugagaguccaggccuugaacagccccuggauaagaucgaccuccccccugauguguagguugcuggguggaaguauguuuguacacaggcccuuggaugauacgcuuguguagacuguacguacagacuccugggcucuaaccuagcccaggcagauucuugguuugugaacuugacgagugacuucauucugugucugcgcuugugacaccaaccagcauacuagauucucacaaacacuauuuaggugagaagauacaagcagucuuuuuauuuuucuuuuaagauuuauguauguauaugagcacucuaauuugcguguacaccugcgugccaggaucccauuacagauaguugugagucaccaugugguugcuggaaauugaacucgggaccucugaaagagcagccacuaagccaucucuccaacccugauacaggcauucuaaagcaccauauuggcuauuuauuuuaauaucacuguaucagacuggugggaaaaggggaaaaaaaagaaaagaaaaggaauaagaacaagucaguaggauacuucgguuuucuuucaaauuggcugcuuuccuuagaaacaauguggcccuaucaaguguuccuuuucuacuugaccucauucaaugguacuuagaggcaaccauccaguaguucucaaccuuccuaaugcugugacccuuuaauacaguuucucauauuguggugacccccaaccguaagauaauuuucaugacuacuaaauaacuguaauuuuguuauuguuaugaaacguaauauacaaagcuguauuuuccgauaauuuuuugaggucuugacccauagguugggaaccacagaucuauaccuauauagauagccucggguauuuguuacucucccugcaaacccuuuguucccuggccuguggcuuuggacuuagaugugcccccaguuccuggaaaggaaucugcuuccuuaugcuccuugucuuuuagcccugauagcugugguuaggacagaugaauuggccaguuuccuucuccuugugggccauacuucaagggaugagacuggccuuuagaguuagggaagagagugggaaguacccugacuuuccauuucuguaacaaacacuugcaguaauaaacagguaaagagcaaagguuuguuuaaacacauaguuuuagacuuuuguuuuauuuuuaaugauuuuauuugguuuauguauaugagugcucuaucuacauguacaccugcgugccagaagagggcaucagaucccauuacagaugguugugagucaccaugugguagcugggaguugaacucuggaccucuggaagagcagccaaugcucuuaucuuaugaacggucucuccagccuaguuuuggacuuuuaacccacacacuuaccacaauccuuuauuaggcuuauagaaaggcagcauaucauggcaagaauaugugauggcuaggacuggaaaggugccucagugguuaugagcacaugccuaucuuggagaggaucugacuucaguucccaguacccucuucuauucuccucagguaacuacacacacaugcacagauaucaagcaugcauacacauaauucaaaguaaaaauuaaggcagccaugcagccuuguaagucuuguaauauaccgccaugaauuucucagaacaguggaccuucuucuuuucuucuaucucuuuucuaagcaugcuuucucucaugcuguagacuuccuugcucuuuguccaauuaucugacucuaggccagcuuaacuuaacuuaacuuaaguggcaugacucucuucccucauccauuguccuuggagcaacugaugaggcauacugcuugccuggccuggaaguuuucucuuuaucacuaauaaaauuauccaggaggacacaagaagaggaagaaaggaaaccaggcccacuuggcacccuucccuuguacugccgagcuaggaacacuuaggauccaucuuacagcagggggacaccagcacagugcacaggcugccuguuccccguuggcuccauugaaagaagcacgugggugaggcugaaggcagaaguacccucucuccaguucacccuucggucuguguucuuuaucucucucugcaggagcuucgggucaucccuuguacucaucgguuccacaggaaguguguggauccauggcuacugcagcaccacaccugcccccacugucggcacaacaucauagguaacuauuacaggccuugccacacccugacccuacgaaguaugacaagugcgucauacuuugggcucaugagcaagcugaaccaacacagcaugguuuucuggaccugcagauguggaccuuagguuuuggaaguuguuugcacaacucuaagcagaaccuagcauuaaggaucacuuugagcugcaagugacaugguggcuuagugguaaacuguuugccuaggaugugcaaagcccuagguuugacagcccccuucgucccccgccucuaaagaaaaucaucuuauguucaaguuugaguuuccaauuaaauaggauccuaguuggguaugggugugguaauguauaccugcauacccagcacuugggaaguagaagcagaaguucaaggucaucauuagcuuuguggcaaguuggagaccagucugggguacaagucugaggaaaaguaaaaaaaaacaaaaaacaaaaacaaaaaaacucagccuccugaccuggccuccuuaagccuaaggccccaucucuuuaacagaugacaauaacauugacugcccaggccuagacuauaggguuguuuccagugacauagggaugaugaacaugcaauggcaguguuugcagcugcacccacagggcagcgugggaggcacucucgucuuuguauuuguuuugcucacauagacuauauguggggagaugggaaaagagacaggucagccucuaccuacaguguacaguguggcagggucaagcauagacuucccuggcacauaguuccacuugaugcuucagucucuaccccauuaccuuauuuccuccaccucuuccagaacaaaagggaaauccaggugcuguuuguguggagacaagcaaccuuacacguggucggcagccaagagugacccuaccgguacauuacccaggccgugugcauaggaccaaugccaucccagccuacccuacuaggacaaguauggacucccauggcaacccugucacacugcuaaccauggaccggcauggggagcagaaccucuauucuccacaaacacccaccuauguccguggcuacccaccccugcaccuggaccacacucuggccccucaucgcugcagccuggaacaccgggccuacucaccagcccaucccuuccgcaggcccaaguucagcagccgcagcuucuccaaggcagcuugcuucucccaguaugagaccauguaccaacacuacuacuuccagggucucagcuacccagagcaggagggccagacaauacccagcgucacacccaggggccaaucccgugccuucccaccaaguggugccagcagccugcucuuccccacaaugguacauguggccccuccaacccacguggagaguggcagcacaucuagcuucaguugcuaucaugggcaccguucuguguguagcggcuaccuggcugacuguccuggcagcgauagcagcagcaacagcucuggccagugccgcugcucuuccagugacuccgugguggacugcacagaagucagcaaccaagguguguaugggagcuguuccaccuuccgaagcucccucagcagcgacuaugaccccuucaucuaccgcagccgggggccugcugugcaccuugagggcuccccuccaccagaggagcucccagcaggacacagucaaagugcugggaggggcgagccauggcuaggcccugccucucccucaggggaccagcuguccaccugcagccuggagaugaacuacagcagcaacuccucgcuggaacccagagggcccaacagcucuaccucagaaguggggcucgagguuucuccuggggcugcccuggaccucaggaggaccuggaaaggggguccagagggaccaucaugugcuugcugcuucgagccccagcccuucccgccgggcucugggauagaaacaagugcagguggcagcaguuuauuccuggguccucggcuccucgaggacugcaacccuccaaguggggagccacagcuggggagcucccagggccuguauggucuucacucagaccauuauccuaggacagauggggugaaauaugagggcuugcccugcugcuucuaugaagagaagcagguggcccacagugcuggcaggggcaauggcugcuacacugaggacuauucagugaguguacaguacacacucaccgaggaacccccacccagcuguuaugcagggccccgggaccugagccagcgcauccccauuauuccagaggauguagacugugacuugggcuugccccaagacugccacgggaugcacaaccacagccccugggguggggcacugagcuuggacguuccccgacuccacuggagucuaggcacaacccgggaagaggaacaggcuccauguuaccaagcugaggugcagccuggcugcucuccagaggaggcaggugcuuccagggcuagccucuccagugccccccaggacacucaggagucucaugcccuggcugcugaggcuucaggugagaacagaugacaguaguauuuguauaaggauccuugucucagaccuuuuuuguuuggcuuccucugugccuuuggcuucuguacuugaugacuuucaaacauugcuuuucagcccuaccccuccucaaacgcuauauccaugauguuggcaucuccucccaucagaugcuucauaucccaaaagcacaucucaauuuuauuaacuauucugcaucuccuaugguuccccuuaguccaucccugugucuaucaaagagcaaaguccugacagaggucacugcaauuguuugcucucccacuugggagaccuuaaucacgguccuuauacuagaaaugcuaucgugacuuuucaguuaccuuuauaagaugucuguuuuuguguguuuucuguuugguuuuugagacaggguuucuuuguguagaccaggcuagucuugaacucagaucucucugcuucugucuccugaguacuacugggauuaaaggcaugcacuaacacugcccagcauaagauaucuucuaacuggagaugcuccuuuugauccagccugugucuuguuccugcagcaugucagguucauuuccaucuccaucgagauccuucgaucucagcuccacagccuuccuuuccccaucagugucacucccacugcuaucuccuaaucaccucaagccaggcaccucgugggaagaucugugaucugugaggagucuccccuggcccccugggaacuaauucacuuaacuucaguucuaccuaugcuucugugauaucuuaggagauucaguauaggcaucaagggagaccugcucacccucugccccaacagcuguucucaguguagacuugagcuccucaggaaaggagccauugcugcccccuuuaucacacagagccaaaucaccauugugaacuaucacauccaagggcccuauggaugggcuagggaugcucaaggaccuuaccugauacguacuacccaaagccugcugugcuggcucucuccagacccuugaugacuguucucccucuuucucccaggaccaggaucuggcccaggcaucgguacgggagcuugagcucaaaaggaacucuuauguagaaaucgugaacuguacggagacuucaaagucuggcuuccuucaaaacuacuauacacacacacacacacacacacacacacacacacacacacacacacacacauauauauauuuuagcuuugacaaacacaaaagugguaauaaagagagcccuccucaacccaaaaugugagccaccuguggcaucccuuccucuuuaacaaaccaacagacaaaaaucucuugaguccuuugccucuuuaauaauguguuguucuguuuuguaaugugugcuuggguuucugaggugugugggauugaguucucugcuuuuuuucuaaaauauuauauguaaauguaaaaaguuauuuaaauauauauuuuaaagaacccuaacuaccaacuucuguugaaaaaaaaaaucacugcugcauuaaaugaaccacaucaugugucaauacuguugucucccuggagggaccucaggccuuugaaaagcucaggguuacaccugccuuauugaaaaugaaccagaaacuugaaguaaaaagcuccaaggaacaauacaaagcugccucauccuuuuucccuuuuuugaggcaaaucugaacuucugggcuucugggaagccacaccucuccugcccacaccuguaggcagcaauggaacaggagggaagugggggcagugucaagcuauuacugccuaggccaacuuuauuggagacaguucugcccauucucuucuguuccuuugguaggucuuuaucccagcagaggcuguggcugugaccagcccuguuacuagggucucuccugcacucugaccaccagucaagggaagagacgcucucacccuguggccuuggagucuuuuguaaaaucauuuugggcuucaugccaucaauugcagggguaauuuaaauggggugugcaggguggacacccaggaggaauguugauuuauggccuugguguccugugggacuagaggaacaagcucuccucucaguagcagugcaccgcuccuugaaaggcaugcugaggcacacuugugcccaugggucuagggcagccacaccccucagcuguugcccccuuagguugccuucuugggggacauaugcuugaaccacaagaguguacuaagcuccaauuggaccagucccccauccccagaaacaggccucugccugguggcugcagcgguucaccuugccagcagaugucugcuagccugucugccugaugcacuauuauguacugauucuccacgagacagacuaucagauaguucagacccaaaggguaggcuuuuguauauuuuuuccagccucuuuuuuuuuaaggggaagaguuuuuuaaacccaaaccacuuuugguuguuuuuguuauuguuuuuaagauguuuuguuuauuuuuaaaagggagagagaauuauuuaaaaucacuucagggauuguaauccuuuuuauucaaaauaguccuuguucuuaaaaguauuuucuuuuccuuagaggaaacuaaucggcuuggcccuguguuugcuaacucuucuggucacuuuuagucauucauuuagcagaugucuuuuuccaucaggaagaguuuggccgagugggucugaaaacucgguuacagaauggggaccaccuggguugccagagacagaaaugacccuucuucccagucaggcucccaggaagucaucccaggguccagauugcacauuugagaugaucagaauacuuuguucuuuaaaaccucguccuaggaugagggcauuugcuuauuucuauccagaaucuaacaaaagaagucccacgucagauggcccaguuauuugcccuuuaggaaguggccauagugaaauuuguucuucugccggacucuggaggucggucccuugaggcuaugcccagugcaccuguugcugagggugugagaagggccuaaacuguugacauguaaucggggcugccuuucuuucuggggccaggaguagcagcugcuaagaacagcagcuuuccuuacugugcaaggggggggguggaggcacagcuuuuaacaugaacugcaaagcacagcuucucauuguugagauguuuguuguuucugguuuuccuuuuuuuuuuuuuuuuuuuuuuuuuuuuuugugugugugugucuguaugugcauauuucuccauuggcugaaacaaaccccagaaagauuuugccuuuguccugccuggcuagaaaaccauuucucaguacucauagaugaguagagaauuugaaugccacuaggcagaguuaaaaaaacaaguucaacucuccuuugaaaaaaugcuacuagugggugacaggcacuuguaauuguuguaguuuuggacuaguagaaacaaaagauuuagagacaauuaucaucuuuguguugccacaucagaccagaauaaaaccuaucuuaugcaccauuuaaaucagaagaaauagugucuaugaaguucugagagccacagugcucucuucugugcccucuucuggggaggggaaguggaaagggagugucaguaguguguggugauuguauagccauggacaaggagcaccccacuguccacugggagccuguguguggaauagcaagugugggcuugauaccagcccuggguguaagacagccaugccaacccaaaaucuagaaccagaugaaaauggaaguuaagucauuguguaccuugaggugccucuguggucguagcuccagaagcugaccauccauccccucucccccaggcccagaccgcuguauccgugucccucuuuagucccgugguucaggccuuucccuaugugcuucugcucucaaaguccacacaggacugaugcuuuuaaaauguggucuguaaaagaauuugaaaguaucaucuuuuaaacugaccugcauuuuucuauuccuuacauaaacuuuuuguaucguguuggucuaaugacacuauuuuaauuuuuuuuuuauuucucccauagcacuuaauauuuuguaaagauuuuuuugugauaaaauggucuaagggcucuuuuuccacauuaccauuuuaaaaacuuuuaaaagcuagaaaacaacuuauguauauucuguauauguauagcagcacauuucauuuauggaaauauguucucagaauauuuauuuacuaauauauuuaucuuaagccaugucuuauguugagagugugacauuguugaaauaaucauugaaaaugacuaacaaggcccuguaaauacaugauaauugcacacagauuuuacauauuugcagaccaaaaaugauuuaaagcaaguuguagucgucuaugauuuuguaacaaauuguacaaaugacuguaaaaaaaaauacaauuuuaucaaguaugugucacauguggucauugcuguggcuccuaacgucuagagccugggccagugcucugauuuccaucguauccagagaugccugugaccuucugcuccuauuaacagauuccaagucaucagaguauuggcuggaaccuguggguuauauccuugaguaacaguguguggcaggacccugaagcaggaagaucacaucuuucagaccauucuggacuacagagugcauccaaagcuagcccgugcaauguaaugaaacccugucucaaaaaaguaaaagaugugcuggagccugggcaccugccagcagucaaggcuguagguucgauccccccacaccucccuuccccugcccugugccauccacagaaaaccaguugggcaugguggcuuugcuuaggaggcaaaagcagguggaucccuggguucaaguucaauuuagucuacauggugaguucuaggacagccagcucuguguagagagccugucuccugacccccacucuacccccauuuuuaaaaaaaggacugaaacuuugucucuuuucccuggaaggguagccacuaguuuguaaaacguucugagauuaggugaaaagugcagcuuauuuuucagacauacugcagaggagaguccaacccuaugaguuccuauuguuucuuauccuagcuugggccacuucucgggugacagcagccguacucccucccagcuucccaccccuccaugcacuccugguggcagcuuccagaggaaagcuucccagagccuuuguuuaauggcuuugccuagcuguaccucuuggcgcuuccagaaggaucucagagcaugggcucugccacagugugguacagagcccgguaacccucggugaggaugccauggauguuuggcaugaucuccagcugcuguuccucuuggguuucaggaagcaguguccagcccuugcaggcuaugagcccacugucccuggacaacacuuggguaguggcugcauguuuggcauaucuguccuuaagaucuuggcugacuuguuaacuuuuucuccuuugaacuuucuuuacucgggccaagaagaaagcagagaugucaaaguuaaaacuugagaagggaacucaguauaauuagcagggauuugcgucugagucuucacuauaacaacaagcaccauuugccgaguauagucuccuuacugaguaccuuuacauaugucacugaguauuggucugcucaaggccacaaagcuuagggacuucauagcuacagcugacaucuauugcauacuaagugcgcuccuucuuauucucugccaucccauucaaaaggucuuugcauguauugauucaucuauucuucauggagcccuguaagagaagcgccaguauuauaagaucaaggcacacacuugagacuuggacccugacagccagucucuaagacauacucugaguucugcuggccaccauaaagugacagaacuggacucaucaggucaagccucuggcugccaaguuuuaugaaugcaaguucacagacuauagguaccccagguguguauacagaagcauauacuacgcaccuuuuuccucuuuauuuucccucacugucaacuuccuuuugucuguguauaugaagucgcccuccagaacuaaacauaagaugagcccuaaaucuaacuagaucugguguuccaucccucuaucacagagacucuucuaccccaauccugucuucaacuuaaggauuuucaucaccugcuggugaaaucucugccuuuggauguuccuuccucccauccaucuuaccaccacuggugguuucuuaccucucugaugccaccugcaaaccugugcucuggagugcccagcagcuggccuacuggccacuugcucuugguauuuccugugucucuuggugccuuucaacaucgugcugucacugggcuucagucacuucaaggauuuugcuucuccgagcuuggaaggcacgccaauagcguuuacccuucaauugccucugagcacaaccuugaccagagagaaugaauuggcaauuaacugacucuuucccacuucccaguggugaggugguaccuggugcugggugcuagucugcuuuauauccauucugacugcacagauguuggugggaccacacagcaguccugcagccugguguucaaugagaugguuuacuggaguccauagguagggaugcugggaucuugucucacagugguuggguguuagaaauaaaaaggggaaaugauuuuuuuguucuugcuaaagagcaguucccaugaagaaacuagaguuauguuaagagacuaagcuuuaacaucaucuuacauguuauuccuuugccccagacuuuggaaaucuagcuggauuuugugccuccugcucaucuagacuuauuuuaaauaccaaguaagagaaagaugugacuuuuuaaaggucaugauauuuugguucuuaacagcaugcuggggcaggaagcuggagucaggaagagcucaguaggaacauaaggcaguuugccuucuggaaagaugaguccacagcaggcaggaaaggaauaggacccacuugcaagacuucuauauaagcuacagucacaacuccugcccauucauacacaaacgacagcagguaaguccugcuggacugugaauacaccuucuaaccugauagauagcaaaagccaggaaaagccacucaacagggaacauaaagaacaagguguacuuccugggacugggaacaauuuggguaaauugaaucacacuagaagaccuggcuuuuucaggaauaucaccuauacaaaaaugaaaucagggacuagagagcucggcagucgagagcuggcuacuauuccagaggauccagcaccuuuuucugaccuccuugggcucccgcacauagguaguacacacaucguugaccuuucugcuugaaugugaagcuguccuaggacuuggaaguccagcaaccacgcagcucuguuguuuuuuguuuuuguuuuuuuggguuuuuuuuguuuuguuuuguuuuuuuguuuuuuuuuuuuucgagacaggguuucucuguauagcucuggcuguccuggagcucacuuuguagaccaggcuggccucgaacucagaaauccgccugccucugccucccgagugcugggauuaaaggcgugcaccaccacgcccugcuccacgcagcucugaaguguucuaagagggaagggcauccugagacauagaagcccaggaagcacacagcucugagaggaaguuuccucagcagaggcagugcagcucccaggggaggggcccccagcugagcugaggaacucaggauccucagcccacuucuucauuucauucucuucauugcuucuuggcuucuucugaugagagucacaccagauagagauuuauugaaggguccaggcuggggaggaauaaauccaggcguggcugccucuacuccugagggggagcagacaauuggacaaagcacaaugcuuuuauagggguucuugaugggggaggugaggauuuccagggugaggauuggugggauuucaaguccugagcuuaggggagcccgggauugguggguuuuccuguucagagauugauggcuuuuguucagacuuuucaccuaaaauuagcauaaucuggggagaggccugcugaggggcuagggaugaccuucgugacaguuacagagacugcaaacauaguuaugagaguuaggaaggucuggaggagggccuuggcuguuggagcucuucaggccuugaggguuuaugaagggagucuggcauuggagccuuuccugccucuuaaguggccuuaacaacauauaucaggcucacgcacauacacauaauaaauauuuuuaaaauaaaauuaccauauuuuaggugccuuaauuuuuauuuuagcuaccuuaguaggggggagaaauguuucuuuuucuuuuucuccccuccccucaugucugugcguuguguguugcugcuuucccaugucuagucuagucaccugccuuucucaucugaagcaaaucgcugucugucuagauucuggguggcaaugcaggcaguuuugagcuauucacuccaggauuucugaugucacuuugguuugugaagugggugugggcagguauuacaucaucauauuuuacggucaagugauuuuuuuagaagaagcuccaaaacgucuggagucuucauuuucccuaaaaggcuugggggaaauucccagugugcuuuaggaagcacacuuugcauaaaaugccaccagacacgcagaccagauuaugugggcacagaugcagggaucauccuuuugugugcagaagugcccuucuccaugcacauaaagaggguacuguuaauuuauccaaauagcugccaagguuaggggaccagaaaugaaagaacacgucccugcagcccugagcaccucucccugucucucuugcccaaggagaugacaugguuucuggaaugugguuuuauuuuacaucccguggcaaaugcaguaauuagagcuguuagcacuauaaaggccuggaaaugagaacaaagaccgccucuuccugggaacucuugggcaaugccucuguccuuaucaggugcagguccuguugguaguuuugaguuuuucauacauagaaugccaaaggaggcuucuaccgagugggaggagggugaaaggauggaaaaacaaaguaugugucugacagggaauccuggaaucaccauguguugccuguuugaaauuucaacuguugucccuggagugaaucaaagcuggcaggccgaccacaccacaggcugcccugugguagagccacccccaggcccacggcaucugugcccacagacacuugggaagacaacgacgccuauucagcagcaaacucuggcuucaccucccaagaggugggucaguuuuauagcaggacauuggaaaagguuugucuuugggaaggguuugcaaauaccuaaaaccagacaggaaaacacccuuccauaccagugaguccuggagagauggcaccgugcuuguaggucacuggacagucacugcauuugacucugcuugguggagaccaggaagccauaggagagucauuuuguuuuccuuuucuuccccagcuucccuccccucccccacagucuccauuauauaaugccaccuagacuguguucuggaacucaugauccuccugccucagccuccagaguacugagauugcuugcaggcaugugccaccaugcccagcacccuuccccgucuccagcuugguuuccucauuagcuuucuuccaggcaccugcccaccacauucacucuguuagcuuugucagucagugauggagacacagcuuaguuucuggggaacacugaaccuucuggcacacagcuauucacauggaugucucuagaaacaaucucccccgcucucccucaugccaggcauuugaaccuugaggcucaagcaugcuagagaaacacacucacugaccucuaucccaagccccacuauucauauuuuaacaguauuuauuuuaaauuauuuguguguauuugaauacaugcacaaguugcuaugaaggcaagaggaagacaccauaucucuuggaacuagaguuacuuacaggcagcugugagacaucaugugggugcugggacccaaacucugguucacuagaccagcaggugcucucaaguguggggccacugcuccagcccugcacgcuucagauuugauuuaguuccuucccucuguucagcacggcucacuucagguuggcugcacccacccacccauccuuaaccaacccuuaguaacugcaccugugcuauuucuugugcaucgauaaaauuuguauuuauugaagaguuacugaaggccagaugcuauuuaagcuccuaucgugaaaugcugcccacagucacaugggugugcggacugguaccacuuuuaguuuacaaaugaagaaacccgaggcacagauugcucaagaacaaugucccagacccuauggcuaauggauccagccaaaguccacguagguugcucuggaccuuucacaguuguuaccauggcucugccucuucccuagcugguccaucuacccaccaucccugggccuaggucaaguccuaucuugucacaagacuuccuucuugucauagggcucagagauuggucuaccagaucaucacucuguguucucugaauuggaauguuccccucccucagacagggacagccaacagugccuccaaaaugauuaccaugagaaugaaguggaacaaugcagagcgaaugccaggcaccacugcucacguaauuggugccaaauauguaauauuuuugcacuaggaaucucaagcaaugccaggcagugguggugcaugccuuuaaucccagcacucgggaagcagaggcaggcagauuucugaguucgacgccagccuggucuacagagugaauuccaggauagccagggcuacacagagaaaccuugacucaaaaaaacaaaagaaaagaaaaggaaucucaagcaagagguguggcauuuugucuucaggugauccagauugaauugagcagcuagcaagaggguucagagauggcucagagguuaagagcacuuccugcucuuccaaaggaccugaguucaguucagcaacucacaaacacuuguaacucuuugaaaucuaauccuuuccucuguucuccguaggcaccacauacauacauacauacauacauacauacauacauacauacauguggcauaaauauacaaacaugacaaggucucaccauguagccuuagcuguccuugaacucacucuguagaccaggcuggccucaaaaacucagagauccgccugccucugccccccaaguguggggauuaaagacuuauuauggcaccacaccuggcuucaaauaaauccuccaacagagaaaauagacaauaagggucagcaggaugguucagugaauaaagaugccugcuaccuggcugccgaugcagugcuggcaaccugaauucaccugccagcaccuacagaaaaggggaagaagagugucaaccccacaaaguuguccucugauuucuacaugugugucauggcacacacacacacaucuuauaauaaaguaaaauuucaaguauguaacagggcuguuuugaugucucaguaggcaagagugccugccacccagugaccugagccugacccccaggguguacacaauggaaagagaaaaucaacaucuacaaguauuccucugaccuccauacacacacuaacacucauacauauacacacaauagaugguuuugaaaagcuuaaaaagaaaguagauaaugcuuuuuaaagauuuauuuauuuauuuuauguaaguacacuguagcugucuucagacacuccagaagagggcaucagaucccguuacagaugguugugagccaccacguaguugcugggaauugaacucaggaccucuggaagagcagucagugcucuuaaccucugagccaucucuccagcccugaauaaugcuuucauuaauauaacauuguaaacuggaccccuuuagguaaaaguauuucugaugcaguuuggauaccaaagcauccacugcucaucgccucccucccucugaccucucacgugcugagugcgcuccaccucugagcucagccccagcucccucagagcuccuuucuugacuuauuuucacggaaucaucaguuguagaacuuccugaaauacugcauuucuugaacauccuuuguuuuguuagaugggaaagggcgccuguagacacagggaggaaagcaguuaggcuuuucaggauucuugccucggagguuguagaaucaugaagucaggcuucagauaguauuugguccagguuccugcagccuagugagggcuuuggucuuugcugucaucuggccugggcggugacaucaauuucacagccaucucacugugaaaacaccagaguuagggugguuagugcuugaugggagaguuuggguugagugaagaagauguauguccugugugucuugcucuaugaaguuuuuuuguuuuguuuuguuuucuguuuuuuguugguuuuuguuuuuguauuuuuuuugucagauauuuucuuuauuuacauuucaaauguuaccccuuuccugauuuccccuccaaaacuccccuccccucucucccucccccuccuccccaacccacccacucucauucccaguccuggcauuucccuauaccggagcauagaaccuucacaagaccaagggccucuccucccauugaugaccgacuaggccauccucugcuacaugugcagcuagagccauaagucccaccauguguuuucuuugguugaugguuuagucucugggagcucugaggguacugguuaguucauauuguuccuccuauggggcuccuuggguuuuguuuuggguguuuuguuuuguuuuguuuuguuuuaugcuauucuguagagcucggucuaaauugcccuugcuucccacguuuggggcuuagcuccuggacaccugcaagcucaagcuucugucuggaaacacaucuguccuucuccgacgcucagccagccgagcuucuuccuaggauuuuuagcuucuguaaucuuucuuucuucucuguaguucuucucggcucuuguuuucuuucuggaggaucagcuaaucaagaagacagugcgccugcuuuuaugaagucuugcuuucucccuuuauggccccucccuucaagccacaguggcauuuccccaucuccucgguuguuuuuauuugguauacaagcagcaaacucccacacccauauggggacacagcugagguucaucaugcaaaaggacagagagccuucagagagaaaauguggagugagcccugaccugugaggcaguggauuagaccacaugacugaacacucaccaaucacaggccuugcaccugacaugguaccuggugcucugucugccccagggccacuggccuccugacuuuaaacucaauggcuccauugccucaucuucacccaaucuucccacugaucacgcuucauacccaggaccagagauucuuuuuuuccuuauuccaucaaaacagugaauuccugacuuucuuaaauuuccuaucacugagauccuauuccugagcuaggaucaguaaacaacucagugcugagccaaaccuaaguccagagaaaaaaaugagaaaacgaucugauguuuguuugaaauguugaaauuggauacauauagcuagcucagugguagaaggcauguacuugauccagagacagacagacagacaggcagacaggcagacuuuugggugagacagggcuuuguagcccaggcuggccuuacacuaucuuguucuaccucccgaguacugggauuacagguauguguaccacacccaguuuuuucagugcuggguauggagcacacaauucagcugcaagacaagcaguccacugauuggccuauauucccaaucucuuucagguguguguguguguauuuaaaauuacaaugcucaucuagugugucuuucagugugugugcccaugggugugacggcugaaugugaaggucagggacaauaugcaacaaccaguuuucuauuuuugccaugugagccccagugaucaaauucaaaucacuaggcuuggugucaugucccuuucucugcugacccauuacacugguccuugggaccuccuucagaaggcuugggggacaggcucugugaucagaaguccugcaaaguccguaggaauucuuugguaagguggugccuccuuauguagcccaugauagcauggaacucccuauguuacaggcuggcuucaaacucacagagagccucucccuacagugugccggggcuaaaggugugcaccacugugccuuccgagcaaaagcucuagguguuugggaucagacaccuuuguguuguguuuaucugcaacgugagagccuucagaacagacuucauuccaaucaaugcuuuacacucuagccugaccaaacuccacugcucaggcagguuccccaggaggagaaaaagaaccugccugcaaaguguaaucaggcgaauggacucaaacgucagcauccuauugaaggcaaggugcugucaugaauauccuaauucuuuccaugaaauaagucuccgaaacaccccaggcaugcaaagcauugaaaugagcaucuggggcuggagcccaacaccacauaacugagcgaaagaccuugagcccuuaagcuaugaccuagacacucucagcuguauuuuuagccuccaggacgauguuuccaucaucugugcugggcuuucagcuucagagagaagguggggguagggaaggccagagggugcuccuuucucaaggcagcccaauggguaggcgcucacaggccuucacacggggucacuuucacgagugugccacauauguagugaaaaagaucagagugcuuggacaggacaggcuaccauuuaaugcucugcugucaacaucuuaaaauucuucuguuuuuucuuuuguuuuguuuugcccuugaacauccaacaaucccccuaacuuagccuccccagugcaggugugagccauaaggccaggcuugaaauucuuaauaagucugaacacaggacccuauauuuucuuuguguguguguuguggggguggauagucuuuagagacagggauucucuguguagcccuggcugucuuggaagucccucuguagaccagacuggccucagacucacagauauccaccugcuuccugaguucugggacuaaagguauaugccacuaugcccugcuaggacccuguauuuucauuuccuaugcagucauacaaacugaagagcuuauucugauugcacuaaggguggagaguuugaugaacaguagaggcugauaccagaucugcaggggcaacuuucuauauaagggaggaggcaccaucaucucaagcuauuaucaggaagccuggaugcccugaguuggccaaaagaaauuuuuuuuuuugaucuccugugugcccccuuccuauuuucuccucugacacccaaaggagauauagaaagaaucuaguagccagguguggugguguggugguacacaccuuuaauaccagcacucaggacgaagaggcaagcagaucuuuggguuggaggccagagcaaguuccaggaucaucagggauacacagagaaauccugucuugaaaaacaaaauaagccgggcgugguggugcacgccuuuagucccagcacucgggaggcagaggcaggcgguuuucugaguuccaagacagccagggcuacccagagaaacccugucuugaaaaaaaaaaaaaaaagaaagaaagaaagaaaaagaaaagaaaaacaaaacaaaaagucuauuaaacuguagguugguuaaagugcaggggauugguuuugcuucucuccagcguccugacugauuguugcuguguuuuggauggaacccaaggacucacuuacccuaggcaaguuucucucccaggguuccacaacaacucuagugcuaggguuggaggugggacucacuagagcgcuggccacacaggcacagagaguacaucuuauuggugucucuguaguauccugggugucugaaauacccuacacacacacacacacacacacacacacucacccacccacacacacacucacacacaucugagcuguccucagcacugcccauguuccugucugucuuuguuuugagacagugccacaaaauccaucuaggcuggcuuugcacuugaguaguugagggugaccuugaacucucuugauucuccugccucuaccucccaaucuggagaugacaggcacccaccuuguuucuuuggugucgagagcaggccuuugugcaugcuaaguaaacacucuaacugagcuauauccccauccaugucugacuauucguggaguggggcaaggcucacccuaccuagugucugcaccaauguucgcuguugguuuaaauugucuuugaagguaaugcugcauuugaggggagagccaagaguguaggguagaggucacagggcuuccuggaggagcaaacaggcugguguuggguugccuugccugaggagguaugaacaaacacccauucacccuaaauuuagcuccgacagcagacaaggaagacuccucccgaacccagcuuuguaaccaacgaauuuauccagucucacgacagaagcugagugacuuaaaagcaggcgcaucaccaaaaagcccuauggcccuuaaaaacaaccucagugaagcagccuuguggagcacuggcuucgguggugucuccccauaucacaggccccugggguagccccuuuauuguuaccacagacuuaaccauaaucguauugcucuuuccuuguugcagcugugggccgaagcucucugcu

SEQ ID NO: 5866 - RNA, 1721 nt, Mus musculus
ggaggaguuaguugcaaacaaacuagccagcuacacgggcacaggcuccuuuagucuccucaaucucaguuacuccacugcccugggcauuuucucuacuggagcuaguuggugacgucugcaaacucaggacaucuuugaccgcuggcucauuggagggaaugcagcuagcaaauauuucucacuaaccauucuuucuuuuauagcucuuuaagaagccucugacucgauggcauccuuucaaaaagaggaacuccggguuggagaccguaccgcaaccgcgaaguaccgaggcuggcuuggaacccaaagccgcaggugcugcuugcugucacagcugcgcgccagcucccgcccugggccacaguaagucccuacccuggggugacgggcacaauuacaccagcucccggagggggauggcaucccaccaccaucggggccucccgggagccgcacaccuguaagcaucuaggacgcggaagccuuuggaccgcgccaggcgggugaggaaggcccggcggcugcggcccauucgcggcuccgcaagguagauggccacauccgggaagcgcaccaccgagggcggcguggaagaggcuaccgcgcuguguggggacccagcucgcacucgccgucgcuucggaagcaucugggcaccaacucuggaagcacaggaagccgcagaacgaaggaaggcagggucaugaaagaaggcggaaggaggagagaggaaguggugucugcucuaugcaaacgagacgcccucuaggaugcuuuuggcuucccaucggaagccccaguucuaugcaaauaacgcccgaggauucuuauuugaacuacucucauagaaagccccagugguuucccagaccuuagaguagccugggcccguaggcggggcuucgccucguacugggcgggcacuuuucuccucucgggggcggagucucggccucucuuccucgcccccgagggcggggucucagguuauccuggccauaugagaaguccuggauaacccuccacugccucugcuggugacagagcgcccacgccacuuccccuggguaugcagaggggaacggaguuugaguaguauacaugugagcugguggagggugaaaacguuuuccaauguaacgaacagcauugggacagcuggcguuccauuuggaaaguuaagucugcaacccuauagguuggaacaauaauaugaacuaaccaguacucccagaucucaugucucuagcugcauauguagcggaagauggcuuagucggccaucauugggaagagaggccccuuggucuugcaaacuuuauaugccucaguacaggggaacaccagggccaagaagugggagugaguggguaggggaacagggcgggggaggguauaggggacuuucgggauagcauuugaaauguaaaguaagaaaacaccuaauaaaaaauuggggaaaaaaaaaaaaagacuagaucccaguggaagugaacagaaaugguuucuaugugcccuuuuuccccgauugaagaaaaauaauuccaguggcucuucaucuggaacagcauuauuuauggauuuuauagauuaaacuuauuaaaauuccuuuauaguuacauuaggaaggauuuugaguccugauugauacccuuuguucaguuauuucacuggaucuuuugucagaaauguuccuaugccccauuaugccauaguca

SEQ ID NO: 5867 - RNA, 10557 nt, Mus musculus
cggaaacccgaagcccccgccccggccaggccgucgcaagcgcucuggagggcgguccgcgugagagccagccacgcggggcaggagcgcccaguugcugccggagcugggcccgccagaaccucuccuggagccccuugcucuccuugaaucucccuuucccaccgcuuucuggauacccuugacgcccacguuccucgcgcccuuucccgccccuacgcggggcgcugccccugccacccaagucccugcucaagcccgcccggcucccgcgcgugcccagagccauggcuccagugcgcaccgcaucccugcucugcggccuccuggcacugcugacgcugugcccugaggggaacccacagacggugcugacggacgacgagaucgaggaguuccucgaaggcuuccuuucggaguuggagacccaguccccgccccgggaagacgacguggaaguccagccgcuucccgaacccacccagcguccccgcaaauccaaggcagggggcaagcagcgggcagauguagaaggugagaaccuggugacauggguggccauggcaucaagugagcauacaggggcucuggagggucuagccacuucccaugcugccccgugaggaaugucucuccaaggcaacgcaaggcaacacacugccaggcagcaguucuguccuggaguuuggaaaccuggagguguguguucagcauaggguggcgcugggcuuuugaggucgcccaaguuguucaucccaggucucaagagaguguagguuuggacgagugggaaauugugauucgccucuccgaacuggcccuagucucuuaguggcaagcuucaagccuaggcaucugcuugccuccucuucucccacaggaacacagacaggggagcggggugaggaagacuuccaggugaaagugggcagucugagauggucagaacuaagcgaggugauagcaucccggaggcaugcaaccccgagccucuuaugcaaucguugucaguaaaucuuagcuguuuuucauggcccucuggagaguggcaacggaucuugugaucucucucccaggagacuguaaggcaccauucaucauuccugaggucagccacucccccuccggcccccacugcuguagaucuguccugcucucccuacccucaccucccugcacacuuugccuccagcaaccaagacguucuggacauugccaagugacccugcuccugcugcauguuuugcuguauucccuguguuucagccagcugccuguguguuucccauucgccauuaaauucuccgcacccagcaauugcagcuccuagggugcuagaaggguggccccugcuacuugacuucucugagaugagccagcacggagagaacuaccuaccugccucucucucccucuguccuugauaagggccuccuguugguuuugaguuucaacgggaaccuuuugggacuucaagaccuacggagugacugccggccugccugccugccuuccucccugggaaggaaccaaauccagggccuuacauaccaggggacugacugcucuagggcagaucuacauccccagccugacugucucuuugaagcuuuucuucucccuugaaaggaggcucuuggaaggccaagccacagucuuuaauuugccuggcuguuugcuuggguagcccugcucuuucagguucuucccuguaccuuccaugccuggcacugagcugugaggcauguggguuaggcagacaugugaauuagggacuaugaggaccccauggagguuuggacagacagagaugucucucuauauaucaugcccugaacucacuacuucagagcagccaagaguugcugcuguucacucuggauguacagauaggaugccuggacaagguuucucauucuaucacuugggcaaauggcuaaccucaguuuccugaucuguaccagaccagggacugacaggugcccucacacccaggcucugggcauccagggggaccaugugggcacacagauuaggcucugauugucugcuccugcaucuucauccuugacagucccuccagaaaaaaacaaagacaaagagaagaaaggaaagaaggacaaaggccccaaagccacaaaaccccuggagggcucuaccaggcccaccaagaaaccaaaggagaagccacccaaggccaccaagaagcccaaggagaaaccacccaaggccaccaagaagcccaaggagaagccacccaaggccaccaagaagccuaaggagaagccacccaaggccacuaagaggcccucggcaggaaagaaguucucaacuguggcccccuuggaaacgcuggaucgguuacuccccucacccuccaaccccagcgcccaggagcuaccgcagaagagagguuuguagcaggaucccuggggcucugaccucuuugaggacagagaaaugaggaaagauuccugggacucugagacaagggaauuuugaggccuugucauuaacuugguggcuuucucagugaguucuguuauugcugcucuugggcagagagaaagccugggagcuuauaggugagagcucugucccuuggucccuccugcuuuccucuggcagcaucagcuuuaugguaagagcuccuacaaacagcagcauagcucucuagccccaggguacacuaggacuacacuauaacccauggacuuugggauacuagauacucacuaucaucauaguuggggaucaaauagcuagcaacaggggcuucagagguggaucuguggagguaggguggaagugagcuuucuauguuuccucagagugagcuguggucuuaggaggguaucuauaagauccccaaaggcucugaugcauuguggucuuagacucucgaggugguccggguaggcagccccguucaucuguucuuuggacuucuguguuguagacacacccuucccaaaugccuggcaaggucaaggagaagagacccagguggaggccaagcagccccggccaggugagcagcugucauccucuugauuucagggcgacugaccguacagcccugcuaugcugagaggcuuccuggacaggaccuugguaggguugucacuaggccacuguuaucuucccuucagagccagaggaggagacugagaugcccacacuggacuacaaugaccagauagagaaggaggauuacgaggauuguaaguagggcccuccacaugggcauggacuagacucuggccugggcacugaggggucaaccugcagcccacucagcauggcuggcugcucagaaucugccucccccauaguugaguacauccgucgccagaagcagcccaggccaacacccagcaggaggaggcucuggccagagcgcccugaggagaagacugaagagccagaggaaaggaaggaagucgguaggguaggaagcaguagaggggggucggggucagaagagagacccuggcucacuuccauccuaccuccacagagccaccucugaagccccugcugccuccggacuauggggauagcuacgugauccccaacuaugaugacugugaguauguagcaccuucaaguccuuagaugcagacagauggacaucugguguggaaaguguagucaggacacugggccuucccuaccuacauaccuaaccccugacuuugacacuaugggugucucuaagucucuuggcccuguuacccuaugugggcccugcucuccauacccuggguucuagcaggcuuccugccagcuuacugcaucugucuuuuccagugggguuggcucacaacugggccugcuuucccagcgcccugccagcaccagggaccccaggcuacccuggcacuaggaccccaaaggucaugcaggccaugaaaagcccaggggagacauucuacuggaccugaagacuagcuaaccuaaccagaaccccagggccacucaggccaguagacagcagaaacaaaaaccaagggggaaacauccaaaaagcgaugauaaacucagaaaucagcaccuucaccuauaauaaccacaaaagccaggcuaaaggccagccuaaaaacacaauaauagccagggcaauauggcacgagcagagcccaguuaccuacuacagcaaaccugggauagccuaacacagcugaagcacaagaaaacgaccuuaaauccaaggggcuuggcugucgaccucggcacacugcuuucccaaaucccaguggauccuucaaaucucuucuuucugggcuuuagacugguacagguccuuacccugccucggacccuuggcuucugcccagaucucaaagucugacccuucuuggccacaaaugguagcugccacccaggcaccugucuuguccuggugccacucucugcccgucuucgauucuuccuccccauaggcagagccuguacuaggcuugugaccucagucuuggcccuaccuccucgcuugccuccugugagcucaggagcccagaccugcauagauccgggccagcucacccaggcuuucucuccuacaguggacuauuauuucccccacccuccaccgcagaagccugauguuggacaagagguggaugaggaaaaggaagagaugagugagucagaacaggcagauagcauggcaggcuaccuccugaggccagaugugccuaccagaugugcccccagcucaacuugaaucccucaguccccugcucagccugauccuuaucugcaugcuccaggcucagccugaccccuccccacauacucucaggucagccugacccauguaucccuagcuuagccugaaccccaccacauagcccuggcucagccugaccccuccugcuugcuuuuaggucagccuggcccucauguaccccuagcucaaaccugauccuuccauaugccccagcucaaccugacacccccccccccauguauuccccguucagccugcucuccccuacuccaggccccggggcaaccugacuggccucuuuuuuaucuuacaugccccagagaagcccaaaaaggaggguaguagccccaaggaggacacagaggacaaguggaccguggagaaaaacaaggaccacaaaggugcacggggcacccauggggacagcauuuguuuuuuuuuguuuuuuugaugcuguaggcccuugguuuuagcuccuccccuucuuguuguuagcagggccccggaagggugaggagcuggaggaggagugggcgccaguggagaaaaucagugaguaggcuaugcggagggugaggacccacucaggaccauacaugggaccugauucauggugcaacuuugaccccccagaagcccaucagaccauagacucuugcagcauacagcggagagucucaugaacugaaggcagccuuccucagcuucaugcaugcuccagccugaggcugacugcuugcauggugggaggcuugggagggacagagauucuugguauccagcagcuggcuggugggggcagggccucagggagggaagcagcucuccagcugccuuuauagguuucauaagucuuaagcaucagcagcucauucuuuagauggcaggggaagcaggcuuggagcagauuggcuccuggccugaucagaguugacuggcacccacauguaagugguacgggcuguaggcuuguuggcucuggauuaauggagggaggcugagucugaaccacuagcccacgacggugugugcaucugcagagugcccaccuauugggauggagucacaccgcauugaggacaaccagauccgugccuccuccaugcugcgccacggccucggagcccagcggggccggcucaacaugcaggugggugagugggcugucuaucugcagugggucaggcuccacugcccaugcucagccucccuucuaacaggcuggugccaaugaagaugacuacuaugacggggcauggugugcugaggacgagucgcagacccaguggaucgagguggacacccgaaggacaacucgguucacgggcgucaucacucagggccgugacuccagcauccaguaugucgaugggcuucugggcagugggcaggagcccagcaccgcucugaguccuguguggggcauucaggacagcccuuggccugaacuaggaaggccagaaaaucaaugagaguccaaccaagucuccaucccucagucauggcuacucacauacuccacauguucagaugggcagacaggcuuugcaacagcaacugcccauggccagacagucacagaaucuggcuccagggguccaggucaugcuccauagcccuguuagcccagaaguaggucuuggggcauuagagccuuggguggcagcagcuuugucucgauugugucugcuccacagugacgacuucgugacuaccuucuuugugggcuucagcaaugacagccagaccugggugauguacaccaauggcuacgaggaaauggugggugcccgagagcugcucggcucucacguuuggaccugggaggacccuugggaggggcaggcugggacccagaggccugcuucucucuagaccuucuauggaaauguggacaaggacacaccugugcugagcgagcucccugagccaguuguggcccguuucauccgcaucuauccacucaccuggaacgguagccugugcaugcgccuggaggugcuaggcugccccgugacccgugagugaagaggggaggggggcugccugugguuuuggggguagcugcauaugauuuggauauggagcaaagggcaacugauccaggcccuguaugccggcucuccugcagcugucuacagcuacuacgcacagaaugaggugguaacuacugacagccuggacuuccggcaccacagcuacaaggacaugcgccagguuaggaacccgagucacaggcugggaugggcccugcucggguacaggagagcuuauacuuauauaccccuguccuuacuauuccaaaggcauagucuccccucagggaaucuuggucaccccuugcuuuagggaggaaacuaguaccuggaggcaucugagaggggcuggaguuaccugccucuucccauagaacccaucaggggagcagcaucccggucagugacgucaugucuccucccugccagcugaugaaggcugucaaugaggagugccccacaaucacucgcacauacagccugggcaagaguucacgagggcucaagaucuacgcaauggaaaucucagacaacccuggggaucaugaacugggugagagcccggggucauuuuuuuuuugccaauggccagagcaccaggguccugcacugcugugcuccugcugggccuguacaguggauaugccugccacacucaccaucuccugccugaccuggacaccccaggagauccaggcuugccuugcugagcaccacaagccucauugcccccaggccucgccaggcucagugccugcuguggcuccugucuuugcaggggagcccgaguuccgcuacacagccgggauccacggcaaugaggugcuaggccgagagcuccugcuccugcucaugcaauaccuaugccaggaguaccgcgaugggaacccgagagugcgcaaccuggugcaggacacacgcauccaccuggugcccucgcugaacccugauggcuaugagguggcagcgcagauggugcgcucaguguggggcuggcgagcagugggcagagcucagaggcaggggcuccuugacuuuccagcccuuagugaccgaugguuuugcuugcagggcucagaguuugggaacugggcacuggggcuguggacugaggagggcuuugacaucuucgaggacuucccagaucucaacucugugcucugggcagcugaggagaagaaauggguccccuacagggucccaaacaauaacuugccaaucccugaacguuaccuguccccagaugccacggugagaggugcacccuggcuugcugagcuguggcaggccgugggggguaggaugcuggggaggggguugcugacaggaagcugaggugcugacacagagacccuggagggcaagaggaagacgcagagggccauggguaggaugugcucacagacggaaggggacacggccuauaccacccaucccuaggucuccacagaaguccgggccauuauuuccuggauggagaagaaccccuuugugcugggugcaaaucugaacgguggugagcggcuugugucuuaucccuaugacauggcccggacaccuagccaggagcagcuguuggccgaggcacuggcagcugcccgcggagaagaugaugacggggugucugaggcccaggagacuccagaucacgcuauuuuccgcuggcuggccaucucauuugccuccgcccaucucaccaugacggagcccuaccggggagggugccaggcccaggacuacaccagcggcaugggcauugucaacggggccaaguggaauccucgcucugggaguaagccugggaagaguuugggaaaggugugagaaagggauggggagaggaugaccacaggucugucuguuugucuguccguccagcuuucaaugacuuuagcuaccugcacacaaacugucuggagcucuccguauaccugggcugugacaaguucccccacgagagugagcuaccccgagaaugggagaacaacaaagaagcgcugcucaccuucauggagcaggugggauaaccugagcugcacagaaggcagggugaagcuugggaggggcguagacaucgaaucucuaggugggcucccacuguaucucccuuuuugaaggugcaccguggcauuaaggguguggugacagaugagcaaggcauccccauugccaaugccaccaucucugugaguggcaucaaccauggugugaagacagguacuuugcaugcacuuucugcaugugugugugguuuuuuuuaagggucucaccauguaccucugguuggcucggaacuugcuguauagcccaggcuagccuucaauucacagcccuugaguacugaggucagagcuugugucaugacaccugguucuugcauguacagcuuuaccugccuucccaggugggcucaccuuguccucucaaaguaguagugagucuccccaaauagcaaggcaagccuggccugugcagcaagucuggccuucuggacccugcccaggacucaggaggacaggguguggagagauaccugaggacugggccuggggaaucuaagggcagggcugggagacccugggacaaucaggcccaccuucccuauauagcaaguggaggugacuacuggcgcauucugaacccgggugaguaccgugugacagcucacgcagagggcuacaccucaagugccaagaucugcaauguggacuacgauauuggggccacucagugcaacuucauccuggcucgauccaacuggaagcgcauucgggagaucuuggcuaugaacgggaaccgucccauucuccgaguugaccccucacgacccaugaccccccagcagcggcgcaugcagcagcgccgucuacaguaccggcuccgcaugagggaacagaugcgacugcgucgccucaauucuaccgcaggcccugccacaagccccacuccugcccuuaugccucccccuuccccuacaccagccauuaccuugaggcccugggaaguucuacccacuaccacugcaggcugggaggagucagagacugagaccuauacagaaguagugacagaguuugagacagaguaugggacugaccuagagguggaagagauagaggaggaggaggaggaggaggaggaagagauggacacaggccuuacauuuccacucacaacaguggagaccuacacagugaacuuuggggacuucugagacugggaucucaaagcccugcccaauucaaacuaaggcagcaccucccaagccugugccagcagacacauagccaucagaugucccuggguggaccccacucccccagugugggacaucaaagcuaccgggacucugcauagacucuggucuacccgccccagcucuaccugccagccuuuggggaggggcaggcaaggaagccaacgucacaucaauaaaacaagcucaugacaccaccuuccccuguucugacuggcuggacaagaggcuggcuugcuggaugcucucccuaccugucccauccuacacaugcccaagugaacaagguucagaccugugaaaaauucauguuuuauuuacagggcuugcauugcaagggugauguccugagcccgcugccucucacuagggacccagccccaggcccuccagguccucuugcucugccccgaagcccgcaaagcugauaggcuggcaggccaggcugcguaaguucacuaggcaggccgucuguguggaacugaagucaggaacagccacuaacagcacuaccugguccucaggaccug

SEQ ID NO: 5868 - RNA, 10557 nt, Mus musculus
cagguccugaggaccagguagugcuguuaguggcuguuccugacuucaguuccacacagacggccugccuagugaacuuacgcagccuggccugccagccuaucagcuuugcgggcuucggggcagagcaagaggaccuggagggccuggggcugggucccuagugagaggcagcgggcucaggacaucacccuugcaaugcaagcccuguaaauaaaacaugaauuuuucacaggucugaaccuuguucacuugggcauguguaggaugggacagguagggagagcauccagcaagccagccucuuguccagccagucagaacaggggaagguggugucaugagcuuguuuuauugaugugacguuggcuuccuugccugccccuccccaaaggcuggcagguagagcuggggcggguagaccagagucuaugcagagucccgguagcuuugaugucccacacugggggagugggguccacccagggacaucugauggcuaugugucugcuggcacaggcuugggaggugcugccuuaguuugaauugggcagggcuuugagaucccagucucagaaguccccaaaguucacuguguaggucuccacuguugugaguggaaauguaaggccuguguccaucucuuccuccuccuccuccuccuccuccucuaucucuuccaccucuaggucagucccauacucugucucaaacucugucacuacuucuguauaggucucagucucugacuccucccagccugcagugguaguggguagaacuucccagggccucaagguaauggcugguguaggggaagggggaggcauaagggcaggaguggggcuuguggcagggccugcgguagaauugaggcgacgcagucgcaucuguucccucaugcggagccgguacuguagacggcgcugcugcaugcgccgcugcuggggggucaugggucgugaggggucaacucggagaaugggacgguucccguucauagccaagaucucccgaaugcgcuuccaguuggaucgagccaggaugaaguugcacugaguggccccaauaucguaguccacauugcagaucuuggcacuugagguguagcccucugcgugagcugucacacgguacucacccggguucagaaugcgccaguagucaccuccacuugcuauauagggaaggugggccugauugucccagggucucccagcccugcccuuagauuccccaggcccaguccucagguaucucuccacacccuguccuccugaguccugggcaggguccagaaggccagacuugcugcacaggccaggcuugccuugcuauuuggggagacucacuacuacuuugagaggacaaggugagcccaccugggaaggcagguaaagcuguacaugcaagaaccaggugucaugacacaagcucugaccucaguacucaagggcugugaauugaaggcuagccugggcuauacagcaaguuccgagccaaccagagguacauggugagacccuuaaaaaaaaccacacacacaugcagaaagugcaugcaaaguaccugucuucacaccaugguugaugccacucacagagaugguggcauuggcaauggggaugccuugcucaucugucaccacacccuuaaugccacggugcaccuucaaaaagggagauacagugggagcccaccuagagauucgaugucuacgccccucccaagcuucacccugccuucugugcagcucagguuaucccaccugcuccaugaaggugagcagcgcuucuuuguuguucucccauucucgggguagcucacucucgugggggaacuugucacagcccagguauacggagagcuccagacaguuugugugcagguagcuaaagucauugaaagcuggacggacagacaaacagacagaccuguggucauccucuccccaucccuuucucacaccuuucccaaacucuucccaggcuuacucccagagcgaggauuccacuuggccccguugacaaugcccaugccgcugguguaguccugggccuggcacccuccccgguagggcuccgucauggugagaugggcggaggcaaaugagauggccagccagcggaaaauagcgugaucuggagucuccugggccucagacaccccgucaucaucuucuccgcgggcagcugccagugccucggccaacagcugcuccuggcuagguguccgggccaugucauagggauaagacacaagccgcucaccaccguucagauuugcacccagcacaaagggguucuucuccauccaggaaauaauggcccggacuucuguggagaccuagggaugggugguauaggccguguccccuuccgucugugagcacauccuacccauggcccucugcgucuuccucuugcccuccagggucucugugucagcaccucagcuuccugucagcaacccccuccccagcauccuaccccccacggccugccacagcucagcaagccagggugcaccucucaccguggcaucuggggacagguaacguucagggauuggcaaguuauuguuugggacccuguaggggacccauuucuucuccucagcugcccagagcacagaguugagaucugggaaguccucgaagaugucaaagcccuccucaguccacagccccagugcccaguucccaaacucugagcccugcaagcaaaaccaucggucacuaagggcuggaaagucaaggagccccugccucugagcucugcccacugcucgccagccccacacugagcgcaccaucugcgcugccaccucauagccaucaggguucagcgagggcaccagguggaugcguguguccugcaccagguugcgcacucucggguucccaucgcgguacuccuggcauagguauugcaugagcaggagcaggagcucucggccuagcaccucauugccguggaucccggcuguguagcggaacucgggcuccccugcaaagacaggagccacagcaggcacugagccuggcgaggccugggggcaaugaggcuuguggugcucagcaaggcaagccuggaucuccugggguguccaggucaggcaggagauggugaguguggcaggcauauccacuguacaggcccagcaggagcacagcagugcaggacccuggugcucuggccauuggcaaaaaaaaaaugaccccgggcucucacccaguucaugauccccaggguugucugagauuuccauugcguagaucuugagcccucgugaacucuugcccaggcuguaugugcgagugauuguggggcacuccucauugacagccuucaucagcuggcagggaggagacaugacgucacugaccgggaugcugcuccccugauggguucuaugggaagaggcagguaacuccagccccucucagaugccuccagguacuaguuuccucccuaaagcaaggggugaccaagauucccugaggggagacuaugccuuuggaauaguaaggacagggguauauaaguauaagcucuccuguacccgagcagggcccaucccagccugugacucggguuccuaaccuggcgcauguccuuguagcuguggugccggaaguccaggcugucaguaguuaccaccucauucugugcguaguagcuguagacagcugcaggagagccggcauacagggccuggaucaguugcccuuugcuccauauccaaaucauaugcagcuacccccaaaaccacaggcagccccccuccccucuucacucacgggucacggggcagccuagcaccuccaggcgcaugcacaggcuaccguuccaggugaguggauagaugcggaugaaacgggccacaacuggcucagggagcucgcucagcacagguguguccuuguccacauuuccauagaaggucuagagagaagcaggccucugggucccagccugccccucccaaggguccucccagguccaaacgugagagccgagcagcucucgggcacccaccauuuccucguagccauugguguacaucacccaggucuggcugucauugcugaagcccacaaagaagguagucacgaagucgucacuguggagcagacacaaucgagacaaagcugcugccacccaaggcucuaaugccccaagaccuacuucugggcuaacagggcuauggagcaugaccuggaccccuggagccagauucugugacugucuggccaugggcaguugcuguugcaaagccugucugcccaucugaacauguggaguaugugaguagccaugacugagggauggagacuugguuggacucucauugauuuucuggccuuccuaguucaggccaagggcuguccugaaugccccacacaggacucagagcggugcugggcuccugcccacugcccagaagcccaucgacauacuggaugcuggagucacggcccugagugaugacgcccgugaaccgaguuguccuucggguguccaccucgauccacugggucugcgacucguccucagcacaccaugccccgucauaguagucaucuucauuggcaccagccuguuagaagggaggcugagcaugggcaguggagccugacccacugcagauagacagcccacucacccaccugcauguugagccggccccgcugggcuccgaggccguggcgcagcauggaggaggcacggaucugguuguccucaaugcggugugacuccaucccaauaggugggcacucugcagaugcacacaccgucgugggcuagugguucagacucagccucccuccauuaauccagagccaacaagccuacagcccguaccacuuacaugugggugccagucaacucugaucaggccaggagccaaucugcuccaagccugcuuccccugccaucuaaagaaugagcugcugaugcuuaagacuuaugaaaccuauaaaggcagcuggagagcugcuucccucccugaggcccugcccccaccagccagcugcuggauaccaagaaucucugucccucccaagccucccaccaugcaagcagucagccucaggcuggagcaugcaugaagcugaggaaggcugccuucaguucaugagacucuccgcuguaugcugcaagagucuauggucugaugggcuucuggggggucaaaguugcaccaugaaucaggucccauguaugguccugaguggguccucacccuccgcauagccuacucacugauuuucuccacuggcgcccacuccuccuccagcuccucacccuuccggggcccugcuaacaacaagaaggggaggagcuaaaaccaagggccuacagcaucaaaaaaacaaaaaaaaacaaaugcuguccccaugggugccccgugcaccuuugugguccuuguuuuucuccacgguccacuuguccucuguguccuccuuggggcuacuacccuccuuuuugggcuucucuggggcauguaagauaaaaaagaggccagucagguugccccggggccuggaguaggggagagcaggcugaacggggaauacaugggggggggggugucagguugagcuggggcauauggaaggaucagguuugagcuagggguacaugagggccaggcugaccuaaaagcaagcaggaggggucaggcugagccagggcuauguggugggguucaggcuaagcuagggauacaugggucaggcugaccugagaguauguggggaggggucaggcugagccuggagcaugcagauaaggaucaggcugagcaggggacugagggauucaaguugagcugggggcacaucugguaggcacaucuggccucaggagguagccugccaugcuaucugccuguucugacucacucaucucuuccuuuuccucauccaccucuuguccaacaucaggcuucugcgguggagggugggggaaauaauaguccacuguaggagagaaagccugggugagcuggcccggaucuaugcaggucugggcuccugagcucacaggaggcaagcgaggagguagggccaagacugaggucacaagccuaguacaggcucugccuauggggaggaagaaucgaagacgggcagagaguggcaccaggacaagacaggugccuggguggcagcuaccauuuguggccaagaagggucagacuuugagaucugggcagaagccaaggguccgaggcaggguaaggaccuguaccagucuaaagcccagaaagaagagauuugaaggauccacugggauuugggaaagcagugugccgaggucgacagccaagccccuuggauuuaaggucguuuucuugugcuucagcuguguuaggcuaucccagguuugcuguaguagguaacugggcucugcucgugccauauugcccuggcuauuauuguguuuuuaggcuggccuuuagccuggcuuuugugguuauuauaggugaaggugcugauuucugaguuuaucaucgcuuuuuggauguuucccccuugguuuuuguuucugcugucuacuggccugaguggcccugggguucugguuagguuagcuagucuucagguccaguagaaugucuccccugggcuuuucauggccugcaugaccuuugggguccuagugccaggguagccuggggucccuggugcuggcagggcgcugggaaagcaggcccaguugugagccaaccccacuggaaaagacagaugcaguaagcuggcaggaagccugcuagaacccaggguauggagagcagggcccacauaggguaacagggccaagagacuuagagacacccauagugucaaagucagggguuagguauguagguagggaaggcccaguguccugacuacacuuuccacaccagauguccaucugucugcaucuaaggacuugaaggugcuacauacucacagucaucauaguuggggaucacguagcuauccccauaguccggaggcagcaggggcuucagagguggcucuguggagguaggauggaagugagccagggucucucuucugaccccgaccccccucuacugcuuccuacccuaccgacuuccuuccuuuccucuggcucuucagucuucuccucagggcgcucuggccagagccuccuccugcuggguguuggccugggcugcuucuggcgacggauguacucaacuaugggggaggcagauucugagcagccagccaugcugagugggcugcagguugaccccucagugcccaggccagagucuaguccaugcccauguggagggcccuacuuacaauccucguaauccuccuucucuaucuggucauuguaguccagugugggcaucucagucuccuccucuggcucugaagggaagauaacaguggccuagugacaacccuaccaagguccuguccaggaagccucucagcauagcagggcuguacggucagucgcccugaaaucaagaggaugacagcugcucaccuggccggggcugcuuggccuccaccugggucucuucuccuugaccuugccaggcauuugggaagggugugucuacaacacagaaguccaaagaacagaugaacggggcugccuacccggaccaccucgagagucuaagaccacaaugcaucagagccuuuggggaucuuauagauacccuccuaagaccacagcucacucugaggaaacauagaaagcucacuuccacccuaccuccacagauccaccucugaagccccuguugcuagcuauuugauccccaacuaugaugauagugaguaucuaguaucccaaaguccauggguuauaguguaguccuaguguacccuggggcuagagagcuaugcugcuguuuguaggagcucuuaccauaaagcugaugcugccagaggaaagcaggagggaccaagggacagagcucucaccuauaagcucccaggcuuucucucugcccaagagcagcaauaacagaacucacugagaaagccaccaaguuaaugacaaggccucaaaauucccuugucucagagucccaggaaucuuuccucauuucucuguccucaaagaggucagagccccagggauccugcuacaaaccucucuucugcgguagcuccugggcgcugggguuggagggugaggggaguaaccgauccagcguuuccaagggggccacaguugagaacuucuuuccugccgagggccucuuaguggccuuggguggcuucuccuuaggcuucuugguggccuuggguggcuucuccuugggcuucuugguggccuugggugguuucuccuugggcuucuugguggccuuggguggcuucuccuuugguuucuuggugggccugguagagcccuccagggguuuuguggcuuuggggccuuuguccuucuuuccuuucuucucuuugucuuuguuuuuuucuggagggacugucaaggaugaagaugcaggagcagacaaucagagccuaaucugugugcccacauggucccccuggaugcccagagccugggugugagggcaccugucagucccuggucugguacagaucaggaaacugagguuagccauuugcccaagugauagaaugagaaaccuuguccaggcauccuaucuguacauccagagugaacagcagcaacucuuggcugcucugaaguagugaguucagggcaugauauauagagagacaucucugucuguccaaaccuccaugggguccucauagucccuaauucacaugucugccuaacccacaugccucacagcucagugccaggcauggaagguacagggaagaaccugaaagagcagggcuacccaagcaaacagccaggcaaauuaaagacuguggcuuggccuuccaagagccuccuuucaagggagaagaaaagcuucaaagagacagucaggcuggggauguagaucugcccuagagcagucaguccccugguauguaaggcccuggauuugguuccuucccagggaggaaggcaggcaggcaggccggcagucacuccguaggucuugaagucccaaaagguucccguugaaacucaaaaccaacaggaggcccuuaucaaggacagagggagagagaggcagguagguaguucucuccgugcuggcucaucucagagaagucaaguagcaggggccacccuucuagcacccuaggagcugcaauugcugggugcggagaauuuaauggcgaaugggaaacacacaggcagcuggcugaaacacagggaauacagcaaaacaugcagcaggagcagggucacuuggcaauguccagaacgucuugguugcuggaggcaaagugugcagggaggugaggguagggagagcaggacagaucuacagcagugggggccggagggggaguggcugaccucaggaaugaugaauggugccuuacagucuccugggagagagaucacaagauccguugccacucuccagagggccaugaaaaacagcuaagauuuacugacaacgauugcauaagaggcucgggguugcaugccuccgggaugcuaucaccucgcuuaguucugaccaucucagacugcccacuuucaccuggaagucuuccucaccccgcuccccugucuguguuccugugggagaagaggaggcaagcagaugccuaggcuugaagcuugccacuaagagacuagggccaguucggagaggcgaaucacaauuucccacucguccaaaccuacacucucuugagaccugggaugaacaacuugggcgaccucaaaagcccagcgccacccuaugcugaacacacaccuccagguuuccaaacuccaggacagaacugcugccuggcaguguguugccuugcguugccuuggagagacauuccucacggggcagcaugggaaguggcuagacccuccagagccccuguaugcucacuugaugccauggccacccaugucaccagguucucaccuucuacaucugcccgcugcuugcccccugccuuggauuugcggggacgcuggguggguucgggaagcggcuggacuuccacgucgucuucccggggcggggacugggucuccaacuccgaaaggaagccuucgaggaacuccucgaucucgucguccgucagcaccgucuguggguuccccucagggcacagcgucagcagugccaggaggccgcagagcagggaugcggugcgcacuggagccauggcucugggcacgcgcgggagccgggcgggcuugagcagggacuuggguggcaggggcagcgccccgcguaggggcgggaaagggcgcgaggaacgugggcgucaaggguauccagaaagcggugggaaagggagauucaaggagagcaaggggcuccaggagagguucuggcgggcccagcuccggcagcaacugggcgcuccugccccgcguggcuggcucucacgcggaccgcccuccagagcgcuugcgacggccuggccggggcgggggcuucggguuuccg

SEQ ID NO: 5869 - RNA, 1268 nt, Mus musculus
gaguuccagggacucaucagcacagaccaauccugggacaaacugcugaggaggcagggcgaaguggaggcugggccagaaccgcaguccugcccuggaagagccaggagcaugccucagagcuccaccgugagcuccauccacagaagaaaagggcuaacaccacacagaagcauuggaugccaacauaaacugcagauuccacacucccaccugcuguggcucugcuauggccuggguguguccaucccucaaagaccaaggugccaagccugcugcuaugaggagcucucuagcuaaagggugcacaccagugaccaauucacacugaagacaauaaggauaggaagaccauuuccuccauggauggaacaguagccaucacugccagaaccuagcccuuaccucugaccagacucugggccaaacccaacuuuaaccacacagguuaauuuaauccucacuuuuaagaagaagcagggagcugaaggggccauuccaugguagcuggaaaguauuccagguuagauaagguccuaguucuagcugcugggcugcugggagcagcguaccccaaacuuaccccaguguugcugcgcccggcucaccaggaacggucucaucuggaugaggcggguggcauaaauaugggcguacugccgguuaaagcugcgcucucccagucggaagggcugugaggaguugguguaaguugccacagguacccgggcaaagguggcauugcuggcagagggcggggcgagcagagugugggcccucugugcugccugcucggagaacauggcggcacuccuggcuuguuugguccaagcagcuguguccaggccgaggaguuaucacugcagagacacacaaaggcauuccugcaaucccuucuuguacccaaagcuccccuagugucccaaccacgcuguccacaaugugcacacauguguccggaggugucauccuauaaccuagucagauacaaccuggagcucguuccaaaccuuguucaucaccuccuccucuccacauuucuacccaaucaccagggucucaaauucugcauacccucaaauggaauuauugaucugcuucugcccagcucccugggaccucugcuaccucuagggaugcuaucaggcaucacugaagaagccugucauaauauaauuagugauaaaaaauaaagcauaaagcugccccuguuuugcucaaaaccccccaaagguugcuuuucaguaaauaaaaccccaaguucuuac

SEQ ID NO: 5870 - RNA, 2425 nt, Mus musculus
cuguuuccagagcagcugcaccaguuuacauccccaccagcaacaccaagagcuuccgucucucugcaucaaugcccagaucgucugaugcugugauaagcacagaguaguggcuccacacaaauccugucccaauucccagacccugugcuguggggguggggauccaagguuacaaguagaauugagguuuuggccaggugagccugaacaacagacuauucuggauuccugggugguuccauaaacucggugaguuacaagagucagaaagguaugccaucgauuccaaccucccacuguggauggagugcaaucaugaacucugggacuucugaccuucuggauuguggaauauuuuguucuguucuaagacaaauuuuguuauugaugguuacaauaguaauaggaaauaauauagauuugaacaggauugguuuuugguuuugguuuuguuuguuuguuuguuuguuuguuuugaaauaaggucuccugugaagaccaggcuggccuggaacucagagagaucugacucccuccaaguucugggauuaaaaguaugccacugcaucugacaucaguaaauguuuugugucccuccuaauagauaagugaaggcauccccugauuucaugugcaaugaccuugagcauugagcaucuucucaagugcuuucugccauaaaugguaaaaacucugugagucuuggccaaguucuaauugaauccauugguuuguuuugguuuguuuugguuuugguuuuucaagacaggguuucucuguguagaccaggcuggccuugaacucagaaauccaccugccucugccucccaagugcugggauuaaaggcgugagccgccgccaccaccgcccgacugaauccauuguuuuguuuuuuuuuaaugacagauuauguacauuuuuauauauucucaauaaaagucaucugcuggcuaugcaauuuaaugucuucccauggcugcauacauacauacauacaugcuuuuaugcacaauaaucaguauagaagacuucuaagccccucaaauguuugcugcaacugacacaagcugguaucuuccaaucugacucaguucucacugucuaccuggccauaacauugaaucacacagauugagggcuuggucuucaugauuacccccacuucagauaucaauuacaagcuccaggugucucaccugugcuguugagggacuggcuauaaccuggguuucuagaacuuucugcucagguucaguucauuugcaugggcagcuuacagagaugaggaaaauuccuggguacuuuacaggcauuagcagaauauacagaugaaggacucagugcaauaugugugggaaggggccuuccuagaaccacagcccaggaaccuucacagguuucaacuguccagaaccuccugaaacuggcaaccaugucugacggguucagucuaauuuuuagcccuuccauguccugggagcuugguggccaucagccauccuucagcuaccuaggauacagcaguuauuucauuagcacaaaaagacacuaucacuccaacagguuccaaggauuuuuggagucugcaugccuagaaaucuauaagaaguccaaauauacaacccacaacaucccagcaguuaguaacacaccacuuuuacacagucuugcagcccgagcagaguguuuaauguugaugagauccaguguuucaagauuuccauuuaugaaucaggcuucuggugucaggucuaaaaaaaaaaucuuauccuuauccuagaucucaaagacuuucuccuauguuuucuugaaguuuuguuguuauauuuuguauuuaaguccaaaguccaucugagugauuugcaagccuuucauuguuuucaugaugucuccugaugcagcaguguucacugaaaggacagucuucccuccauugagucccuuuguuccuuuucagaguguaucgagguggcuggcaggauggugcaugcacucgccacccaagcugacgacuugaguuugacucccagaacccacgugguagaaggagagacucaacucuugacauguuauccucugaccucuacaugugcaugccugcgugcauaugcauccauacaaauaaaugcaaucaauaaaaaagauggaaagugaggucuuguaauaggaacagaucagaguccagagugacucccucugagauuuucaggaucuuguguuccagaacaaagaauuggaccaaggacacaugcauagugauagaaacgaguuuaagaaaagggcugcugcugguaguacagaccuuuaaucccagcacucagcaggcagaggcagguacagguggaucgcuuauggauuugaggccagccugguuuacauuacugaguucugggacagccaaggauacauagcaaaaccuua

SEQ ID NO: 5871 - RNA, 76326 nt, Mus musculus
cacaagacccagguucaauucccagcacauacauggcugcucacaccugucuguuccaggagaucuaaugcucucuuuuggccucugggggcaucaagcaugcacaugguguacagaaauauaugguggcaaaacauucaugcauauaaaauuaaaaccaaaacaacccuuucugccaucuuccuucgccgccaccauggugugaaugaauguucuggcggaugcucucaagagcaucaacaacgcugagaagagaggcaaacgccagguccucaucaggccauguucuaaagucaucguucgguucuuaacugugaugaugaagcacggauacauuggugaauucgagaucauugauggucacagagcugggaagauuguugugaaccucacaggaagguugaacaaguguggcguuauaagcccuagauuugauguucaacucaaagaccuagagaaauggcagaacaaccugcucccuucacgucaguuuggccucauugugcugacaaccucggcuggcauuauggaccaugaagaggcaagacgaaaacauacaggagggaaaauccugggauucuuuuuuuaaauguaaagcauaaauaaaaagccuuuguggacugugaaaaaaaaaaaaaaaccaaaacaaccaaacaaaaccuccccaaacaaacccccccgaaaccaagaacacgcaacccagauacccagauguagucuauaauaaagauuucuuuucuuggcuaagagauagcuuugguggugguaaagguuauauaugcugguguuuuugagccucugguguaggcuggcaucuuuuuagcagagucuuguaguaacugacuguucccuguuaaugcaguggaacauauuccugacugccuucuuuuugaucuuuccugaguuggccaagucuaugucauaauagauaaugagugucuuuacauuuuaaauaguugugauauuuaugguuuaauuugugccuucuuacuuacaggaaaaguuauauuuuaugcaaugguuuauuuucuauuaguauuuccuauguaauaaaguugauggacacaucaacauugcccuucuaugguuuuagaaguaaaacuuuacauauauucuuuuuuccucuuauuuauuuauuuauuuauuuauuuauuuauuuauuuaguguaugugaguacacuguacccguacagaugguugcgagccuucaugugguuguuggguauugaauuuagaaccucugcucgcucuagucaaccccacuugcucuggucaaccccgcucacgccagcccaaagauuuauuuauuauuauaaauaaguacacuguaacugucuucagacgcaccagaagauggugucagaucucauuacaggugguugugagccaccauguaguugcuaggauuugaacucaggaccuucugaagagcagucaguguucuuacccacugagccaucucaucagcccuuuuguuuuuacuauauucaacuauauauauauauauauauauauauauauauauauauauacacacacacacacacacauauacauauauacauauauauacacacauacacacgcauauauauacacuaaucauaaaaaugauggaaauguuauuaaaugaacauaaauaaagucuuuuuguuuguuuuguuuuuaguagagcuuaaaaucuuggcucuuacuguaguacaaacccaaaguaagaacaauuuuuagacacuggaguucauuguaguaaggcuguacuucagugucccucacaucaccaaaggauguuaccuccauaguagcuaagcuaagaguugacaguucugcugcaccaaggaaugaacuguaggcacgauuauuuggauacagauuuccugcuauggucaaagcuguuugccuugagugaucgucaucauucucaggccgcagggaacagguugcagucauuuaagaaaugguguguguauuaagauggucuauccaugaagucauucaucaacuguuucaaugaacaaugguucugcuuggaggguggcacagauguuaggugaggguaagauucugguuccuugccugugaugauuuugaaaagcauucaucucgaaaaagaguaacuuauaagguccucuucuucaaaauugauacaauaauuauaaauaccaggcaaaacauacauauauucuuauucacugauuuucuucuaguugauuugcugucuucucuuaaagaacuuacuuuauguuagacuucagaaaauuuucuuuccuucagucacugaauguggcauaugucauggcaaauauguugaagucagaggacaauccagagagaggugucagcucacucgaaccauaugggguggagggaucggcucuuggcugaaagguccuuuaccuuaccuguccagccaucucccuggccucacaaauggaaucuuuauuuuuuccccccuuaauacugauuugugugugugucuccaugaguauaugccgccuaggugcgggugccugggaaggucaguagagagcaucagaucaggucuucuggagcuaaagguauagaugguugugagcggccugauaugagugcuggaaauugaacucagguccucugcaagagcagcagguuuugaccacugaaccaucuucuuaauuuuuuuaaauuauauuuuuacucugugugcacaugcguguaugaaugcaugcauauaugcacaagugugcaugcaugcaugugugcaggcaugugcauauuugauuaugguugugugucaugacaugcauguggagguucucccaccuuucugggacccauugggcccagacuggccuuaaauacuuugccuccuuucgucuaggauuacauuauacccaccacacucugcuugcuguauuaugccuuuaauguaaaagucccuucccagaaccuuacaaagagcacaacagugaagugcuuuccccagauucuaagucuugcucucuuacuugguccccuuguugaggaaggauuaacuuuugcaucuguucucccaucaggcaaggaauccauacccaaggccagccugcucccacugaacucugucauuaccccauccuccuccagacucugggaagucagugacugaggccuuuuguuuguuuuguuuuuuuugagacaggguuucucuguauagcucuggcuauccugaaacucacucuguagaucggacuggccucgaacucaaaauccuccucucucugccucccaagugcugggauuaaaggcaugcgccacuauugcccggcagacugagacuuucuuaagacuucuccagaucucugaugccuuccauggcugugguuuuagggacaauaauuuaagucauuuaaaaaaaaucuguuugugcacacgugugugcggauauauggcucucgucagacuggcuuugacucacaauauucuuccugaaugcuggaaauauaagcgcagagcacccaugccuagccaggaauucauuagaacaacuuagugaaaucgucaggauucuauagauuuuguucauuuagaaaguccucucuugcaucaguuucacuauugcacagagccauaaugugcaucuauaagaguaaguggccuuuuggaauaggaauggaaugucucugaacuaucuaucacagcugguuuuccucagagaugcucagaguaacaaagguagaggaagugagagugagaggucuuuaaagcacuguucuagaggagugagucauugaauggacagucauggucaaugugcccgcagcccugucucuaucccuucuuccucauuguagucagcagccagguggcuguucuuguugcucugccagcccuguguuccacuggcuccuucugaccuguguuaaguuagaucuuucucagcaaaugaaugacgcuugcuguuucccacaaccauuuagggaaggaggcacagagacagaacuacaaguuccugccuggugcaggcugcugcugggcuuuguugucuccuggguuucauguuguuccaggaagacacuuguauggagcuguccugacuugaagcagucuguuggacuuguggaaugcugugcauucucccucuauauauccugcucuuggaauuuaccugagucagggagcccuuuuucuuuguucaaggggcuucuuaacccugcccuuugaaggcuuccuugacccugguucugauccacuccacagcacagcacaggguuggcagugccgucuucauccauuaugcuuuccuuuaaaccuuuucuccuccauagugugcuuugauucuguuguaggguugugcugaagguacgaaauguuuguucuuucucuggguagcucgcaucagcuaucagcgaucacugugacuuccuuucgucuuccuguucguucucuuuguccauuuucuauucaacugagcccuccucagaagaggauacuucccucucuucuacuuuucuccucuucucucagacauggucaaagcccaggcugucucuucagcuuguuguguaccugaggauagccuugaaccccaguucuuccugcucugaccucccaggagcaggcauuacagaugugcacaucacaccggcugcuuccuuacacacucagcugccugcuuugggaugugacuugaugaguuggccauguccaugaugcuuucugacguucucucucuggcaggccugucuugaaacuuccccuugggcugcacuugaucuguucucucucaugaagcuuaguuuauauuuauauucuagaauuauguagaauacauuucaaaguaacuauuaaugccagauguacugguccagguguguaaucccagaacucgggagguaaagcagaagcuuccauuguauauugagacgucauccucccccagcuccaucagaaugguuuaaaaauucuaagaggguuggugagaaggcucaguagucaggaguacuuucuaggucuuuuuagagaagacccgaguuugcuucccacacccacaugggcucuucaguuccaagggauccaauacccuuuucugaccucugaggucaucgggcaaaugugugcugcacauaauguggcaagauauacaucacauuuacuauuugaauucacuuaaaugaacuguucagugauguuaaauuaauucacguugugcugguuccagaauucuuuccauuucucuguguaucuacuaagacacaguuccccaucucucuuccuguaacccuagaaaccucucauccuacugucugucuuuaggaauugacccuucuggguacgucauggaguauucauccuuuugugacuagauugcuuacuuagucuacuacccuuaagauucgucuagauaauagaauuuucuuuacuuuuaaugccaaaucagauuuuguuguauggguagaccacaguucuagucauugaccauuugggugcuuccauccucagcuguuguaaguggugcacuuacauuuauuuaccuuuuuuuuuuuuuuuggugguggugugguggcaggggguggugaggggcguguccuguuguuuggauuuggagacaaggucucuuguauuccugacuggccucaaacucaaguagucagggaugacuuugaacuuccugaucuacuuccacccacuaagugcugagacauagugccgucacacccaggguuauaugguuccugaucuaccuacuuccacccacuaagugcugagacuauagugccgucacacccaggguucuaugguccuggggaucaaaccucauccuucaugcuagguaagcacucuuaucagcugagcuccacagucugauuucuuuuguuuuguuuuuuguuuuuuuucgagacaggguuucucuguguagcccuggcuguccuggaacucacucuguagaccagccuccaaagugcugggauuaaagaugugugccaccacugccuggcugucugauuucuuucaauauaauuuugagaaucaacucucaacucuguguguguguguguguguguguguguguguguguguguguguguguguguauacaugugugcacaugcauagauacucccauacagauguacauacacacauauagauagauaucaauaauucauuuguuuuuauuuugucuuuccccccauuaaucuacuuauagguauuuaaguucgugauggauaaucuuuucucuauuuuauuacuuucauuuauuuauuuuuauguauggcaguguuugcuuacaugcauguuauguucaacacaugagugccuaguggcugaggaggacaaaagauggaauuacagacaguugaaagaugccauguggcugggagccagacucaguuucuuggaaagaguagcaaugcuuuucaucccugagcuguauuuuguuuuauguguauguagcguuaauggggucccgcaucugcuccgccacagggcucagcugaucagggaggugggacacuguaagucaacugcgcuucacuuugggggugaggaaacacagucugaggcacaggacagccggagcuggcucgggaguccccaggccugcaaggaggccagccugucugauuuucaggcucuuggacacgcaggcaucgcuggaagcaucggaagagcugagaauggagugggggccugugggcuagaucugacccagagccaagaggggaaagggaggagcuuuggcuggucccgcagugggaguucucggugguggccaaggcugaucgaagagaggccgucuacuggagaucagacaguggcucuacaggcaaaggccuccacagcucccuauggcggaucccgaugaaaaguggcaguccaugguuuuaaggccuuuauugucauggcagaaaguggaugaguaaaaccaugccccacuucucagggcgggucugagguucaauaccuuuugcagggaggagugucugggaaggaaagcuuauuggcuaagucuccaagucuuuagcuacuucauuccaaauggagaucugucuugagccuauauaaucugucacguccucuacauguggaggggcuuggugcguugcccuuaugugacugauggccacaaaucuauggagggcuguggccucauucuaggaacaggugaaaugccuaugaacaccauaaaaguccaccaacuucccuggagcuggaguuaagucagaacccgacugaggcccuaggcaagagcagccccauuuuuugcgauggcugaucuugaucuuguaagcuuguuuggauugaaagccaccuagaagaguagugaaaccagcuaguagguauaucuaccaguacguuuccauggagcuuugaccuaaaucuauugauggacuggcaaugugagcagucugugguagguggugggacuggaagaugaggccucacuagaggaaguggaucucugggauugcuuuuggagauaucaggguuccuuucugacacacuugugucuuggcugccaugaggugaguaguugugccuuaccaagccuucaaccaugccagaaacaauacagguugccagguaugaacuguguaaauccucugcaaccagaagccaaaauaacuaucuccucuuacauuguuugucuaaagugggggaaguuugacuaacacagugcuguuugcuugccuguuacaaaagaagcugccacggaacauuugucuguaaguuccagcggggacacacacacuuuguuacaauccaggaauaaaggcuuuuguccauagccuuugcuaccuugugcuguguuacugcccgcacagcccacugugugucggagaugcagugcuuccucauccugaucaacauuugaugcucuuuuuuuuuuuuuuaauuuuagacuuuucucguaaguguaugcuggcaugucaugugguuugacuugcauuucccuaauaagcaaagaugguacaguuuuuucugccuucuuuggugaagugucacuucagaucacuugccuaauuuuaaaaauugaguuguucauuuuuuuaguaaguuuugagaguuccuguaugcuuuauuagauauguaacccgcagauaguucuucagucuuugaauugucuuuuugaucuuuuaaaguugcuguuuguauuuaaggcugggagagguggggcucaaacccaagaucugguacgugugaaacaugcuauaccccagccaccacauugacuuuagaaaauuagaaggcuuuauuuuuuuauuuuauguccaugcauguuuugccuucaugcauguccgugcaucaagugcaugcuuggugaccaugguggccagaagaggguguuggauccccuggaacuagacuuacgggugguugugagcugcggugugggugcuucgaaucaaaccuggguccucuggaagagcagccccuacuucccguaaccucuuagccaaacucaggcccaaacagaacacuuuugaugggguauagaauggcacuuucuucuuuuauggauugcauuuuucuuguugccacaucuaaucuuuacccagcagaaauauuuuaaaaaauuuuauaguuugacuucuaauuuggucaauuagauuuuauaguuugacuucuaauuugaguuaauuagaaugugauucaggauguugcuaggaguacaucgcuuucuguauguagauauccagguguggcagcauuguugguuaaaaggagucuauugaaccuagggaccaucccugacuaagcaugaaugacuuaagcccauagcuuccauucauguuuuccucugaccuuuucaauguccccuuugccaucuccuugcuuuuagugugucuguauggucagucucccacaccccaugccuucuccugucuguccccgccaugguuauuaaucacuuuuacuuccuguguuucucuguuucucuguguuuuuauuuuaagugauucucucacaagccaugcuuauguuucuugaugugagagcauaugcccuuuaaaaacuuuucaaauuacuuuaugagagagagagagagagagagagagagagagagagagagagagaaagagagagagagagaacaaacacaugugcauauugagacuucugacuaacuucacuuuacuguuugagacaggauugucacuggcuggccaguacaccucaggcauuugagcucggguccuccucucuguauggcaagcacucuaugaacugagccaucuccucagucgucaguggcuuuccucuguucuugcgauuuugacgcugucggcucuuguuaacgugugugcuuggcucugugcacucagccucucccaccagcagugacuuuuccgccuuccucagcguugucuucuucccacccucgagcgugggugcugugggugauguguagccagccuucgucuuccuucuugcugcacucuucucuuggagaacacaucuacucuuaagagacugaggccacacaguuuugcuacaguccgacuuuuccuuguuuucaguccuucagguuaguuguccuuaugccaugggguucuucaggugauuguaucauccuuugaccuuucuucucugugaggcuuuuaccauccccccuugcccaagcucagaucccagccagacuucauugugauuucuucugaaaagagugacauauuuuuuaaagagaaagaccuacagauacuuuucuguuauucuggcacgagccugguagaauagaguaacaaguggacaaugccucuaguuuaucuacuuaauggaagcagggcuucagauguguggugucgguuguggagaguaggucuguauaauugcgcugauguagaauguagacucaggauaugucgaucuuggacugugucuuaauugugaagacaguucuuagugucaguaggauuugcuuuucccugauaguaaugucuugcugugcaaggaagccaagguuuugggcuagggcuagcagcauugggaaaugaccuugacacacaugaauuaaagcguaaggcagagcuaucacacccacucuucuccagugccuuugaagguauuuugggcccuguggagagccucuaguuggguuagaauuugcucuccauuucucugugggguuguaggcaaggucaccuaguccuagggacuaguccuaguccuagggagugacuauauagguuuaugggaagaggcuccaggcuccgugaggucuuguugcugcucauguccacugugcugcaaaguaggaauuaaccccaguuucuaccuuccucuaacuaggcuccugaaauugggagagaggguguagugugguucaggcuggccuugaacucugucuuaggguuucuauuccugcacaagcaucaugaccaagaaacaaguuggggagguuuauucagcuuacacuuucacacugcuguucaucaccaaaggaagucaggucuggaacucaagcaggucagaaagcaggagcugaugaagaggccauggaggggugcugcuuacuggcuugcuuccccuggcuugcucagcuuucuuccuuuuuuuucuuuuuuugauuuucgagacaugguuucucuguauaucccuggcuguccuggaacucacucuguagaccaggcuggccucaaacucaaaaaucugccugccucugccucccgagggcugggauuaaaggcgugcaccaccacugcccagcuucagcuugcuuucuuauagaacgcaggacuaccagcccagggauggcaccacccacagugggcccuccccaacuccuugaucacuaauugagaaaaugccccacagcuggaucucauggaggcauuuccucaagggaggcuccuuucucugugcuaacuccagccugugucaaguugacacacaaaaccagccaguacauccuaccuuaguucuucauguugauuucaucuaucggcaguuuucucugugaccuuaguaguauauaguaucaaagaucaguggcugcugugguuacuagagagagggugauuuauagagaacacauuuuauuugauacuguuuuuggaaguuccaagaucaagacacugcuaaguuggguauuuggugaggauuacuuccugcauccaacauggcaccucacugaugccucuuuggagaggaaaagcgguguaccacacaguggaaaggacagaagggcaguuggguugcacacugggagaagcauguuucauaaggaccuugauggcauuuauuagugaggagccuuaauggcuuaaucaccuuuuguagcaucauaccaacuauuaaauggccacucucugaauuuuagagggcauauuaaaaucauagcagaugcaaauguguggaggcucuagagaaagcacuuacuagagccucuucuaccaguuaaagaagccuguuaauuuuuuuuuuuuggaguuuuuugcuuugucucuggcagguuaagaucauggcuguugaacuugcugggacugucaucccacaugggcauuaacagauggacuuucagauucacucacaacaggucuguucucagggaaugaaauagcccuacagcaaacugucuccuuguuaaaggcucuuucuaagccaagaacuaauugcuuuuugucagcaguguaaguaaacauucuugucaaagcugacuuucugacauuuguuucauuacugccuguuuauugaaagauuccauggaauucucuacaaagaauucucaaaaaacaucauaaagccaggcuggguuucugaaacauuguuuuuuuacuugcuugauuuucaguugaauuguauaauuuguuuguuuguuuuguacuuuugagacacaguuuuucuguguugacacagaaaaccagccaguacauccuaccuuaguucuucacguuaauuucaucuaucggcaguuuucucugugaccuuaguaguauaguauacaguagcccuggcuguccucugaucuguagaccaggcugacugcaaacuugucucuugagaucacuugucucugccuccugagugcugggauuaaaggugugcaugaccaccaccuugcucauugaaaagauaauaauaguacagggauaccgauuuguguauuaaucaacaaucuccguggaucaaugacccuccuccucugaaguucuguuuuuagggaugugaucacaguugacugugaagcucacagugaguuaggcaaucuguccagaacauuauaaugucagauguaaaccaacaagacaagccuagucacagcccaaguguuugaagaacccuguggucugggcuuugggcuuucccaccagcauuccaguccuguggguauaggcugcuggagaaucuuaccccauuuauaugcaaaagacaaccaaauuggcuaacuuggggcuuuauaaauaguaggacuguuucuccagccugucuucauucuacucagugcuaaaauuuccuggcagccuguaacuaaugaaauggaaaaguacuguuugcagagcauuaagcuagcugacuugaaugcuccugugaugccuugucaccaggccguguauugguugcucuugagguggccaguuucuuccuaaguugagcuuucaacagcaacucaguucaaaauuccaaaacaguuacaggaaagcccauuugucaccaugaggcuaagaacaguagaggucagggcaucugcuuagauuuagauuugaguagucuagucucucauaugucagcuugaugguggcuggacugguuuagaccucaggaaagugugcagaauauuagaugcacgugagcccugugcugcuuuugcagugaagauguuuguuguuuucugcuauuuuacugaugaacccagaccuagagagccugggauaaauaguacaagaucagacuguuggccaguggcagggcugggauuuugacucaaguuuguauccguaagcccuaaaagguacugcuuuuauuugaaauucuugugccagauaaagcacaagaccucaaccucaaacacuaucucuccacuaaaguuccugcagcuuguuguggagaaauuacaaggcuuucuuagaagggaggagagguugcugcacacaugcucacaggugguacugugggaagugcaacugagcagaucaacguagcauggacagacacacagccuagagauuguguauaaagugccuuugcagaguagguugccacuggcagguuggugaccagcaggaucccgugucuucucuuucauaguuguuguggauaugagucucaguuuccuguaucuugugcaguguccuggggucacuugcucacuguguucuuucugcucuaggacuuuggcuuacuguuuguaguugcuguuuaucuugccacugaccaggagaugaucucugguguguccuuuacccugcauacugccaugguguagcaggaacugcaguucuguuugguagguucuuguacuuuccugcuauguuugugaucugcaguuacggugagaaaugcauguuucagagaucccagauacauacauacuugcgguggcagguuugagaaacaguguguuauuucuguggugugucuucauacuuucacuucauuuguucgguucuguuccacuggauagguguuauacaaaacauuauucuagaguaugcauuuuccaguaaguagugucuuaagacuucagucuucuugccauaacuauuacacugagacugaggucuggauuaagacuggguggagaacagugcagaauuagugaaacccagaagguuaugguuugagagggagaauucccagcugugggagggugcucccgcuguaguguugguggcucuguggagagugcgugugucuaggguggagacuuugagaacaggcuuuauucugcgcugggaagaaggcuugggauggagcugggguguuggucgcugaaggcgcuuggauuccaguugcaguuuccuucucauguuaggguagacugcagauaccggaaccuuuuguguuuucugcucuuaaugucauuuuaaaaauguaaagacacuuuaucuguaugaauguuuugccugcuuguaugacuguacauugccgugugccuaccacagugugacaggaauuguaguucugugugauugguuuucacacuuuccuacuauggcugugacugaagucacaguugagaaauguaacuuggaagacagaagaggguguuggaucccuugggacuggaguuacagauacugucauguggauccugggaagcaaacccagguuaucuggaagaacagccaguguucuuaacuaucugcugagaaccuucuccagucccacauuugaaaaacuauauucauuauuauugugugucuccugucggggagggcccuauagggaugucagagaccauuuguggagacagauuucuuucuucccauccuuauguggguucuggggauuugacucaggugaucaggcucauaaggcaaacaccuguccugacugugcuggcccacuucccaggcuauuucugagaaaugacauggggugugccauaggcuugaauggugaugguaguuuggucuagucauuucucauuuuggacuuuuuuuuuuuuccauuucugagggaacugaaguagaaaaguaguuuaaauguuucugauuuuauaugcauaggaaaaaaguugucucagagacugaugugcucauauagagucaguauuuagggggaauugauugucuaauaguuaaaaaauauauuuauaugcauuuuaaaaaaugaagagccucuuucucuuguuaaauuaauauaauuuaagaucaauugucacuauacuauuuuuauuuuuaauuaauuaaaguagcuuuguaguaagcauuaauuuuguuaauauugacuaaucaacugauguaugauaugaaauauauucuccaaauuugcauauaagucuuacuaaauuauuuguucuauauauaucauaugcaaaccacauugugaaugguugcaugcauguugcuugauuuauuuuagauaaauauaugcucaugaaguuuuuuuuuuguuuuuguuuuuaacucuagcuauaaagugagcuuagccagacuaaagauacaucacaggucaacaaaggcaaaauucauuuguaaacaauguguccaugauguguauuuacacauaugcauguuccuguguguaugugaaugcagauguacauguaugauggcauuauuugaucuuauuauauuaacaucauguaauaauguauuauaugauaauuauuauauuaaauuaaacuaauuugauuauauuaaaacaaagaguuguguuuacacuuuguaauuaaacuuugaagccuuaucaaaauauguagagcuguauuaagcaaagaaauggcaaacaaaaacagcagagauguaaccagaauuuuagagaagguuauuggcuaggaaauaugaauguagagccguucugcugguaaauaugaauugagauuacacugagaaacugcuuucccuuauuguuaccuguaagauuuuacagucuaguaguaugaggcaugaaugcuguggauuuuguagcauuacuccauauugcuagagagggugaaguaggguagucaccugagaaauggguaagcauucucucuuaagguuggacuugacagcuuugacacacuaguugcacacacacacgcacgcacgcacgcacgcacgcacgcacuuguuccauucagucccagguccuggccuggcugcuguguccuugguuuuagugaccaugcuucuguuccuucccucuccugcuucuuucucaucuuucuugagacaugcaaguuggaguuaacuuaaugcuuuguauuuggaaacaggaaugccugccaggugaggcggcucucucagucagcauguggcauccauuuagcucacagacauuuggcagguguucugggcuggcccgagcacugaccgagucuuaucagccaccugcccguguauagcguuggaagaauggugcagacauguugcuuucaucacugcucacagaggauggcuugcuggcuucaccuucuuuaguaucuagacuuuauuaauuguaguucccacagagcauuuauuagugacuuuuagaaugacuuaugcucugucacuaagauugcugaugauuuggaagcuuaauagcuuucaagagaauacaacauacauuauauuagaaugugucacgugguguuugagcacacaagaaacugguuuuggaaaugguguugcuacccucugauucagacccaauauuuuuaugucuaguauccucugagaagacccuuacugacuggcuccccuaaugcugagacagaaaaaugagcagucagcccaggagugaaaacgcugccgucucaugaauauccaaacggugaccuguugccaacuggccaguguuccuauggaagggagcagcuggacagucagccacgagaggaaacucaguuaggacuccaccucagcuuccucagucaguuucuauuggauguugugagcacccaacauugcucucuguucuuuuacuuggaaaccucacccagaagggcacucugcucugcucugcaugcuauucuugauggggcgcuccaucaggcugcuuugguggggcuuucucugugacuuucugcuggauauuuguaagccuccgacuugauggcaguauuuuccuguuauuauuuggucuuuuacuuggaagccucucucugcucugcccaagacucuauugggaacuccagguggcugccuuuaauuucugcuaggugucugaguucccagcuaauuucugcugaguguuugagaaucugauuugaugguguuuuucuguuuugucuaccuaccuaccuaccuaucuaucuauccauuucuuucacuuuuccuuuacuuggacuugcuguaaacuuaauaaauacauuauccaaaccuaaacuauuccuauugcuaagaauaguccauuuucugaaacaucugaaaaggagcccagaacagacucuucuuccuuuguaaaauguguuuuuauuuuaugugugugugcguuuugccugcaagugugucugcuacuggcaugccugaugccuguggagguaaaagaaguugucagauucuuuggaccuagagugauggauaguuuugggugcugggaauugaaugcagguccucuagaagggaagggcacaacgcaggguuagagccuggcaggccgagagugugaagcuccagaacaggacagugaaugagccauuuuucuaaccauggcuguuuuauaaagggucagcaauaaagaauccagaagaaaagugacugcaucuccaccaguugggaaggacuuagguaaauccuagguugaaacugagcacugccagggaggagcugacaagagaaggaaggauccuuuauagaaggagaaugggaaaugaggacucuaauaacuaacugaauaucuuuaauaccucgcugaagucacagcucagaaagauguugaggaaagagagggggguggggaacaaaguuguagagaauggcuaccuucugcuuaauaccuguggcauguccauccacagaugugccccacauaugcacauaaguauugugugugugugcauacacuuugucucagccuauucaggcugguauaacaaaaugccauagacugguugguuuauaacaagaaucuguuucugaguuucagaugcuagaaguuuacuguccagucauugguagguucaguguuugaugugcaugcuccucacacacaauuuuuucuaugucuucacauggugaaaaaguaaagggucccuuuaagggccuuuuaauaaggacauuagucaucucaucacaucccuuucaccagccuuucuaaaccccucuuucugaagcugucauggugacuggacacaugaaguuuggaaggacauagauuuuucagaccauagcacauacauguucucucuucugaugaccaaauggacaguacagccauaggaguguggugaggucugauucaucauaucuggguugacugagacuggcaaggaugguggacauugucacccaagcauagggucagugaacuuugaucacauuaugcaggaucacgguaauuguuuauaggguggacaguauuaaucucaagaggagcaaagaauggcucugccuacuuagggagagggauggccuagcagcuccgagcuccacuucugcucuguugugaccuugggaagccagucccccagcucccucccaucauguagcaaaugccuccaguauucauccuuucuugggaaagaaaugagggcagugcauauaacccauugaguuugggauccuaucuugcacagaaaccccuggguuaaggguuuagucuccuuuacuuacuuacuaguagaauauguucuacgagcugcucuaaaccccagcuugucugaaccuuugucuguuugucuguuuguuucuagacaaacuggaggagaagcuugagguuaguucagugacagcucagccccuagcauuggaaagcggcaaacagaaggacagagguccuuuugguuuaagagauggcuucaagcugacaaaguagguugggcuccuggccaggcuugcuccuauucccugagacagugauaguuccucgugacauuaccagccacacucauucacugcaggugguucuaguuuccuggcuugccccacuuuguggugccuaggccugugggaacuguuuagcagucaaaacuguugugucuacaaggagaguuagagcuugugguccacaaugcccagcaggauucggaggcuguguucucucuuugucaagagcuuucuugucccgugcucaucaggaacagagugggagcucagugagacuugcuugcugacucacuggcucacucccacccugaugcuggagcucugcugcucaucccccccaccccccaccuccugcugcaggcccacagcugcagggguggccuuggauuugcuggguggggcucagagccaccugcacuugacaggacacauuuuuacauacuguuggcuggaaauaaucaacuuuauuuaaagagaauguggauucagagugcuauaaaaagcaaccagcaaccugcuagggcuguuuuaggagcaauuuuccugccugcugagaggcccaugcuaggggacuugggggucuaugcuggaaggacauaguagaaagauagacuagcaggucccaggcaauaaauagccccuaaugggcaugcagagcucgagaaccugguaaggggucaggcagagagacuugcagccuuuguccugaggaauugaguucauaugccauacugaucuuugcaugaggagccgauauguauguaagagccgcuauccaaggccuuuuuccuauuacaggcuucuuuguucuuagucucugaucucuuagucaagugcuagggcuauuuugguuuuaauuucaugugggaagguauguauauuuucauauucuuuuaaaaauauuuauuuuaugugcacuaguguuuugccuuuguaaaggcaccauguacugcaguggucagaagagcaaguuggauuccauagaacuggagucacagguggcuaugaaccacgauaugguaccagcucucucuugucuucauaguuuugucuauuuuaacaugguaauauugauaggguucucaguggagagggaucucuuucucccuacuuaccaacuguagagguagccacuguuacccuguuguuguugcuguuuuaauuuucauagauaccacuccauauucaugugugcccaugaccagugugagccuuguacuaccaauggguuucccaugggagggcccaguggaagauugguggcuggccggccugcaccguuggcugcacuuguuucuuuguacuccauuucagggcacuuuagggacuggaaccccggggccacagguacauugucacuccugucuguguuuguauaaguaguugcuauucucuuggcugaaauguuugcauauuguagggaauuuggauauuaccuaaggaagcaaagaggucagauccucucuuaccacaaaaaucaaaccugcuuaugcauguaugcucauuuccucuucauaaaaaccgaggcaauaccauauauagaaguuauauaucccuuucaaccucuucgguuuuuuguuguugcuguguugaaagguuuuuccauaccacuagucuaauugaaauacuugacuguucuauguuuuccuuguuuuggugccuuucucuugcugucuuuugucaagucaucaggccaggcguccucuguggcuuucagugccuguguucccugugcugcacagugccuccccucagguacucgcccaguuuguguccaugcugauugcucacugccugaucuucucaguauugagugcugagguuuuaaauugccucugauggaagcgaauuucuuagccaucuugcuugugcagucacaucaaagcuuaaacaacagauaccugagaugaggugugggcuggcucucacuccugaagcuauauggaagaaggauccuucuggcccacaguucuuguuccaucauucugaucucugccuguucucauugucgccuuuacauccuuuuccuagauaaguguguguucaaaguuuccacuugaagaucaauggucauagugggugagggcccaccuuaauugaccugauuauaacugacucaaggauauaauuugguagaacacaaauuaccuucagcagccuucucuuauccagcccucagauuucaggccauguuggaggcccagucucuuaaauauaggacacaaaaguacacauaccauggguaaaaguauucuuuuuuaauucuuuuuuuuuuuuaagauuuuauuuauuauuauauguaagcacacuguagcugucuucagacacuccagaagaaggcgucagaucucacuacggaugguugugagccaccaugugguugcugggauuugaacucaggaccuucggaagagcagucagugcucuuaaccgcuuagccaucacaccagccccaguauucuuuuuuaaaagugauuuuaaaaauuuuuauguuaugugcauugguguuugccugcauauauauaucugugugaggguguugaaucccuuggaacuguuguuauaagcaguugugagcugccauguugaugcugggaauugaacccaggaccucuggaaaagcagccagugcucuuuaaccacugagccaugucuccagccccaagacauccuuaaaacuugagugagaaaacaguguccucuuuauucacccuuauccaaucuuggucuuguuucugugucaaagcaauuguaggcccuugcaacuuagugcuuucuggaaugggcagaagcagucauacuuuacaguguguggaacucccugccugcucaggcugucugcugcugugugagcagacauggaagaugacugcugagccacaccuacuugagaauauucugcuaccuucucuauacaaaggcuuuuauaugugaauuagauccucaacucacuuagugacuugugagucuaaacucaucuuuaaggcauuuauaugauugaacauagcuaaauuuuaugccagauuuuguauuuuaucuucaacaucugcuuccuggcuaggcccuuuuguaccuguguacuagcuaguuuuaugucaacuugacacaggcuggaguuaucacagagaaaggagcuucaguuggggaaaugccuccaugagauccaacuguaaggcauuuucucaauuagugaucaagggggaaaggccccuuguggauggugccaucucugggcugguagucuugguucuauaagagagcaggcugagcaagccaggggaagcaagccaguaaagaacaucccuccauggccucugcaucagcuccugcuuucugaccugcuugaauuccaguccugacuuccuuggugaugaacagcaguguggaaguguaagcugaauaaauccuuuccuccccaacuugcuucuuggucaugauguuugugcaggaauagaagcccugacuaagacaaccugugcuaguuuugcaauggagauaaguaauaggauuugguugacuagguuuuuuuaaggccaucucauuaaaugcauugcuuaccucuuacuaaugaugugcaguuuuaaugcaguccuuguggcuuugauuuacuuacuagggggaaagagaggcuuaguguuggguuaggauuaagucaaacagcugcaggauggaggguuuuuuguuuuguuuuauuuuguuuuuguuuuuuuguuuuuuugccuauuuguaaaggacaaguucugcuuagcaguucaucagacauacccagugcucaugagccagggaucuucuuaaccaaccucuuuguuuacuuaacaggccugguucugaacugacaacaagcagaacugugauuuccuggagaccauguaugagugucacaaaggaaauugcccccaaagagacuuuagcagagguagaaagcaagcuauccugugugugugugauuuccucaggacauaacacuagcaccgugaagcugcucugcauuucucuggugcaucucaauguucuuguucuuuuucaggauucaggagcaguuccagaaaaauccugacaguuacaacggugccauccgugagaacuacaucuggucgcaagacuacaccgaccuggaggucagggugcccgugcccaagcaugugaugaaggggaagcagguaacagcagcagugggcagggccucccugcagccagucugagcuccaggcacagagcagagacuacaagaaaauuaggauuguuuuucugaaucuugucccccgggggugguugccuuugcuguuucggccuuugcgucugccugugagcccuuuucaccuggucuucagguuuuccuggggacagucagccguauucuuaaucugagcaaccauuaucuggagaaaagcucacauuugauaucuuagccuuauagcaaggacucgggcauucuuuuggccuccuuguagacagcuaguuagucucuuaguuuucuuucuuuuuuuuuuuuucgagacaggguuucucuguguaguccugccuguccuggaacucacucuguagaccaggcuggccucaaacucagaaauccaccugccucugccucccaagugcugggauuaaaggcauucgccgccgccgccaccaccaccacccagcaguaaguguauggaccaggaggcccagcagagaaagacuuuuuuuuuuugguuuuucgagacaggguuucucuguauaguccuggcugucuuggaacucacuuuguaggccagguuggccucggacccagaaauccaccugccucugccuccccgaguucugggauuaaaggugugcgccaccacaucuugguuuucaagagcagauccaaacauuauuaccuucagcuucccuaagaaaacuccaguuagcugaccucccagugagggcuaagguaccuugcaugaugacugucaccucucuuuacugguaugaggcucagugcuccacacagaauagggcagcagagccauuuuguguacuuuggagguaaauaaauacugaaaucuagucuugggucaggggauagagaagaacauuguggauguguucuuagacacagaaacugucccaagacaguaagaugacagcaggaaaacaggacaggcauuccucacuguuccugucucacauggaugcuggguucacacagauauguguugagcaggcuuuccuauccacaugccucuuugcugauguuggcuagaggucaccagagggcaugacauucugugugugagguccagguuuggcauuacuugagguaccuaccucgucagugcucaggcucaucggccaggcuugucacuucaggaugcucaugggggaggaucguuccacuuccucaggcacaaauucgaugauguauacguuuucucccccuguugacaaacaaagcucauaaucuucuucaaauacaaacacucccuauaaccaccugcccccagccucccaaacugucagucaugcaugguacccauugcaguuccagcuagucccgaggcaaagcaaagaaguauagagauucuauagacaagcaagcuggaugggacuacacauuccuaguacuguaaagggugcacauaggugcacuaggaccugcuagcccaacaccugaccucuuagauuagugagagguccuguuucuaaggaauuaggcaaagagugauagaggaagacaugggacgcuuuccuauggccuccaugaacauggauggccauuaccacacacauacacauguaaaucuaggcuacagugaccauauuaauguuuggcuuguguccugcgguucuuccauagggcaagagccaugucagguauguauagcugugacauuaccaacuuaagcugauuucuggaacuuauguuuaggaccuaauuuuucggagggaaagagaaguuuauuuagaaaacuuugguagaaauaacauuauuauauauuguuauaaauaagcaggauucacuuaaaauaauauuagguaacagauucaaauaggauauaaugugggaagccgcccccacauucgccgucacaagauggcgcugacauccuguguucuaaguugguaaacaaauaaucugcgcaugagccaaggguauuuacgacuacuuguacucuguuuuucccgugaacgucagcucggccaugggcugcagccaaucagggagugaugcguccgaggcaauuguuguucucuuuaaagaggaaagggguuucguuuucucucucucuugcuucuuacacucuggccccauaagauguaagcaauaaagcuuugccguagaagauucuggguguuguguucuuccuggccggucgugagaacgcgucgaauaacaauuggugccgaaaacccgagacgagaaaaaacuccggacuggcgcagggaagaucccucauuccggaaccagaacugcggaucacguuuauaaagguucccguaacacagacuguugagaaggauucaacugccgaauucagaacucaucagcuggggaacgacggugauaaagguucccguaaagcagacuguuaagaaggauucaacuguaugaauucagaacuuuucagcuggggaacgagaguaccagugaguauguuuggccuugaauuuuuucugguguuaggagcccuuuuguucuuuuucacauguuaucaagugauuaagauagggcugaaaauucuagaggaaauucaggacaagcuaucagaaguaaagcgggaagaaagaguaggaacaaagaggaaguaugguacacaaaauaaguauacaggccuuuccaagggucuugaacccgaggaaaaguuaagguuagguaggaauaccuggagagagauuagaagaaaaagaggaaaaagggaaaagaagaaagaucgauuagcggaggucucuaggagauacucgucacuagaugagcucaggaagccagcucuuaguagcucugaagcaagugaagaauccuccucugaggaaacagacugggaggaagaagcagcccauuaccagccagcuaauuggucaagaaaaaagccaaaagcggcuggcgaaagucagcguacuguucaaccucccggcagucgguuucaagguccgcccuaugcggagcccccgcccugcguagugcgucagcaaugcgcagagaggcaaugcgcagagagaugcgcagagaggcagugcgcagagagaugcgcagagaggcagugcgcagagaggcagugcgcagagaggcagugcgcagacucauucauuccccgagaggaacaaaagaaaauacaacaggcauuuccagucuuugaaggagccgagggugggcguguccacgcuccgguagaauacguacagauuaaggaaauugccgagucgguucguaaauacggaaccaaugcuaauuuuaccuuggcgcaguuagacaggcucgcuggcauggcacuaacgccugcugauuggcagacgguuguaaaagccgcucucccuaguaugggcaaauauauggaauggaaagcgcuuuggcacgaagcugcacaggcgcaggcccgagcaaacgcagcugcuuugacuccagagcagagagauuggacuuuugacuuguuaacgggucagggagcuuauucugcugaucagacaaacuaccauuggggagcuuaugcccagauuucuuccacggcuauuagggccuggaaggcgcucucucgagcaggugaaaccacuggucaguuaacaaagauaauccagggaccucaggaaucuuucucagauuuuguggccagaaugacagaggcagcagagcguauuuuuggagagucagagcaagcugcgccucucauagaacagcuaaucuacgagcaagccacaaaggagugccgagcggccauagccccaagaaagaacaaaggcuuacaagacuggcucagggucugucgagagcuugggggaccucucagcaaugcagguuuagcggcugccauccuucaaucucagaaccgcuccaugggcagaaaugaucagaggacauguuuuaauugcggaaagccugggcauuuuaagaaagauugcagagcuccagauaaacagggagggacucucacucuuugcucuaaguguggcaaggguuaucauagagcugaccagugucgcucugugagggauauaaagggcagaauucuucccccaccugauagucaaucaacugaugugccaaaaaacgggucaucgggcccucggucccagggcccucaaagauaugggaaccgguuugucaggacccaggaagcagucagagagacgacccaggaagacccacaaggguggaccugcgugccgccuccgacuuccuauuaaugccucaaaugaguauucagccggugccgguggagccuauaccauccuugcccccgggaaccaugggccuuauucucggccgagguucacucaccuugcagggcuuaguaguccacccuggaguuauggauugucaacauuccccugaaauacagguccugugcucaagcccuaaaggcguuuuuucuauuaguaaaggagauaggauagcucagcugcugcuccucccugauaauaccagggagaaaucugcaggaccugagauaaagaaaaugggcuccucaggaaaugauucugccuauuugguuguaucuuuaaaugauagaccuaagcuccgccuuaagauuaauggaaaagaguuugaaggcauccuugauaccggagcagauaaaaguauaauuucuacacauugguggcccaaagcauggcccaccacagagucaucucauucauuacagggccuaggauaucaaucaugucccacuauaagcuccguugccuugacgugggaauccucugaagggcagcaagggaaauucauaccuuaugugcucccacucccgguuaaccucuggggaagggauauuaugcagcauuugggccuuauuuuguccaaugaaaacgccccaucaggaggguauucagcuaaagcaaaaaauaucauggcaaagauggguuauaaagaaggaaaaggguuaggacaucaagaacagggaaggauagagccuaucuuaccuaauggaaaccaagacagacagggucuggguuuuuccuuagcggccauuggggcagcacgacccauaccauggaaaacaggggacccaguguggguuccucaauggcaccuauccucugaaaaacuagaagcugugauucaacugguagaggaacaauuaaaacuaggccauauugaacccucuaccucaccuuggaauacuccaauuuuuguaauuaagaaaaagucaggaaaguggagacugcuccaugaccucagagccauuaaugagcauaugaacuuauuuggcccaguacagaggggucucccuguacuuuccgccuuaccacguggcuggaauuuaaucauuauagauauuaaagauuguuucuuuucuauaccuuuguguccaagggauaggcccagauuugccuuuaccauccccucuauuaaucacauggaaccugauaagagguaucaauggaaggucuuaccacagggaauguccaauaguccuacuaugugucaacuuuauguacaagaagcucuuuugccagugagggaacaauuccccucuuuaauuuugcuccuuuacauggaugacauccuccugugccauaaagaccuuaccaugcuacaaaaggcauauccuuuucuacuuaaaacuuuaagucagugggguuuacagauagccacagaaaagguccaaauuucugauacaggacaauucuugggcucugugguguccccagauaagauugugccccaaaagguagagauaagaagagaucaccuccauaccuuaaaugauuuucaaaagcuguugggagauauuaauuggcucagaccuuuuuuaaagauuccuuccgcugaguuaaggccuuuguuuaguauuuuagaaggagauccucauaucuccuccccuaggacucuuacucuagcugcuaaccaggccuuacaaaagguggaaaaagccuuacagaaugcacaauuacaacguauugaggauucgcagccuuucaguuugugugucuuuaagacagcacaauuaccaacugcaguuuuguggcagaaugggccauuguuguggauccauccaaacguauccccagcuaaaauaauagauugguauccugaugcaauugcacagcuugcccuuaaaggccuaaaagcagcaaucacccacuuugggcaaaguccauaucuuuuaauuguaccuuauaccgcugcacagguucaaaccuuggcagccacaucuaaugauugggcaguuuuaguuaccuccuuuucaggaaaaauagauaaccauuauccaaaacauccaaucuuacaguuugcccaaaaucaaucuguuguguuuccacaaauaacaguaagaaacccacuuaaaaaugggauugugguauauacugauggaucaaaaacuggcauaggugccuauguggcuaaugguaaagugguauccaaacaguauaaugaaaauucaccucaagugguagaauguuuaguggucuuagaaguuuuaaaaaccuuuuuagaaccccuuaauauugugucagauuccuguuaugugguaaaugcaguaaaucuuuuagaagcggcuggagugauuaagccuuccaguagaguugccaauauuuuucagcagauacaauuaguuuuguuaucuagaagaucuccuguuuauauuacucauguuagagcccacucaggccuaccuggccccauggcucugggaaaugauuuggcagauaaggccacuaaagugguggcugcugcccuaucauccccgguagaggcugcaagaaauuuucauaacaauuuucaugugacggcugaaacauuacgcagucguuucuccuugacaagaaaagaagcccgugacauuguuacucaaugucaaagcugcugugaguucuugccaguuccucaugugggaauuaacccacgcgguauucgaccucuacaggucuggcaaauggauguuacacauguuucuuccuuuggaaaacuucaauaucuccauguguccauugacacauguucuggcaucauguuugcuucuccguuaacuggagaaaaagccucacaugugauucaacauugucuugaggcauggagugcuugggggaaacccagacuccuuaagacugauaauggaccagcuuauacgucucaaaaauuucaacaguucugccgucagauggacguaacccaccugacuggacuuccauacaacccucaaggacaggguauuguugagcgugcgcaucgcacccucaaagccuaucuuauaaaacagaagaggggaacuuuugaggagacuguaccccgagcaccaagagugucggugucuuuggcacucuuuacacucaauuuuuuaaauauugaugcucauggccauacugcggcugaacgucauuguucagagccagauaggcccaaugagaugguuaaauggaaaaauguucuugauaauaaaugguauggcccggauccuaucuugauaagauccaggggagcuaucuguguuuucccacagaaugaagacaacccauuuuggguaccagaaagacucacccgaaaaauccagacugaccaagggaauacuaaugucccucgucuuggugauguccagggcgucaauaauaaagagagagcagcguugggggauaaugucgacauuuccacucccaaugacggugauguauaaugcucaaguauucuccugcuuuuuuaccacuaacugggaacuggguuuggccuuaauucagacagccuuggcucugucuggacagguccagaugacugacaccauuaacacuuugucagccucagugacuacagucauagaugaacaggccucagcuaaugucaagauacagagaggucucaugcugguuaaucaacucauagaucuuguccagaaacaacuagauguauuaugacaaauaacucagcagggaugugaacaaaaguuuccgggauuguguguuauuuccauucaguauguuaaauuuacuagggcagcuaauuugucaaaaagucuuuuucaguauauguuacagaauuggauggcugaauuugaacagauccuucgggaauugagacuucaggucaacuccacgcgcuuggaccugucgcugaccaaaggauuacccaauuggaucuccucagcauuuucuuucuuuaaaaaauugggugggauuaauauuauuuggagauacacuuugcuguggauuaguguugcuucuuugauuggucuguaagcuuaaggcccaaacuaggagagacaaggugguuauugcccaggcgcuugcaggacuagaacauggagcuuccccugauauaucuaugcuuaggcaauaggucgcuggccacucagcucuuauaucucacgaggcuagacucauugcacgagauagagugagugugcuucagcagcccgagagaguugcaaggcuaagcacugcaguagaagggcucugcggcacauaugagccuauucuagggagacaugucaucuuucaugaagguucaguguccuaguucccuucccccaggcaaaacgacacgggagcaggucaggguugcucuggguaaaagccugugagccuaagagcuaauccuguacaugguuccuuuaccuacacacuggggauuugaccucuaucuccacucucguuaauauggguggccuauuugcucuuauuaauagaaaagggggaacugugggaagccgcccccacauucgccgucacaagauggcgcugacauccuguguucuaaguugguaaacaaauaaucugcgcaugagccaaggguauuuacgacuacuuguacucuguuuuucccgugaacgucagcucggccaugggcugcagccaaucagggagugaugcguccgaggcaauuguuguucucuuuaaagaggaaagggguuucguuuucucucucucuugcuucuuacacucuggccccauaagauguaagcaauaaagcuuugccguagaagauucuggguguuguguucuuccuggccggucgugagaacgcgucgaauaacaauauaacaauuugaaauccauauuauaauaaaguuugacaugugccagaauccuuccuuauuuuaaacuucaaaagaaccuuaaauauguaaaacaaucccguguuuuauagaugggagagaaaugacuaaauuacccagugacggcucccuuguucaacccaaacagggcuuuuuagauaccuauuugaggggcugcagagaugguucagugauuaagagcacacacugcucuucugaugguccuggguucaauucccaacacccacauggcagcucacaacucuauaauguugucuuuugguuuguagauguacaugcagauaaaguacccauacauaaaauauaugaauaaauauuuggauaucuauugaguagaagaacugcuggauaaagggacaaaacuguucuuugguucagaugaaucuguuucuaagcuuagacuucugucugggucucaccucuuacuuuauacauuccugauuuaauggaagaugggguugugugaaacguguaacauggaaguugaguuaauacuuguuuuuuaggggacaguuugcucugacauugggaacaacuuagaugucacccuccaucccacauaggaugacaguccacaaagcucgguucaccuuggucuguuuuggaugguggggcgggugcugauugccuuucccaguuugccugccucacaucauuuucaguguuaguggaucagguuugucuuccaauucauuuugugguaagagcaucaauaaauaauaaacaaauguaagggcugagggaguuaccucaauugauaaagugcuugcucgugagcaugaggaccugaguucagauccccagugcauacuuacaaagaccuaagccguauuguuugccuguaauuccagugcuaggguggcagaaauaaaaggauacugaggauuuaccaguuagccagcguagcuuaucaacauuucagguucaauaagagaccuguuacaaaauaagugaacaaaauagaggaagauacccaacauuaaucucuggaacacacacaacuauuuaaaauuuaaaauuuuauuuuaaauuauauauaucuuugguuuguguuuguguauugucuuaguuaagguuuauuugcugagaagagacaccaugaccauggcaagucuuagaaaagaaaacauuugauuggagcugacuuagucucagagguucagucauuacuauggcaggaagcaugguagcacacggacagacauggugcuagaagaagaagcuuugagaguucugcaucuugauccauagccagcagaagugacugugagccacacugagcauaguuugagcauaggagaccucuaaacccuccccacagugacacacuauuuccaccaagaccauaccuacucuaacaagaccacaucuccuaauagugcuccucccuauggucuuucagggccauacuuacucaaaccaccacagaucauacaugugaguguagaugcucacagaggccagcaggaagauacugugucccuuggagcuggaguuaaagguaaauuaccugacauggaugcugggaauucaacucagaugcucaagggaagaaccucaucucugaaaguuucuccucauagcaggcccaguuuaaaauuaguuucuuuuucccacuccucagaagaacuguauuagcaacuacaccaaggguacuaugguuuguagcuucugccauaccauguaguuuagacucauguuucucucuuguauuuguuuugaucucgaugguggugcaguccugcuuuuacuaacuaacccuggaucuggcucauucuuccguggacauugucauagcacauggcccaagugguguuaccaagauagauugcuggcaucgagcauuugucucuuauugcauaggcaguaaugguuagcaaaauggugcuuuguguauguccaucacagauggagugcccaucucagugacucaauccuuuagcccaccacacagaaaccacuauacacucaugggagcccagcuaagaaucagagcuauccccacccaaagcaggcuuagcuuguuucuuuaaagcacagugguggggugaggagcuuuccagaucugcugccaauuuuaauguuggcauuuugugacaccuacugauguugcugcuuuaccugugaauaucuuuauuucagacaugguaagaaauuucauuuuucuccuuaauaaaauaccucuccaugcgauuuuuagcaguaucacaaacuuguuuuacauauuucugguauguuuaauguaagagcugaaccuaugaaacuguuagaggaaaaaaguaaggaaaauacuucaagaaauaggcacaugcaagaacuuuuugagugggacucccuucacuaggaaauauuaagaccaacauugacaaacagguucucauguaauuaaaagccuucuauacagcaaaggaggcagcuaauugugugaagagacagccuacagaaugggaggauagaagaccaauaucuggaauguacaaagaauuaaaaaaaaacgacaagaaaucaaacaacucaguugauaaauggacuaaugaaacaggcugagucacugacagucccugagacuggcacuaaacauggauugcuaauaaucauaaaaaauguucuccaccagccuucuuacaaaugcaaaucaaaacugccuugagacggguggccacaccucuaauaccaacaccucagaagcagaggccacugagucucugaacugcaagccagccauggcuucauagugagagcuugucuaaaaacuaaaagcagaacccauugagguucucuuuccuugcagccagaaggacaguuauuaggaaaguaaccgugcuggugaggcuauggcgugaaagggagcuuguacacacugcugcugggaauccgagagaguuccaacccugggaagucaguguggagggcucuuaaaacacaaacaacagcaaaacaccagauaauccugagaagcaagccuugcacaugacucaacuggagcacuggcgggggggggggggggggggcaucagcggguaacagugugugguuaggcagcacuuucacaguggcuaacacguggaccuaagcaaggaguugcaaaagcagagaagaggagaaagaaaugugauagagaccacauucaaagucuuaaagccauaaaauacaguugugugcuuggugggaacauaucagauguggcaaguuaaggcagucucaguccuauauuguauguacauacauaaaaucauacacaugcacaugugacaugaaagugacuaauggaggagagaggauaggacauaaaggggcagcagaugcuuauccugcaguacguuuacuuaaaacuuucaaaaugucuuggucuauuaguuucuuaugauuuguaagaguuuuugucacuccucucuuaaaacugugaaguaaguuucuuuuguaucucuuggguuccacuggccuaagggcuuuuccucagaguugcacuucuugacugguucccuuccaauuguucccuaaaaguaccugucccaguugccugucagcaguauuuuauuuuugguuugucucuggcauccaucagaucuaaucauggugguagccaugacugcagcagcaggugggagacagggcuaaaaggagggagcauggcgcagagccuaggcccucucuucuccaguguagcucagugcugcccuucgaguugccuucuaagcuguuuucacucaucuccucucuggaagagugugaggacagcauaguucuuucaaggguaguggagaauggauggaguguguguguaccacaugcauuauauucuucaggggaaaauaggaaguuucuuauuuugccuacaagauuuugcauauaaugauucuccuggcuaaucugaaagaucccuuuugugaagcuucucaccugccucaguagagcauuguuaggucucgucuucacggggucuuugcucaccuguucucugcugcacaggaaggguagcagacuugucuuccuuccuuagggacccccagagcacaggugccgagcagugacuccaugauugcucccuucagucagcgugcugacuuuucaaggcaccauagacugcaguacccuggagaguuagaccaugcaggcuuuuguuuuucauacgagaaaacuuucugcugagauggcacuggaauggggaccaggagcgaggcucgcaguaaccuuguuuugacuucuuuugaauggaaagugcuaggauuuuaucacaaaguccuuauugaauauugcugaguaacuagugaaccggucuccugauuuucuuuucucucaaaggcugugggugcucagguccuauugcauccccagguuggcucugaccucacuccaagagccucuuggaauagcuauuugguccccagacagguuuuguauauagcucuugcccuccgaggcuuugucuugugguugcauucuccugagcuugauguaggugcuggaagccaugcugaaagcuuucacacacaucauucccuuauuacaauugcucugcagaaaugugggaagauauugaggcaugauggcucccagcacuagacgggcagaggcagguugaugucugugaguuugaggucagcaaggcuaaauagagagaccacgucucaaaauuaaccacaaacaaaaauaaauuaaaaaguaggaagacuuuauugcaagaaauuuucaucauagaaaaguugcauuuaaauuuaccuaauuuuugaauguacagcauucuuaaauagucacaaguguaagcauuggaaagucucuggccaggcuuugugccucuugugcugugagaucuuacaacuguuuugaggccuacuuuagcagaggcaugcgucaucaaauauaaauauguaauucugcauuuccaucuuuagcagauaauaaguucuacuuagaugccccuauuauuacuacccauuguucaucuggcaccauaagggcagcccugguuggucggucacuuguuuaucuccauguucuuaagggcgccuucuugguacacuucacuguccucggucuucuguucagguggcuaccccuggcacuaagaguucccauccucugcucuugaccccuuugagcagcagggugauuauuaaacuauacugaagucauuguggcuccucuaguaaacagcaaugcuccaaaacauuuuguuuugcauaugugcauuuccguaugaauaaauuccauaaagugcaguugcaagaccaaagguauguuuuuguaauuacugcaaagcuaccuuuguaguacuguacuaaaucuauaugccaguacccauuagaaugcacaagagcugcuuuuuagcaaacuuguugacauugcucuuccucagauugcugggucuugugaagguuuggugaaaauuauccucauaguaucuagugggguaugaaaagugugugcuuguaaaaccaguacuugggacgcagacagcuggacuaucuaggaagaccgucucaagcaacauuucaaaagcaauguuuagauucagugugaaauuacaguucuaugaguuuguucucucccagcuuccccguuuucuaaguuguugcucuuuuucaggagcucuuuguagauagagaggagcaauguugugugguguguguggggugguggugguggugaugugugugugugugugugugugugugugugugugugugaugucuuuuuguuaucccuaaggaauguuuaaaaccagagauggcaccaaaaucuauauguaauacauuuucucuaugcaacauucauaugauaaaguuuaauguauaaaguaugcacaauaagagauuaacaguauguaguaauaaaauauaagcauuuaaacaguguacuauaauaguuauaaauaugauuuacucuuaugagaugaugcagugucuguugaugagauuaauuugccacagguauggauguggccuugacaagugaaauaauguccuuaucaaggggcugcugauauguugagguuguguuuggagcagaaauaugacuucuacacuaacauuuucauggcagagcagaaugaccagauggauuggauucauuaaccagucugucauuaaugggacuuuaaauuccaacuuuucuuuuuacaaguauuuuuuuccccacuccugggaugaaacacuagugaaagcauuccauaaacaauauggcugucaccacacuuuuucauuugguuggcugacuaucugccaguguucugggguuuuguuguuuguuuguugcuuguuguuuuugagaucucaugcaguccucucucuguacucugugccugacuuuauuguaugaccucagauuucauugccacacaguacccaggcaugucugucccucugugcccuggugcuuccuuugcauguuugugagacucuuugggcaucuuccucacaguccaguuucagugcaguucugacagccaacuucuagagcuuuguuugcaguguguuagcagcuucuuugguagaccagguuucucuaguaaucuuuauagcuuuccaucuaaccauacuccugaaucuacacauuuuuccuucuuuuuaggaggguuuucuuaugagaucuauauaguucaguguuuucuaguauaacacagugcuauuauuuguaacaucaacacauuaauuaggccuuuucaauauuaaccaaacacuuaucacacauauuacacacugugaccauugcuuuuauagggcgagguaggacagcaaaacuagcaucuaguuauccauacaagaaacacuaaacaaaguugugugcaugugcacagaugugugcuuaggguugaaaagaagggagaaauuauguaguuacauuguaauuaaaaaaaauaaaaauaaaaauguagcuggcugugguggcacauaccucagauccuaauacucugggaggcagagaaaggagggucucugggaguuugagaccagccuggucuacagcaugaguuccaggauagcuaaggcuaacagagaaacccugucuugagaaaccaagaaaaaaaaaucgaaauuuacuguuaaaauuaaguaauaaauauauacuuuaaaaacuaacauuaaacaaaagaaaaaaugaaaaaaaaacaaacaauaaaaacuaacauuaauuuaguuuucuuuaaaacuuuaugguuaauaauguaucuuagcaaccucaucauguaguaguaagguuuguuuguuugaggucucacuacaacucugcuggcauugaauguacagagauccaccugccucuguccccugaguaaugagaauaaaugugugugccaugcuuggaccauagauuacauuuuuguauuauugcugauuugccaguuacaguuuucuuggaauccuuuuugauacauugaguugaguuuuugaaaaaggacuggagauacggcucacuaguaaugaacacacacugcuguuccagaaaaucccaguucaauuccuagcacucugaugaggggcucacaaccaccuguaauuccaggacaucuggaaccucuggcuuccauuagcauggguacauaacacacacacagagauacgugauuuaaaaauuuaaaauauguuauugauuuacugugcaugucuguguacauauaugugcacauguauguggguggccuuauuggauccccuggaucuggaguuucagaacaagugugauauuaccaaagcccagcuuggugagaccaaggaauuuauucuuacaaagcacaggcuagagguuacuuacaggaccauggaugacccucagcugugucauaguaaagguccaucucaucauggauggagaccucauggaagcugcauucuggaauuccacuuuuaaucagcccuuucccccaggaccaugccaggugaagaagcuggcugcucuuuauaggugaggacauuaaggccuugggaauuguaacuguuuacccaaagggagucagacuguccccaguugggauuccuucuugugcugauggaggaggcugagcggggucaccugccaucucuuaggaugcuguuuuacuacucaggugcuauaacaguauuuauagcugguuugcuuguuauuuguucuaauuucucagugcuuucccugaagaguuuaauuacauuggacuuuauagcagucucuuuagauuaaugccaccuuccuuaaauucaauaguguacuaaagaacauuccuauguccuuccucugcuacuuugagcugucgcuuauguuuuaugcaguuguaacucuuuuuccccucauacucuguucaaaagacagugcgugguccacauugccuucuguuucccuguugagcuucucuuuuguguguggauuaauucuaccaccuaccuguguccuacugugucagccuggacucuugagcuuugguuuuaggacuuuguagguaagauagucugucgguaaugauucucugggucuagguguggcucucuuagauuucuacuuggaauucacugagcuucugggauguucagauuaauugugucagauuuggaaaguuuucagccguuacuguuucagguaguuuuuggcauuucucuccuaucuaucugugaguccuuauuuugaaaauguuggugucucuuggacaauccugaucauuuuccuucuguuccuuagacuaaaccuaacuuuauuuaaguuugccugauccuguuuccaaaugcugagcucugcuuuugaaaaucuccucuacauuuauuacuugguguguuugcauguggguaugugcaguuguguguaagcaccugaggaggccacuuguacucaguggacaucuccagaggcaucaaaucuggagcuaggcagcggugacccacccuguauggguaccaggaauugaacuccaguccuggaagaggagcauaccgcucuucacugcugagcugccugguaccuucuccacgcacuuuucuuuucuuuuuuuuuuuuuuuuaagauuuauuuauuuacuuacuuacuuacuacauguaaguacacuguagcugucuucagacauuccagaagagggcaucagaucucauuauggaugguuuugagccaucaugugguugcugggguuugaacucaggaccuucggaagagcagucagugcucuuaccugcugagccaucuuuccagccccuccacguacuuuuaagcuccguaacucauaguugucugagaaaagacuaacuuccaugucuuuauugauauuccacuuaggagacuuuguccuccucauacuuuccuaaaggacuuugguuuucuuuaguuuuugagugaauuuuaaaauaauugguuuguagucuuuuuuuuaaacaagcccuugucuguacuuacauaagcguagguuuuguucacugcuuucuuucacccaugucugggucgcacuuccugguuugguuugguuugguuuugcuuuguuuuuaaugcauuuugugggaacugggaagauggccuggugguugagugccuaccuguccuggcagacgacuuagguugauuccuagcacccuagcaccggugguggcucacaagcacccguaacuccaguuccagagugcacaagauccucaggaguucuugcaagcagaacaacgcucaugcacauaaaauaaauauuuuuaaaauuacaagaauaaauuucguaaucuuaguauugaaagguagucaguauuggccagguaguggugacacacaucuuuaauccuagcaaucggaaagcagaggcagguggaucucugugaguucaaggcuagccccccaaaaagaaccagaacaagaaagaaagguguguacugaaagcagcaacauggcugcacuggagauggggcaugauccccuccuucucugugaucuguuaguguguguuuguugcacuguugguauaguuguuuaaugacccugaaauaauucuguaaguucugaacucuuuguagagcuagugaacucucuguacuuggugaacuuaguggucagcuaaugacuugcccgagguuuccuuaaacaccuggaacuacugacucuuccugagauuuccacugugccuacaagggcaggguccuauggaguaugccagagcuucugaaagcccuuugggcguuuuguucccuagccuuuucuuuaguucccucgguuguuaaaauagugauuuuuaacuauaaugauuuuuaacugacacuccccugagaaaaggcuuuuugaaaacaacuucgcauccagguguacaggcacauacacacccuuuuuguugguaggaucuguuaagcaaccuuugauagcuuagauaaugcuuuugagauggagcuuugagagagccaucucuguuucgcuucuuguaauggugacuaguacagugggaauugagucugcucagggcagagagggaugggguuagagcaaaguaggaggucacaaagcuagcugggucucuucguuagcuuucccugguuaguuucuaagugcagaguggaaugcuggcagauugggucaugccucuaaagcacauagggaagacgacuuagaguuaggaauuucucugauaauuuugcuuauuugguuuuuuuuuuaacuguguuucuuuuuauauugucaaaaacaauguacuuuccucaugaccuucaaguuacugagauugagucauacucuguguuguccagaaaucaacuuuuucacuuucucacccaugacuccagcaugagugauuguuuccaguugccuugcauuccaagauuaacacauuacuauguuuguaccuuguuugaauaguacuucuucuaguuuucucauuugggucuccaccaccaccaccaccaccaccaccaagugauaugugugagagagaucuuguaugucuuaagauuuauuuauuuuuaaccuuuaauuauuucacaguuuaaugugugccaaagccauuuuuaaauuuuaaauuacauuuucuaucuaucuaucuaucuaucuaucuaucuaucuaucuaucuauccauccauccauccauccauccauccauccauccauccaccuaccuaccugccuaccucugcacaggugcccgccaugguguguggaggucauuggacagcuugcagggauugguccucuguccaccuuguggucucugugacagacugaggucaucaggcagcagcaggucauuggcugacgucucagucugacucuccugucuccuacagugucacugauucugaaugcccccucuaccuggguucuuugugaguaagcuuuaucauguccucgcugguacuaauaggaccuucugaaaaacacucaguguuacccaaguacacgacucuaagccauccuguuuucauucauuucauuucagcucucggggguguuuucaacauaaaggaauaguuucucacacuucuagaguauuaaauuauuagaauuucuggauuacucauuuuuuaguaaauugaucucugguuuguuucuuuuuucuagccuuucuauugaaguuguauuuauuuauauagcaauuauguuuuugguucuuuuuuaagauuuauuuauuuuauuuaugugaguauacuguaacuguacagaugguugugagccuuuaugugguuguugggaauugaauuuuuaggaccucugcucucucugguuggcccugcucgcucgggucacucugguagccccgcuugcucagucccugcucguuccaccccagagauuuauuauauauaaguucacuguagcugacuuaagacgcaccagaagaggacgucagaugucauuacaagugguugugagccaccaugucguugcugggacuugaacucaggaccuuuggaagagcagucagugcucuuacccacugagccaucuugccagcccaugauuuuaguucuuuuuaaaauuucuugguucuauaauuuuuuauaucugcuuagauuucugcaaaguuauaaaauggaacuauuuaaauacauuuucuccugauuaagucuaucaucuuuuguuuugcuuuuuagcuuuuuccuucauguugcauuuuucuuuuuuuuuuuagauuuauuuauuuauuauacauaaguacacuguagcugucuucagacacucuagaagagggagucagaucucauuacagaugguuaugagccaccaugugguugcugggauuugaacucaggaccuucagaaaugcaguugugugcucuuaacugcugagucaucucaccaauugcauuuuucauaacauagaacucucauuucccuacaagauuuauuuuuccuguugaugcuuaguaucuucccacauggucuugagugugggacuuuaugaaugguuuuccuuguugcauuucaaaggucuaucauuucaccaugugucaacugagugaauugacagguuugccuuggugguuucuguguuugaggaguuaguauuuaccuagaguguggccaucacaccagcuccucagaaugauggucagucucugaagcaggcugcuucugcagauccagcuguucccugggcuggcucuaagcuguucucacacaugcucuguuucuaugccugccuucuccuagccagagccucuaacugccagcacacgaugacuccaggccuauggcaucuaugccaugugucauucuuucugucugucuucacagauguacuggacacgccauccauucuucccuucaccaugucuuucuguccuuggugccuccuuuggggauuuauuucauuacacugguuaguuccuguuagaaucaugcccaaauuugaaaaugagcauguuguauaaaacuauugugaguuaguuaaggugaguuuguacuugggaaguaccaagacuguauuaggucuuguuugcaaguagaaauucaugguuagauuaauuuggccaauauuugucaugauuaucaggaaugagccaugccacauuugcuuaugucucuggcuguuagaagguggacagugagccuaaacuauaaucagcaagaccauccagguuaacaguaaauauagagagggggugacagugccacaagucccaugagaagucccaagacagugucucugaagucccaugagaagaugccuccccgagucuguacuugaaccuggugguguagcuguggcaaguaccauguaacagcuggucuuccuagggccauguuuccuuuggggcaguccuucuaauaccuccucccccaagcaugcaucaucaucauuuaugguuagcccccucaccccuuuuuaauaaaagaaaucuuccaaacucuucuccccucauuuuuauuacuuuuuauauuuuacuugcauguaugcuuguaucauaugcaugccugguacccaaggaggcuagaaggggagguucgauccccugggugagacuggaguuacagaugguuauaaacugccauaugggggcagaugcugaaaaucuaaucugggccuuaaucacugaaucaucuuugggggggggggcucaguuuuuuguugaugaauauuuaaaaugcauuuaggggcuggggagauagcucauugguaaaaugcuuaccaugcaaauaugagggcccaaguucaauccuuagaacccucauaaaaaggccaaaaacccagguaugauggcaagugcuagcaaugccugaguuagagaaacagagacaggcagauuccuggggcuugcuggcuggccagccagccuagcccaguuaucaaguucccggccagcaagagacacuggcucaaaaacaaggucuaugggugccugaaaaaugauauucaaaauugucucuggcuuucacaugcaggcacacacauucacacaguuauacacuuaccauuuuacacacauauacacaaaacuacucagguuuuacuauuagaaaucauuagcaaauaguacuugacucacagaaaauuaaaagcacccccucccacaucuaaaaugaagcacuuaauuagcaucuaccagguagucucugaauuuuaacuucauacaccuauuagaaaaagaauuugaauuguccccaaagucugauuaguaugugcauuauacaaauacagguugacaccuauagugcaaaguuuucagauuaaggaagugcagcuaguuaacaucugagcaaauacgccaaaaaagaaugaaugcagcuuagacagaucacuugauguuuaaggacgcuuacuacucuuguagagcaccuggguucauuccccugcauccgcaucagguggcucacagccaccugugacaccgcguauaggggcuccagugccuucuggcauucacaggcaucuaugugcauauaguacacgcacaugcauugauacacuugaaauaguaagucuuugggggcaggggcaaggguuuccagacaggguuucucuguguagccuugacugucuuggaacucagcucuguagacgaggcuggccuugaagucggaaaucuaccugccucugccucccaagugcugggauuaaaggcaugagccacugccuugcuaauaagucuuuuuaaaauaagagaagugaaacaaauacaaauuauauuuucuuuucuaauuauugagcuuacgguuaggguuaggguuguuagggucaggguuguuagaguuaaccuuuucccagcacuucccaguccauuguggagacauacauucagggcaggaagagguauacccaugauagcaaaguagacacauagucccugccugcccagagcaggcccugaggggaaaaggguggcugaggcuugauuuuaugaagaaccaaguaaaaggccaagcacuauggcacaugccuuuaaucucacuacucaggcagcagagccaggaggaucuuagugaguucaaggcaagccuaaucuaugcagugaguucuagaccaguuagggauacauaguaagacccugucaaacagacaaaacagacaaaaacugaaggaacugguuuuacauccuggacaaagagcaagcuauggucacacucucuguagcaacguagggaagaggaggccaagcacauuugucuuucgccagaaaguuuggaugggcagcugagcuuuucuaggcacaguggucccgggccuuaaggggccagagagagggcucuugucacugguugucugugugcccauuggagaggaggauggagaggagauccuucuggaaaggaagcaacauugaggauuuccuccaaaauuuugagcugagaaaaucuagguagucacaggggagauggaaggaagcacccaacuccuguaucuucugcucguccccagcgagagccagucucugccacuacagagggaaaggauuuggguagaaagucaagugugcuggaagcucccuuagaaaaugcaccaacauuuucugcugcagucgcuuaagggaguugauagauuuaggugguguacuggcugguuuugugugucaacuugacacagcugggguuaucacagagaaaggagcuucaguuggggaagugccuccaugagauccagcuguaaggcauuuucucaauuagugaucaagggggaaaugccccuuguggguggugccaucccugggcugguagucuuggguucuauaagagagcaggcugagcaagccaggggaagcaagccaguaagaaacaucccuccauggccucugcaucaguuccugcucccugaccugcuugaguuccaguccugacuuccuuggugaugaacagcagcauggaaguguaagccgaauaaacccuuuccuccccaacugcuucuuggucaugauguuugugcaggaauagaaacccugacuaagacagguugcuuggaauguggacuagguuggaauggagaugcuuggugagcccaagugugcacagcugccaccuucacaagcaagaugauuuuucuucugguguguucucaggucucuguggcccuuagcaguggcaccauccgaguggccaugguggaagagaauggagagcguguccucauggaggggaagcucacucacaagaucaacaccgagagcucccucuggagccuugagcccggcagguguguuuugguaagugaggucaccugugugcagagcucccaucaagguuuugcgccugcuaugaugaccuguguccaggucuuuccgauaaucagcgaggucuuuaacuauagcaauuagagcagacuuaauuaaucucuugaguauuuagcaccccacuccugcuugcacucuaucuccaugagcuuuuccguuuguauccuccaccccucaguguccucaucauucccaagagcccacuuuucuauggauaaaggcaaaaccgagaacauuacaaugaaaauggugaauuuuccuaggucccagucugcguuuauuaaguucaccaaguagaucucaccuagcaucuggcaaggcauggguuaaauaaaauuugcggcuaugacagugagguaugaauccaaaugaauaaaaucaaaugaauaucagucaguaggacacccccccaccucccccacccacccccacacacacacaauggggcuguauguuugacuagauuugucuguggcucaacucugcugugauagcagcccugcuagugagggcugacugcaugcuggcacuggagaggaaaauugaagcacacauaucuuggacuaacuuguuuccucuuucuuccugcagagggaacaaguuagguaagagagauaaagaugaaaaagaaaccaguaagucuuuggaugaaaaaacccuucaggcauucuucauauauguaacauauaaaauaaagauagcaucuauuaaauucuacaagagguucucaaugguggcuggcuucucuggaauauucuaguugguacugguggauaaagaagaaagcucucaaacccacaguggcuuuaucuuggcuacgcucguguuucagaggaaggcauagacaagggauugagugaacugaacucagugcuugugagaauugggaguaucuucugccccaucuugcuaucagauccaaaaauagaacuuaugugcuuauguggaaauguccccuuuaccuaggcaugugccuaaaugcugccagguuucuacccugccccaguucguccuauggucuccuaaggcccaugugagagcauguggaguuuucagaaguggggcuggaucuggucuguccuguguucugagucucccaauacccagcacugaugauauccacaggggcauggccuggggcuccaccaggcuauauaugucugauuguuguucuguuccucacuggugcauauuccuuggcagagcagcauuccacagccagagacaagagaaguccugcucugccugaggugucucuugccucugacaguggacuuugggugucagugugguuggauugaaugaacugguaaaccauggaugugucuacaagguuguuucagagaagaauugaaugugugucaguguucugaaugggaaagaccuaccuuaaauguggguagccuagaaccauucaguaggcugggcccagauugaacaggguauggaggaagagagacauuucgccuauugucucuccccucccaagcaagcaugccuuuugucuuggauaucagacuccagguucuuuguccuuucaacugucugguuuguaugagugaccuuuguacccucaguaucuaauugaggcuauacaccauagaucucucauucugaguaucugacuucccuagcuuugcaccuuguagguggccuuuguggucaugugagccaauuuaauauguauuaaauauccuuacauguauuuauuauaucucuauucuugcucaguuucuuuggacaacccuaguguagccuucuuaaaauuggcagcucagugcuuucccccucacacuugacuaugaagccuguacauuagcagugcuguauugagcucuuucccagcuccuugcuuguagcacuacuugagauugcaggugcccucccagacugcuugagcuuugcauagucaggcaguucuggacuaugaguaacacagcggccgaacuggacuaguaaccuuccucuugguaggccaccaugcuaggguucucugacucuagggcugcugucuuuaaggacugaguugugggacagccaugucuucugccuuggcuaguugaaccucucuacaaaguaugggauugaguuaggaucccaauucuacacagaucucuuuugagagcacuucccacguggucugcaacacuuaaaaguuaccaguguucaucauuggaauggucuucacagacugcauuuguguucagaauccacugggauuagaaucuguauacuaggaauuccuucuacuuuaugucuauaaaaugugauuguuacuaaauuaaccuucuaagagcuuuuguugauaaguccaacucugacuugauaaguauuccagagccauguuacuuuuggggaguagagguguccauguaaguugaauaggaugaagucagacauaauaacuuacaccuauaaucuuuauacuugagagacuaggacagaaggguugccaugaguuucaugcaaaaaaaaaaaaaaaacaagaaaagaggaaacaaaaaaacugggccagcacgagagcucaguagguaagggugcuugccgcccgccaagccuggcgaccugaauuugcucuuuagcacucauguggugaagggagaaaaccaacuagcacagguuguccucugauaccccucuguauaugcgcuaugaugccuucucauguguaugcacacacaaguagcugauagcuaaaacacuaacuucuuacauuaauugccagcauauauugaacauguguguccucaaugaaguacauuauacuguuugauucuuugcaaagucugagaagucaggaccuucaggcuuugagauggggcuuguaguuugcccaacugugggauggagccucaaagccccaccugcuuagcugcuguuuucuuucuugaaaagguuuugccccuuuaauggggguugggaaaugagaaggaauaaaaauaaggugaaaggggaagggaucauuguggcuuugaguaguucuugugucagguagacauggguucuauccacuaccaggcuggagagauucauguacuguacccguacccucacuagcauggcuagagacagccagagggcuguuugugcagagagaaucagacguaagguuccaugcacacauucccuugcugcagacucccugaggacucuccauucauguucugcuauggccugggcuuaccguauaccagcugcuguuaagguuuuguauugauuuuguuagguaccuauugucugcagaguuugugagaagcagaacuagcuacauccgguugcugccauagccauggcacccucaggugcuaugccaucucuugucgaaccaaagaaagcuacuuggagcugagacaccacaccaucagaguuggagguuuugguuuguuugguuugguuuggcuugguuucucagggggcaucacuuguggacaauaaguggucuuacagagcagagccaugugcauuacagccacuucuucuggcugggcccuggccuguacuuagagucccuucuugaugagaguuucagggcugaucucccaccauccaagaaagcacuguguauuauggaguacaucuauuuccaguguguuuuuacuuuauuuguuggugacauaacguggccaguuuuuuacuucugaguacacauauggggcaauccuauaaauuauuaaggagauuguuuuuauucaugaagggcuuauuuuugaccuacucaucacauuguguuggcuguguggacucagcauaaggauuaaaaaaagguuaccuaacaauaaggggguaaggcuguggggcaugccugugggucauuguuguagccauacuggacgacuuuaugagccuugagaugaacgccuggcuccuuagacucuacaugccuacugacugcuucuuguuaggccagcaaguugaccuguggauauagccuuuuuuggagaaaaggacuuuacaaauaggaauuuuaguacaagaucauucuggauuuucuggaugacuccugaaaucagugaaagacacccuuaaaagagacagaagaagagaccuagacauaggaaguccuuaugaagaccaaagacuagaaggaugugggcauaaaucaagggaugcaaacagccaccugaagcugaaagaaguaaaaggacccuucccugaagccugcagcagguacagccaugccaacuccuugauuuuuggacauccggucuccagaacuacaagaaaugaauggugauguuuuaaauacccucugcuuuggccugggacacucacacaggguccuugcagcaucugugaagaggaguggcauucagagcuguuauugguaucucuagacucugcaguaagagggucugaccuucucaccuccaagcaggggaguguagacaugccacucgcuucucagcccuuccacguguccugcugcuucucccuuuugugguagaucccacaccagacagucagggcaggcagggguggcagcuaaaaccgugugacaguucuugccucccucccucccacacuugagaauguuaaaugagacuucuugacucaggcaagcuccuugccugguuacagagauguaaaaucagccguggcaacggcaccagcuacuuuuccugacucuccguucgguuccagaagcgaggcacugagcuugugcauuggccucguuuuuuccucccuguggagagcuggcaagcugacugcccucugcauugcguggguagcuguaggcaggcggcaugcucugcuucagggacuauuggacauggcuguguugcaaagguaguuggaucugccugagcagugaaugccauuccacgcaucuucauguacugacaucucacacacaaacuacuuagcauuguucagauagcacuagaauauuuucugaagaaacagauguuggaauuccggcuuuaaagcuuacuucacuguauuuauuuaugugguuuuguuuuuucuuuuuuuucuuuuuagcccugugaguauuuuuauauaagcuguaccucccugacuguauugagaugauuuccugaaguuauuucucaaaaaguggaaccccaggauaauugcucuguggcuguccccgaagggcgcaucauuucuaaguggcacuagugcugcgucagcagcgacaccccuugucucccaggacuacuuaauguuccuugccaguuugucugggcaucuccaguuuucuuuuaaggaugaaaggguccguuguuggccuucucugaguugcaagccacuuuuccugaugugacaacauuuccuggccuaugaagauguccuugcaggucacuuacugaucauguucauuaauccagaauggaaacuacaaauuaaauuauuuuagcauuuuggcaagcgccccaaaccuugguuuuauacauacuggaaugugagcccuuauaccuguaguguaaugcuaucuccaggcugaggcuuggagaucacgcagaaggcagugaccuaagacugcuuguuccaaaugaaagcaggacuaugcugaacaguggaugggcccucagcaccuccuccuguauaguaggaagaaaguggcacauagcuuuguaucauuguguuguccccacucugcaaguauagcuguauucugccucccugggugagauccauggcuguauccugucugaccuaugcagcgucuuaguuuuuguuuuaauuucuuaagcucagaaaggcaguugaugacauugaaaaucaggagacugcuuauaucgagcuggcuugcagcauacccauaggagucaggcugcccacaucucuccacagugggugucgagcugagcaggugcccccgccaugcugucaucucaccccauuaucugcccuuguuccaaggugccuuccuggaaggaacgucccacaacauucccguuggcccaaacucaaucccacgggcagcugcgaggaguaaagccauccucacugggcacagugcuucccugaauagaaaugagguuccguuacuaaggaaggaaagggauagaaaugcuggugagucaucggcacagaucgggggaugcugagguaaguuuauucacaccgagggugaaguuuuucugcgaggacauuuugggagcacuguucagucagugacaaucuggggucccucugggaaauuauuguguucugggaccaggcagguaaaggaggaccuggaaaaugagagugcauccaggaaauggugaggucacagugaccuuggaaagggccaccucauuuugccccaacgguucagagugacuuucuaagccacugagaaaggugguggccaggaggcagcaagcaguuuccuugaacagaaggugcugucuuuagcagugcccaugcccugucaguaaggagaggucagugggagaugggaccucacaggguccuaagagcuugaugcuuauguguuaaugugacagugugggaaggccuggaaugagagggaauguucuugcaagauaccugcaggugggccacauacacaccuggguuccucaggagacacuagacaggguccuuagcgaaguagagaggaccagggaagcaggccaggcugcuacuugagaagacuuacuuagucuuagaaaguaagucaggguacagggccaacacagugguccuuacucuuaaaugauucagaaaaaagcauuauuuauuauguuuuaugcaaacacauacagaguaggacaguugcuaaaugccuguguggcucucuguacuuucagcaauguguaaauuugaaguuuuuugcaaauaagaaaugaguaguguuacaaacauacaaggaaacucagcaucacuagggaaauaaagucaaaauuacagugagaugccuuguauaccugugagaguggcugccaagaagcccauagugcucaauuuggaggagcugugggacccugaacgccucacugcuacuaugagugccaggugguggacauagccagugugcccacauugcagcccuaaugaccugcucugugcucccaagaggaggaaacgcacacaucuuuacaacagcuuccuacccaaccaccaaacccuaggaacaccuacacggccauggacagauagugaucaccuacaucaugggauagucuugccaagcaucauagcccacaggauccagaaaggaagcguguauacaagcccacaagcugugguguucaggggaagacauccuggaccuggacaagcuggauggcaagaugagcaaugcaaaaugaaguggagggaaggccuggguguggguggguuguaguggaggcuggaggagacuaaauugcaacagggugaguuuuacugugugcaaacuacaccuccucaagucugacuuguuacaaaguaacaaaauguuaaaacaaaaacagcuaauuuaagcaaaccaugggacuacuuuugccaggguguggucuuuagccaggaacccuugaaaucucuuccaugagcauuuuuccucuguucucacacaacucagauucugucuucaguaucaagaauacccuacccuacccucggagaccugaguguauucuaaccacuuuaaguaguuuauuuggaagauuaagugcccaaagugucuuaccugaguucccuagggguauuacuccaaggaagucagugaugcucagaagaacgugucagcuaagacuucugggacaugaagguauuuaaaaagucaaggcuagguccuggcugugaggguaaggagccagacagcacagcacaugaaaugcuucaaggaagcuuuguggcaaacaaaggaggccaggccaagguaggggaagauacucaugagccgucacuaacacugcagccucacuuaacccuugacugcccacucagaauagucacagaagcuuuggaaaugacagaaccuuugguauggucuccugccccagauucaagagcauccugaaccuuagggcagaggucacugagaaaaauacugaaccauguauacuuguguauagccaggcaaaagaauaacaagcuacggcacccucgaaaauggcuaugacaaaaacaaaacaacaacaacaaaacuaaauauccaugagggaguagagggcuggauccuuuccuugugcaguaccaggauguggaaggaguccagcuccagugggaaacgauuuggugcuuucuugagaccuaaaguaccaugugagccagcaauuccauuccuagguaaauaccaaaggaagggaaaacagaaacccuugcacauagcagcauuauucacauagccaaaagggggagaauggauaacaggcugugguuaauucauccaguggaaugcuccucagcauggagaggaaugaaguucugauaugugccacaacacugaugaccuucaaaaaccuuauaauaagugaaaggagccaacacagagcaauguaagguuucacuugugugaaauccaaugagacaaaagcaucaguaauugugccggaggugucagggaagauauuuaggagauuuuauuaugguaagaugaagaguaauuacaucuggcuauagggcuucuuuuuggagugauguuucaggauacauaugugguuaguugcauaccaucauggguguaccaauugccauugaacuguugacuuuugaaaaaaaaaguguuauguaauuucacaauaaaaaauuguuuuaaaaauaagguggcugacaucuuuuaccagcauaaacgagugaugcauuuugguguuacuuggugauaugauauggcugaacccaugcugucuguacaacagcccucaacugcuccaguuagguaguugacaugcauaccugacugaggaauguguguguuuuaguuauagauacuuuaaaagcugguuguugugguggugcaugccuuuaauccuaguucucagggacaggauaaucauggaauuaugaauucaaugccagccuuaagcaggucucaaaaggggauguggggugggguggggacugaagggcuugggagaugguguagugggcgagaacacuugcuuuguaagcaugaugaccacacuugugcuguagggguggguggguggguggguggguugguugguugguugguugguugguuuuaacaaacaauagccaaaaccaggugugguugcuuaugucuuaaauguggaguggggccagaucccaggagcucacuggccagcuagggucacuuuauaggguggugagcaauagaggagaauacccaauguccuccucuguucuccuuauacacaggggugcacacacuuguacuugugcaugcaccacaggcacauacaaagagccuggaguguagugcaguaguguauugcuucucugguaugcacagugcccuuaguuugauccuuacugcuucaguaacuuugagauuuuuuuuuuuuuuuuggaagaauuugagcauguuccuguaaauggacguucugugaaaauaaauauagauaaaauauuucuaaugguaaaaagugauuggauucaucaugaauuuugcuagauuugcuaaguacacagguggaccuggaagaggaugaacccuaccccaucuucccacuguagaccuggaagugaaucuuucccuuacaucuggcagguggcuguaauccacucucuccuguggggcagaccagagacucguccuguguuccauuucuuaugucuguggagcuaugggguugagcaucuguguagacuuagugguaauuuugagucugguccuugugguguacaaagguccacuaggaauagcugauguacagacaguguugggucuucccugcuguuggugggcuuggagcugaaggagaaucuaccucccacagcccugacuuagaggauuugucuuuaucuuaaauagucaugauaauguguguguuacagagccuuguuugggggaggggguguucuaauaguuaacuacuguagaucucaguaaugauaauuauugauaaagauaaaaggcucucuucuuuccagcagcuuagcaguuauucuguaagcaccucagaaugucuucugaaauagagaaagccgauuuccuacuugaagguucuucaccccucagucucgguaaagacagggccaaauucucagcauuaggguuucuguggcuuauuugggguccccaccucauaaacugcacaucauuuuagggccuguggauuagaauauguagaauaguguuguuuuaaguuuauaguuuauaaguggggacaaacagcagaagucauuuacugguaaaggugcuaccauaggcgggugcuuuugccuauuuaaaaaaaaaaaaugugucauuucccccccccccauuauuuuauguguauggguguuuugccugcaaacaauauguguacaauuuucagagaggccagaagaggauauuagguaccaugggacucgacuuauugacaguuggaaaccaccauuugggugcuaagaaucaaauccagguccuccggaagagcagccagugaucugaaucagugcaucaucucuuuggccccucuuccuuauguucauucccuuguacuuuuggcauaagaaguagaaguuacaaggugggggcuggagagauggcucagugguuaagagcacugacugcucuuccagagguccugaguucaauucccagcaaccacauggugguucacaaucaucuguaaugggaucugaugcccucuucugguaugucugaaggcagcuacaguauaccuauauaaauaaaauaaauaaaaauucuaaaaaagacguuacaagauacugaugucauaucacgauuacaaguuuuuguguuguuuuuuccauuucuggaagccuccacuguguguucuuuaccaccagcuuaaccucuuagaugcuuguacuccaggggacugacuccaggguucuccaggucaggcacagaagcucuuaacaccaucugagcacuguaugguuuagcccaucacagucaccuuacaggaugggcaaacaacaacaaacuuggucuacucagauaaaaguuuccugaugagucguccagccagugaccacaaaggcuacugccaacgcuucuaguuucuuuugugugcccauuugaccaguagcuuugggaaauggcguguccuauaggguguccugugacaaaagcgccugugccguugaauacaagaugcugcugauggucucuguuccucuccuguugaaauuccacuuggcuucuaaguuucuguggucauaagcuucacagauuucaauaccaagggcacugcaugguuuuggguagaugccacuuuacuugaccacacugauccuagacucuccugcagcuuguggucaacuccucuuggacaccucucugaaccauugaugucuaggacuggggcuggaggguuacugcaggugccauggaggaaguggggacaggccuugucaugagagggauccuugaagauugucauguauuaggcugcaugcuucaucucagaggucccaucucccagaaaggcagcaggagacuaaguguggcucuuggaagggaggaacaugguugaguugggcagagacaaggccucacccagcaggacugcagcagcaugggaaggcccagggccagguuuuagaaaacagugucugccuaggaagugcagacacaugugguagacaguauucugacucugaggaccaagaccuguaggauucaggucuccuuaagugccuucaacaugaccucuggcucagagguucccgcgugugaccucagcugucugcucauucagccaccugcccuuggugcagguucuaagcucagccuggaauaucugcccucacacacuuugcucugucccuagcacuuugcuuguccucugcuaggcucuguccacagugcucaauguucuuucccagaggcuugggcugucuccugccauacuugauacagguuuucucucuguugucccaggugaaucugagcaagguuggcgaguacugguggagugccauccuggagggggaagagcccaucgacaucgacaagaucaacaaggagcgcuccauggcuacuguggaugaggaggagcaggcaguccuggacagacucaccuuugacuaccaccagaaacugcagggcaagccccagagccacgagcugguacgagcaccacagcccuccuuguacccucagcaggcggugggucacacugguggggaagagggcaugggaauaggguaguacuggcuuggcccuuggccucugcuuuaguucugcaguguccugcuuagcuagggaauugcuuaugucaccuaguccuuccugaggacagauaaacauugcuauucagccauaucucauaccugagcuuaauggcacagccuugauggugucucuuuauuugcccugaacacaccauagcuuagaauccuuggguguugaugacucuuuaugccuuaucuacaggcaacuuucuggagcccugagagccccauugguagaagaagggagggcuaggcuucagggccagcuuagguucugacuccaaaagcuaaugcacagcaaauaguaggugagugaagaggagugcuggggcuguaacaagggaaugccagcagcuucugggagagcagaaggcuaugccugaccuguagagugcccagggacaggcugcugguggcaaagaaugauugcuuagauaaacacauuuguucuuccucuuaauaauccucagaguagcuacuuagggaagaaaaggcuguugcuguggguucucaucacugugaaaugcccagccaaacagcacaugagcucgugugcauguagaccaagcauggcucagagaaggauugacaacuggguauaggcuaucuacagaaaggcagcccccagggcuccagagaaguuaauguguguucccuguugucucugaaggaguuuuucuuugugguuuguuuggauugcccugucuuucccuucagaguggcauuauaccuuggggcaggggucuuuaguaggcucuguuguugcacuggccacuguagucuauuuucauggacacgccuuuagaagcagcccugguguccuuaccucuucccccaggccauacgagcacaugucuugagcaugagcugugaugggcaggguagguuaacugguuguaggcucugcacaacaguucugauuagagugucuguuucaaaaugaagagacugagguuuugaggucucaggauguauugugccucauagcagcucuagcaaagggcugggguuuccugcucuguucugacccuguguguggugaagagaaggucugugaggggaaggcccauguaauacagagguccuuaggcagaaacuuagaacuuuggaaccucaccuuagcagagauagccagaccugcuuggucacaguguaauacagucauguugaccugugucugcuagacacaaggucuaucuguggcacuuugccucgggguggggccuuauggaucggcucacuccugugccuaggaucaggacuuugcccacagaaggacuuagauguguuuagcaggugacugccagggaaagagccugccuugaccagagaagugaacgcagaugaggaggagcuaccaaguaccacugagaaauuugugccacagaauggagagaccaaggauaaguauggcucuucauaccuuccccggaugcugugacugagucuuuguuguagagaaacacugaaauagguacugauuguggcuugaauugccuuugugcauuugccagaccucagggaagucuugugcagauuugaauuacaagauguaagaaaagcuagaagguccuccagcuuucugcaccugugagucuccaggucucugggauugcaucccuugcagaacacuugucaaaacaaccucagugccacuugccgggaguuagcagcagugcaggguuugcaugguaggucagguucugugcacccugucuccuuccccucccaggcucuuguuuuuugugcagcccuccuuuuuuccuucaguccugaugcccucuggcguggcuuagugucaccuuccucaaggacagauggaaaacagucugcaucagugagagcaagcacacagcuaucuuuaaggaauuaagaggcuagccucuuuaaugugaccuuauucaaagaacaguucagccuuguuuugcagucucaauaaugguccucugcaggaacuggcugcuuuuuucccauccuuguaagucucagaucaccuagucaggacgacugcuucccagccuacugucccagaccgggaauagggucguaugcuugucuccaguaaaccaagacagcucuuaggaaguuccucacugccauucugaaacaggauagcaaaaggaucaaaugauaacagggcuaacccucauauguaugcacugugcacaguacacugaauauaguauccugugugagggcugcuacuggaaagcugucucacuccaaaggcaaggcuuuggggguguccuguuuuugcuuucuaugaagacugcccucuuugcccacaagacguugcagaaaccugaguuugaaacagaagguccucacaacugugcauagaagacuugcccacggcugauggacagcuuccacacagcucuuuaugauccaacacugcgaaacugaggagacuaaacaacaacccagcuaagaaggucccuaaggaauaccuuaaagaugcuguggucuaguggaaagagcuuuaucuugagucuaaauugauuuugcuguggacuugucauggaucucacaggggccauugagggagcgaguguauuugcccagauguggucccagcaagaccuucaaggagcuaaggcauggguggaaccaaugugauuccauccccagugcuggacgaaucaggauggccaaggaagccucuggcuguggauagucaggagcauaguucaauuuucacaagucccacuauccgccugguaucugugcugaaguuuucguuccauucuaggcuugaaaugccuuggagacacaucuucaguguacagcacccugggguuccauuaaaguaucuuuagcacuuucuuuuauugagcaaagaaacagaaagguagguccugaugcagcagguuagcucaucaucaguacucacacacagggcuuucauggguagcugaggucacuucucuaggauugccacuccuaacuagcagaaagagaauggaaauggggccagguuccucugccagccuccaucugcugugcacauuggcagucacaguuaccaacaggcucuguauugaugcccauuuaugguguaaacuugaaguuuucuaaaucugccagaauuuuaaauugugcuucuaaugccaccagugcuuuguauuuuaaagcauuuuaaucuugaagugguaauauaccucucucuuuuuuuuuuuuuuuuucguuuuuuaauucuuuaauugccauaaggucacuucuuuccaaagucaacaaauggaauacucuucaucuuuuccccaguuaaguguucaucuagaaggcuuauguggacguacacaggugucauugcucugucuguacuuugaugugucuuuuuaggauuccuccagccugguagcacuuaccccuuauaagcagugacagacauugcacagauagaugucacuaaauccuaugaguaaguuugguggcacacaggguagucugaucucucucugccuuggcucuggagaaagggccaugcauuuaucuuggcauccugaacucccucaauuguccguuuuauagugggucccacacagucacuagguucuuguucacccugcagcuggcuaaggcucagcagccuccugccuagguuauuuggcuggucucaucuuguuuucuuuugagacuauacagcuucacacuucucaugggcaaagauggaggccuacuauggacuaaguuucuuugauaugcuuguugcuacuucacuuagauuuaaaaacaagccaagacucacuuaucacgaagcuuggauuuuguuuaauaauccauaguucugagaauccaguaacuuugcugacauucaaaauuuuucacuuugcuuucaaucugucaucuucgugauaagggcagcagcaccuguccucugugcccguucugcagggcugucugcagcaggugcuccacugggggacagucuccagccauucgucuuguuagucuuugcuuucuuacgguuggaaggaaggaaggaaggaaggaaggaaggaaggaaggaaggaaggaaggaaggaaggaagaucuccuucucuuggguacgucuaugguagcaacugaggaaggcagaugcucagaggaaggcuagcccauuagcacgggcacagcugcugucacagggacacagccuagagccacacaacuccaaucugccucugauuuucaaggacuagacagcucaguaguggccauaagucuaccagcucuuacuguguccuaaaagcagugagguguuucggacugguccacagcuggacauuuggaggucucucccuuccucgguaucaucauauccucggucaaucccaguauugucugaugaauuuuucaaugacaagaacuuccuuccuuggggaagaggugcuagaacaccucuacacaccuuagucaugucccuaaggggcuggggcaccaccgcuucauaucugaaucaucucccuggggauuacuguaggcucuguggguuguguggaacuuggacagaccuauugggaaaggaaccgaagaugaacuaagaucagucagggcucuacuagagacugaagcuggaaagcuagaaauucagucuugggagaacagucuugcagaggacuuggcagucagugggugccucccuuggacacaaacuggccugcaguccucuggccagucggccuaacaggcaaguccacaagccccgaggaagcaggaugucugugccugcaggcagucuguucuaggagaaagcaugcgaugccuugugaucuccuuuaaucucucuauuuucuguuuguagaaaguccaugagaugcugaagaaggggugggaugcugaaggcucucccuuccgaggccagcgauucgacccagccauguucaacaucuccccaggggcugugcaguuuuaaugaccggaaguaaaggaaacccucgccauuggggagauggagacguuguccuccucacucccugcaugccagggacucacuucuccugaucaguccuagccauuuuuuucuuucaugaugaaccaggccuuccaugcugaccuucuaccuucagacuauucuagagaagguacagggccagcugcugcuuggcagugucuguggccaacacugaaugcagguguuugacaugcaggagggacaugucccagccuacugguagcacauguucugucuccacagcaaccaggcacugcaggcagcauuuccuuucuccccguucucucugcuugcuguuguuuugacgcuauucugcuugcuugucuucugauuggggauaaggaguggcugggcucagacaaagcuaaguuguuguguggagccaggcaccugcaugagggccagcggggcauggcuguggggcugcuaugggguucccucacuuguuguugaucugugucuaucucugugugugugugugugugugugugugccaucuugcucauuucuuugugaauacacuugacuugccucaguuuuaugggcagagcagcaggaacugggucuguuugagaugguaggagaaagucugagguucuggccucucacccaggugugguaaggauucugucugcccucugacugcagcugccuugcuuugauucuuguugaaaugagcugagacuagccaccacuacuuuuuccccucaagaccuccucuuugggggugcugcauucaagccuggguaccuccaagaagagaucacagccuguugguaguucauuggcagauccgugucaacuacacucccuaaggagcuuugacccugaagcaugccucaggaaggaaaacguaugcacuagcuugaaggcaacuacaauugaguccaagaaaaugaagauuucucugugccaaucacuagacugcuuuuuggagcucagagccuguguggcgacgccagcuaagggugugaagaccugcccagaggaccaggacccuggugucccaucccuuuacguacucucucugugcugguuggugccuggcaucuccauuugccugguucuuaguugugugguguguguguguguguguucacgucacagcacuaauuucuauacucugguaaccaaccauacaaagugcaagaauuaagacccauugaagccaaggcagacuguucucuggaaagagcccugcaccaccgagugcuauguccacuugcuuggaaggagccauuggaagagcaaauuuuggaacuuacacaauuguguagaaaggagcugguucauuguaggcauuuaagggauuucugguuuacuuccuaaaaguccauacugggaguuaaucugugggccugaguagaccaugaugguggucaagggacagcaguggaccccauauacccacuccagagucugaacaugugauuggacauuggucaucaaguugaugaaaucucccucaagaggucaccguccaggagcagaaucugucguagucacaagauccccaggacacuuugcuguuuguuccugaaguuuucaucaaggucuaggcugcgcacaucccugucccauggaagcugucucaccuaaagaaggaagucucguggugugugugcaccugcagucuucucccucucggcccucauccuguggguagucuugcagaaggaaugaugucguggcggaacccugcauccuuuuauuuaagacaaugcuuuucucuguguugacucaucuucauuacuguagcaugguuuuauuuucuguguugcauuuuuuucuuugucccugccguguuucaacaaacaagccuguauagaaaaagcagccugggggauauagcacugguuguaggccguggggcaggaagcugugacugaucccuggggcauguuguaguacaugguguagugguggcuucuguaucuacaugucuccaucacagugaggcucaaucccagccagccaaguagauaguucuuugcccugaggcacugcccugguuugccccgccacugaagcuggcacauugccuguuuucucuuuuuagacacgacagccacaguguggucucuaagucccaccagcugaggucugaggaaagcagggugacucuguccccuuugcccagagacccaaagagugggguguccagccugcagaguugcucuggcuccucgguguugguuugcaauaaaucuguguuuaagcaguucugguucugucugugacagucacuauuaagacacuuacaugaguggucguuacccuugacuucuagccgugaguccugcuucccucuacacagucaacaccaaaacuaaaugcacuggguuguuucucaccuggccuuucacugcuuuuagaaauccuauaagauguuaauuuuuuauuguuaccauaaagacccauucaaaauauugaaccacccugcuggagaccccuuuucuugggguuacuauugccuugauuaaacaccaugaccaaaaguaucuuggggaggaaaggguuuguuuaucuggcuuauacuucuauguuuuaauccgucauugaaggaaguuggggcaugaacucaagaagggcaagaaucuagaggcaggagcuaaugaggccauggaggcaugcucacuucuccugguuugcucagccugcuuucuuacagaaccuaacccaguagcccaacacccacaugggcuggguguuccccugucaaucacuaguuagggagaugccuuacaggcucggcuauggccagaucuuauagaagcacuuuccagggagagucccugcucaagugacuauggauagcugucaaguugacauaaaacuagcacccaacuccccgcccccccacacacacacacaguuuaucaggcuuccaagcccuuagaaugcaggcucuucucaguacauaacccugugucugucucagaauccacuuagaucucagacuucuccuuccuguguugugcccuauucagagaauccaucacugacccuacucauucucaguaggcaggaccuguggguuuguuagccucucucaugaagcacagguauugcccaucucauuccugagaccagaaauaaccuuaucccccccaccaaaaaagucuucagugauaggcccugagaguacaggagugagcacagucaagcauuuuguguggaaauguguccaggaggcgucagcugcugugcagagaacucgcuggccagaacacucugcuuggggaacagacccucaccccaccucaaaucugcugcucuagcgggccagcuggcaggcagcucagccaggaacuggauggccuccuuuugugaggagaacgcauggaguuaaugcaaaggcuggcuaguucuugauaagcuauccuguuggguuagagggccagugacccugguacaaacaaagcuggguauucuauagaacgaggacuggccauggccagcugggguugagcuugcuaccugccugaaggucuagagaguuagaugucugaaagaaccucccgccuggaacaucuacuggauguguucugaaagcccugggugccuccucccagucuugcuuaccaguuacugucucaggugagaaaaaaaaaugaauauacuuuucagauugaccaauuaacucaggauguuaaaaugccugcauuacuuguuuuugguuuuguagggguuuguuuguuuguuuguuuucaagacaggguuucaccauguagccuugguuguccuggaacuuucucugcagaccaugcuagccucaaacccagacauugauuggucuaucucuaccuccugaguggugggacuaaagggguggaccaucaccaaccagccauuauugguuuaguuugguuuagcucuggcugcccuggaagucacucuguacaccaggcuucuaaagagauccgacugccuggccuccugagugcuugagauuaagggcauaugccaccauugcccggcuuuuggguuuauuucuuaagauucaaaauugaccacuuugucuucaaauugagaacagagucccaacauacuugaacccucaguguugguucuucuuucuauccuccagucaagagcccaagacccacacugcacauacagaaggccuugugcagccugcugacucccugcuauuccuggggcgagggagcagagcccuucauggggccagcucaccuuguggcuguggggaugaccugcagaaugggaacagucauaccccggcccaggcucuggacgacaucacaaggucagccucuggauuccuggauggacuugugccugguagguuagcauuugccgguuggucaagauuaaagaugccuggagguaggccugccucacuuccugcugcaucuccacacuaggguuugcaaagagcuagacaaggccucacagauuucuuaguauaacucuugaugcuaguuauaggagcaagcaucucuccccacgguguauggccuguggcuaccucgucugucuccaaccauccaaccuaagacuggcauaagauagcuucucccuuuuggcagcagcugucauucaccugaacccacaacaacccagacaugggugccucaguggcuucccaaaccuuugcugaagagaagggucugccuccucauagaggcauuauauaaggucaggguaggaaagagccaggggaaaaaagauucaaacccucccacaacaggaccaccaaggaugccuggccauuuugcucugauagcagauuaaguaccugggccacagggccagaaguggauaccacaccugcuugcuugccugccugccaccuuuugcuuucuguguguaccagccuccuccagcauaggcaagaguuaaucucaccucugcagaaguucccuguaccucaagacucccuacccuuaacuccaggugacaccugguuuuugagacccccauccugcaaaucacauguaucccuuuaccccuuggggcacacagacuggugugugcuagccucugaucuucccaacaccuuugagaaguugaaagccaggucuggccugucucccuggcugguuuuccaugugugguagugagugcuggcucaugucuguaaacucuaauguauucagaggccgccugcuccauggaggcaagaaucagcucaugcccgucccuugcugcuugucuucagaaagcuguucucaguuacagagacgccuuugucucgugacugaugaugcuccuuucugccugcccagaagguguguguccuagaguagguagauuucccagcucgcucccuguugcccuuugccaguucccuaacuugugagcccuugugccuuuccuggauccccucacuuaggccccuaguaggguccaaacuacgaggucugacucuucccaugggcaucugacaucagccaugacagcaagacacuguccugccugcauguacacucacaaaccgcagagauggccacagcuuaccgguaucuaagguaucugcugcugauuguaucagcgguguauaaagacaagcuugauuguuuucuuaaguagaagguuuggaggcaauuuccaguuuuaaguguuuccccuggcuugaggagcuagaugggucaguugguaaaauguugcugcacaagagugagguugaguccugauucacaggcucacagaaaaaacuaggugagaugugcaguacaugcugcgauuccuggggagcuagagaccuggaucccaagagcuugcugaccaaccacccucaccaaagagacaagcuccgaguugagcaagaaagccuugucaucagaaaggaaggugaaaaaaagaggacgacaccugcuaacuaggaaguugacaccaagaaacaugucuaauaaaacucaccacacuuuccaggauuaagucuuuggacuaacugcuuucaaugaacuggacccuugcccaacagcaaggucuaaguaggacucuuaguuaaacauacauuucauagcccuuccccuucacccugugggccggcaaacaccguuucuucuugccuucccccuacacucuacacucuagugaccacugugggcccuggaacucagucccuucugaggccuguagcaagucagagaagcauucugcccuucaaaacccauccuuugagguuguguuuaagugcaagugugugggcccucguucaaaaggaccaagaauuuaaaguuugcugcugcagcauuuuagucuggugaccacccacaggagacucuuccacacaggccccuccugcugguuaaggcuaaccucugccccggccugaaagcgcuggagcugccuuuccugucuccccaggcuacagcaguccgaaacuuaggaacccccuugucuuugcucugcagugaagaccagaauuuccaugaugccauuuuuaaauuguauaaauagguaacugcuuguccuuagcuucuuucacccuugccucugugagccggcucuguggccucccucagaggaggcuuucugaagugaauauuacuuuaucuccugcaggucagugcuuugguuggucuggcuuucucucacucuugaagguggaacugugguagagucuccugcagguuccuuacaucuuuauggucucuuucccuucccuucccccuucuucccccuuccccccucccccuuuccccuuccuucccccucccccuccccuuugauuuuuagucuugugcugggugaggaguuaagagugcugggcauuaccacuuugugagaaaagcaaacaggcuuugacauuucuauuugaugguuucuuguacagacuucuaguugcauuuucaucuauuuuguacguacacgcugugcacacgacuaguaaggguauucugacuuuaugccuguguaaguuauauaugcucuagaauugaccaacuggaagcccacuuuuccuuagaaagucccuccucacacucaagccuugcucucuucagguaugacuguucuuggggagucaugucagugucuucaacuacuuuguauauuuuaucuucauuuccuaacuacaacacagagacaggcuagagcuuuuucuauuccuagccuuguuuccaaggcccaagccuguugucccugugguaccugguggcagcucccaugcccccuggcuugcaaacaaguaccuaucuucugccuguugggagugccuuucucaucacaggcauuaaaugcuuaagauacucuagguuucuuguuuugcauccagcuuauguaaugaagugcaaagcaccagcaucuagccuaccugcaaccuggcugaaccuccuggcucggccuguuuaaugacaguauacauaggccugguggguagaucuaagagaacgcauagguggaaggauggaugcacagggacccaguucuggaacuauggaccuagaccccacccucucaggucauccaagagccaucuaauacccuaagacacacugugaaacaggcuaagugggaccccuacagagugaggggggauuccuaucuguacagugagaaucaauaaccuuagaagaaucagguucagguucaaaaucuacucauccaggaagaugcugcuagaaaucucaauguacuugggcuaaaagcuuuccuggugucaacuggaaggaacauagugugggagucagcuccacggaguccuucacuagaguccugacaagcagacagaaugcaguagagccccacugguugccucuccugcucuuuugugccugaugcugguuaacagccgaaagagcuugugacauguaagagggucuaaaacuaggugagaagaaguaggaagaagccacagcacaggacguuuaacuugacccuuuccacccuccugcuggggauggcaaacuuacauacucuccuccccucuggggagacacuguggucacacuucaccuucauccacacacugggauacacuuuagguucuaaccuagugguucucaacuuguaggucacauacccagaaauccgcauaucagauacuuacauuucaguucacaaccacagcaagauuacaguugugaaguaucaaugaaaaugguucuguggugguuggcaccacaacaugaggaacuacugaagggcuguguuaacagcauugggaagguugagaaccacugcucuagccccauuagagcucagagcugguguuccagaacaccccaacccagccacaacagaaccuucacuguaguccugucagggaaggauagauagcuggcuguccaguuggccugaggcuuugcccacagccugucugaccuggaaucauggacucuugguaagaugacagacuucagucauugggcuaagcgauguuuuggugaaugaacacagaucccacugguaaaugggagugccggagccguggcucaugaagcagcacagggguggacacugaagccccaaacuacccagguuguuguaacucgugaccccaagggcccuucugagggauagaaccauaucuugaaggcacuggucuugugucaaguucuucuagauuccugggggcuccagaaggggaggagcuggacuccaggagauuggauacagacaaagcacccaguccagcuagacucccagagccuggugcccucacugcagcucugugcauccuaugcccacacugcugccuccucuagucucccugccccagguuuccucuuguucucuuugcccuaggacucccaggcuggucauagggggccugaaccauuuguacacgagcucuggggcuaacacucaaaggugcccauucaccccagccacuagggaccucucccggauccacauccaacagccgucuguggcacaacagccgucuauggcacaacagccgccuauggcacaacagccaucuauggcacaacaugcacauuuuucugccuccuccauaacagcuagaugguguacacuuucuggauggucugaauaaacuagccaagagccaggugucccuaaaagggguuagggagaugguccuguacuuaccuaaacuguaaaaggaugagcacccaaugagucucuagcaauuagucccuacauaaaccauacaaaguccacaauuagaaggcccaaugguacccuagucucucccuuugccgggcucaccuaggacgccuccaacccauccaaauuucucuuucuuuaauccuuauuuuuccuuauuuaauccugcuaccucugugcccauuuugcuuucucugcuugcuagacuauaaagcuucaaauauuacuucagggugccccucucccagcauagaaaaacucaccaauucucuuuccucuccccauucaccccagcauacucccccaccuccaucaggaagcuuuuguguuuacauuuuuauuguggcaaaauacacguuacauaaaauuauuuuguauuauacuuuguauguguguucgcguguguucauacaugcucaugcaugugaaauuggaucucauucuaccaugugggucccugggguggaacucaaguagucaaucaagaaccuuuaucugcggagccaucuugaaggccccauuucggccaguuguacaaucucaugguggcacagccaucaccagcauccauagccagcauuuaaaaaaaaaaauuaaacuuuaauuuguugcuggucuuaaauagaugaaauguuacaaaaggcccucuucuaggcucuuggaagaguuaaaagccagugggucuccacuguaggagcaccuggcuguuguagcaaguagcaggguugaccaccacaguccccacuuucuccaucccacagcucuucugcagggucaagguacaggauggcccuguggaucuucagacagccugccugguuugauuacugcauagagugggagggggcuaguggacucuauuguggaagcauugggguuagagggacaacaggguccaguuggucugaggguacagcccgggaggaucugcuggcaggcuugagugaggucugugggaggagacugcgaauguccaacugagaaugggcugcuuaguaguuguaggaaggaggaucuaggaucugggauguagcugagaguuggagccuaccauggagacauggauggccaggaugaacugguccuggaggccuggcugacauaaccugccaggauuaccuuucacacaugguugccuuucguauguagccacauguaauccuagaugacccagccucucuccuuccauuuuccuuauuugguguagggguuguuuucacaaagugcucuuuuugugugacucugacuguucuggaacucuggccucaaacucacagagaccuuucugccucugcuuuccaagugcugggauaaaaggugugugucagcauugccugcccuucuuucccaucuguaagccuguaaaagauauccuaaaucccguauguaacccaaguggccagauuucaaucccauccaccugcaccgucacauucaucagaagagaaagggcccagcaugauggugcaugccuuuagucccagcacugaggacagggaagcagguggauaucugugaguucaaagccagccuggugugcauaacaaguuccagcccagcuagagcuacauagacccuugggggugaggggagagaaauuucguagcaauucucuuuugguauaacuugagugcuaccaaauauauauauauguaauucuggcugucccuuccauacccauguuuauguauguugaguucuuuuccugagugucucuuaacucccuugaugaaagucuauguuuggauaaauaccuuuugccagguauggugccuuuaauacuuagcaacucuuggaguugaggacaugacucauuuaguaagguaguaaugcgguugccaugcaagcacaaagaccuuuuuggggaucaagcacacacuuaaaaagcuaguuguaguagcacacacuauaaucccagcauugugaaggcagacauaaaaaagaucacuggagcuugcuagccaggcaguguaaccaguuggagaguuucaguuucaauuaggcaugcugucucaaaagacuaagguagaaggauggagaaauagcucagcaguuaagaacauuggcuguugcugggcgugguggugcacaccuuuaaucccagcacuugggaggcagaggcagguggauuucugaguucgaagccagccuggucuacaaaaugaguuccaggacagccagggcuauacagagaaacccugucucgaaaaaccaaaaaaaaaaaaaaaaaaaaaaaaaaaaaaaaaaaaaaaac

SEQ ID NO: 5872 - RNA, 1275 nt, Mus musculus
ucccaagacaggguuucucuauguggcccugaaacucucucuguagaccaggcugaccucaaacucagagaugagccugccucugcuucugagugcucugcuuuaaggugugcacucacacagccaggcucuggcuuaacauuuugacacggggaacauuucauauuagugaaguguaacagguuaacuaguggauuuugucuguuuagagcaggcucuggagccaggaagauccagggggaccccagcacagcuuccugucagaauacuagcaggaacacccaagucgcaugacaaccaagucacauuagaccucgcuaacuaaucuucauaaggacugcugcaaaacaaguguucaaaauagucacucauguuauucaaauuauuuugugcagggauacauuuuaccaacccaacuauuauuuagggcagcuuguuuuggauacaaagcccgugggccucaaagucgcagcgcuccugcuucggcccgccaaacgcuucaauuaucagacggcaucccacgcccugaauguaccagguucuuaacaagcuucggaagcgucucccguguaacugcuaaugacagccgaaagacagugagcaacaggcuggcuuuggccagaugcaaaguucugcauuggcgcgaagcccgagcgagcgacugaaacccaauucugugacgucacgucacgcccacagccugucuugcaggccgcuccucuggggccgggcuacgcguugacgccacacgccggggcggggcugagaguuuggagcccggaguggugucggcgcuucacucggguggagcugaacgggagacagguaaccuugugcggcagacgggcuccguccagggcugggaggcucggcgcuugacacccggagcucgcggccgagggugaggccuaugcguccuugcuuccggagugccugagugacgggcgugaagccggacagagccgggcuggcggagggcggcgauggugggcgggggacgagaccugacggacagacguuauagccaauggcguggcaggguccuccaggcgggcggagauuggcggacgcggacuugcgccgggggucggggggccgagcgcuauuggcucuggcggcggagccgcgaagguggcgggcuagggaguagguggccuggcggcccgggagagccccaaggucgcggcgugucacguggaccggucgcucccucuggcccgcgcgcguucuuuuguccugcgugcgcugaccccagcaggccgccguccuuguguu

SEQ ID NO: 5873 - RNA, 67526 nt, Mus musculus
ugucuugcaggccgcuccucuggggccgggcuacgcguugacgccacacgccggggcggggcugagaguuuggagcccggaguggugucggcgcuucacucggguggagcugaacgggagacagguaaccuugugcggcagacgggcuccguccagggcugggaggcucggcgcuugacacccggagcucgcggccgagggugaggccuaugcguccuugcuuccggagugccugagugacgggcgugaagccggacagagccgggcuggcggagggcggcgauggugggcgggggacgagaccugacggacagacguuauagccaauggcguggcaggguccuccaggcgggcggagauuggcggacgcggacuugcgccgggggucggggggccgagcgcuauuggcucuggcggcggagccgcgaagguggcgggcuagggaguagguggccuggcggcccgggagagccccaaggucgcggcgugucacguggaccggucgcucccucuggcccgcgcgcguucuuuuguccugcgugcgcugaccccagcaggccgccguccuuguguucgccgugcccggacacggcgcugaccuuggugccugcggcagccccaccugccgguaugagguaaaccaggcugucggccaaggugacacugguuucccuagaaacaccauccacgcaccgcuuuccucgcgagagugugugacagaugugaguuauacccagagugacugggaagccugcuacugugcccucgcaugaguuaccagaucauguuucuuuugcccaccgagcagugugccagucucugaagugacagguucggcaagaauccucacguggauaccauguaaagacaggagagcggaguguagggcauuugaguaucuacacggugaaggagcagggugagguguggaaaagggauuaaagguaaugagaagugacgggcuagguguugugcgcaugcguaacucaacuuccugacuguaagaucagaaaauggcggcguuaagcaucauuggaggguggaguuuuagauccuugacgucaaaaggucacucaaggaacaccucuacaggcccaaguggggucaguggggucaaccuguauucgauggaggucucuacguccguaaguguuaucuguauauagugaagcuauugcgaaugugcaacuggucuucaucacccuaaguagaagcguguaacuaaaaauagaaguaaaaauuucccccagcuuuucuguggauuucauugcccuuacaggcccuacuugugucuguguauccugugcucugacauugagcagaggacaccguuggaguuccucuguuugucugauccucuagccuugcccuugaagguggaaccagguagauuaguagguggcguuaggaaagugacacuauaauugucuuuuucucuuuuucuauccuugucauuuuguaucacauacuaugcagcuuucuuucuuuuuuuuuuuuuaauuuaaaagguuacauuuauuuguagguagggagaugugcacacgugacagugcuuguguagaugucacggggcaacuugugagcgcugguucucaucuuucaucuuucuagggguugaccacaggugaucagguuuggugacacugguccaauuugcaggccccuacuuucuuucuugguauauacacauuuagucuugcuuaucucuaaggcagauugaucuucucauuauuuaugugccuuucaguugcugguaauugccuuuucugugccguuuauuuuauuaaauaauaauggggcuauucuuggaaauaugauuaauauuuccaugaaauguguguuuucaaccugacuuucaguguugcugucuuggaaaugauagucuuguagaccagcacauacuuuauucuguuuuaucuaccugucuauugggcuucuccugaugauguguuaggauuuauagugauguguuaaaauuuuaaucuuccauguugcuaauuuuuuucuaaugucauuuuucuuucugcuggcuuccuuuggguuccuuuagcauaguugcuggaaugaggcucccagcugguugugguuggaguagagguagaaaugaagcuccugcuuuguauuuugggacuccuuugccugucaccauccuuuggcuuaagagcauaggcuuugugguuccuuugucuacuccuguuggcaugucuuagaguuucucuacuaauuaaucugagacaugugacacauuaggggggugcucugucugucuccagguuccaaaaguuaagguuuaagucaccuuacuuccucagucaaaccguucagagacaauuguuuuaaauuuaacauuuaauaaaauauugacagauuuucaugcuuucuauaaaggcuucauaguuuucacucuuuaagaacauauauugugagccggcacugguggcauacaccuuuaaucccagcacuggggaggcagaggcagguggauuucugaguucuaggccagccuggucuacagagugaguuccaggauagccagggcuacacagagaaacccuguauccaaaaaccaaaaaaaccgauuuugugguucugguugagaugucguugagauaagucaguaacucagacuggucuggagaucuaaaauguuccauacugcuaggguuacagguaugcgccacuaugcaacaccucucuauaguaccucuccacuucugcccuuaccagugcacugcuuagaccucugcagucuugggcaccucugaugcuauagagccacagcuagggagacaccacagcagucuugagacuuagcuaaggaagcuugcucagugaucugacuuuggaagugcuccuggaugauagcuuguacuuagaugggcuaaguaggcuggucugcuaaauaguggagacacucuaguaaggguuuagauguuagagggauugucagaccaagguaguggauguuuacuuaucuugggcccuuaaaguucucagacaucucuauuggcuucuuauaauucuuuagucauagagacacuugaaguuuacaaagugcuuuacuguuuguauuauaauuuuaaaaaaaacgagagagaaaagagugauuacuguuucuaguucaaagagaacaaacaagucaggccuaguuaguauguaaugcuuacauagcaaguuggugucauugauaccugugguacuaucaguaaagugcuuacugggcaaggaccugggugugguagugcauguuuguaauccuagggcuggggaggcagaagaggguggauccuuggggcucccuggccagcaagccuagcucauuugacaaguuguagacaagugagcuacacugucuccaaaaaaaguguacagcacuugaggaauaacaucagagauugaccgugggcauauacacacaugugcgucagugcacgcaccuauauguacacauauuuauauuuaauauguacccauuuaauagacaauagcuaauauaaauauauaugccacauacauaacauauauaauaacauuugaauguuccugccucagucuccagaguaggauuacagguguugcguuuugugcaacaccucuuaaaaaugccuccucacauccacccccacuggucuaucugcuuauugacaccugccuaaauauuuguuuaucuuucuuaaaguuaugccauuaacacuuaaaaauacguuuuucuugguucugaucuuucaggucuuuuuauucucucgaauauuagcauccccacugcaguagguuucugauguucaauccaaggccuugccuaugcuagacaaguacuguauguuugagcuuaggcuacuauuucuuuuuucaucuuuuuuccccaauacaucuucuuuaaaaaauuauuuucucuguguguuuaugccguguauaugccuggugccugugaagguuagaagggggugucagauucccuggaucuggaguggccugguggguguugggaaucaaaccugauuuuuucugaaggagcaguagaagcucucuuaaucauugagccagcucuccagcuccaauuuuaccucuuacaguuaagacuugaauccacuuugaauuuuguauguaaagggauccacaucuuuuuucuuuuucucuuuuauuauuuauuuguuuugagaaagagucuuauuauguagcccuguagaccaagauaguuggaauucaacuauccaccugcuuuuuucugccuccucuugggaauaaaggcacgucguaccaccacucccacauugauaugguuuugguuuuguuuguuuguuuguuuguuugagacaggguuucucuguauagccuuggcugugcuggaacucuguagaccaggcuggccucaaacucagaaauucgccugccucugccucccaagugcugggauuaaagguguguuauuucaauuuuucaguuuuuuaaaauguguauguuuuuguuuugccugcacguauaaaugugcaccauaugcauaccuagugcugugaggucagaagaggauucaagauccccuggaacuggaguuauagaauuuugugagccauaucaauacugggacucaaaccuggguccuuuaugaaaaccacaaaugcucuuaauugcugagucaucccuucagccccauuguauuguucuuauguauuaggcaaagccccuggaauugugucuuaagaccugcccacaguuuucuuaccacauauguaagagagaaggcugaaggacaggcuacacauacuaagcuguuuggaauuuaaaucucagugugaaugacaagcaaguauccuggucauuuuuagguaaaguguugugccauuugcugaaggacaaacuuuaugaugagucauuuuaaggagaguuugaagcucuugagauauuuguucuguuggagccaagcuuucucuggcauuuuauuuuuauuucucaagagguaacuuacuugagaauaagcaaagucaaauucuucuacuuccaauauuaagaguacagcgaacacucaaugguuucuggauauguuagagaaugccauuuugcaguuaacaauaauucuuaaccaagccuuacuguuuuuccugcagucauuuaauaucuuauauagauguaaagauccuaagucagaugguaaagcuugcaacucugugccuacaucucuggggcuaguccaggcgucuuaggggacguggguaugccaguuugacagucacgcucugucuugcucuugagcuuguaggcuaggcucugaacaagucauuggcuguugugaacccuuuuaagcuaguguauuuuucuucaacagcugggcaaguuuuaucucuuuaacauucuuuuaaaacuuuucucucuuuuuuuuuuaaacagguacuuguggaaggcuucaggacaaaauguuucauuuaaggacuugugcugcuaaguuaaggccauugacagccucccagacuguuaagacauuuucacaaaacaaaccagcagcaauuaggacguuucaacagauucggugcuauucugcaccuguagcugcugaaccauuucuuagugggacuaguucgaacuauguggaggaaauguacugugccugguuggagaaucccaaaaguguacauaagguaaggcucacagaguaguccucugcucuguauguuggucaggugcucacugacugccagguaagugaguauauccagaagagucagugggcaggcaggcaacuagaacccggcaccauccaccaugucuacugcgucagacucaguguggccucaguggaaaccacaguccucuugaguuguuuccagcaaugagcucaacacucaaagcacacaaugaagcauguguagccagcccuucaaggaucugaggaaaugcaagugugaucuggcgaccaugugaggaagcacaagacuggcccuccgggaucucccugaagguugcuuuaggaugaagcucucugaagaaagaaaaucugugggaaaggaugggaccuggagaugcucuuccauccugacuucucugagagaacaugucauguguauuugugacauuucaaauucaccacauguacuuucuauauaaacagcuguuuagauccuuguguuucuauuuuucucuugucuuugauuuuucuguaucaucuacaugggcacuuuuuuucuuagacccuuuucuucgauauuugccugaauccuuucugagggugacuaguucagacuauguggagaugugcugugcuuaauuggagaaucccaaaacuaccacauuguauccaccuccccuuggcuagccaagcauuagugccagaguugguguguucuguugauggccagugacuguucauggguuaugauggucauuucuuaauuuuuggauauggaagccagcuugcugcagggguugcaguguggugcaaugguaagauguguaguccacagcuccccaccugcucuaagucuuugggagaaugacacagucacgaugauugucuucauggaggccaugcucagccaagaugucugucuuuacuguggaccaggccuauuugcacuauugaaucagccaucuuaccagaaggcauccuuuauccauugaccugccauuagguuuuuaguuuuguuuauuuaucuauuuguuugcuuguuuguuucuuuuaaauucaggacuuuauuuugcaggagggagggccacacuuuuaccuucucacccucaaacuuuuaaauuguugcugcucugaaauuccuaccaaacucuucauuuucuccuuguggacuuugaagaaaguguaaccucugagccauguaguucaggcuaaccugaaauauguuagguuguccagguuguccuugaauucugaauccucuugcuuuuacugcuguacuacugagauugcaggacauacacuggcgugccuaccuacuaaaggaggagauuuuuguggguaugauagcuuuuguucucuaaacaguugcauaguauuccuugaaaaggauuuuguuuuguuuuuccuucucccugcaugguugugguuaucagagaaagcagcaugugauaauuagggugagagaguacugaagaaagucugucauaacacuaagaguggggcaagagugcucagcuaccaucugcuugcuccccauagagacuguugguggugggauuggugucuuggggucaaucaguaugagaguuucuuggaaacacuuuugggagggugaauaguauacauguaagagauuuuguucuuuaauugaagauguguguggguugaagguccuuggagcagaguuuaugccuguaucuguuacuaagaguuugaguuacucuuacagacucaggcauugcucugcccugcuaccuguggaaggagguacaagagggcugauugaagggcuggccccacuagagauccugguuguaggcugacagaacuuugaccucuuuucugccuuguucacagcuaaguaguccucuucaaauuguauuacacacacacguugcaugugccuuuuuugagagagaugacccauaauuuaagucacauuuucagagauaccuaugacuauagaguguuauguccuauaaccuuagaaauacuucauuuuauuaaaaaugcuuugggucuggggagaugacccaguuggugaagugcuugguguacagccgggagggccuaaguucacacgcacacacugcucccagcacacauauaaaaauuaggcagccaacguggaccuagaauucaucccagugcuggugcaggaauuagagggucuuugugaguuugccuagcuagcuggcaaaguuaacuugccuuaaaaaaauaagguaaaaagugucaaggaagauacccuaugucagccucuagccucugcacaugcauguauguguauguguguguauguguaugaaaacaacacacauggugcuugccuggcauguagaaucccugcuuucaguccuuagcacuuuguaacuggguguggugauggcaaauaguaaucuccuuguguacuugggaaggaguggcaagaaaaccagaaauccaacgucaucuuagcucugaaagaguuagaggacagcacaggucaugagacagcugucuuuaaauaaaggaacuacagaggugguuccgcaauugcucuugcagaggaccuaaguugaguucucagcagccacauggugcacaaccaucuguaacuccaguuccaggggaucugacacaaaauaaaaaaaaaaaaaaaaaaaaagaaugcuuuaaucuccuguaccagaaaggguuuaggguuuuuguuuuguuuuguuuuguuuuuuggguuggguuugguuugguuugagacaagagucucuguguagcccuggcuguccuggaauucacuguauagaccaggcugaccucaaacugggagauccauguaccuuugucucucaagcucugggauuacagacaugaggcagcaugcuuggccaucucuauuuaaaacaguagccacagaaacaacuuuuaagaugguugggggugucuaauuuauuaguucuguguuugccccucauauauucaucccugauuuagugcccagcauuccacagaaaaaugaucguaugugugauugugaaaauuaugucuggccaaaguaucacagugggucagaacucucugucccuucuuccugugcugcuccacggaauucugucuucuaauuuaaucuaccucuguacugggucuacugucuuuuuguucugaguuugguccucucugagacuaucuguucuaggcuaucauaggcauuuaaggaauuuugcuaguggccuguauuagcauuuauagcucccuuuaaugucuuaacauguuggggacacauagaacaaugacaucuguguuuauguuuuaaaaacagaacuagccaagcaugaugacacauuugugaucucaguagucuuaaaacaagcagguaguugaggacugcuaagccccuggucuuguuuuacucaggagagacaggauccaagcuccaguauuguauccaggucuuucugaugcagaucugguccuuuuccuuagugccccagcgcuugucuugaagaugcuagugacugguccugcuuuacccuuccugccuguccugccauggagcuuucccacagcucacgacugcagcauucuaccccuuauaccuccccaguucacagucucccuucuuucuaauuucauucauugauaccucucccucccucccuuccuuccuuccuuguuuuguuguuguuuuuugagacaggguuucucuguguagcccugauuguccuggaacucauucuguagaccaggcuggccucgaacucagaaauccgccugccucugccucuggaguacugggacuaaagguguacaccacgauucaauucucuaugugucuagcuuguccacuccuaaaguccauaagaaccauaguucaggugucugcugcaggagugagggacucugcauucagaaacuaguggagagccaucacuuuccuuuggccuguugcccuuuccggccugccccuccuuccaugcucaugaagcaaugauuuucugugagugaacuagacaucaggggaaaagacacaagucauuguccacaugacaaaucacauucaccuuuucacuccacuggagugacacugcuuugacugcaccuagaaaaauaggaccauuucuaucccuaauauacauuugcccguuucuguggugccugaguguacucaaggcagggaccuacagguuaguuagucuugcagucaguauguucauuguggugguggaggggcuuccuacugugcucuuuugaacaggagugccuaugcugaacagucuacaggacgcuacuuuagugcucuuuuacugguuaguucugggaagaauucagaaaaguuuuuuuuuuuuuuuuaauuaaugauuuuuuuuuuuuuuuuuuuuaguuaggucucauuaaguagccccaguuggucugaaacuagccauguagagcaggcuggccucagagaucaaccugcuucuaccuucugagugcugagauuaaaagcauguacaacugcaccugguagaaaacauuuuaggaaugcccuuuggcacauaaaaggcauuuucugggguguucucuguuuuguuuuugguaugcaugugugugcacacaugugugugugggucagaggucaauguuggggucuucuuugcugcccaccuuauguuuugagacaggguuucaaacuaaauucaaacagaauuuacugauuuugaacuagcugacuagugagcuaugauugucugcugccugucucaaccccacucccucccaguguagauuauaggcaugugcuaccacacccagcuuuauuuuuuuuaagauuucuuuauuauuauaaauaaguacacuguagcugucuucaaauguaccagaagagagugucagaucuuguuacagaugguugugagccaccaugugguugcugggauuugaacucaggaccuucggaagagcagucagugcucuugccugcugagccaucucaccagccccacacccagcuuuuaaaugggugcuaggggucugaacucaggacuuuguguuugcauggcaagcauuuuaucuucuaagccaucucccugaucccuagagauuuuuuauuuuauuugugauuuguuuuuauuuacaggguacuaggaauuuaguaugcacucuagaaugcaucccaccauuauucccuuuuacuuugagguauuaaggauuuaaccuuguaccuuaugucucuagacaagugcugucccgcugagcucuaucccuagcccccagucccagcucauuuuuaaggauauuauucaugugucuguauauguguacaaaugcauaugaguacaacuauggaagucagaggucaaccucaggucuuacuccucaggagccauuuacucuccuggaggucaucgaguagguugagcuggauguccagugagugccaggcaucccgccucugaagucucugaugcuagagauagauggauguuacucugcuguuuuguuucuuguuguuuuguuugcuguuuuauaugggacauagggaucaaauucagguccucaugcaagcuuguaguugauuuugaacgauuuaugaaaauaacauauacuuagagucuguagucaacuuaaauaggauuucaacaaucagucaggacuugaaagcuaccucucaaugaucuucaacaauuucuaccaagagugauuucagcaauugcagcuuuuugugcuaaacuaacuacaccagcccagacuugugcacacuuuuguacuucucauggguaugcauuugugguuaacuagggguacccauuaacuaacuccugaaggcagcaggggguguaaagcagccucuucgccuguggcaguuugcuggugugagaacuauguuaacuagccgugcaugugaguuggcucagcagagaggagaaggagaacccuugaacuucugaagggaagugcagauuguucugagcugugagagaugaggaaggguagcauuggagguggggacuuagcaagggcuuagaaccucagcaaguggcagguugagaggaaaggcccucagacagaauaauacuuagguccuaaaggaaucuuuuuuuuuuuuucuuuuuuucuuuuuuuuuaaaauuuuuuauuagguauuuagcucauuuacauuuccaaagcuauaccaaaagucccccauacccacccacccccucuccccuacccacccacucccccuuuuuggcccuggcguuccccuguacuggggcauauaaauuuugcguguccaaugggccucucuuuccagugauggccgacuaggccaucuuuugauacauaugcagcuagagucaagagcuccgggguacugguuaguucauaauguuguuccaccuauaggguugcagaucccuuuagcuccuuggguacuuucucuagcuccuccauugggagcccugugauccauccauuagcugacugugagcauccacuucuguguuugcuaggccccggcauagucucacaagagacagcuacaucuggguccuuucgauaaaaucuugcuaguguaugcaaugguguuaaaggaaucuaaaagaaguuucacaguuaagucaaaagguguuugcuuauuuuguauuuuguuaggugucaugagugugaacccucuucgguagagacuggccagugaggccuugagaacuaauucaggccaaguggaaauggagaagcuacucugaggauuacuacaucuuucaggacacacuuuguuguugcuguuguuguuguccccuuguacuauaauuuaaagcaaaaauaaaaacaaaaaaucagaauagaaaaguagaaaccaaaacagaucuuaagggaaaggacagcaccaagaaagaauugaguugcuaugggcagcuuauccuggagcagccagaauguucuccuggugggaaagucaaagaacuggcuuuggcaguccaagaaguagcucaguuucucuacauggcauggggacuaggaaagguuuccugaggagccaaugccaguguuuagaaaggagaagauagcauauuguagagccagccuguucauucuugagacuuucuguaccuuggcuuccucccccauucgaggcuucccugaggcaggucuuaaagcccuugagacuuuuguuuaacucaguguuuagacugugaguagguggugacuugaagacuucagcauucuacaagaacccuuggagcagcaacuuuacccagcuacacuagggccccccuuaaaaggcccagucacuacugugaagguagguccuagccaaaucagcacagaugaccacagauaaucacuuuccaauggccucaugaguugugucaugugcagaucugggcccauuccuauagaauguccucagucugcuuaagagaaaaauaugauauguugccuauaauacuucccuaugggaaggccugguuuccaagagcauugguauaacaaacuguucccaaacugcaccuuuaaaauauauauauuuauuuuauguauuugagugcucuguuuucaugcacaccagaagagggaaucagauuucauuacagacaguugugagcuaccaugugguugcugggaauugaacucaggaccucaggaagagcaaccagugcucuuaacugcugagccaucucuucgguccccuccaccaacugcaucuuaagugguaucaauguauuguauuucuugacugaaucagcuaaaggcuccuggucucucauaguagucacauguagccagacaucuccaggucgucauagcugagguauaugguaguaguugcuggccugcuccucaguugcugcacagggaaguuccagugauaaggaguggcugcaaauucccugagaucugggcucaggucucauacugcugcucauuacguugguuagagcacguugagagacagacuguacuccugagagauggagaggcagggaauguguauggauggaagaucguguaggacugacaggcuagcccccaaccugcuucaaugugaucugaugauauagccaccuauaguuuaguacagcaugccuucuaugaacccuauauaggucagagcuaaggcagcuuuacuuuguuauucuuagguauccauaacagguauccauaugcccaaacagaaaguuuggaaacuucugucaugcauacuguaccauaaaaacauuauuguaauggcgcuucaguuguguucaauugguguuuuuacugacgucuaauuaugauuacucuaguuuuuuguuaguuugguuuuuuauuuuauuugccugcuguguaacaauaccucagcuucaaaaguaauagauuacaggcaugcuuccaucaggucucugguuuucacuggcuuauugcaguggguaccaguaugcauggaucacagcacaccaugagguuucccucauaaauuggguggugaugggcagugguccuauccugacugggaaaggggcuuccugccuagggauugacugaguggauagaagugucccagguucugcucuuucucuugaauucuuucgaacauuuguaguuugccuucucuggcuacucuuccauugaucugagaccuguucacauaagguagucacauagucauauugaaaaucauucccaggacauuuucuggaagaacucaagggccugcaagucagaaacgauucauagguuggagggggagggguagaagguaugaagccaaccuugucugcuguggcuaggacagcagggcuugccucucagaguagcacuagccauccuauagguaggugacauucaguggacacugagucauuuaagaagcaucuaccugacugccuuuucauugggucagaaagcuaaaaggaagcuaucuucuggcucucagucauuucccuguagcuuauauugauaacaauaaguguaauuagcauuugaacuuaauaacugaggguguauuugauagugcugggcuuuaucaaaaauuuaucaaugguaaguaggccuuugagccugucccacccauauuccuagauuauugucacauguucuugguuagucguugcuuggcaccaguacaggacuacuaagugcuuuugguuuucuauaaauaagguaggagcucacauuucauuuuauuucaaccauaguauuaaaauuauuugcacuugaaaucuguccuaaguuauccuggcagaaagguuaugacuguaagcccacuuaggguuggcaggaagauacaagccccucuucugcaggcucccuccuguuagcauuggguggcaaaaguuauccaguguucagugcuggcuucccacgaggugccccuaaguauugugucuugagaccagcuuucagcauagccuccuggucugguucuuccaacaccaucuucccuuccugauguaucuauucaguguucuucagcaugggauuuguuguuuuaccuucagcucccauaggucccaccuguucuguucuacaagccuuggggccugaguuggccuuuaaaugggugccaucucuccucagcauuguaugcucugugcauucugugaauucacagucacuuuucuugucucucgugagaguaaggagcucauuuaguuugucgucuuguucccaaaaccuuagagcaugauguagauaguuggccuuuaauguguguuucuugaauuuaaccaaaaauggauuuuuaaaaauuguuuuuacauuuauuuugagagugggggguaggugccaugguaugauguggaagucagaggacagcucuugggaguugguucuuuccuuccacuguggguuccaggggucgaacgaacucagguugccaggccugguagcaagugcucuuaaccacauuagccccagaaauggauuuuuuuaaaaaccauuucuguuuuugcuaggcauggugauauacaccuuuaauuccaauguuugggagacagaggcaggcagaucucugaguucaaggccagccugggauauagagggagaccuugucucaaaacaaaaacaccccacccccaaugcuuuacaacucuuuuaaaugaaaaaaaaauguguauuuuggacuacuguaauagaucaguuaguggagcaaagacaugauuucaugauuugauccccuaauauccauguaaaaagaggcucaguggucagugcacaccuguagucucaucacaccuagaagggagguggacacaauaggaucucugggacuuuuuuuuucuuucaguuuuucuuacuuuauuaaaccauacuaauauucuuucaaggacaaacauacagcccaggaugcuacagugagagaaucuuauucuuaugaaagacaucacaaggcgcucucgucagugaugcuucuuaccauuauuccagggauccaggaaguauucagccccuagagcuaccacaaacgcagcaaauccccauuugaauccuuuuaauauuacgcuugugaaggugaugcugccugcaaagccacccauguaucuccaagccccauugcaagccuauggaucccugagcccucgggcagcaagccucuucuaauggcgucccuucaauuuuccacucuuuguaaucuggaaguuccuuccauuuuaccauggccauguccguguucaugucugugucuagcagccaugucugacagcaaugugaccuucccgggauacucucugggacuuucuaaccagccagccuagcugcacuagugagcucagaguacagugagagacccugcgugaaaaaguuguuguaaagaacauguguggaagaugauaccccugacucccaucuccacaugcacacacaugaccuauauuugcauauacaugaucauguaugcauacauguaccacacacaagaaaaagaaaacagcuauguacacuuucugagaauugcagagacugauggccugagauaggugccuucucuaccucuagccccugucuuguccagaacuaauuuuccugacagcuuccuaugccuugagugucauuuguaaccuuguccaccuaccaugugauauuuuaacuuuuuucuuucuauaacaccuucaucuuucaugagauuugagugcuucgaacuuuguacgguuuaguacuaaucuaggcaaagagacagauguuuuccucauuuuauuaauugcaaaacaugccaaguaagagauucaagaggcagaugaccuuagaacugggugugguggaccuggggacaagagcacaggucagcauuacucagaagucuccacccccacccuucauccuucuggagccagaggacaacuucaucucuaucucguggacaagaaaccacuccugcuguaggaaguguugguuucugugcugugaaaucacauucccagggaagcagcugcugcuuuccuuuaacuucugccugguacacggagacacuucugaaaguagacauugcugcccuuuuuaauguugaccaugggccuuguucaggugccagcagagguagugaaggagggaauaacugguucagagaaacaacugaagugggugggucacucaggcuuuuuccucacucaccagaagauuggaguugggcagguucuuguugaugucgccacugcugcugcuuuucuuaguggguggccuucuauccuucaguucacacugagcagggauuucggguagugggguugauauuuuucuccugaagguuuuugaacauuuacaaagguuuccucuugugcuggccagacacuaauaucucaguggcagcaugggacaaacuaaugauaaauauguagaaucugguugagauagauauaggagaagaccagcagaaaaccuuuuugaaaauagacauauaugcagguguuaacaguacaccugugugaggugaaugacugggcaucucagggugauggagagaaggccagagagggucuagaaguagguggucaguaagguuucuaaagacuacaaagaaccccaaccccagagccgggauauuaauugacauggauguuggcaacaggguggaagagaugaagguagggcuggagaaauaggaaucaugucuaagaugcaggguugcaggugcaagagagaagugggaaguuguguaaggcugcugggaagaaaguguggucagcagguaggggugcuuuuagccuugaauaggugugugugcuuuggcuauuuguggccauucaugugggccaaauaaugaccuucccuuucugguuaaacgaucuaacuugguuaaauuuacucaguguauauaguaugaguuuugccaaguagguguagucagcuugcuguauacugaagccuuugguaauuacccauaucagaaaaccuacuagugugacaccagucauggugcaaaggggaucuuuuuuugguuuuucuagacaggguuucucuguguagcccuggcuguccuggaacucacucuguagaccaggcuggccuccaacucagaaauucaccugccucugccucccaagugcuggguuuaaaggugugugcuaccuaccacugcccggcacaaaggggauauuuaggggcaaucccaacccaguaugggagccacucuuguuugugcccguuugacugagaaaagagagccaguagaacugcucuccccucuuuauuccucgauggaaacucaagagaacugguaugaacuugguuguugguuuauuucccugacuggcucuaguacaagcagaauuucugucuauugccuuauugaaaaucacuggaguuuuacuaagcacaaaagguuacagguggggcuggagagauggcucaguggguuagagcacccgacugcucuucugaagguccagaguucaaaucccagcaaccacaugguggcucacaaccaucuguaacgagaucugacucccucuucuggagugucugaagacagcuacaauguacauacauauaauaaauaaauaaaucuuuaaaaaaaaaaagguuacagggagcugggugugaugccaccgucccccacuuuuuacaugugugcuuggaaucugagcucaggucuucaugcuuaugcagccagcacugagccccaaccuuagcuucccuaccuuauuuuuugagacggggucuauuugacuaaacuggcugguuagcaggccucagggaugaucuuuaccuccucagcguacacauuacaggugcacaccaucuuaccaggcucuuuuaugugaggaccaaacucagguccucaugcuuguaucagucaguguugaacccaucuuccugucucuuagucuucuaaguagccuuggaaaccaggcgugguggcacaccauuagaauuccaguacucuagaggaauggagcaagaggauaagaaguucaagucauguucagcugugucgcaaguuuaagaccaaccugggacauaugagaccuugucaaaaaauaaaggaagaaaucaugcuugggauuuaguguaauaguagagaguccacuuaguaugugagaggcccugggcuugacgccucagcccugcggggugcuaggaagguaaaaaggugguuuggguuauacugcucuucaugggcuacuugccaugaagugaggcuuggacuaaguaagccagcuucuguggcuuguuuggagugauagagccuuccugagguucuguguggaaagagcugcuucuuguuaguuaguucaugcagugcugagaugggguaggguccgguuaucuccugcccaguuugcguuggagaggcuuuacuguaggccuugguuaggccaggcagagcugucuaaugauuucuuagaauguguauuuugaagaugggccacuaaaccaugugguccauggucaucucuucuucuagaacgagaauagacacuccccugugcuguccuugaucaccucugcuucuagcacaaggauggacacuugagguucccuggucaucucugcuucuagaacaagcaccuauagccaagguaugcagucuuuauuaaugucugcuuccagaagaaggauggacagccaaaggaugcugucauuggucauuuugcuuccacgacguagggucucuguuggaccugcuggaagguuccaugaggucagaagcacaugggguccauccaguccuguguaugccaucucuuaguaccuuguguagagccugaugggguggcugguaugcuaucaguccucuaguccacuccccaccaccaccucaacagaaauacuguuuuuucucacagagaaagagccagagugaauuuugguagaagccaaauugauagaggaagguugagcuuuuguuuuugagaaauugacaucuugaaauuggaaacacuugauaaaaucuuuugaaaagaaaguuguaacucuuucgauguuccagacaaucaguaaugucugaauguuucuauaguagguuucaugguagguauccgaagauaacaucagaucucucuucuccagucaguucccauuaauuaaccagaaaggcuauaauuguuauaaaaaauuuuauuggagccgggcaguggugguucgugccuuuaaucccagcacuugggaggcagaggcaggcggauuucugaguucgaggccagccuggucuacagagugaguuccaggacagccagggcuauacaaagaaauccugucucagaaaacaaaauaaaaccaaccaaacaaacaaaauuuauuagaauauagcuuauguaguauaaaugccauuuuaaagugcacaguguuuuuaccacauuccuaaggcuauguagucauauucccaguggguuuuguuugcuuguuagauguugagagaauguuuuacuguggagccuuagcguaccuaaaacucacguuguacacuaggguggcuucuaacucacagagaucaccuugccucugccuccaaaguguaagaaguaaagguaugcaccaccugcuuggcccaaaugguugugguuuuugguuuuguuuuguuuuguuuuguuuuguuuccuuuuuuaagauuuauuuuuauguucauugguguuugugcgcauguacaccugugaggaugccagaucgccuggaacuggaguuacagacaguugugagcugccaugugggugcugggaacugaacccagguucucuggaagagcagccagugacuuaacugcuaagccgucucuccagccccuuaaaaacuguuuuaaugaauaccaaaggaauauguucuuacuguagcauuucagaaaacucuucauaaauauuuuagaaugagagacuaaccugcucuauaagaauuagauaggcuuuuguguaguugaggagaaccuucugguuuauauaccaagaacugauagguauauucauaaaucagauauguugguaccuggauagcaaccuggauagauuuugaaagaucuaagucuacaaaaaccagaccacauggggugagggugggagugggcaagagggucacuggcagaucauuugccuaguauguuuagggucugggguuucauuccuagcaugauaaaacaauuacuuuauuaaguuaacuuuaccaauugccccaggcacagacagaauccuuuugauagacaggcaucgccacucccugagaacacaucugugugugugugugggggggaggaucuuugcagagacagcaggaaggggagcacagaagucuuaauucaccucucuuaaaugucaagacagucuaauccguugcugaugggaaaguuuagaaacagaguacucuuacugcagagaacgcagcguuucgucccacagagguguguugugguagucugcgucuguaacccccccgcacugggaagaccaaagcaaagggaucuugaauucaaagccaaauagugacucccauagucacaucaugcccucaauucaccauccccucaagacacuuucuuuuaacaauuuuuuuuuccugcauggaaauaagucuucaucucugucucuaaacuuauaaggggccaaugaggcgacucagcaguuaagagcacuaagaggacuuaguuugguucccaacaucaacauugggcaacuaauaaacuacuuggcacugcguuucuagggcauccaauacccuuuccuggcuuccucaggcucacacaugguguacauacagauaagcaagcaugcacauauguacagaaauaaaaauaaguaaaaauuuaaauaucuauaaaauauguauuagauacaauauauaaaauauauguaaauuucuauaucucuaaauauuuuaaaguuuauaucuuuugugagguggguuaaguaauaauauaucaucuacaauacaaaaugcagauuaggugcuggugaggugguucaguggauaagagcaccaacugcucuuccaaagguacugaguucaaaucccagcaaccacaugguggcucacaaccacccauaaugagaucuaauacccucuucuggugcauuugaagacagcuacagugaacuuauacuaauaaauaaaucuuuuuuuuaaaaugcagauuagauuauugaaaucuaaagaaaauaaaaauaggaauaugaggaaauggcaauguugccuucuugcagaggacaguuauauaugacauuuaaggaagagucagguaacucugcucuuuuugucuuuagucaugggacauuuuuuuccgaaacaccaaugcuggagccccaccgggcacugccuaccagagcccccuuucccugagucgaagcucccuggcuaccauggcccaugcacagucccugguggaagcacaaccuaacgucgacaaacucguggaggaccacuuggcggugcagucucucaucagggcauaucaggugagcaggggcuggcugcagcaucgucagauaugguauucccugggccucucugggggugcguuguuuuacuucucuuucaaaugccagcaguuuccuuuuuacuuugauuuagugaggcuaaaucaaguacaagaaaaaagaagcaagacaucuagcugagcaaauaaaucucucacuuuaauguucugucucagaauagcucaaggcaaguuaggauguggguguagaagggagguucacagcugaugagcggagcagggcuauggauggauugauaucuguauacuguucaaaaguaaauccauacaguuuagagacacaagccaggguagagaagaagaacucagucuguaaaaugugggugaaauaagggggccauaccuaaauucugccaguaagcagccagccucacacauauggccagcaggacucacugggcuuuucccuguccuuccucuauccaaacacuguaagugaaggccucccuccaugcccaccucuguagggaagggagaauuuagaccuuagaacggauaugagaggaaaaguaccgaaaaacaagccagguagcuuuccucaggaagugccagugggagugaguccaggccccacggccuacuggagaauggaugcagcagaagccgcagccugggcucuugccuugagcucuugcuucugccucaugcuucaguuccuguggugguugcucagaagcauccuggguccucagucuucuuucuaccauguucuucuuugaggacucuucuugggacaugugugugcucacaugacauggagaaauacagaaugcuguaaaugcuacaguccugacuguauccgucauacaguggcuacaguuacauuuuuaaucuaguuucccaugccuucucagcucuugcugcucucagguugcugcaagagcuuaugacagaguaucuaaacuuaaaaucaacaacagcaacaaaaccacguaaaggaguuuuucugagcauggugauacacaccuuuaaucccagcacuuaaaagccagaggcagguguaucucugaguuugaagucagccugaucuacagaguuaguucugggccagccaggacuaaauaguagaccuugucucaaauauaauuacauuuuuaaaaaauugaaaaaugggugguauuuccccacucuacccugcuguuguaguaaauauuuaaucccaauuugggguuucuguccugccuuugaucauuaaguucccagagaaaaagacauaaaaccucuacauuuacacuaacccuuuaaagcaccagagcugggcagauaucuacccucuaagcuauuaguaucuuccucccuaucaacaaccccgaguuacaauuugcccuguucugccugggccacccuuacuccauggacaaacccucauggccaugcuuucgucauucacuuaccccauggagucuucuccucucucuaccuucucucucuucauggucccugccucugaaccaaaacucucccuaucucucuccugcccagcuauuggcuguaggcaucuuuauucacccaucagggauaacuugggggcaaagcuacauagcaucaauuggucuaaguaagaauauccucaucucugaggcccccagggccaguguuuggcauuccaguacacagcaacagaccaaaccucaucuuaaauuaaagagcaagguuuguacaacaaggcugguaaauaugagaauuuacuugagaauucuuuggguacagaauucaauauuauaaucauacaaacagaacagccucaauauacccaguccauuucuguuuugauggugcuggagguucuauacagcacauaaauacacacaugugguuugcaggagcucuaucgcugagcuauauaccccauccucuuauuugguuuuuaauuuuguaugauuuuauguaucuggguauuuugccuaccuauauaugugcaccgcaugugugccugguguccauagagaccagaagagaccauuggguccucuggaccuagaguuacaggugguugucuguccccguguaggugcugggaauggaaccugagucauauggaaacucuuuaagugcugaacaaccucucugggcccaucuucuguguuuuuaaauauuucagaucaagugcuuuuuaauccauguaguggucuuuugggccauaacccuugcuccuccacacauauaaacaaacagacagaugauggugauggugaugaugaugauggaggcaaaccucguaauaagaugguaccauauccaucccuuacccggcacagucugagcuuucguuucccuucucagggaaauaaucgucuccacacuggaguaacaauucucccagcauaucucauuucuguugaucuaaagaaacugcaaggaucccaggaucacuuuucaaauauccaaguuuauuauuauaacuugauaaacuuguccauuuuuuuauccucauaaaagagcaguguauggacugcucuuugagaggucuagaguucaauucucagcaaccacaugguggcucacagccaucuguaauggggauccgaugcccucuucugguguguuugaagacagcuacaguguacucacauacauaaaauaaauuuuaaaaaaagaaagaaaaagaaaagaacuuaguucuaucguauggguucauugagcuauguuccuuucuaagaaagauuuguaugaacuauaagucuuuuacccuuccccacagcucacuggaucugcuuaaugacuugcuuguguuauuauuccaggucaggggucaccacauugcaaaacuugauccucucggaauuaguuguguaaauuuugaugaugcuccgguaacuguuucuucaaacgugggugagaauuaauauguaaaugcuaauuuuaauguaauuuuacuuuuuuuuugccccuucccucuuuuuuuucuccuguccuuuuguguguguccuucccucucaucguuggcccacucauagauacgagggcaccauguagcacagcuggacccccuggggauuuuggaugcugaucuggacuccuccgugcccgcugacauuaucucauccacagacaaacuuggugagggucugcgagcagucagcugcgcugcuugagcgccucucgcugugcacagccugugcuagccaggacauccagacagcagggaaagacucugaaguuuccuucguucugaucacuugaaauucagcagucagauagucuuagugugcuuuaaggauauuauuuaucucaaguuucagccagauuguuuuaagacucaaucuggaaaaaaauuuucaaaggaagggucuuuggcaccaagaaaaccuggcuaacugcuuuagauaguagcucuucugacuccagcuuuucauauccugcacaacaccgccuaugguaaggccacgagcccugcaaggcugcuguugucaugacugucccauucuggaguaugguggggccuggugggcuagagaguguuuauuuuccuaaagagcaaguuccagaucaagcugugcuauuuagguucccugauuuauaaaugcugugaucauacugaggaaacuuugggaggccuucccuacagcgucaggacaccagggccuuugggaggugcauguguggagaauugggguuuugucacuguugcugggagauaugccagccuguaccugguccuccuugugaggugaaucagcauugcagugcucacugaagcugcuuccagaguuaauuugcuuaugucaccaugcugcuaaccuguacuaaagaaaugauggugugacuaauuacgaaaugaccggcguguucacaguaggcaccuugcaugcuaaugagucgaugaucaccaacuugcuaauacucuuggggagaagaugaaauuaguguccuugaagucacuuugaggaauagucucuggggcuuugcacaugcccuguggucuuacaggcauuggugaguuguaaccaaggauuuggauauuaauuagcuacaguuagugaacauaauugacauuggaauugauguugacaguuuauaaauaguucuuuaguuuucaagaacagucauggauauuacaauauuuccucuauauuguauauccuuuuagcagauuuaccaaauauguagaaaaaacaaaccuuuucuuuuucuugguaauccacacaaaaaauuugugaucucaaaagauagaaggugguauugggccagucaugccagucacucauuggcuuagaacacuugcugugcaagcacgaggacuuaaguccaagcccuauguaaagccacaugcaaggccacaugaacaugugaugccagcauuguagacaguggagacaggaggauugcugggguuuuguuguuguuagccuaguuccagguuaagugaaagaccccaucucgaggcaguaagacagagauacccagugacuuacucuguacacgugcaugcgugagcacacugagugaacgagagcgggagaggguguagagacuucucuccaccagcagucagcagucaggacuaggugcguuuccucucauuuaguucaguuuugauagaucguuccaugaaaagaauuuguuuauagugaacuccaaaagagaaagucuggaaaaagauuaguauuuuaauauccauguuggauaagaggaauucuagcuucaauggcuuguguuagggaagaaauuaugaggcaggaaccacggacaagaaccacuucuugaggcuagcagauggugcagcaggugcuuggugccaaggcugauaaccugcguuuggucucaggaacccacacgguggaaaaaguacuacuccagcaacuuugaccuccacaccuacagugugguauguacaugcaugcagacagacauuuagaugacagacagacagacaaguaaauguaaagacagucuaacgccugucuaccuggaguuggaaucagauucaagaagggagcuuacgucccuggucugucuccuuccaagugcuggcauuaaaggugugugucaccucaccacacucuggauguucagaaguuuacagaacccagcaaaacacuugcguguauuuauuuacuaccuuauaaaggcuauuuuaagaauguaaauaaucagccagucguggugccucacgccuuuaaucccagcacucgggaggcagaggcagguggauuucuaagaggacagccaggacuauacagagaaacccugucuugaaaaaaaaacaacaacaacaacaaaaaaccaaaaaaguaaauaaucaggugaagagaagcugagggcaagcccggaagugucucagauauacuguagcauggauuuggagugcaccacugucuuggcauguaaacaaggguuuuacucagcugucacaugguucacaguacauagccugcaguacacuauccuggugggcuucuguggagauuuuauugcacaggugugaucaaaauaagaacuggcacgcuaaaaugcaguuggauaccaggaacuuaauacuuagcauuuucuuggcauuccuuccucucaggcauagggcaggaaccuucugaaaugaggccugaacugaaucaggggguagagcaaggaacuuaugcucaauugugauagggaaacuggggaggauuaugcucuaccuugagaaagaggaacucuaguaucuguggccuaacuuggggagaaagguauaaggcaggagccaugaacaaaaacauagauauaaaauaccacgggaggagaguaggagaacuccucuuaaucugaccaaauagggcuaaauucuggaugugugcuugggugugaguucagucuugcucugggauucagugaugcagaauuuugugcuuauaagacaugguucuuaggugguguuagugccuucucccucgguggugucuuccacuacaugagaaucccaagacacuucauuuuccuguuuguaucacaucaguucagagaguacucugaagccugcuaguccuggaggguccccuccaugugcuugguucagagugagccacuggcuguaaacacuuaccccacuugugaacagaaacaccuccucccucagucaggcuagagaccacaaaauucuaguuuuucauuuaugauaaaaaaaaacuguauacuagagagaagcagaggaaaaaacuggcccuguucuguacuacuggaaccugccuuaaaggguaccucucugucugcacauuagaauaauugggggccuuuaagcugccuuuucccccuucagacuuguaggucacggcaagcuuagcagucuuugaagaguuaaaaaucuuaaggauuuccaauagaguucagcucuggagucucuauuccauaagucugcccugccucccccaccccaccccuuccuggggccuugcuucauauccacuuuggaugauguccucaguguuuuugugcuucugugaggaucauaguugaagauuuuauaagucuuaaagcucaaguacauaaaaauggcucagaacucucugaaacccucugacaacucccugugacaggagcauguggaugagcuaagagucuggggugagaaaagcacauuggaugugugcuuuuuuuuuuuuuaagaugaggucucggguucccaagcuggaauagaacuugcucuguagcccagguuggcaucgaacuccugaguuuuccuguuucuaucucccaaguucugggauuacaaagaugugccaccugacccuguaaguuuuauuuauuuuaauaagaaaaauuauaaaccucuaaguagauuuuacacucuguguguguguguguaucauccugccuggccugaaacguaagguuuuccaacuguugguuaaugcagcccucugcuaccaugguuaccuuccuccuaaauccccucccaucaaacucagggccucuaguaagcagggcaaguacucuaccauuuagcuacaucccaucucugauacucugaauuucaaauaaugugacauaaagauauuuacaaguuaaaaaggugucaguuguuagauguuugaaacuguagaaaaaguaguuugaacaaccaccuuugauguacacacaggucugauacaaguuuagacaacacacaaauccuagcaucucauuuuuauuguaauacaagcuuuauaaacccugacuggauaaccuuaagcuggaugcugaagucaccucaucuucuaggcagauaugaugauaucaccuaagauuaagaauuaagcugugcguagaggaacauaccuauauuguaaggucucuguguaagcaagccagcaugaucuuucugucucugggcuuuuauuugugagccggcacaccugcuaucucucuccuuccugucugucuccaugccuuccacuucccccaccuccccgaccccucaccuaggcugggcagaggacccacugccucauccucuucaauaacuaggacuacaggcuuuucauuaaaaauguaaauaauguuaguuauggguuauauuccaugauuauauucaugaugucuggacugggguacauuuuccaugugugcaagguuauguuuccuugaggacauuuccuguccuccacagccaugguuugcucuugcuuucugcuguagcgcaggaaaggcaucccacagucuccuggcaggaggacacuugaggcuuuuccaagauugccguaaagaaggcacauagguuuagguaccaagguagaaaugaguguauguuacaaaaugacagaguugagaugaguggauaggccuagacagugagcuccaucauuguccuccucugagauacauggcuuaauuagaaaccagucauccaggcuggcgagauggcucgacugguaagagcacugacugcucuuccgaagguccugaguucaaaucccagcaaccacaugguggcucacaaccguaaugagaucugacgcccucuucuggugugucugaagacagcuacaguguacuuacauacaauaauaaauaaaaucuuuaaaaaaaaaaaaaaacaaaaaaccagccauccugaagugcuaacuucaguguggcaccugucauuucaggcuuugcauucugugcuugucauuuccuucgugcucaguuuggcauggagaagggaggguugacaucuuguuuucugaccaagccugcucagucagucaaaugguucuccaguggaggagugaagacuaaaaagaaaaagacaauuagacaacauuguagcaagacccaagucaauccugagacugaaggcagguuuaauuuuucccaauccauuuuuaugccauuuuaauuacaugcaguacagugaggaacuagcaaggcaguaagcaaagucccgugauuacuccugugacaguuguuuccaaggacuugucagaaugaccaaaauaccugaggccacuuccuuguccaagcccaaaaucuugcuugaagccuacuuaauacuaugauuaaaauuccugccugagccuauuucccuguucuagucuaaaguuagauuccugcucgagcuuaacuuccucggagugucccuccuaaaggcucuccacagcacucaucguguguccucaauuuucccuuucaaguauuguacccgaacuaaauuccuucuuaaaauugccaucaucagugacuucuguuauguauuucacgguaacuucucacauggacauaaugacuauuuuccuaaucugagacuucaauauaauuaaagaauucagauuaacauuuuguaaacaaauauaaggaaaauaugaaaguucucaaacauacuauaccuuuaguguuuguaaauucuuuuuuuguuuguuuguuuugguuugggguuuuuuuuuuuuccuuugguuuuucgaaacgguuucucuguauaacccuggcuguccuggaacucacuuuguagaccaggcuggccucgaacacagaaauccgccugccucugccucccgagugcugggauuaaaggcgugcaccaccacguccggcuguaaauucuuaauaguauuaggauacgagcuuacauuuaguuaaaagucaguuuuaaguccaaaacucuguuggccuuugagcugcuuaaaugaaugugcauuugcucuguggccucagaugcagggugucaguguuccugugcauccuucugaccuucuugcugcacugagaagagugagcugggaacucaguguaaacccuguuugucuagcauuuuuuuugagcugcagucauucuuauugcucagauuggucucaaaaccaugugcucaaacgacccuccuccuucagccuuucaaguagcuggaacuacacauguuugccacaccaccugguucuagaauugcuuuuuaaucaccauuuuggugauuuguuuauuuaucguuuaucguugccuucuguguagccucagauagcugaguaguacccaguaagcuuccuuaggugaccacaggccggccggucuccugaagcuguauucaaagggcauucaagccccuagguguugagcagggauuccuugugugugccugagaacugguacgucugucacccuacccccaugugcauccuuaucuuuuagaaguaacacagcugugucccuaacagcuugucuauaccagugacacauccacacucuaaauuaaauguaagugcugagaagacugcagaguccucagauaugcugggagagagacaguugugcuuucuauaaugacaacacaguagugcucuuucacucuuugguuuguuuucaaagugaaaaaaagaaauaaaaguaucugcauacccaauacccagauggcaagcacucucucauaugguauuccguuuuuguuuuuuuuuuuuuuaacaagaaugaauaauuucaguucccuuugaagccuuccccugugucugagcuuugcaggaucagguuguugaccuggucugucuugacucuaaauggaaaaucgucacccucaccuuaagcagcacauuguugcuuuugugcagagcuugggugcucaggucuuagaugcuugccccuaggagaagaaggcaggacuuugccugguguuugcacaguguaggugucuuaauaagacugccugcucacugggaucuguucagucuguuugaaccucugcuugagaggaagugccuggcugccuucaugugcacacucuggaccacgguucugggugaagaguuuuauauaucugggaaaagugguugagcuucacuaguggccaggaaaguuggguagaagugccugaaagcuuacagguaggaggcagcguaaggugugcauagcuguguguuguuaagggucauugguguugaguucuucuguuccagcucugccaucuuguacaggaagacuacacauccucuuacucucuacaguccacugcucccuggacccaguucugaaagguggccacuucacacaucagcucuuuucccuuucuuuuccucuggcuuucaccacauaguggucuagaaaugcauaacugucaguggccucuugagguuagauuagagcagggggaucaaauggugcugccugguggcuuucccgugucaggggaguggccuuccuguccuuugauuuaccguauccagcucuucuaugaacaaguccuacauuuaccaaaaccggucacagcaguugaaccccugaucacaaaacccauccuuguaucuguguguguguguguguguguguguguguguguguguguguguguccuuccauuugucccuccaucccucuguugguguuacaguaucuguguugcuuauuucuguggugaugguauagaauuuugguguugagguuuuaaacuaacucucaccugucuuuuuccuucugcacucccccaugcuaccccacucugccucucagaucuugcaguuuucaaggaacgacuucgaaugcuaacaguaggagguaugaaaauaaugagccuuugaccuuucuggaguugaggacuucauuugauuaguaugugcaacuuuuccuagcaugugauuuugggaaaguugacacagcaucuaucaguguuuuacaauuuuuuaaauuguuuuaaaauauuuuuccuuucacuuaguuauuaaccaacaaguagagcugugaccugguauaggcucguuucugcucauuuuguguucugacaagcauuucaucguauccaugcuucacagucgaugugcuauaagcuuccucugcagcguuauccccuuagcuccugugggagccugaggccacauuagcucugcaugguggcguguccucuccucugugugguugguuuugcuagacucuggcuuccuucagauucugcuuccggggcauucugaacaaggucucuaaacuguucucuuauugaaagacaaccagaguacuaagcuuucugggggugcuuuuugacccuuguuucugggaagaaugcccuugaggaauccagaguugaggugcuggggccaucugccugcuauguucucuuccuacgccucuuugauuugaccaguuucuuucucugcaggcuucucuuaagacauuuuucuuuuccuuugucuuaaucauaauaccuaugaaauuuuaaauuucacauuuugagacaaaugaagacucgugcagcuguaagaauugcuggguuucauaaccuuuaguaguuauccccugaaguuugacuauagcacacaucacaccagggucaagccaaacccugccacaaaguuuaaucccuggaaacuacucuugucuucuccauuucuguaauguuuucauuuuauggaugcuauaaaaauggcaguucaguauuaacauuuugauguugguuauguagagacaccccuagguuguuaguguuuugguggugaauaguaucacaugauauggaaaugcaguuguuuuaaaggauucacacggugaagacuacugagcaaaaagauuucauuuuugugauauacacuguauuaaacuuuucauccugugugcuuuuguuguccauuuuaacuuuucccuuagcuuuggaucccagagaucuccccuuauauacuuugauuggcucaguggacugcaccuauaauccuaccauuugggaaacaaggcaggaguguugcuuguuugagaccagccugagcuauaacugucuuaaaauuuuaagucuaggaucuauuuugaaugugauaagaucaaugucuaaaucaagauguacuuaaauacuuauuuuugcccauagucucuaguuguuuuggcauuguuagcuagaaagucucuccuugaguuuugcacuuuucucaaaaauaaguaggaucugucuggugaguuaagguacuugcagccaagccugacaaacccgaguuucauucuugggacucacaugguggaaggggagagccuuugacuccacaugcaugccuuggaacauguaugucucacauauacagauaccaacgcauaauacaguucacaaagaaaaucuuuaggucuucucuguguggaacuacuuuggauuuucagauuuuuuuuuuuuuaguuguucauauccucccaccaauuucacauuuagauuauugugacuauaaagcuuuauuuuuaccauuaucauggcaguuuuagagucuuuuauuuagaauaaauguuucugucuacaugcagcauucuuuuguuaggaauaagguaaacuuacagggaaauugaaaaguguuccuccaugguuuuaugcuaagcuaaaauaccuagagauuugaugauguuccuuuugaucuuuuugguauccugcgggucuuuagugacaucaggcuucauucgcacccuguuaguuguguugauguuguuuacaaagggcaugucuguguacagaucuuagaggagcaguccuuuguuucucugggguuucacuguuuugagcucuucaaccacauugauuucugcucuuuuaguuuuuaugugucuguugguuuuuguuuguuuuucccuuuuaguccugaggccaggguuagaaacagauuguugauuaaagccuuuuuguuuguuuguuuucagauguauauauuuuucuuuuuuuaaguuucuaucuugguacuccuuuagauuucccaaaagcuuugauaacuucagugccuuccccuacccuauaucaguguuuuguuuuauuuugaauaccuuugguuuauuuagaaguguuuauuguuuaauauuuaaguguuaaugguuucuaauuugauucuguuaugaucucaguccuucuacauauuuuguuaguguuaauggccuauucugucaucuguguugauguguggccuacaguccuuugaaaaggauguugcuuguuguuagguggaaugcuguguaaacaucaguuaggucuuguuugaagcuuguuuuccuagaucuauaacaauuuucuguuuuuuuuuuuaagauuuauuuauuauuauacauaaguucacuguagcugacuucagacgcaccagaagagggcgucagaucucauuacgggugguugugagccaccaugugguugcugggauuugagcucaggaccuucaguagagcagucagugcucuuaccugcugagccaucucuccagcucccaauuuucugauuuuuaaaaaauacucuuaaaagagaggguuuugaaaucuuccaauuaccuauauagauuuuuccauuucuccuuugaguuucuuauuaauuuuugguucagauaguuuguagcuuuuuuuuuccuugagacauugucucacuguauagcccaguuggcuuugaacaguuggcuauucaacuguugguuacccuaggcuaaccucuaaacuuguagcaaucuuccugucuuguccucaguguugggaauacaagcuuuuaauaugucagauuuauacaaaaucugcugcuugugcauuuagaauugcugucuucucaguaucuguauugauucuucugucauaauguaccuuuuuguacuucuaguaauguuuacucugaagucuacuuuaucugauacuauaugcccuacuuuguauuagcuugauauugcagaacauauuuucuaguauuuuccaucuauucaugucacaguauuacaaguaaauuucuuauaaaugaucaugugcuuagguccuaguuuuuuuguuuuuuguuuuuaaagauuuauuuauuuauuauauguaaguacacuguagcugucuucagacacaccagaagagggcaucagaucuugcuacggaugguugugagccaccgugugguugcugggauuugaacucuggaccuuuggaagagcagucgggugcucuuacccacugagccaucucaccagccccagguccuaguuuuucuguggaguguuuguuuuguuaguucuuaaaaaucuauucuaccaauucuuuuuauuuaauguuaucuauauuuagugugguuacugauauauuaagaguguaaguguaguauuuuauacuuuccuguuuuuuguauuccuaguuuuguuauagaguuguuagugucagccagggccuuggaggccauaacaagcuagguucagcuacucauccuuaaaaaggccaauuaaagaaagaaagcaauggugagaaacagcaaaagaagauuuauucaauguggucacauuggaaauaggagugaagugacccuccugagagcaucucugggauccuaacauaaagucuaggugcaaguaggugggcaagagcucugcagaguccagaagccuggccaagcggcuccagccaucaucauuucagggcugcucucugacagugaccacuaugacacuaggcuucagccuuuuccuuugcccgggaagaaacuccuggggaaauuccaauuuauuuuguauaagccaaagggaggauuauaguaucacuuauagaauaucuuuauuccugcaaaacaguuaaaggaauguuggcuuuagggcuggagagauggcucagcaguuaagagcacugacuguucuuccaaagguccugaguucgauucccagcaaccacaugguggcucacaaccaucuguaaugagaucugacucccucuucuggagugucugaagacagcuacaguguauuuauauauaauaaauaaacaaaucuuuuaaaaaaagagaaaagaauguugacuuuaacuuucugaucaacugugaauuuuuagaaaaauguaucaaugaggggcaggagaggggcauaugagaugugaagaucugaggacaacuuauggacugcguucuccccuuccaccuuuacgugcauuccaagaguuaagcccagauugucagucuuguguggcaaguaccuuuacccacugaaccagccccuggauuuuuaaacucuuauuuuaaaaccccaucuuuaugacauucauaaagcuauaucuaucguauagcucuuguaguuguuguauguauuacacaguguagacuaacuuaccaucuacuuaugucauuauaccucaggucagcaggagugaaaaacuugccuccuuucaucuccauguauaauguaucugucuuaaauacguuuccuacauccaugugaaauggagccccggcagacacuguugaagacauuugccucauccgugaacuggagcgucuguuacuucugccccugucucgugugcuugcuuucugugugagguugcuucuuuuucucgucuccuucugucugaagaauucauucccuuugcccguuccuuuagaaccauccuuugugcuauuagcugguucucguggggguggagggacagaguguuuuguuuuucuuaccugagaaucucuuaauuuucccuuguuuuguuuguaggauucuaaguagacagauaugauuucuuucagcuauggaggaacauaccacuuuuuucuagcuuuuaggauuugugaugagaaaaucucuaaaucucuuuuuguuuuguuuuauauuguuuuucucuguaaguggagacucuccuuuguuuuaaguuuucucaaguuauacauuuuggcaucagugccuuuuccuauggauucaaucaacuuucugaaucugggaguuaaacucuucugauguauuuaaggaaguuuucagcuguuuucuaaguacucuuucagauacucgcuuucagaaauuugccccacaagaauggaaaaucuuuaauuacauuagcacauauccucagugcuuuuuaauguuagcuuucauccaucuguuuuuccaucuucagauucacuaagucucuuuaccugugacacuaaaccugucuagugaauuuauuugugggguuuuaauuuccuuuuuuaaaaauguauuuacuaauuuuucuguguguguacaugugcaggcacacgugcuauagugcaucuguggaggucagaggacacuuuguaggagucggcuuucuccugccaucuggggacaaggucucccaucauaagguuuuuguggcaggcacuuuuaccuauugagccaucucacuggccacuguuuuaauauguuuuuauguuuuuaguuuuugcuaaggauuucaauuugucacuguuuuuauaauuacucauugagaugguuuugugauagcuuuauuuaacucuuagauaauucuaacaucuguuucugggaugaguguggcuauugcuucucacucauucugaaauucuugcuuugguuuuacuuuuaguuuuuguuuuggguuuuguuuuguuuuguuuuguuugagacaagaucuugucacauagaccaggcuugugucauacucacacagauccuccuauuugccuccaaauguagaauuaaaagcaugcaccaccacuucugccaaaauauuucugcuucauuucauuucuuuccuuuuauuuguuaugcuagagauuuuaugccuaccuuuuaaaauuccauuucuuuuuuuuucuuucuuucuuuuuaaagauuauuucuuuuuuuucuuucuuuuuaaagauuuguuuauuuauuuuauguuuaugagcacacacuguuguagcuauacagaugguugugagccuucaugugguuguugggaauuuaauuuaggaccucugcucacuccagucaaccccgcuugcucuggucaguccagaucccucagucccugcuggcucuggcccuaagauuuauuuauuauuauaaauaaguacacuguagcuguuuucagacacgccagaagacagugucagacguuguuacagaugguugugagccaccaugugguagugggauuugaacucaggaccuucggaagagcagucagugcucuuacccgcugagccaucucuccagccccuguuucuauuuuuauacaauagguuaaucaugaugauugcuguuuguauuuuuucagcuuuuucauguagcccaggcugaccucaaauucacuauguaccugaggcugaccuugaccccucauaccucccaaguucuggaauccacugccuggccaaucgcccagcucuuuuaguguguagggggauguagccaucggaagaccaauugaaggcguccauucucgucucccaccucaugggaccagggaaucaacucauucaucuggcuugguggcaagcgccuuuuacccacggagccaucuuacuagcucuguuguguguuuugaauuuuuuuuuuuaauagaaacagagacguuuugguauugugaauucuggaaucuuauuugguuugucauaacagaccuucucuggacacuucugucaggagcacuaccuuguuccuguuuuaccccagagagguuuuagacucauucuugggucuucccuaaagccucgauguggauacucagacuuguaacaaguuagugagagacagugggacagcgugcagcaggaauugucucaaguuuucuggucuugugaagcugcccccuccugaucuuuaccuagagcaguauuuguggggcuuuguugucuauacuuccuaagguuucucugcugcucauucucuacucucugucugggauaugggaguggaagagaacccaggacuuccuuguaucucugccuuucuucacccuuucaacaggauuaccuuuuuuauuuauuuuuuuaagcaaagucuaaaguuuguaguuagaauuaguaaagaaaaagaaagaaaagcaugugugugggguucauuucucaagugacugaagauguagaaauggguccaacacuucugaugcugaucaaugagacccaagggcugugaauuacaaucaaguguuauaccuauaggagcaucagagaguguaugccuccuucaugcuguugguguagcaacacaguucucaucugcaugugaauacgugacuggccaacaucaaucacaaccugaauauuuucuaugcugaagaguguacuguuuugacacauugauccggaaauuuccgauauuuugucuuguuuuacuuggugguuguugcugguuugucugagaugcagucuuccugaaaccaccacugaucuugaauuucugaucaucuugcuuucaccuccaacguguugggauuacaauaaccaugccuagccugggcugaguuuuguaaaccuaagaaguuucuuaaaaaucauuaacuauauuaaacuaagcauagugguacauaccuguaaucaaagcauuuaggaggcugcuacuuacuggaucaaagcuagcuuagucuggauaacaugagccugucuuaaaaaacacaacuacagaaaauauuuuaguuuuuucccauaaauaccauggagcuauugcuuacaagcugggucauaagaggcaggagcguugugcuucccagaugccuguaacugcuguauuuaugauacaguaacaggaaacaagugagagagccuaaguaaaccgcuuucaccacggcuuccuucaggcuuguggggcuuuuuucuuugggguggguaguuugaguuggguuuuuuuuuuuuuuguuuuguuuugguuuugguuuuuuuugguuugguuugguuugguuugguuuuuuuguuuuuuuguuuuuuccuuuuaauuuaaugaaauuaaaggggcuugaaaaaauauaccuugcuuuuuaagacuuaaggauguaauaccccagccaggcauggugguguaugucuuuaaucccagcacucaggaggcagaaguaggcuuaucucuguuuugcggacagcuagggcuaugcacaaagacccugucucaaaaagagagagagagagagagagagagagagagagaggagagagagaauaagaauguaauuucccaaccuaguuugaaugagagucaugaagauauuccugggccacugauguugaagacugacaugacaaccagacauguuaguguacacuguuaauuccacuacagaggcagaaagcuuaccuaacguucaaagccauccuggucuacauagcaagggaaauucaaagcuaaauaacaacugucagguacaaaacaaaaaagccacccuggagacucauguccaugcuuguguuugcaggcuucuugccuuauuucgguucccugauucgugggucucacagcagcgcuuagguacuuaacgcaggcagaaacaacgagacuguuuaucuagggcucagcauguugucugcugguucaguguucaguucuggagccugagaaaguuuuggcagcagguauucaggugcuggugacguacacugugcucuuugcccuuccugaauugauguguuauuuuagaauaagcgccagacuggaaaccaaguaauggugucauuucauaguuugcuccuuuacugauuucaagaugaaauaagcaugaugcugaagaacagagccuccuacuguccuuuccaguuugaaacagcuuucagaugaagaggcaucuccccugcagugacugcuugaggauaggagaguggauagggaaagugaggguuggaucuguaauagcacugcagaguaccauagaauagcuagcaauuugggaaaauauuccagggagaugcuugcccuuaguccaaggcugaaagcugucaaccuuuccucugcuacccuaguuguauccugaagaacagucucccaccagcugcuuggguccuggugacuauuucucccucccagugcagaccccagcuuugucacucacuguguaauauguaugcacauuacuguuaaaugauucauguauauggucugcuauucucuaucaguucccauuuucuacuauaauucucuuaacuuuuuauuuaccuuuugauugauuucuuuugacucuuuccaccugcccaaauuggcuuuuaucuuugaacuuucaaauaaauuuaacucuaaauuauaaauaauugccaaacauuagacuaauaugcgcauaauagcuuuauuuuaguuuaccuaguaauaaucuuaguguguaauuauuguuaagguuucugauucugaugguaaauauugcuuguuuucauauacaucagggguaugugauauuuuucuuucuuccuuuuuuuuuuuuuuuuuuucuccuuggggcaucuuggauuucuuuucccuuccuauaaacugugaccccugcauggcuaugccuugucccucaucgucuguaggguucuauggccuacacgagucugaccuugacaaggucuuccacuuacccaccaccacuuucaucgggggacaggagccagcacuuccucuucgggagaucauccgucggcuggagguaagaacaguucuuggaaaaaucuaacagaugucauaccuggcuauuuguuuggcuuugguccuguggguuuuuuuguuuguuuuuuuuuuuuguuuuguuuuuaaacucuuuuuauuuauuuauuauauguuaaguacacuuuagcugucuucagacacaccagaagagggcgccagaucucauuacagaugguugugagccaccaugugguugcugguauuugaacuccggaccuucggaagagcagucgggugcucuuacccacugagccaucucuccagcccgguccugugguuuuaagaaacugaaagauaaccaauuucuuuuuucuguuuuauagcuagaaacuuuuaaaaaauuuuuuugaaacuuacuuuuuuauuaaaaacuuuuuuaaaaaaauacuuuuggaucccuuuagauuuuauuucaggugcaguugucacccuggaaauuuuccucuacuuuauagagccuggagcuauugauugcacuacacagugguggcugcuccuguccuaccccuuccuuuccuuucucccauucuuguuuuacuuuuccuuccuuccugaccuguuuauauauccuacaaacagcagcugagagccuggcuuugugucgggccgcuugugcggugccugucugccucucucagacagguuauugccacuguucgguauauaaggguaacugaggugccuauuucagaagggaauggauuugguccauuauucgauguugcugcuaugguauucagauuucaugaacccaguuugaaacagucacagucagggaucucugaggggcuccugcccugguuggacguuagagccuaggucaccucagucagggccuuuccaucccccagugguuaauguuuguuccagugagcucaucuuuugcacguuccaagucuacacuuagcacaagaaaauauuugaaugucagaagggacgcucuguauccauccaaagcaccucagcuaggagcugccuugcuuccucaccgauggcccuucucaggagagcacgaaguagaacaugccuguaucaguaggaguggugaacuuagacuuguuaaggaucaauccaaugugaguuaacuuugggucucaccuguguguuauugucaccacauugaguaugcugucuaagccugccuucuucaucggagccaccuauuaacuauuauuagcacuggaagcuggauggugauagcgcacaccuuuaguucuagcacucaggaagcagagguaggcagaacucuugaguuugaggccaaccuagccuagagaacuugaaaugggcaaaaugccugaauaacuuucaacugucgaaaugauauguuuaauauauuggcucaaauaaaauaggaaaauuuaucucaucuauuuuuacuuggaaaauugagcuuacugaagauguauuugcuaaguucuguuuaauuguaucacaacuuaacacaugcacacaucacauguaaguucagcagcgccaccaguaugauaaugagagacuuaugugcauuccuuauuucgaguugggauuauuccguggacaacaguuauagcuuaggcuuucuggggucucguguauuucuucuggcucuuguugacauggauguuaucucauccagaccacacagauaaugccccauauaagucaggucucccauaagaagccaugucccaagugacuuggcuuuucuguaugucccaaccuucaucuuucuuacuuauuuauuucuuaauaaaauaaagaaauaucucuuguuuauuucccauaaaauuuuaaguccugaauauccuugugugaaggggugagcagccuguagcaugcucaagggcuaccucccuuuuucucucuguuuaucacaucugguagcucuugaaaaaauuagagguagcgcuucucaacccccagaaacuaguuucauuagagcaggaagcuaagaguuuccaaaacuuacacaacuucccaaaagaaauugaguucuccugaaaacugaaccaaggaucaaggggacaaaaacacuaucuacuguccagaucuccaacuguaucucugaauuaauggcuaaguaaugcugacaaguuagggagaauguugucuggauggagucuuuaacucaguaguguucucugagcuuuuaguuguucaguaauggaagcucugccucauggacuuaagggcauaaaggauggaccugggcucagcucaguaguuaccaagggaagucuuccguccucagcacugccaucagcaggccacacagggcaaugagaggcagauccgggccucugugacagacaccuggugcuaauggcuucuccauuauacagaagcacaccuuacucugcuggucacgugcgaaaccugagacaugacaauagacucaaagcuuaaguuauggauggcuuaaucuaaguuagaaguucuugggaggcaaaggcacaaagaucucucagcuugaggccagccuggcaaagugucaagucuacauaagugagacccugucucaaaaauccaaaaggaaaaggaaaugucauguagaucgguuaaaaccccuuuaauuucagaagucuucccagcaguauaauuuuucccuuggcuacaaaagcuguaguauauugugaacagaaguuuaggcaaagaacaggcaccugaccauaaauucaacaagccuuuaacuaccaaugccaggugggcccauuuguguaaaccagauggagccccugggcuuguguucggcuucuggcucccugaagacggacggcugagguugugggucugugaugucacagcauuggacacccugcuguugccuuugcuagcucacggcugcuccuggcuugcuuucacaccuauggucugggccuccaaaauagcaguauaggugguaaaggcucagcaaggaccgugagucugugcaagaauacuggaguuaggcguccugagggggauuuacaagaucccucuaguuuuauaggcuguuucucuucucuucuuaacuuucuaucccuaagagccagcucuguugcuguucuccaccuuugcauaaaugacugcuaccuccuuucacaggugugauucaaguagacuuguuaggucuauucaagaccugugcuuuuauuuacccaggcacagugucgcaugccauuguuguuauuauuauuauuauugugguggugguacuggugguggugcugguggugguacugguggugcuggucgugaauaccuuuaauccaagcauuugguaggcagagguaggugaaucucuugaguucaaagccaaguuggucuacauagugaguuugaagucuuuaagcagcucacuagcuuuucucucaugccugguggacaugcuguaaaggcagacuaccuuucuuagaaaaggauccaguccaaaagcuggcauggucuuugcuacuucccaugaagauaaugaacuuguuguuuauuagccuggcccugaccccucagguucucaguguaccauaacccagauccuaagaaaguauuacauagcucuguuagaagaccucagaagauaagugucgccuauuccggaacuagggagaggcugaugcaggaggauugcaacuugauuucugccuucuguuguagcaccucgggugggaaaaggaaguuugcuucucccuggccugaauaaaagggcagugguaucuucauacaaugcggcugggucaaacauacccuugcugguauagaggguggcacacuuggggugcaguucauguuuaccagugugaugguuuguauagccagccccaaguaaauguuguuuuuacaagacuugccuuggucauggugucuguucacagcaguaaaauccuaacuaagacaaccagugacucuugugucucuguacauauguggacagauggccuacugccagcacauugguguggaguucauguucauuaaugauuuggaacaaugccaguggauccgacagaaguuugagaccccuggaaucaugcaguucaccaaugaggagaagcggaccuugcuggccaggcuuguacgauccaccagguaaagaggugugguuuggagggcgcuggagagauggcucagcuuugacuacucugccagagguccugaguucaauucccagcaaucacaugguggcucacaaccaccuguaauggaaccugaugaccucuucuaauguacucauauaaauaaaaaguaaauaaaucuuauuuuuaaaaaaaaaggaggugugguuugggccauaggcucccaggccguuuaagggguguauagccuguccuccaggcaugaaaauggcuaaagccacaaguauguguuaaguuuggccaggagaauagaguuggcccuccauuguacgcucuugucgucugagaaugcuacauugaggcugguccuauggacacugcucuucaaguugcuugguucuccacccagguuugaggaguuccuacagcgaaagugguccucggagaagcguuuuggucuggaaggcugugaggugcugaucccugcccucaagacaaucauugauaugucaagugcaaauggaguggacuaugugaucauggggaugccacacagguacucuaggcccucgggagauucgagagugccugaguguauuaagaugagccguuuucuaaggucuuuacacucccacgucagcaugacuacagagucggucucaaagccaaauaugcuuagacuuguauuucauucuauagggacuuuuguuagaauuaaauccaaauggacaugguaguguuugccuauagucacgguucuugagaggcuagggcaggaaaaucacaaaacugaagucuaucuugggcuacaauaaguucuaaacuagcuuuugcuacauaauggaagugugucucauaaguaaaccaaccccagugccauugcuaccucacuuguagcaaugacuguuggcggagauuuuggagaugcagggagcagcguuaguaguuugguacuuucugccuuucucuugucuguggccuguggcucaguaugcccaguggccagagaguugguguccguauuagcuuugaaucacaacuauucuugggcuacaaaccaaggagcuucuauguccuggguagggguaggguggagcagcuuugcccuggaguuuacucacuguucccugugucccagaggacggcugaacgugcuugcaaaugucaucaggaaggagcuggagcaaauauucugucaguuugacucaaagcuggaggcagcugaugaggugagguucuguauggagauauguccacuacaguugucucagccugcuugagaccccccugaagccacggguuucucagaauacugucuuaacugaagcucugcucuuacacaccauucacaguuugccuuccuuauuagaacuggcuaaccuccucuacccugcagccuuauauuccuccugcuggggcaaggauauuccuucugcccaaguagcucuauauuggugccugggagguauaauauuggggagauccucccuguccuccugcaguuagguccuaggagucaaaaucccauguguagaauugccauugagagugaaccucuccaaccaacaccacuugucuuuuuaauuuuuuaaaacuuuuuuuuucaccccuugcaguacuggaacuaacucuuuagaccaggcuggccucaaacuuaaagauccaccugucucugccuuucaagcgcugggacuaaaggugugucuaccacugccugccaucucuugucauuuuuaucaucaggguucuggggacaugaaguaccaccugggcauguaucaccgcaggaucaaccgugugaccgacagaaacaucacuuuguccuugguggcuaacccuucccaucuagaggcugcugacccugucgugaugggaaagaccaaagcugaacaguucuacuguggagacacugaagggaaaaaggugaggccccuaagaggucugugaguacagcugucaucacacuuccuuccuacacuuacaaucaccaagucugggguaucgauguaggagccaguuuuagcuguggacagaaaaagggacugcaaggaaaaggugugggaugcagacagcaggagagacuugucacuggugaggccaaaagugcauagcagacagcuccacacugccauggcauuuccuuucugugauagagaaugcuggauauuggcuggcuggcuugcucaaauauaaaaaacccuuaucugacuguaaucuuaguauuauuuaaccucaggauauaauucuuaguuguagcaaauuuuauauuuguauaguaaguuguauaguucuuaguaauagugauguaaaaaugaaauaagaaaaauucaguguacauggugauuuguacauugguugauaaauuuaaaagacauuguuaaccuucuuucagggagcuuuauucuguuggaagaaaaaggaguaaauaaaaggagggaaaugacaggaagucagugaagauguugucggugaagcugaacugcauaaugaagcaugcagcacuuuggaauaagcagccauagaugcagaguaguuagaugaggagugaggcagucagacauuucagggcuggagagauggcucugugguuaggaauacuugauacuccucagcucgggucccagcacugacgucagacaucucucugccugccugcagcuccagcuucagggaaccucacgcccucuggccucagcacauggugucuguucacagcaguaaaacccuaacuaauacaaugaccaaggcaagucuuauaaaggacagcauuuaauugaggcuggcuuacagguucagagguucaguacauuaucaucaaagcaggaacguggcaccaucaaggcaagcaugguguaggaggagcugagaguucuccaucuucaucuaaagacugacuuccaggcagcuaaaaugccaucuuaaaguccacacccacagugacacaccuacuccaacagagccacaccuucuaauagugccacuuccugggccaagcauauacaaaccaucacagucguccauuagcuguccaugacuaugaugguuuguauuuucuuggcccagggagaggcaccaucuggagguauggccuuguuggaauaggugugacuaguaggaacuagcugagaugugucaacauguugcugaggcuggaugaaggcuugagaaggaaucagauacauuuguucccaccaaauucacugcaauacucaucucuaagaagaugauuugaagggaaauuggcagacugugaccaggccaagcaacuagaccaggcugguauguuggaguagccaaagacaugacagcuaaagaaacccauuuccugggguagcuuugugucugggguuggaguugcuucuuggaauuauuuuguaggguguaggaggauucuuauagggugcagaaggggugacacaauagguguguggcuuucucuauguucagggcugcugcugucaacugguggcauauguggcugugguagcaagucaggggcuggaaaggaugggagcauucugagcuccugugacuuugugagcugugauuuacugagcaggauagugcaguagguaacggagcuuccuugauccccagaaccugcaugaguuuggaaaaagagaacccaacuccacgagguggucuuuugagcugaacacaugcacuguggugugcacccuuccucccauacauaucaugcacucaaacacaaacagaaaaaacacguagaaacucuucucagccucuuguuuucagacuuaacagucgagauguguuguuuugggucuuuugcaggugaugucuauccugcugcauggggaugcugcuuuugcuggccagggcaucguauaugagaccuuccaucucagcgacuugccguccuacacaacccauggcacuguucaugugguugucaacaaccagguaaccccaggggucugauauguccuccaggucauuuaaaaccuucacuguuucaugauuauauacaaaagugggguuuuauuguguuuggguaacaugugggauuaaagagcuggcucagcagcuaagaacauuggcuguucuuccagauguccuaaguucaauccccagcaccuacaugccugcuuacaaccuucuauaacuauaguccuaagaauaugauucccucuucuggugagcaugcagaacacccauacacacaaaauaaauaacuaaaaaaaauuuuuugaauaacauagccacuuuuuacaguggaaagguuuuaauuacauuauguaaggagggggcauuuuuguuuuagaguuuuucugucuagaggcacaguuuuagguaauugguuuucucuuuaagaaacuggaguccuauauauacaucuuacuauccacucuuuacuuaccacacuaguaaaaguagucauuauagauuauuugauacaacagacuucuaaucuuaggguuuuguguucuaguaaugcuucaauuaauaauauucuucuaguucuuacaguucaguucuuccugguguugauacuguuaucuauuagcuauuuuauccucccauugggucaucucacccaauacauguaacucugccugaccauauacauauauacauacauauacauacgugcaugugugugugaauauauggugucauguauguaugucgauauaaauagcacacauuaaacagagcaagggcuacugugcuccacuaacacagaacugaaauucauuaauucacuaauucagaacugagggguggagacucaaaacaccaagaaggauaaggaggccagagguugauagcaguuaauucucugcauacuagaugccuacauggaaacuugaagguugaguagacaaaaggcagcagugggacaggcagaaaggaagucuuccaucacagauguuuaauaugaaccugaacugccaucagccagugcccagagaaagcugcaggggaauagcuccagcugggaagcacuggccuguucacccaagcucaauccugaccucccauauaaaaagcuguaugugagggcuggagaauggcucagcaauuacugagcacugguugaucuuccagaggacccagauucaauuuccagcacccaccugcagcucacagcugucuguaaguccaguuccauggacuccaaaucuuuuggcuucugugggcacacacacuguguguguguguacaugcagacaaaguacucacacaugcaaauuaauuuuuuaaaaagguugcacaugauugcacacacuuauaauuccacagguggagacaugagggucucuagccuaauuggugaacuuaaggucaguggagaccucucucaaaccaaguggacagcaguccugaguauaacaccugaagugguccucugcccaccacaugcacaugaacacagcaaguccagaugcauugugagguugugggcgggacugaugagugacaaaggauaccacacaacauggcaaagcguccauugacugcguggugugauuagcaguguaucaaauucagcaccucacaugcauuaacuucaaaccccuaggguuguuaccuauacagugggguggaauuagcauuagcauuuuuuauuucguuugcuugcuuguucuuucuuucuuucuuucuuuuuuuuaaagcacagucucacuguguagcccaggcuggccaaggacucacucuguagaccaggcuggccaagaacuaacucuauagaccagacuggcauagaacucacaaagauacagcugccucuacuccccaguacuggaguuaaaggcaugugccaccacacacagccgugguauuaacauuuuccaaaagagaacauugagaaagagggacuaaguaguucgcuugagggaaaugauagaauuaguagguuuaaaaaaaaaaaggacaaagaagaaucuuaaaauaaauaaaaagcuccacuagugaacuuugucccuguuuaguauuaacaagcuuacuaucuuaaccauuucuaaugaacuguuugccuguauugaacacauccaugcuguguuucauucaucucuguuaacagacacuccacacccacaaacaacagcauuccggggcuugagagaggcuuaguggcuaaaaguccuugcugcccuuucagaggaccucagcugaguuuccagcacccguguugggcggcucauaauugucuggcuucaacuccuucuuuugguuucuauggguacccacacacauauuucagguacuugcagacagacagacagacacauuaaauaaauaucaaacaaaaauuaaacaaucagugccuauucucugucccuccccugcucccaguaaccaccauuuuacucucugacucauccuagguuugacuaauguccuauuaggaacauuccaacuuuuguucaguuaucaguuugcuguccaguugaguagccucuacauuuacugcuguaaauuacacugcugugaagcuggguguacaaaugcucugcagcaucuccccuucaguucuucuggcuguacacccaugaguggaauuacuuacagaauagucucauuuaaacuuuuguuuuguuuggauugguuuuuugugggcggcuuuuuucuguuugguugguugguugguuuuagcucucuguagacuagccugguacucauaagguagacuaggcuguccuaaaauauauaaagaucuucgcugccucgugggugcugggcaauuucagaguuucuguuuucacaaguauccauggauuuaacgguacuuagcagaguaugguggugcacaccuuuaaucccagcagggaggcagagacagguggaucucuugaguuugaggccagcuagaucuacauaaugaguuugaggccagccagaauuacauaaugagacccuguuucaaagaacaauuuaaaacaacaguuguaaucagggacuagggagauaguucauuuaguaacaugcugacauacaugugugaggaccugcauucagcauugggaagcagagacugaaguaucuaguuagccagccucgacaaauuagugaguuggagguucagugagagaagacaccugacguugauaugugcuugcacauccccaugggaacaagccgugcgcuuggacacugcacacagagcagaugggcuaagaaggaagggagaaaucuugguuugguuugguuugguuuuuuggguuuuuuuuguuuguuuguuuguuuguuuguuuguuuguuuuucgagacaagauuucucuguguagcccuggcuguccuggaacucacucuauagaccaggcugaccuugaacucagaaauccgccugccucugccuuccaagugcugggauuaaaggcgugugccaccacugccuagcgggagauaguucucuaaaguggguaggugugccaacaccuuuucuuacuggggaucagacucaggguuuuguacacacuagggaagcaugcuaccacuuccugcucucccauagcagaggaaaaggagacaugcacauuagugaagcaagacccuaaacuuaguguauacuuacguguauuuauauaaauaugccuccagaaaaacaaucaucuggaaaggaaaacaucaaaauguucauacuacaaccugccuagucccucuuccaaauucucuuuauuaaacauacaugaaucuuguuaucaaguagggaaacaagcaaaauuuaagcaaagaugccacuuagggcacacacucauaguacaccaacaggaaguauaagccaugcccaacagugccugccacccaucauacccuguugccagaucuuguguucuguaauuacagauuggcuucaccacagacccucggauggcccgcuccucucccuaccccacugauguggcccgaguggugaaugcccccauuuuccaugucaacucagaugacccugaagcugucauguauguaugcaagguggcagcugaguggagaaacaccuuccacaaggauguuguaguugaucugguaagugaugccaggguaagggugcccaagugagucucaggccugugcucucacucuugcuaagucacauggggcuuuauaaugucauacugacgguaggauccuucugguaccauaguguuuggagccaggcucuccuccaaauacuccucaguguguauuccaucugguccuaauuaagacugcuuuacaaaucaagaauuugauacccaggucauucucauuaugucucauuugauagagcaaauccaccaaguaaaaguagaaaacaagauuuuagcuguaguggaaguaaggcagggcgaguagugacagccuuguuguaucacacagaugaaaugucagauaaccacacccacagaccagucacucucucacaguccucucuugcuacucugacuagguguguuaucgacgaaauggccacaaugagauggacgaaccuauguuuacacagccacucauguacaagcagauccgcaagcagaagccuguacugcagaaguaugcagaauugcuagucucccagggugucgucaaucagccugaguacgagguguguccuggcaggccuuagguguucugucaagcaagagauuauuccaggccaguaaaaacaugugaagucuugacaacuacagcauuuuaacuucagugaggaucugggauaucaaaaugcuuuuuaaagaagguagauguaguagagguggagaaagguauucuagagaugagguucucucuguugacacuuuuggguugagagauguaugaacaagggcccauccagcuuaauaaagacccucugugaucugcacagagcauucuaccacacacagacuaccugaguagcaguucuagacccaugggaugguacccaggcccaaaauacacauaaagccaguucuuaggaaagaauguucagaauuuauacuaaacagaaucuccagccaugugauguagggaaugaggagcagaauuuacaggccuuuuagauguuaaagaggcuguguguguguuggagacuggcaauacagauguaguuugugugcaaaaauauggagggacuggaaggcuggggugcaguggccugcacaacaugaguauguacucagcuucauguacccacucuuccaggaggaaaucuccaaguaugauaagaucugugaggaagcauuuaccagauccaaagaugagaagaucuugcacaucaagcacuggcuggauucccccuggccugguaagcaagggaucguaucaucacaguagagagacuccuugugagguggaugcaaccgugaguccacuucccagagaaaguucucgcuccccucuuccguaccuauaacacauagugaauguucuauuucagcagagccucugucauccccaaggaagccaucuaggcuuuauuguauuccaccuuuuauuugcccaaggccaugugauacuguggugaaguuucuagaaaggcagagcuguuucucugaucugcucuauagaugccccuuccaaaguagauggcauauguuuguucuccuaggcuuuuucacccuggauggacagcccaggagcaugaccugccccuccacuggccuggaggaggaugucuuguuccacauuggaaagguggccagcucuguaccuguggagaacuuuacuauccauggagguaaccaagccugcacuugcauguggaaacguugaccuaggucagcaccucaugaagacuaucccuagccaugcccuuuagaaacucgccuguccauagccauggguguguugauagacucagcucccacuacaguuccuucacuuggaaagaagcagagaagcaacuaagggggcaucacuuugcgcuccuaacacugaguggcaaaggcugugcuugugucauuagagcacaggacguaagcuucccacaggagcucguccugcaguacugggaauaaugucuuuucugcagggcugagccggaucuugaagacccgcagagagcuugugacgaaccggacuguggacugggcccuggcagaguacauggcauuuggcucacugcugaaggaaggcauccaugugcggcugaguggccaggauguggagcggggcaccuucagguaaacucggaugugcauccuucagucugaaaaggaagggaagggcuucggaaucuguacuccagggaugggggggacccauuuccagaaaggacuguauuuucaaugcuagguugccucaccuuuccuguguuguugaggaugcuccguuucuaugcuggaagggcgcuacccugcagugucuggcagaaugccagcuugucacagugggucauacgguugucuucaaggcucacaugguuggcucagaugccuguauucuugcuuauuaaucuugucuuucugccucagccaucgccaccaugugcuccaugaucagaauguugacaaaagaaccugcauccccaugaaccaccuuuggccaaaucaggccccuuacacuguaugcaacagcucgcugucugaguacgguguccuggguaaggccaaccccaaccccaccucaggcuucugcauuccuucauggugguccugaacauggcuuucuucccuucugucucuugcaggcuuugagcugggcuuugccauggcuagcccuaaugcucugguucucugggaggcccaguuuggugacuucaacaacauggcacagugcaucauugaccaguucaucugcccaggacaggcaaagugggugcggcagaauggcauugugcuccugcugccucauggcauggaaggcauggugagaacuucccuuguccacaagaccugggaacagccuguccaggacccuauccuaacaaggccgaggguucucuugauucgucccacccauuuuagaugggaagacuagcuaacacuuugaaaggcaagaguggcccaucugcaugcacccugcauggccaucucugggcaaacaacacguagcugauacugucuuucaaguacucagcucccucugcccugcugcucugugcuuuguuagugggugggggaggacucaaauuucugacaucaaggaaaagaaauggcaagagcagcagaugucagcaugggaaaccugagagguaacuugugugucugguuucagggucccgagcauuccucugcccgcccagagcgguuucugcagaugugcaaugaugacccagauguccugccugugaguagagcggacccuggauguccugaggggucagaucucagcucacucuucucugccuuaggaauuagaguggguggacccguguggccccaugcccugugaucucacugaaauaggcuacuucauuuguuuccugcuguugcagaaagccagcaaaccucagccugaacucuuaggugacauugccauugcuuuaaggcagguuuguuuuguuuuguuuuguuuuguuuuuaagacuuauuuauuuauuaauuauauguaaguacacuguagcuguuuucagacacaccagaagagggcaucagaucucauuacacaugguugugagccaccacgugguugcugggauuugaacucaggaccuuuggaagagcagucaguaccaucuuuccagccgcguuaaggcagcuuuaaaagaacccaggagucaguuucuaaggaaauguagacuugacuguacgucuccuagaucccauguauccacugcuaaacgguagcccucaggagccaccacggauuaaauggggcucagacucagggaagcuguggauccuguucucacuguccucagugaguccuugaguguccugagagacauccugagaccucucugccucguguugccuccugucccaggcacaaugcucacaagugccauuggccucugcccauuuccucccaugcaauaggaccugcaggaagaaaacuuugacaucaaucagcucuaugacugcaacuggauuguugucaacuguuccaccccuggcaacuucuuccaugugcugcgacgacagaucuugcugcccuuccggaagccggucagugcuggggucuccagaaugaccagggugccagccuuccuguguuaacacacaggaaggccugcccugcugucuuuugcuuuagauugguugagugauaccuaaagggggaauacagaagagacguggucucagaagucaguuucuguugccauaaacgccagcgaacuaaacauucucacucccacugagcccucaugugcuggggagcacggaguguaagagagucagacaagguacaacugaguccucaugugcuggggagcacggaguguaagagagucagacaagguacaacugaguccucaugugcuggggagcacggaguguaagagagucagacaagguacaacugaguccucaugugcuggggagcacggaguguaagagagucagacaagguacaacugaguccucaugugcuggggagcacggaguguaagagagucaaacaagguacagucccuaagccggccgugguggcgcacaccauuaaucccagcacucaggaggcagaggcagguggauuucugaguucggggccagccuggucuacagagugaguuccaggacagccaaggcuacacagaggaacccugucuagaaaaaccaaaaaauagauagauagauagauagauagauagauagauagauagauagauagauagauagauagauaucuagauagauagauaucuagauagauagauaucuagauagauagauagaaagaagaaagauacaguccuuaguccaacaaggaagacaaguauaguccugguauauugagaaauaagauggguugucauguaguuaugcugaggacuggaagagaugaaaaaggaccccagcgggaccaaggaauuccaggagccccagaaagucuugagcuggguguugaagcaugaauagauguuauguugugcaagugagcaaaaugaucagaaagaggguaccugggauaaggauacagggagagcccugcugcccuggaauacugcaaggggggcaugcaaagcuaacugcaggucuacugugccccugguagccugcaggucuacaagucagaacugccuggugauaggccugucucagcuauagaccagccaaagguguguuaucucugagaccaccugagaacagcuuaguucaccuaggggaggccacagaccaggacgauggcccuggagaguaaacaccagaggaggugaagagcagagaaauuagugucuucuuccugcauugugugugugugccucccacugagaucuggaagacaggguguccuggcuguguaccaaaggucacuguuuagauguccuuuauuucggaccaucauucuaaaaucuguaagauauagucuacugugagcauauuuugucuuucaguuaaucgucuucacucccaaaucccuccugcgccacccugaggcaagaacuagcuuugacgagaugcugccagguagguguggggcguggauuguuagugcugggaguuccucacugucuguaggccuuauggggcuuguacuuaccagucuccuuaggcucuuucuagauuuuuagucaugauauaaagaucucagacuguaaguuccucuagaauugcauuaaaauagcagggcuugguggcgcaugccuuuagucccagcccucuggaggcagaggcaaacccaucucugaguucagggccagccuucuuuacagagcaaguuucaagccagccagaauuacauggugagaccuugucucaaaaaacaaaagaaaggaaaagacaacacagugaaucuagggucucaaauaggcgcaugcaacagcucaccacaacucaggaguacaacucuuagcaaauucuuuguaaagaggaaaagcucuggggagggagggagcgccagcuacacugcugagauaagaggcuguggcaugagauuucuacauggaaagugacuaauuaauacaggugcuaauuaauacagcuuguagccacccagaugcaccugggcucaugaggccagaaagauuguuucuucucaaccaccaagccgcgagagccuuacacaacgaaccuuuuuuuuuuuuuuuuuaaagauuuauuuauuuauuauauguaaguacacugcagcugucuucagacacuccagaagagggagucagaucucguuacagaugguugugagccaccaugugguugcugggauuugaacuccggaccuuugggaaagcagucgggugcucuuacccacugagccaucucaccagccccacaacgaaccuuuuguuuauuauuuucuacuuuuugugugugguaacauuuauagcugggcagaggugucacgugccuuuaaucccagcacuugggaggcagaggcaggcagauuucuaguucaaggccagccuggucuacagagugaguuccaggacagccagagcuauacagagaagcccugucuugaaaaaaacauaaauauaaaaauaaguaaauaaauuuuuaaaaauauaauauguagaaucuccugucaaccguuuuuagugcugaaugucacuagagaagguugaguaagagcuguacagcagucucaccaucgagcucuagaccuuacaucagguagaacugagacucguacccaguaagcacucccaccccacacaucccugcucucacucgggcagccaugcucuacuagacucagaguacaggagcaacccuucuccaaaaugcuuaggaccacacauguuuggauuugggauuuuucuugauuuugggguauuuguauagacucaagucuaaaugcagacugcacuuauuuuauguguagcuuguacacaugcaauagaauccacucugggucuccaguguccugagcuuugacugaagccugucacauagcagaugaauaguccacuugggguggacuguuauccaggaagucuucagaguuuguaucuaaagaauaggagugcuccgucuauacgggucuuuuuauaacugacuuauuucaguuaguguaauguccacaggauucacaugggacacagugugugccaucacuuccugucuuguuaauauggaacaguauccacacuugaucuuaccugaaagaugaucuguucuauagaugugcugcauuugguuuuaguuccugugaguagcaccguuuugaacagggguauacaaguaauccuucaagauucugacagucagccgggugugguggcacacgccuuuagucccagcacucgggaggcagaggcaggcggauuucugaguucaaggccagccuggucuacagagugaguuccaggacagccagggcuacacagagaaacccuaucucaaaaaccaaaaaaacaaaagaacaaaaaaaaaauuuacaaauauauauuuuauuaugaaugugaaugcuuugccuaguuguacauauguauguguaccauguggaugccugguaccugaggaggucagaagaauauccacacgggagcugccaugugugugcugggagucauagcauguccucugcaagagcaucaaguguucuuaaccacucagccaauucuucagcccuccauaggauugggggggggguuguuuguuuaauuucuuuucuuuucugugcauugguauuuugucuguauguaugucuguuuaagggcaucagaucaccuggaacuccuaacucccuuggaguuagacaguugugaacuaccauguaggcacugggaauugaaccugggucucauggaagagaagccagggcuccuaacugcugagccaccucuccagguccccuccaucagaugauuugauuuauuucuucuuaaaguguaacuguccggguuguuccuguuuucauuauaucuguacagcuuuuugccuuuuuuuuuuuuuaauugugcugucguaucuauguaucucuagguggccuggaaauugcuauguagagcaggcuagccgcaaacucucagagaucuacugccucugucuccugaguacuagguuaaaggugcaugucccaggccugaucuugcaucauggcacagacaucagaagcuugugagggaggaguaucucugacccucgggaaccauagccccgagccacugugugauagcccucagcucacucguaacagcugugggauaggccuggaggaagagccagcccagcccagaugugggaacuuucuuauaggaacgcacuuccagcgugugaucccagaaaauggaccugcagcucaggacccacacaaagucaagagacuucucuucugcacugggaagguguacuaugaccucacccgagagcgcaaagccaggaacauggaggaggagguggcuauuacaaggauugagcaggugagggcauguggcgugguggcuaggugccaugucccagccacggggucuuagcagaacaucauucacucacugaggcuccuccccuucccagcagaguagcugcacagcuuuucccucuggaaccccagucucccuuugcuuagcccuacccauccucugagugucccuugguugaccucacccugcucucuccagcuaucaccauuccccuuugaccuccugcugaaagaggcacagaaguaucccaaugcugagcuggccuggugccaggaagagcacaagaaccaaggcuacuaugacuaugucaagccaagacuucguaccaccauugaccgugcuaagccugucugguaagacccaaguccuugauggccuggaagaucuggaagcaagcuagagaacaggcaggagccaccucugacuucauccuugucacucccccucucuguuucucucagguaugcuggccgagacccggcagcugcuccagccacuggcaacaagaaaacacaccugacagagcugcagcgcuuucuggacacagccuuugaccuggacgcauucaagaaauucucuuagaugcuccuggaguugaugaggccauggcccccauguccaugacgcucuuugcuucucaacuaaagaauagugccucagcacuguccacacgucccuucgcugugccacaccaccccuguucucauaggaauuaaguuguccacugcagugcucagcugcuccccggucacaugcugcccagccugugccgacuucucucaggcugcacaccguucauggagaccggaaggagcagaauaaggaaagggccccucucaggacauccuagagaaggaaggcagcucuggccccacccaugcccccagugcaauccuccaggguaggaacagaacccuauguggcuucccaggguacuagcacucagcccucgucacccaucaagucgcagauucaaggccaggaguaguuucaucuugcuagggccaagcugagagcucauggaggaacuauagcugccaggauuugggagucaucaggauguugugugaauagagauugucaugggguauuuagaggacuuuagcagugauguuagucuagcccugcuacccuucuuggguuugggcuguaugugggaaacuuaccccagcuaccacgccuggagagcuuggcucugaguacggcccagaagcuccauuggcucccaacgccaggcacugcugccucuugguccugcugccucugcucuccugaccccuccccagucacuucauuuucucuguuguucccuugaacacacagaagcuguugacgaauucuuuuuuuugcugugccaaggcaggucaaaagcagaucaguggauaagagcaaguugucccaaggagccagcuguccuuccucccucuuuugaccuccacugggacacaccugauuuauuuauuuugguuaaaaaaaaaaaaggaaaugaaaaaagaacaaccaccuuugcauugcaucggcuugacccauaaacuaaguuaucauggccagccugccugcugucguguguuccgccuccucccugccugccugagaacagucuucuuguuggggugggggggucccagcugccauuugccaacuggaugugugccccacagcuuucuguucccccucaugggcagcagccauuaucaacagcgcagccugggccuucagcaucucauuuccccugccacccauuaucuugguuuuaggcaugucuaauaacuacagucggcaccaggagagaauguccugggacaggaacaaugccccuuacucucagaggugggacucacaggaccaaaguuuguaucugccuguggucggcauguugcugucugguauccccuucucccuugggacagccaggcuguuuugcauacaaagcuggacuagaggaagggaagcuuagcggggugugggugagugcaggacaggaucuccauaagcaguacaccugggaacgccacaggagagcuaguucauucaugggggggcaggauuuauauggccauggaccauuggccggggcagggguguuggaagauaccucaucugcaugcucaggggcaacacuuuauaaggucaaacaagugaagccugauaacugccagguaauaaauucuacugggguugaugauggugaggagccagguuuauggugccauguucagagggggagggagccaguucaugcagcccucauguuuaaaguauccagugcccugggccauuacggacccacacuuguuuuugaauuuuguuuugcuuucaagaaucaaauugacuuuuauuauucauauacuuuguagaaagggggauuuaauaaacaggguagagcuguaugaaggauaggguccuuggaggcagcuagucucuuccuugacuggucuugugugggccagguaacuaugguugccugcaguggaggugucaagccuaaggaggugucauuuuguaaccuucccccugacuuccagcuauuuggggcuuucuguccccuccugcaguguucugagccuucaagacaauggcaugaguaaguugugaaggcuggacccacaucuugauacuuguuuucugcaucuugggcagcuaagcaucugccuucuguguucauucaccaccauucaauguaagaagaugcuucucagccgggcgugguggcgugcgccuuugaucccagcacuugggaggcagaggcagguggaucucugaguuuaaggacagccagggcuacacagagaaacccugucucgaaaaaaagaaaaagaaaaaaaagaaaaugcuucucugaugaaaauugggcaccucuuuugucuaacgguuuaaauagguauuuagaaagcaacguguugggcuggugagauggcucaguggguaagagcacccgacuaaguucaaaucccagcaaccacaugguggcucacaaccacccguaaugagaucugaugcccucuucuggugcaucugaagacagcuacaguguacuuuacauauaauaaauaaauaaauaaaucuuuaaaaaaaaaaaaauagaaagcaacgugcuacuacaccagcuuaguuaaguccacagggacagcuaucuccacaggccuggcuuauuagacaagcuucuaauaccaggcacugacacccccaugaaggagucuugaauccuuuaacaacuaccacaacacacacacacgucaagacacuauuacacacaaaggcauaucaugguguuccuauuggucucuuuguccuccucuuauccuggcuaacccuccaucucaccugccuacauuucccuccuauggcauccuuccuuuuugccugugucuaccaucucaucuccuuucagaaaugcccuucccgggcuggugagauggcucaguggguaagagcacccgacugcucuuccgaaggucaggaguucaaaucccagcaaccacaugguggcucacaaccaucuguaacgagaucugacucccucuucuggagugucugaagacagcuacaguguacuuacauauaauaaaugaauaaaaucuuuaaaaaaaaaaaaaaaaaaaaagaaaugcccuucccuugugcccagcuugcauagguacuccacauuagacacuccauccuaagaguuauauaagagagagcaugcaguuuguccuuuugggccucgguuaccucagagcaaaagagaaaaagaaagggaaaugggggaaggauuugugugaggggauucugggggaggggaaggaccgauauugggauguaaagggaaugaauuaauuuauaaaaaagaaauuggucuggcaagauggcuuagcacugacugcucuuccaaaguucaaaucccagcaaccacauggugacucacagccaucuauaaugagauccaaugccuccuucuggugugucugaagacugcuacaguguacuuauguauaauaauaaauaaaucuuugggccggag

SEQ ID NO: 5874 - RNA, 469 nt, Mus musculus
gucuuuuuuuuuuuuuuaauuucugaaagcuuuuaauuuauucccucccaaaagaacaacugcaaucaaagggguugaaaggucaggauuuuauugccuucauaacaaaaucugcuuagaacuggaucacuuggcccuuucucuucuugucgccuuccaauucaaaaugcuugcaucucuuaauagccagcauccucuuagaucugcaguugggcucaacacacuccagucucagcacaaucuucuuuguaguuuuagccuuuuuguggaaaauaggcuuagucugcccaccauagucacucuguuuccugucauaacgcggcuuucccugggcauaaaagacuccuugcccuucuuguacugugucaccuugugggguagugcuuugcacauuucuugcagaauguccggcaggucuuaggcacguucaccauguucgcaggagagcuagcagcucggaaagagcuca

SEQ ID NO: 5875 - RNA, 557 nt, Mus musculus
caccacagcagccaucuuccaguaacucgccaaaaugacgaacacaaagggaaagaggagaggccccccguauauguucucuaggccuuuuaggaaacauggcauuguuccuuuggccacauacaugcaaaucuacaagaagggugauauuguagacaucaagggaucgggcacuguucaaaaaggaaugccccauaagugcuaccggcaaaaccggaagagucuacagugucacccagcaugccgugggcaucauugucaacaagcagguuaagggcaaaauucuggccaagaggaucaaugugugaauugagcacaucaaacacucaaagagcagggacagcuuccugaagcgggugaaggagaacgaccagaagaaaaaggaagccaaagagaagggcaccugggugcagcugaagcgccagccugcaccacccagagaagcacacuuugugaggacuaacggaaaagggccugagcuguuggaggccauuccauacgaauucguggccuaauguacacaaagacauaaaaguaccagcaccaggacaaaaaaa

SEQ ID NO: 5876 - RNA, 8237 nt, Mus musculus
aggagcuuaggcuccuucacugggcucccuguguccucuguccagucauugagcgauagguugggccaucacuuauuaaaguggcccugcccccucugcagaauauauagcuaucuccccauauuaacccgcaccccugguucuggagacaccuuuugucucuuuccaguuaagaggcgaugucaccuugggaggagucuggccuccaagcggccccccuuggaugcugcgggaaaggcggggcagggcgcagccuucuggccuuagacucagcagugggagagaggcgauggggugaacgaagggaaugagcgcccucccucuggcgcuccgcagugcucggcgcgcuggcgcacgcucacucggcuugauaggcgggcggggcagcgcugacgucauuuacgccccccccccccccagcagaggggcgguggccgugcuggcuacuccgagcgcauugacggacagagggacagagagacagggguaucggcaggcacacguccaggccaugccaggggaggcugcgggcgcugagcugccgcugccugaggcaggagggccuggaucccgcacaggugagaccgcgccggcuccccuuucuggcucaauaccuuuucuggcuuucucucuccuccaucccucugccuccucacaguccccuccccugucuuuccagaccgguuauucccuccaccugcaucuuucccccacccccaagccccaggauuucgugaaggccugggcgccgcagacagcauccuccuagccuuguagcuaugaagggcagcgucuuggccuuucacucugggcuguggggaccguagucuuuggaccaagucccauuuaguugugucucugugccacauugcauuccauuguccacagagagcugggccccaggaccgacggugggguggcagguuuggaagcagggaggcccaaaggguccuugcaggcucauccugugaccaccagaggguucuuagagguacguugggugccuagggcagcaagcggcuagacuuauaagggaguuguagggccgauggaaccugggaggcuagccagaggacaccggcagaaccacgucugagagguggggcucugaacagcagcucuccuggccagcaguggucuuccuaugcagaccuuggauaagagggggcauuaaauguugguagaggucaguccacuugcaggcuggaggauacucuuaaguuuaaaugguuccugcuggagaugggcuguguguaacuugggcaaagccaagggcaccuugcugggugcaagaaguuaucuagggacaggaugggcaagaauggggauggugccagugcugugccaggguccugggugggagcuaacaguucccaucuuacucuugcugggggacaggcaauccaggcugggacuccccaggcccagucauaagcuaguuugcuuggugaccuugaaugacacauacacacacacacacaaacauacacacaccuuggcuuuuuauuucccuuccauuuuaaccuuggcccaauucugcccuacugcccuggggccacacuaggaaguggagaaggcaagagccuaacuugggaacgcccagugauggcuacuagccacacccacgucgguaccaucucccucaaagaaccugaaagaaccccucucccuuucugucaggaccugauugcucuaauagcccagcuucuggucagugaguccagcugaugucaaagaacccagcgcucagacauuccugagaucagauaucaaggagguggcugucuccccuccagcuucccucucaucccagcugagaauugcucaguagcugagaaagacaaagccgccacgguacaggcgauguugcccugucaccagugagcaugguaaagccggcaguguuggcugugugccugcuggagccgcaggccccuaggcacugcuccucccccucuuacgcaggacgugaacugagcucuggggacagacacuaggaaggcuuuaaguggauacuucagagagauguguuuuuggccuugguccaggugagggaggggcuguuacagagucuuuuaaaaggagcacucagagaaacacuuaacacaguugagcuaaaagccacgagacucaaaugaaugugcaaagugaccugaguagggacaugcagcucgccaugaggcaagacagcauuagccaggaggauaggaggggcaugggaugcugcuaucuggagagguuucuuugcuaccuuccuaagucccuaaguacuuucugacccauagugcuccacggccugagcauguguguccggugcagcaugucggcagaaggcaugucagcccaugagcuuuugugagcaccuguaccugacccagauggugccuaagaccuagagaaggaccccagggcagaccaggaguucccagcgugcuggaggaucuguuacucugagcggcugucuccauggagaggacauagccagccuucccucagcugucccguucccguggccaucauuucccaccauggcccuuuugacagaccgugguaccugucugucuccauucucagcucugugcagggcugcgcugagcucugaggaacccgagguuggucuugaguauagacagcaaggguaggagagagauaggcuaagaagcuccugcuuacagcagacuuggacugucccagagcuguagugugcaggaccccugcccuugucauaggaaagagcuggcacugcccagcggguucucguggcccucuguuccagauaagcccagcugaaccuagcugaaccggcaagcugaguucugaacagagacaauugcuaguuguguguuugcugaagugcgcccuccaaaacaucuugguuucuacuacacaacagcaccccccacagcuacccuucuuauaaagccucugucagcagcugccgaaucugcugaacaccuggaaagucuuccucaaauacacuuugcuuaccagccauugucuucuccacuaacuucccugaccagcccuccucuggaauuguauccauggaaacccgcucaucccgugcucagcucuucaccuggccuggcccugagauguguccagagggcaucucauguccuuuucuaucuccacagaucacucaugugaugcagcuauugcaaccauccugaaaggggaccaacuggagccccauggccugaccccggggccuaguccucuggcccucacguuccuguccagcaagccaggugcccggccccagccugagggggccagcugggaugcagggcccaguggagcugccucagccuggguggacccggcagagggcagcccaagccuagugguccuccccgagggccugccucuccggccugugccugccgaaggcccucuccccaccacccuggagccccgcaucgugaugggugaggagacaugccaggucaucgcuucaccuagggcagccuggccagugcucagggaccgggagggugggcacccugcccugcacccaccuccagagcuguguucucagggcgauccuccugugccuuccccucccccugaccucgagucuuacuucacaccccccucuacucccaccaagagcacccaugcccugcuuccugaccaugggccccacagggaugccugggaucuggaggccgagcugcuggaugaguuauuggacuccacgccagccucacccuccggcuccuacauuacagcagacggggacagcugggcuucauccccuuccuguucccucagccugcuggacccagcugaagggcuggacuuucccuccgacuggggccuuuccccaucagggucaguggcagaugaccuagagccacaccccgcagcaccuccagagcccccauccucugagucuagccucucagcagacagcagcucuuccuggagccaagagggccauuucuuugacccaaacuuccuggccaacgacccgaugaucccugccgcccuacuacccuuccgggguagccucaucuuccagguggaggcuguggaggugacaccauugccccaagaggaggaggaagacgaagaggauguagcugcuacugcugcugcugcugcuccugcugcugcaaccccagauggagaccuggcuggggagggggaggaugacagcacgucugccuccuuccugcagucgcuguccgaccuguccaucaucgagggcauggaugaggccuucgccuuccgggaugacaccuccgcagccuccucugacucagacucggcuuccuaugcuggggcagaugaugacaggcuguacaguggggagccccaugcccagcccagugcucagaauacagagcaggccuacagaaguagggcuacauucccagggauagaguccacaccucagacaucagagcaagagaucugucuuaccaauagccaggaaucaguugcagaaauagcagaagagauccuaacucuaggccuagagucugaagcuaugaggacaccuccugaucagcaagcagcuccaggcccccagguggaggaaacucccacagugaccccuuggguggggaacaaaguugaccugguuguagaacaaguauccaaggcucuuccugagcccugccaggaggggauaagcaccaccuuaggcuguaagccccucacugcagaggcaauuccagaucugcaggaaggagcaagccccagcuuguguccaguccuuccugagaagaaggaagaaggccagggccuucccucgacacuggaguauguggcuguggcuuuagaggggcccuggaaggcugagggaggugucacaauaccgcaggacccccuuaugacauugcccccacucuugcaaaguacaguucccaccucaggcccagagucuguggcgguagucgcacuagagccccagcagaaugaagggugugucacaguacucccugauguccccgugguauuaccuccauccccacaaaguguagauccaagcucagguccagaggcuauggccguggcuacauaugaguuccagcgggcuaaggaagguaccccaggacuccaggauuccccuguggccgcauccccagcacugcaaggcccagaucccaccucagagccagaaccugaaguuguggucaccucgaggucccagcaggaugaagggauugucacaguaccccaggagucuccuacagcaucaucucuaacccuacaaagcucacaucccacuucggaccaagaacgcgagguugcugccacacugggaccacagcaggcugaggagggcgucaccauaccccagguugccccaguagcaucaccuucauugcugcaaggcuuagagucaaccucagaccuagaaucugugguuguaggcacaccggagucccagcaggaugaagggauugccacagcaacccaggacaccccugugauggcaccuccaccccuucgagguacagauuccaccucggacccagagcugauagcuccagacaccucucaggcccugcagagagaagcaggccacaccccagggaccaagccuucugucucugaggcccaucaggaauuggguguggccucaggaccaaggccagugccuaaggagggggaugcagagccuccuccacacucagcacccccagcuucaaaccaggcccaacagaauggcucagagccagguuacaagagugacagcuuuggggcuccagaagagucagauuccacuuugagcacaaagaccucugagcccacaucgugcaugggggagaaaguagcugcgaacaugucugcacccaagcaaggagcaugucuugaagcccaugauggggucaagacccacucaccucaaagagaggccuugagguccaagaacaagcgugguagaggcaccaaaucaccagggcagggaaaugggcccaagucagcaacaucccaaggugccguggagacuugcagggcacauucugcugcucgcucugaggucagccagccacagcugagaagcaacgaggacaccucaggccccaggcugccuguggcuguaucuguacaagccaggcuagguuccugcccaggguccccagcgagagccacaugcacacugagcagggucuacgcugaagagacuagcaggugugcaccacccuuccagcaucuggagccuaugcugggccugggcagugcugaacagcccaaggugaccccugguauccuuaaucuuuccccagacaacucugcuggugaccugcucaccacaucucagaauagguuucuggacccugacccugcucccaguacccucgacagggcaucccaaucauccccggggccuccagaccccugccugugccccccuccccagaaagccucugaggaagaagagaagcccccagccucgcguggcccgaugccucgggcaggagcccagggagcugccgccaucaccaccucaggauccacaaagccuccgggagcccggcagcgugucagccucucaccucacuccacccucaaccccaagguggcccccacagauaccaaagaccuggcuugcaucaucucaagccccugccaagugccuccucccucugggacccagaacccaucagggccucgagaguucccagcucuugaacaaaaggaugaggacagccuggaggaagguaaggggauggguggggggaggggugugugugugugucagugcuugggccagcuggacucuucccagggggacacuagaggaugggacugguggacccucugcauaguaagaggcccucauaccucgccccucccccagacgcgcagagggccccaggcuccggccagcguugggagagccacggggagucguccagugagcuggaugaguaccucgccccucccccagacgcgcagaggaccccaggcuccggccagcguucggagagccacggggagucguccagugagcugggugagcaggaucucucaccucagaaaucgcagugcccggcacaggugcuggccccagaacggggugggucucucugggugagcaucggcccagcuccuacagaugcuuagccuccgccuuccuauagggcccggcaggcagcaacgaggagaccauugccaaagccaagcaaagccgcagugagaagaaggcucgaaaggucagcugagagccccccgagaggacucugggagaggacauauauaaagggaggcacccucacuaaugccccucaaacccgguagccagugaaauaccuaucccugcagaggguagcaaucuaguaaccccucccuccccuaaacccuggaauguccugaggaggcccuuauagaggggaagggcagccuuccgguccccagaaagggccugagucuccugcucucugccucaggcaaugucaaaacuaggcuugcgucagauucaaggagucaccaggaucaccauccagaaguccaagaauaucuuguuugucauugccaagccggaugucuucaagagccccgccucagacaccuacguggucuuuggcgaggccaaggucugucguggcugugagcgcgaugugguuugggggaagggcccccggggucagugagcucuccucacacagcugucuguacugcagaucgaggaccugucccagcaaguacacaaagcugcagcagagaaguucaaggugcccucagagcccucagcccuggucccugagcugucaccugggccccgugugaggccagagugugaggagcaagaggaggaagaugaggaggugagaccucgaggcuccagacacuuggacgggugccgggggcgaggugaagguuaggguaggauuuuacccugccugggcagcacccugcuucaaggggucucaggcagcuuaagccaccuccuuauucccuuccacuagguagaggaggcuggacuagaaccucgugacauugaacuggugauggcccaggccaaugugacccgggcaaaggcugugcgggcccugaaggacaaccacagugauauugucaaugcuaucauggugagcacauauugacuccuuuuucagcccagaugucucuagggagguccuucgcaaaagacccucugcuaacaugacgcuugcuucuucugcaggaacugacaauguagcugcugacuggaagcaggggcguccugccucuccucagcucugcagcucaauaaagccgugucacaugaucacccu

SEQ ID NO: 5877 - RNA, 1364 nt, Mus musculus
cuuccgcagucgccaucuuuguugcgcucaggcuuccgguacugggaaguguagugagauccuggucgugggaaacguagacgggaaggagagggugaauucuacacggcagggcacgucgggccagagucuccuacuugugcggaguuuggguagcgacucugaugucagcccguucugccccacucccuugggccuuucacagguccuguaggagaggcgugaguugggaccgccguguugacuuugggguucggggcgggaaggcauugccaggugucggguaauuacagagaagcgaguuguagcuccagcugaaggucuuuucggaaaugcaagcaguuugucuagauuaaacaaguaaaggacauaccguauacaacggcacaccgauaaauugcuguaaucucaguaauggaggcaggaggccgagggcuagccuguacuacuguggaggcccugcaucaagaagcagaauagccgggcgugguggcacacaccuuaaaaccccagccaggagacaggaaaaaggaucuuugaggucguggcuagcuuggucuacauaccaaguuuaggacagccgggacgaccuggagaaggcccugccuuagcgcacggcaggacugaggagauaguacaaaaugcuggguaggaugguugggaggugaguuuucccaguaaucccagugcuaggaaaccacagacggcaucucugggacaaagguguaugugugcaugaagagaucacaggaaaacuuggggaaauuuguuucuuccaaucaugugggaucugggaauugaacucacagucaaguggccccuaaacuaacugucuguuuuccuagacagcguuucuccuuguagccuuggcuguuuuggaacucgcuguguagaccaggcuggucuugaacucacagagaucccccuccuucugccucuggagugcaggacaaaagacaugccccacccccacccccagguccccacuaaguuauccugcuggcccuaauuuuguagaaaggaaaauuuaacuuaaaauuuuccuugaaaaaucuuuauguuuguaagaguguauuacuucucuccuuuguggcuaaaaucaagcguaaacgcugguucuuguuaauaaaagauugcugaauuauccagggaagcuucucuugcuuuagccuuacaguagcuagcauuauauugccacacuagcuuuaccuuggugguucuuguuuaagagucucaugcugaauucaaaauuuagcucaaaaaggucagagauaauauagauauaaaacuccuaaggggaaacacauuuuuacuaucuuggauuaaacaguaguuucuuaguaggaaaccaaaagcaaaaauga

SEQ ID NO: 5878 - RNA, 1364 nt, Mus musculus
ucauuuuugcuuuugguuuccuacuaagaaacuacuguuuaauccaagauaguaaaaauguguuuccccuuaggaguuuuauaucuauauuaucucugaccuuuuugagcuaaauuuugaauucagcaugagacucuuaaacaagaaccaccaagguaaagcuaguguggcaauauaaugcuagcuacuguaaggcuaaagcaagagaagcuucccuggauaauucagcaaucuuuuauuaacaagaaccagcguuuacgcuugauuuuagccacaaaggagagaaguaauacacucuuacaaacauaaagauuuuucaaggaaaauuuuaaguuaaauuuuccuuucuacaaaauuagggccagcaggauaacuuaguggggaccuggggguggggguggggcaugucuuuuguccugcacuccagaggcagaaggagggggaucucugugaguucaagaccagccuggucuacacagcgaguuccaaaacagccaaggcuacaaggagaaacgcugucuaggaaaacagacaguuaguuuaggggccacuugacugugaguucaauucccagaucccacaugauuggaagaaacaaauuuccccaaguuuuccugugaucucuucaugcacacauacaccuuugucccagagaugccgucugugguuuccuagcacugggauuacugggaaaacucaccucccaaccauccuacccagcauuuuguacuaucuccucaguccugccgugcgcuaaggcagggccuucuccaggucgucccggcuguccuaaacuugguauguagaccaagcuagccacgaccucaaagauccuuuuuccugucuccuggcugggguuuuaaggugugugccaccacgcccggcuauucugcuucuugaugcagggccuccacaguaguacaggcuagcccucggccuccugccuccauuacugagauuacagcaauuuaucggugugccguuguauacgguauguccuuuacuuguuuaaucuagacaaacugcuugcauuuccgaaaagaccuucagcuggagcuacaacucgcuucucuguaauuacccgacaccuggcaaugccuucccgccccgaaccccaaagucaacacggcggucccaacucacgccucuccuacaggaccugugaaaggcccaagggaguggggcagaacgggcugacaucagagucgcuacccaaacuccgcacaaguaggagacucuggcccgacgugcccugccguguagaauucacccucuccuucccgucuacguuucccacgaccaggaucucacuacacuucccaguaccggaagccugagcgcaacaaagauggcgacugcggaag

SEQ ID NO: 5879 - RNA, 991 nt, Mus musculus
auccucugaacaggguggcauuuauaguuuuaaauaaacauaggagauaauaugaucgacugaaggucuguagaucucaggagugauggauccuuuccaugguccuguuugcagugaagaacauccauggucgcucaaagcacagauguggaccuggugcaccugaggagccuucacaucugggaagacuuuuaggaaguaaaaaaacuucuaugucauuagguuaaaaucauacuccaugcucugagccagucguuuuaacagaaagaaaauaaaucuaaccugcagucuuucaauaacgugcuaacuggcaguaaaugauugacaaacuuccccuucaagcuucauuauacagacaaguaugggaaaggcuagacugaugcaugugguccaggaugaaaucuggaggcaugacacgaagucacucugagccugacauacaaauguauguacagaugcaugaagguugggugcggacagacaaauuguuaauagaacacugugugcaugaaucaguauauacaugauuccuagcugcaucuucuaagaggcccuagaauaaagacacuccaauagcaacaagcaaguccagugccuagcucuccgcuucuaaugugacucuccaaggaaaggaaauaaaagcccugggagagcaggcucaccagagaauguauaggaggaagugggagcucucuuguagugcuggagagcaagggaacacagaauccaguaaguagacacacaacaaaagugggaacaaggcagagagacacaggagccagauggaggcucacaagucaaaccugggaccauguaagcaggaaaaguaaugauucucagcauauaagugaagauccacaaguccaugauaaagauagagacaaguaaagugagaaugggcaaccuguacccagccaccauguagaugcuccagccaaggaaguggagcucaccguucugcuucucaagcccacgcuacaccuagugucua

SEQ ID NO: 5880 - RNA, 7840 nt, Mus musculus
cagaugcgagcuuagagcggcgacugggcgcugaggaccugcuugcucgcugcucccaucccgccgccucaucccgccgccucaucccgcgugcuccacuccgcuccccuccaccgagccguccacccggcgccaugcaucccgcgcgccccgcgcucugggcggcugcgcucacugcccucacucugcuccgcggaccgccgguggcgcgagcuggcgcgggcgcggugggcgcgggccccguggugcgcugcgaaccgugcgacgcgcgugcgcugucccagugcgcgccuccgcccaccgcgcccgcgugcacggagcuggugcgagagcccggcugcggcugcugccugacuugcgcgcugcgcgaaggcgacgcgugcggcgucuacacggagcgcuguggcaccggccuccgcugccagccgcggcccgcggagcaguacccgcugagggcgcugcugaauggccgcggguucugcgccaacgccagcgcugcaggcagccuaagcaccuaccuccccucccaaccugcuccagguaagcugucccugccacgugcgccacgcgcaacucccugggacccgacgaggguggcagggaguguaucuucagauguuugucuuggcucauauugaagguuggaaaauggacccugggaggcggagugaggcacugaacccauuuuuccucuugcuugguucucaaaguacagcuuuucuuauaaguugcaaaaugcgcucugugaaaauagguagaauucagugccaggacgagcggguagcaagggagacugccaguggacagaucccagucacuggagagucuccucgcugagcggggauacccagguuuaggucuguguaacccagcuguugaccuggguuuucauuccucauaaauugggaaggagcgcgucuaucccagggaagcuugaguguaggaaucccggguuggauccggaccaugaagguauuugcaggcagccacgcuguuggaaacaguaccugucuugaaacauccuaucauuugcacgggcuaauuggcaacgcaggauugugucccaauuuauccaaaaacuaacgagaugaaauuaagagcacuggugucuuugaaacugugaaaccuaaaguucaaaacugcucagugucaccaggagcugcaaaaagguuugagcccgguucgggccccauaggcgccauccuaugcucugcagcagcgccuuccagauucagagacugcauuuggugcagaggaugcagacucaggccgguucccugccaaagcagagacuagaaaugcgaaguacgacccaggaauguuacucuuucuaauucgaccuaggugcagcagcagcagcaguggggacagcgacagcgccaaugagaaaaaugcaaacguuuaacaguuaccucuccugcugcaagcccuaccaagcaggcagucacucuaagggcauccuucguuccuuuaaggaaaaaacaaaacaaaacagaaacauuuaaauggauuuggcagcuguugcucuaaauggccagcauucuuagcuguugcucuaaauggccagcauuccuagccagucucgcuuaguuaugugagucaaguucuugcccugaacaucugaaggcuagaauucuccgguuucccacaccaggcuggcagauggugcagaucgagcccccaggaccagggcuagcuggguagagagucucuuuaugauuucuguggcugcugaccuacacucccggguacaggcaaguccugguauguucauccccgagaagcauuggauuccuggcaaagcaagauuccaguuguuucgcugacucagacaaaggcaaaaucaugccauuugccugugugucuuuaacuucuagugcguucugugguauaccaaaagcaaucuuaagaaauacuagcauugcuauuuugaguuaagccuuaaugaccucuauuaauaaucaccauugaacacuguaguaaaaauugaugugagcuuuaauuacaaaagaguuuggaggcuucaauauccauugaaggaaaaaauauaguucugugacacaauucacaauucccuauuuaauaguucuauuguagucagcuaucuaaggagaacaaagagaaggaaaaaagggacguuuaagaaauuacucagcuucuuggaagauaaauacaaauacaaucauuuacauauuagcauuuccuuugucccuguacuuucaaaaaaaaaaaaacccacaaagauucaagcaaauugaaaccaagucuacaaauugaaucauggcucuccuccgccaggugcuagucuagacccgaggaauuuugcuugcgggggcaagaggucauugaggguuugcagccgagucucagggagccguuugguagaugagaaacucaggcuccuugggcaagagggccuucugggauccugcacgccaguuccucugagagaugggagaagcugcgaccuccgacgguuucuagcaaacgaagcauuagcucuuggccagaggcccagagcuuccucgugggcaggaugccucagccuggcauuuccugagaggccaaaucaaaaaagagaggccagcuggggcccugaacuuugcacccagacagaauaaauucagaaccagaugccaacugggacuccaugcucagaaagcuauuaaagccccuuugucaggagggaaggaauucuauggucaugaucugaagcuuaaaccuaaagcuguaaagcucagaguugagaguugggggccaauuaucuggccuuggguccccccuggggcgggggggauaucuuacugcaaauggaguggucagccacaaauuuagucacauacuuagauucaauuaaucuguucaccuuccagcguuccuaucaguuaggaccggcucccuuagcaccuuggguuaugaaagcuaggaggcuuuucuucccgccuccccucuccccaucuucaaggauugaauacacuuuagcaccuagaggucuaagcugugggugauacguuggugcuaucuguauucugugugcuccacugcugaagggggagagggugcacccaagaagaugccccucccacccaaaacacagacuccacauggaccuugaaguugaaagauguacaagcuccucagaaauaaacuucucuagcaugccugcuuaugggucccagaagugagauauuuaacaugaaaccagagcaggcggaugacagaauccccagaacggugugcuguugacaauggguagagaaugaaauauacuuuucccacacaccccucaccacccccacccccaccucccaacagcugugcccagggcugaagcacauuuggaguccuguuuucuggucagcuucacagcagcaucccauggggcgugacugcccccugcugguagcaggcggagccugcugcuuucuccucuauggaagggcuuggagcuagcugucucauaaacacauuccacagagugacuuucaaauugauggcuuccuaaaguaaagcagucaccgugcaucaggcgguauucuagaaugcuuuugcaauuguccuuuucuuagcauacuaagaauuguugaauggcauugccuuguaggugugaccugccccugacaagguuaucaucccacugucaguacuaaucauuuccuuaacccauauucucucccaggaaacaucagugaguccgaggaggagcacaaugcugggaguguggaaagccagguuguccccagcacacaccgagugaccgauuccaaguuccauccacuccaugccaagauggaugucaucaaaaaaggccacgccagggacagccagcgcuacaaaguugacuaugagucucaaagcacagacacccagaacuucuccuccgagucuaagcgggagacagaauacgugagaacuuuuucuuuaguugggggcaaggggaguaggaaacaccccaagacagccuuugugcagcaagucccaggggccugguucauagguaggcaguccaagccccaccucccguucagagacucuugggagguucaaggugaaccacacuaguaaacagugugcugagcccugcagaugaagacguggacuucccccacgcugccuuuauuucacucaaugcguuuuccaaagccuccuggccuauucuuagcccacuuuccagcuccucugucuacucuggagagagcaaaagagauagaggcuggugguuauuauccugggacccugugugagaaggucacaagaagaauaucccuaugaggcacaccacacauuccucuugggaugguccuguggccacugugacauugucaaaacaacaauuguguccccagggucccugccgcagagaaauggaggacacacugaaucaucugaaguuccucaaugugcugagucccagaggcguccacaucccaaacugugacaagaagggguucuauaagaagaagcaggugaguggggucccccgggauguuguccucugcuaucuccauuggcuugguggguaaucagcuucacgguuaccuccaggaaccucacccgguguggcucucugcccaccugacuguguccccucuucugauacauguaugcgucgcucaggggcuuucuaauugggcgguucacaacaugaaucuagaagacaaaaguaaacagugcucaccccagcaugcccacguucuaguguuuauacagcagucuucguuggggagccugagccucucguacuauccacugauuggauuaguucagcacauuuccacuaaagagagacuacagacgagguugggugcgaggucugagagauucagccugacccagcacagaggaagcucaccaagcccuccaaccuccccagagaggcuccagcacacacagcugugcauggaugcacaccaccaccgacacgucgguggcucugcaggagccauggccaucauaauuuugccucagcccaguagaacaacacuggggcgucacuuugggucccagcuaccaguuuguccucagugucuguuaggguuucuguugcugugaaaaaaaaauacuacaaccaaaaccagcuugauaucacaauccaccaccaccgaagaaagucaggucaggaacucaaggcaggaacugcagccauggaggaguacugcuuacuggcuugcuccccauggauugcucagccugcuuuuggauagcaccaggaccaccugccaaggcguagcguucuccacagcagucaucaaucaaggaauguaucauuggcuugucagcuugucagucagcugggaacauuuucucagcugguguuuuuucuucucuagagacucuagcuucugucugucgaguugacauaaacuagccaguacacaugauauucaagucccggucuugucucucucucccucagugccgcccuuccaaaggcagaaagcggggcuucugcugguguguggacaaguaugggcagcccuugccaggcuacgacaccaaggggaaagacgacguacauugccucagcgugcagagccaguagaugcuccgugccacguaagccagagguuccggccccggacucagcuccuuuggaaagugguugagguuaaggggaauugcuaggagcaacuauggcugccagguacccaccccucauccugggcucccuggcccaggagcugcagccaggcccagagagaggcagguaaaggggauuguucagggagaagaaaguccuuaaccuaaccacacccccaaggacagacaccagggucaguguagcuucaaaaacucucagcucuguucuaaaugacuucaaauaugcacuauuucauaugcaagcaagcacugugggggguuuuaaauaaaacuuuauccgcaguaguccugaggguuagagcacacuguuuucuuccaggagaaccuggcauauuugguuucugaauuagagaugucccuaguuuuguuguaauaauuuuuuuugaaaauuagaauauuccuuuaguuugugguuaguuugaucuuuaaaggaauuauuuaaaccuaauaaaacuaauguaacacugauauucuaaaccaccauuucggagaauauuauuguauuuagcauuuuguuuucuuucaguaaaugaaggaauuaugggaaagaguaaauaugcuuugcuuucuugacaauuuucauaggcagaaaaagauuucauuuuuacuuagaauauuucccucaucaguuggaaaaauaacucuaauuauggauagcacuuuuuaacaaugaaaguauuugaugguguuuggugagaaagaauagacugagguccacccccucaugcugaacaaaagggggagcccccccugaauauuggagguaauuauuucaauguaugucuuacucuuuuucuuucuuucaucuuccuuuuagauaauauggagcucaaauaugccuuauuuugcacaaaagacugccaacaacaugaucagcagcuggcuacagccuugauuuauauauauauauauauauuuuaugugugugugugugugaguguggugaacugagugaaaacaaacacacacacaaaccaaaguuuagacagauuucugaaaugccucuggucauuuaaauagugaacuugaucaucuuccuacuucccaguagucaacaaaaagcaguuugaauuuuccuguugcuucuuaugagagacacucguguacuccaggccccggaugccaucugcccccuaacucacccacccaguacgggcuucaaugcugcuggcccucugccuucuugauuucagacguuccguggcugauauagacaaauccucuuuccauccccuguaaauaagugcaggcccuauggagaauggggaaacccauaaccgagugacccggacaucuggaagcauaugccugaggcucaugguccuuauugugccaucucugaauaagggccuggcccuguauccgcaaguggccugaucuacuugggaacugugggagaggauauguguugucucucuuacuaaaaaugacugagaauguucuagggcacucugggagcccauaaggacaaggauaaggaccuuucuuugucaggcaucuucuugaugacuuggcccagcagaaagccccaagugggaggagcagcaucggacuccacguucagagaugucgcaaauaauggugcgcuuaguucuucagaugacuucaaaaaacaauguuuucugguccagccucucaaaauaaaguuuguugugagguggggcugcgggaaggcaguuuuucaaaaacacagauuucuuuucaucuuccuaucuaaacaggaaagaggaguggcuugucugagagccugguaagagcauggagaaaaucaccuguauguugaucuugggguccuucucaaacucucuuuauaauucacgcauauaugcagacaaaguacguucuuaauuguuaacauuguauacaacguagcccagauauaauagaaucuguacuagauaauccuagaugaaguguuagagauguuaggugauauaacugcagacacgcccaaggaaaggagccugugucuggaggcugggcugcucucccccaggccgaggcggaggaggucuggcaacgcagggugagaggagacuguacugcauccuacgggguggacaugcgcuguacagagcuuuccuugagagcacaaaggaaucucaagacauucugccugccuaucagcuuuucuuuauuuuuuuaauuaaguuuuuuggggaaaaauguauuuuugaaaaguuugucuugcaauguauuuauaaauaguaaauaaaguuuuuaucauuuaaaaaaaaag

SEQ ID NO: 5881 - RNA, 1537 nt, Mus musculus
ggagggggcucucggucccauauugaacucgaguuggaagaggcgaguccggucucaaaauggagggccaugauccaaaggaaccagagcagcugaggaagcuguuuauugguggucugagcuuugaaaccacagaugauagcuuaagagaacauuuugagaaauggggcacacuuacagacugugugguaaugagagauccccaaacaaaauguuccagaggcuuugguuuugugaccuacucuuauguugaagagguggaugcugcacugugugcucggccacacaagguugaugggcgugugguggaaccaaagagagcuguuucuagaggauucuguaaagccuggugcccauuuaacggugaagaaaauuuuuguuggugguauuaaagaggauacggaagaauauaaccugagagacuacuuugaaaaguauggcaagauugaaaccauagagguuauagaagacaggcagagugggaaaaauagaagauuugcuuuuguaacuuuugaugaucaugacacaguugauaaaauuguuguucagaaauaccacacuauuaaugggcauaauugugaagugaaaaaggcccuuucuaaacaagagaugcagucugcuggaucacagagaggucguggagguggaucuggcaacuuuaugggucguggaggaaacuuuggaggugguggaggaaacuuuggucguggaggaaacuuugguggaagagguggcuauggugguggagguggugacagcagagguaguuauggagguggugaugguggauauaauggauuuggaggugaugguggcaacuaugguggugguccugguuacagcaguagaggaggauauggagguggugguccaggauauggaaaccagggugguggauauggugaggaggaggagggggauaugaugguuacaaugaaggaggaaauuuugguggagguaacuaugguggugguggaaacuauaaugacuuuggaaauuauaguggacagcaucaaucaaauuauggacccaugaaggggagcaguuuugguggaagaagcucaggcagucccuauggugguggcuauggaucuggagguggaagugguggauaugguagcagaagguuuuaaaauaaaacagaaacgguuacaguucuuagcaggagagagagcaaggaguugucaggaaagcugcagguuacuuugagacaguugucccaaaugcauuagaggaacuguaaaaaucugccacagaaggaacgaugauccauagucagaaaaguuacugcagcuuaaacaggaaacccuucuuguucaggacugucauagccacaguuugcaaaaagugcagcuauugauuaaugcaauguagugucaauuagauguacauuccugaggucuuuuaucugcuguagcuuugucuuuuucuuuuucuuuucauuacaucagguauauugcccuguaaauugugguagugguaccaggaauaaaaaauuaaggaauuuuuaacuuuucaaaaaaaaaaaaaaaaaaaa

SEQ ID NO: 5882 - RNA, 18057 nt, Mus musculus
cgcccagguuuccccgccgggacgcucagggagggacuuuuguccgccuuggaccaacgccgccgucggccugguauccgccaugaaguuucgcgccaagaucguggaccuggcuugucugaaucauuucacacgugagcuggcagggcugcggggagcgagcggagagugcggcccuugugagaggacgggcggggugagggcggcccugagaagagccacggcuaccagggaccuuccuuuugcagcccucccgcacgcaccccuccuuccgcccggggucugccuaaccuuguagcaguugugagcugcaguacccgguggcuccuacguuucuguggaauguggaaccgccuggcccccgguugucaguugucuucugagacuguuucuuuauucuguuuccguuuugaauucuggugcugugggcucgcaggguuguugggagacuggcaggaugucagcagcauuaaaauacaagagugaucugugagcuagaaagaaguucugcaagaagaccaguaggcuccucagugagcuuaguuacuguuuaccccccucgcuguaggagucaguaacaugauagccaagcuugccaaaaccugcacccuccgcaucagcccggagaagcugaacuucauccugugcgacaagcuggccaguggaggcgugagcauguggugugagcuggagcaggugagcaggagaacccagagguucugggcuccagccaggagugcuggaaaggccacaaaugccuguuucuguucugcaggagaacuuuuuuagugaauuucaaauggaaggagucucugaagaaaacaacgagauuuauuuagaauuaacgucggaaaacuuaucucgagccuugaaaacugcccagaacuccagagccuugaaaaucaagcugacuaacaaacacuuucccugucuuaccgugucuguagagcugguaagugggaagaaaagaauuucugaauguuuuuuacaagugacuuggucuaggcaguauauagguagcuacaagcccgagcuuucaaacaauauucuuaaaagugaauuaguuucauuuaaaauauaagaccugagccagaauggugguacaugucuuuaaagccagcacucaggaggcagagauaggaaggugaguuccaggacucugucucaaaauaaaguaaagcaaaauaaaacaaaauagaucugguucauaacuuaugcaugagaaauguacauuguucuagucauuuguaaacagucaugauggcaccauguucuaugggacacugcuuuucccaaacaaccaagcugcuagcuagcaucucuucuaggguguugucaccuuguuuagauguuuccguuuucaccuuaaaauugccccuccuauccugucuucugugauuuucuuaaacaguccucauacuucagcagcacauuuguaccagaugaguuuagugcacagccucuccucaaaacacacaaagccacguguacaagauggacuuuuuuuuuuuugaacuuacccuuucaguuuacuugguugacguuaccauguugggcaauuuuugaaugaauuuucuaaaaucauaggguuuacuuuuuuuuuuucuaguagacauaagaccaagauauauuuuauaaauuacuaaauuggaguucucaaucacaaauagauguagcucugcucacuugggggugacauaagauugaauacacuauuuacuacccauggaaagaaguaggcaucugcagcccaaccaaagcuauuuuauuuauauagcaggugcucaaggguuggcuuacucuaucagagaacugauuuccuagcagugcuuguugaugcucugaggaugaaccuaggcuuggcgacuauggaaguuuauugaauucacuuuucuucuuauccaaacaaguccugggcagcuauuucuaagagauuuuuauacuucacuguuuugaguugggauuuuuaagaauuuuaauugaaaaaauuuucuucugcagauacacaucuauuguuuuguaaaaacuggcuuaauuuuucuuuagaagaaugagugcuuucuuguucuuaguugaaguaauuugacugggucacugguucugguuucucuucuguaagaaugaauuugagacugaggucuggugaaugaaaaguuucuguuuuccuaagacaucaugauuggcucauccauggguuuaugauucaacacugugcuaacugccaagacuuaggacgaauggugacgaaugguggaccuagaacaggcaacagagaacagaaaauugucuugucuucauugauccguaagauggacuuuuuaauuccuaacauguucauaguccuuuuaugguucaaacuauugcggagcaaaaucaucacuuauuaccuucugagcgccucucugggcaugucuuuuugcucaucucccagucugguggcauugguugggcuuuccaugaagagugcucuaccccaaccaccuugggcccuccuuaucuuuacagcuuuccuuucuuacaugugcucugcacaucugugggccaguauugcauuuguuuucaaguuggcuacagacauuaaauuucaugcccucauaauuuguauguguucuuauagcauuccguguaacuguaaguuuggauuuauuuaguucuuuuguuuauuugucuuuugagauauggguucuuuguguagccuuggcugucuuggaaauagcucuguagacgaggcugacuucaaacucagagauccaccugccucugccucccaggugcugggauuauaggugugugccacugcuugguggauuuauuuaguuuuaaggagcaagaugguaauauacaauacuuuacuaaguaagaaugcaaaauauuuugguuucuuuuuauuuuguucuuuugagaaagauucucacgauguagcucugacugucuuagaauucacugucuagaccaggcuggccuugaacuuacagagauccaccugcuucugccuccugagugcugggauucaaggugugugccacuauguccagcauuacuuugguuucugaguuuuagaaacacuucuaguaauaaacauggcuuauccuuuuaguguugcagaagcugcagcauacuuagguguggcacaugucggccaggcacguuggccucuuucugucuccuggguuuacaaaugcugauauugucccucugucugaaacccugucaccucaucuucagcuucuugauaguuaaccucucuaguguuaauguccugaggcagcaccccagagguucucccuuauuccuccccaccgucaccgcuuggucauucagccuucuugcugauguguuuuccucaggcucugaugauugucuggugagcugagcuugcuugcuugcuuauugcuccaucuugucucagucaccacgauguugagagacucgcagggcccugagcagaacagguacacuacaccaacaguaaugguugaauagauuuugaguggguggauuaagaacauuccauuuggaacugaaaaugucuggcaucaguucuuaccuuuugguuuuguuuucgcauaaacuaauguuuuuucuuagcaggugucuucaucgagcagcagcagaaucguggugcaugauauccccauaaagguucuuccgagaagacuguggaaggacuuacaagaacccuccaucccagacugugacguaagugcugggauccaaugcucugauggucauuguugucuuacuguguguauuauuugaaguugcauaguuucugaaaagaaaugugagucauuaugugaguaugucccuuaccuuauauauguaaauucugucaaagaacugauacccauuuagaaaugccacacuuuccacaggagggcaaaugcauuccugagccuguauacaaaagaaagcagagccuauccagcaauugucaacuagccaggcuguguggugccuguggucguguugaagcucuuagcaggaggcacaaaaaagagucaaaggcugcucccaaauuucacuucucugcucacaaauauuuuccuguugugaaacugguuugaaagagacugcaaagaugaccguguccacucuagggaauacaucagucugccacauauggugacagaaaguggaucucuugaaugacagacagcuuguuacaaggaagacuucaguuuaacacccuuaccuagagaggaugagaacugcuguuuuaaagugguuuauuguacuccaugggguaacugggcuggaaugcauuggugaacauuaggugguuuuauuacagacuuaauuguaaacauuuuuuaaugaaugauugagugaaauaguguuuguaaagguuaauaaauuucuugaccaaaaaaagaaaggaaagacaagacaacagagccuaagcuguacuuuggaaggcaaucuguauguaucaugacucuugcccuuaggcacaaauguuucauaggccuugaugaaagagccagaaaggcauuuugcugacuugaagcuuagguuagccgugggaauucugggaaucucgggaccauugcaaacaaagaggaugccaaaugguccuuugucuugcauauaugaaaggaaauuaaacagguacuggaugaaauuuguaguugacugucacacuagaaggugucuauauagguuuggaaaaagacagcauuacuuagagcucuguugugacauaguucaaaugaguugugauaaugucugccuguacucuuucacagaguacacagaauaccccugagucuuauaaaacauuucccagaggaaggcuucuugcucagcacuugagguauauuccccuuggaccuguauauagguaucucagcugaaguacuguguuccuucuugaaccauaacaaugcccuugggagcauggucaccaugguaaccagagccagguagucaggcaucuuuacuugcuugaauaaguuagugacauuuuuaaaguuuuaaagaaacuguauuuggaacuuuuuuuuaaaaaaaaaauaugauccugaguuuuuaaauacgaguauaauucauagcuguugauugaauaccuaucauuauagacuauauuacgauuucuaacgguugugauuucuccuacuuguuuuuaggucaguauuugcuuaccagccuugaagaugaugaagaguguuguggaaaaaaugagaaacaucagcaaucagcuuguaaguuauuacuccuucagaaaagagcugugagugcgcccuagccgugugcuuggcagacccugggaggcagcuacacuauagaugcaggggcaagcgcuccaucagcuaguggguuucuccucauggaggccccaccgcggaggacagaacuuggccucuagggaccuauucuaaugccuuucagcucuuacucacuggggaaagcuuucaaacuugccuuuaaucccucauguuuauaguauaucaggagcguagucaacaguucuuguauuuuguuucuuauaauuuaaacagaacauugcagguuuuauuauuauuauuaauaauucauuuauuuacuuacaucacaucuuaauuguguuacguugcauuacauuacagcuucaccucccucuucuccugccagucccucccuguuaccucccguccccuucaucuccugccuccucucuuuccucucagaaaaggggagguacuccuuagauaucaagaagccuuggcauaucaaguugcuguaggauuagaugcaucuuuuccuauugaagcuagacaaggcagcccaguuagaggaaagagauugauccacaggcaggcagcagcgucgcagauagccccuguacucacaggaagacccaguugcacaacuauuacauaugugcagggggcccagguucguccugugugugcucucuagcuggcuguuuagucucuguaggcccccaugggccuagguuaguugauucugugggguuucuggggcauccuugacccaucuggcuccuucaaugauuucuaacgguugugauuucuccuacuuguauuuaggucaguauugguaggauuccccaagcucaacuuaauguuuggcuaugggucucugcaucuauuuccaucaguugcugggugaggccucucugaugacugcuaugcuagguucuugucugcuaguauagcagaauaucauuaauaaugucagggguggccucccucucaugacauggguuucaagcuggaccagucauuggugggcccuucccucaaauucugcuucaucuuuuucuccugcacaucuuauuggcaguccaaauugugggucuaugauuuugugacuggguugguguuccaaucccuccaucggaagucuugcuggcuacaggagauagccaguucaggcuccauagccccauugcuaggagucuuagcaaucauccuccuagauucuugagaguuuccauuuuccuagcuuguccuagagacgccaccucccacccccaauccaguugucuuuucuaguacucucuuccucuguccuucccccaucucuuccuuccuguucccaucccuccccgcucccccauccuguucccucccucuauccacuccuaauguuuaauuucuuuccauuucucaaugagauucaagcauuccccacuccaaccccuuugggcccucguucuuacuuagcuucuuugagucuguagcacuuagcucuugucggaaucuuuacaccacaaaaggcuuuugaaaccuaggaaguguuaucuuucucuugaguucucacuucagagcagugcugccacuaagcuuguccaagcaaacgcuguccuuuccuuagucuuuguagcugcuaucugaagggaaaaucaguuuuucuggaaguagcacgcacugugcugccagugguguucacugccacugccaugguauugcucugguugcuagacuggcuuccucuaagguacccuggaacuucuaggagcuucaagaggcccagagggaaaagucagacaacuaacugagguauugauuggcuuguucuuucugucuuagaaaggagucagcaaaguggcgagugagaaggagccuuggaugcgagcggugguaguuguuucauuucugugcucgaaaaaugcuaacaggcaguuacugagcuagaauggccaacugcucaaugagcucuuugugggugccuggggagccagauucugaagaacuaaauagaugccucugggagaggcggcaugucuuaauaguuaguagaauaguuugcaaagguagggaaucaucuugguccaucuccacaagugcauggacacccaucaucaguagaggaucauggcugaguccuguacgaagauccugcauaaaugauagcugaggccagacucagagggggcugacguggcugcugccauaccagaacagagcagcaaugcucacaguuguuacuuggggagaggacucagcacuccaacacucccccuuucccgacaggacccucucuucaauuccuguucucucugcccugguacuguugccacagcucacaggagucuccuuucuucuuaaguuccaaccaugcccauucugguucuuuuaucugaaaggagauuugccaaccuguucaaggcacacuucauuucugauuugguuguugguaagggccccauggagucugcugucagcauucugccaaccaggaacauaaauguguuaccuaaucuagagagggaagguaggugccugugucaacaggaccaugcugugugcauugcuggcagaggguccuggggaagugagaggacuggaagguacccugccagcacagcucuucaaggugcagcauuagcaugccuugaaacuggucaacaccugcugucuccuguccuucucccuccacuucaccuucugauguggcugcauaaccacaaccaggggauccagagaagggaggagagaacacugaggggugcugcagaccuuagggggccagugaauagguuucagggagcagcucauuuaaugggaggaacaaaggcauuuuaaaccuuugagccagaguagaggcugugagauggguguacagcauugacuggggccagguggucaucugcauagggaggaguuccaggaccuugcuggacaaggagagagcgaguuuaaccuggugacuucucuggugugggcaaaggucggggugcaggaccacgucugaggcuggugagggaguggucuuacuucuaccacucucaagaugagauuuccaggguuggacaccacuugccccugcuccugcuccugcuccugaccggccccucccuguaccaugguuuacuggccccacagugucucacucuuguuccuuaaaguuucugaacucuaaaucuuccucauucuagaaacaaaacaaguuagguucuuugaagugagauaaguugugauuuuggagcuuuugacauacgcugaguucccuaagcucacagccuucuccaugaggaauuuccuuggaagaagcagcuuucauguugacgcuucuuucaauaacccaagugguuuaaguuguaggugucuggacuauucugcacaucgauguacccaguuuccuaaacaacaagacaagagcuuacauuucccaacaacuggcuuaaucacugcaaagugccauuaguugaccacugacuaauuguacuggugccuacuguaaguuaccucuaaauucaucagagugauaaaaugcuccugacagcuggacugcugcuauaaaaaccagaagauccugggcagaugucauacagacccuaaaagaacacaaaugucagcccaggcuauuauacccagcaaaacucucaauuaccauugauggaaaaaccaagguauuccaugacaaaaccaaaauacacaguaucuuuccacaaaucuagcccuucaaaggcuaauaaagggaaaacuccaacacauagagggaaacugcacccuagaaaaagcaagaacguaaucuuucaacaaaacuaaaagaagauagccacaugaacagaauccuaacucuaacaacaaaaauaacaggaagcaacaaugacuuuuccuuaauaucucuuaauaucaaauggacucaauuccccaauaaaaagacauagacuaacagacugguuauguaaacaggacccaucauuuugcugcauacaggaaacucagcucagccacaaacacagacacuaccucagaguaaaaggcuggaaaauaauuuuccaagcgaaugguuccaagaaguaggguggaguagccuuucuaauacugaauaaaauugacuuccaaccuaaaguuaucaaaaaagauaaggaggggcacuucauacucauuaaagguaaaaucuaccaagaacaacucucaauucugaacaucuaugcuccaaaugcaagggcacccacauucauaauagaaacuuuaccuaagcucaaagcauauguugcaccacacauaauaauagugggagacuuuaacaccccacucucaucaucauuuuuauaguuucuggcaaggagucugguauaauucugauaagucugccuuuacauguuacuugaucuuuuucccuuacugcuuuuaguauucuuucuuuguuuuguacauuugguguuuugauuacuaugugacgggaggaauuucuuuucugguccaaacuauuuggaauucuguacacuucuuguuuguucauggcaucuuuuucuuuagguuagaaaaguuuucuucuauaauuuuguugaagauauuuacuggcccuuucaguuggaaaucuccacucuuuucuauaccuauuaucuuuagguuuagucuucucauuguguccuagauuuucuggauauuuugaguuaggaucuguacuggcuaguuugugucaacuugacacagcuggaguuaucacagagaaaggagcuucaguugaggaaaugcuuccaugagaucuaacuguaaggcauucucucaauuagugaucaagagggaaaggccccuugugggugggaccaucucugggcuaguagucuuagguucuauaagagagcaggcugagcaagccagaggaggcaagccaguaaagaacaucccuccauggccucugcaucagcuccugcuuccugaccugcuugaguuccaguccugacuuccuuuggugaugaacagcaguauggaaguguaagcugaauaaacccuuuccuccccaacuugcuucuuggucaugauguuugugcaggaauagaaacccugacuaagacaggaucuuuuugcauuuuguauuuucuuugauuguugugugaauguuuucuaugguaucuucugcaccugagauucucucuucuaucucuuguauucuguuggugauguuugcaucuuugucuccugacuucuuucccagauuuucuauuucuagaguugucucccuuugugauuucuuuauuguuuuuacuuccauuuuuagacccuggaugguuuuguucaauuccuucaccuguuuaucuguguucuccuguaauucuuuaagggauuuuuguguuuccucuuuaagggcuucuaucuguuugucuguguucuccuguauuucuuuaagggaguuuuuuauguccuucuuaaaauccucuaucagaaucaugagauauaauuuuaaauccaaaucuugcuuuucugguguuuugggauauccaggacuugcugucguggaaguacugaguucuaaaugaugccagguagucuugguuucuguugguaagauucuugcauuugccuuuugccaucugguaaucucugguguuagauguucuugcugucuuuggcuggaacuuguuccugcugugggucgguaagccuuugucagcacuccugggagaccagcucucuccuggcaagaccagugcacagaggacuauggaacagccccaccuccugggugcagauagaggcaagaaggauccugucccagcugcucugccacuucugcuguuuuuccccuuuuuaauauugacuuuuauucaauuugcaggugauugaagcaaaccuaaagggagaauuaaaccuaaagauagaaacugaguuagugugugugacuacucauuuuaaggaucuugaaaacccucuauuacgugaguuuucuuaugguuuauauuuugcuucuaauaaauuuguuucuuauauauuaaguucucaaugaacacauugaagcuugauuuucuuuguuucccauuugagaaggggcuuagauuagacucccugucccugugacacaguagugcaguuagcacccggcaaggggccagguugccagacagaaggugcagaagggugcuucccuccucugggauucugguuaaaacagugauuucuaagaacuuaauagcccuucaucugucacugugcccugagaaguugagcuucucaucagggcuggagucacaaguugugucuuuuuuucucuggucaguucaacuauuuuuuccuucaaguuuagguuggcagauacaaaauaugguacagauauacuuggugacacuuuucaucucauaaaggccagaaaggaaugugggaucaguucaguaagccuugaagggagggcugguuguauaucuuagugagcaguaagcucacuguagaauccuguccuuaaguagagaaguagccagaggaccagaagaaaagugucuggaauaaugggagccauuuucugauauccauguguccagaucagaugacuccaugaccuuuagaggaugauugguuauuccagguuugcuuccacauaagcaccaauauuacuacuagcccugcaagaaacauuuacuuuguagugaggggcacauuguuccaggaaagugaaguccauugcaugaagcuucugacaaagggaugugaaugaccuugguuugcuuggugugguguguguuuguucauaauacauauugagucgauggccucagcaugcuagggaagugaucaaccccugagcuaccuccccagccccgacaugaguuauuuuggugucaaauuacaguauuguaacuaguucaaauaucugcugaagaggauugccuuaucgggcauugcuaggaggggagccucuugguccugugaaggcucaaugacccaggguaugggaaacuagggugcugaggcaggagugggugggcgggugggggaggacccucgugaaggcaggaggagaggggaggggacaggggaauuguggaggggaaacugggaugggggauaacauuugaaauguaaauaaauaaaauaaccaaaaaaaaaaaaugucuacugaaugaguaacauucacaaauugcagucuaucaggcugcuaaaaagaacuguagggucucucaguuaguaaguaagcacgcuuugcacauuucugaguuccuuguuauaggacuguuggacuuaacaaaccauucaugucauugcagccucugacagugucucucaaaacagacacccagaagacauggccaaggugcacauugacauaaagaaacuccuccaguuucuugccggacagcaagugacucccaccaaggcagugugcagugaguuugcuucuccauuauccaccuccuuuguccuacauaugcaaguaugcccaguucuggcaaucgagcugccugagacagucaggcuugaaaggucccuugagccagagguaucuagagaugcugaggaagagugaugcugagcaguguagagccagaaagccaguagccaugcuagaguggcagugggcuguagccugccucucucagcccugggcucucccugugugcugucaggacagggcagacugacucccagccgcugagucuaucagguuucccauaaucagaguccugcacacacuugugcacauacacuugugcugaucugcaucucaccugaagcucgucccuuuccuugcccauccacguucacacaccgaagucuccuccucaguuguuucuuacucauuggugggucuggcucugacugagguuccacacugcucugcuccuccuugccugcucaccccacugagcuaggcagcuccucaagagcuucucgaagcucugugucuccuugguuuuguguuuguuuuuguuguuuuaaagaaaggcacagcaaauggccugaaugugacauccuucucuuuauggaaaacacccaaguggaccucucauccguuagucgacaaggcugaagaagaugaccugagacuagaccauauaauaauaaaacagaaaguucugaguagcucugucaaggaccagccuuccuaaaugacaaaaaagaaaggaugugucccaguuaggguuaccguuguugucaugaaacaccaugaccaaaagcagcuuagagaggaaaggguuuauuuggcuuacacuuccacggcacuguucaucaucgcagaaagccagggcaagaaccuagaagccggagcugaugcagaggccgcagaggaguggcuuccuccuuacagcuugcuuagccugcuuucuuacggauaccaggagcccagugguggcaguacccacaguggucuaggugcucacccaucaauuacuaauuaauugccuacagcccuaucuuauggagacauuuucucaacugaggcucccuccucucugaugucuagccuauaucaaauuuacaugaagcuagccaacacaaaaugagaaaccacaggccgggcgugguggcacaagccuaaagcacuuuaaucccagcacuugggaagcagaggcaggcggauuucugaguucgaggccagccuggucuacagagugaguuccagggcagccagggcuacacagagaaacccugucucgaaaaaaaccaaaaaaaaaaaaaaaagagagaaaccacaaggagacuguaugagaggcuaugggaucagaacacagggaagaguuucaugguuugucguauagcuuucgcccugugcacagggacacaaacauucagaccuugcccauauacuuuggucaccucacugugaauacaugcuuuuaccaggaaggcuaaauugguuaagucgaccugauuuuuuccccuagagccugggcaguuucauucuucaccucucacucuguucccaguggguggcaguggcaugugcugugccccucaggagcccucggaggaaacagacaccagacauaagcggugcuuaugcagaucagccuuuucagcucuaacuaggugucaugagguggugggggcgaggaucugucuuuaacauuugggucuucuccuucuagauauugugaauaacagaacuguucauuuugauuugcuccuggaagacgucucccuucaguauuucaucccagccuuguccuagcaccgucucagcagacucaggagcacagagaccuuugucacuaugagagaagcacuggacgauauggucagucagcugccuauccgcacaucuguacuuggcuuauuucgcucccuaugcugcuuuaagcacaaauggaauuaaugaagcacaguugaauagucacuccuucaaauuacucaauaccaauccccuuaucucuuuuaagacauuaagaagaaaagaauguauuuuuuauagaguuuuuguuguuuuguuuucuucuggugccggagaugagaccagggcgucaugcauacugagcacgcacucugccacugagcugcuccccaccccuaucuaaaauuugaguagcaguuugucaaugacguugcaaaaauuauauguguagaauucauguugcagucaguacaacccagguaguuuccaguucguugccugguauaacacagcugucugcuuucagaguuuagcaugcucauuucucccauccacacaucuaggagaucagugcgaaacggacagccccucugucccugcagcaugccaggcucucaccacacuguugaguauacagcuacugcauguggagccugugugauuuacugaagauucgaguccacucacuuccuucucgcggccugcagagccagagagccugaggaaccugcagagcucccagccuggagaaacugggucccugagagccuaaaggacccacaaaccuacccccagcccacacaguucccaucuugaacuuguccuuuuuguauuuucugguuuuagguuauaauuuaauucccuguuuuguagcacucaggucaagcccaggacuggguucaugcuaggcaggcacugugugccaaacucuaucuccaguccuuuauaucguaauuuuguauaaugcuuccacagugucagaucuacccuucuguaaggaacguuguuuuguguaaagcagucgaagcucggcugucugucauaucugugacgugcugaggguguguccugcuccuggauuggagcugccucacccuaaacagugacuucccauucuccaaaaacaccauuacccgguuuucagcucuaacuaggugucaugagguggcaucauaaacagaguuuucacgucacaaagucaaggccuaaguugccuaggauaagaucuuaaaagaaaaaagaaaauuaaacaaaaagaacauuucauuuuuggcuuuuucaaauuauuaaggaaaaguagcauuucucaauggcuuuuaggauuauucauuguaguuuccauuuuuacuagaaagguucuuguguaagccaagcugaacucagaugagcuguacauagauuguccuggaacucccaagcuccuauccuguuccuaaguguuguuaugacagauaugagccaucacaccacuggcucugcugcuauuuaauaauaagacauauuuaauuaaacuaauauuuuaaaauuagggauucuuuaaucguuaauacuuguaacaaaaauaaaucaaaaucaugaugcagauggaauuucaggagacucccuacaccuuguuccuuaggcuugucuuucugccgaaaguaccagaaccucacuagucaccaauuucaccacugugccgcauaccugaugccaguaacuuuacagugaccuaacguugggggagaacaagcuuccauuggcagucaagggauguggucucucugguucuugccacaacuuucugcguaguguuccuuucauagcuuaugucucaaggagcuguagucaagggagggagcugagaaagccagguuaggagaacugggagcugcuuugugaaaccccauccugagguggagacugagaccagagacauuuuacuguguguugucugcaguuuggagauggacuuucacuuacuaugacugccuaaaacucugagguuuggagaguacuuccauacauaugagagccgguaagcuacccccugaccuugccugccagggcuuagaacccacauuccugguaacuugucuugaacugagauuuuaagacuguccugagagagucaggaaugcagaagaauuccuaaugcagucacuuaagccaguguccaagugggcuuguuauccuguggccuaccuugguucagcaggcaccuuccuacccaucaucaggucuccaggcugagucuguccugcugugcaucuugccacagagaaucgugcucuuggaagucugaaaagcaguucaacauuaguucuggggcgggaauucugguucuuccaccaggagcaguggcugaugacauucuugguaaacgucacccaauuaguggaguacccuuuguuuuuaagagauguaauucuguacuuuuuaauuuuaaagauuuugcuggguuaucagagcguacaagcuggaggauuguuagaugguugaggguucuauggcugucacuccauccacaguuguuccucaccuuucacucugugccuucccucuugggcaccugguuaucucucucaguuucuauacuuaccugcucuacacagcuuuuuaaccuccucccaagacgcccaggccucugaaaccaccauuccuuacuacagcuaggagggccuggugcucuugacucugguaaucagaaucugcaaucugcaugucaaauguauacuggucccagccuuugcaccucggcuucugcccauguccauccuuguauaguaaaucugucuagaaacgcugucuuccugcaggcccugcagccacugcaaagcuugacggccuugccauuucuacaagggugcucucccagcagucacacuuugauugcugugaggcacauccuggauuguauuuaaauggccuggguaggcuagcgcugcucugcucacacugucucaugugaacagaccagaacagacuccuauacaaagucucauaauguggggaagccaaaugccagcuccugucuauuuccaccguggagucaaauacagggaauuucucaguguguggucuaugagcugcauagagcagcuuuguaauuacccuggcugucuguucaugguuuugcauuucucugugacccaauggguuucacagcuucacuccaaaauuuggagaauucaggguagucgucuuguugcuggaaaguuaguaguuggaauuauguggugacacacuccaguucugugcuuuuguguggauucugauggagagucuaaagggagcaugaguuggucauuuuucuucuaaaaacaguguuaaacuaagagaugauaaauuagaaucauuuggacauugaugguaggagggguguuaguaccaauguccugaaggucacuuggcuauuuacuauccgugggaaagcuugaaacugcuuccuuugacuuaauacuuaugcuuguaagagucauuuaacacagguuauaaucaaagcuuaguacuguuauaaauaagaaauuuccuaaugugaaugaacagggaauugguagauaaucugugcugugauguaauaucauacccuaaugcaauacaauaaagugcugcuaauaugguaacaaaccagugggauguugguguccauggugugacauuaaagaccaggaagccuggguguuuuugacuucagucuuuuuauauuuguguauuuucuaacaauuucacaaccaacauuguaaugacaauauuuuuauagaaugaaauaaauauuuauaauuuaacuauuac

SEQ ID NO: 5883 - RNA, 1192 nt, Mus musculus
cagaaugguggaggagaugguuuuuuuuuuuuuuuuuuuuuuuuauguugugcucuuuauugccaaaaauaaaaacuuuuaaaaagacaacuacuguugaucaauaaauauuccuuuuuuuccgugcugguguguguuuccccccaugcugccugaaagccacuacaguagggcccgggaugcucaacgcuuaauaaaaccugccaugucuaacaccagugggacccuggccaucuccccgauggccuuccagggggcagacugugcagggcauagcccagaaacuacaagggcucccgaggccugaaguccagccaccgugaaccuagucuuuggaggcaggcgagccguggcuaguuuauggugagcacgucacucuggaucucauggcuuaacugagucuguaaaucacucagcuucuucuuuagccccgacagggcugagaggacaaugguuucagggcgcagugagccacacgacuccacauuguaguaaaaccucucuggcuugccguuggggucauagggagccugcgacucauccucauccagauuggaauacucacucuugggccauuccucaggcuugggauacacuguaugccgaagugcguugucuggaucguauucaaaagcuacccccgcaguaggguauguuccuugccaaagcccuucuuggcauaggcucgaagucucagcuccugccccuuccucagcuugacaauaaggaugucauccugcuucacauagucauuagggucguuaucccgguuccgagaugucaccggaauaacccgggggcuguuggagaugagaucucgggaggugacauggcgcgucuggucuucauugcaccucacaucgagagugaacuccacagaacacucagggcagaacucuucacaugugcagucccgggaguacugcagcuuguccacaaugucaucacuagugagggggauuaaaccaagccugugcgcgaugaauucaucaugaaggaccgaggaguuggcaucaaucugaacccguagucgauggcuauuaugggcaccucugcgaugaagacccuccgaauggaauuggccaccgccagguccguguucucgauaaugaacuugacguucucuucggugaguuccgugauccgcacuguuggcugguuggcuuacggcaucgcgacccuccgccaggcu

SEQ ID NO: 5884 - RNA, 1233 nt, Mus musculus
aguauugucuuugaauagcuucaaaaucugacugcuugcauauucuaaaaacuaaaauagcuaaaacuugaaaaaaaaauuuuaccccaugucaugaaguaauuaugcuucauugcuccucuuccuggaauuaaguuucuuuuuccccuaggauggacuuucugguuugucuuacuucccuucuugccaaaaaaauauuuucccuguaaccauggcauuucuuuucauccugcucauucuacuuggucuaaugaggcuugacugacauuucaacauucuucccauuguaccugagacuuuuccuaugagaacuauaaguuuuuuaaauccugaaagaaugccaaggaugguguugggggaguucaggugaggccaaguacauacggcuucuguuuaaaguguuccccuuugagagcucucucagaguuuucagauuuggugaaagcucuaaaccagcagaugaugccuucugucuccacaagggacaucucagggccuacuuccccugaaguacaacucaccaaggccuuugcuugugugcaggggagccagcccacaugcuaaggucucuggugucaugugcugccugaaaguggaauuuucagcuccaucaucaaaaugaggagggcauuugcccauuggaacucugucagugugaggguuuggaaggaaugcugagaguguuguguuucuagaagugacauuacccaaagcuuuguccagucucaggcaagaaucuucuguaccuuuccuuggucauauguaguugaauguaaaguagaaauaagaagauggauggauggauggauggauggaauagauagagauagauagauagauagauagauagauagauagauagauagauaggauggauagauagaagauagauaggagggagacagggaaagaaagggauggaugaguagaugggauggauagauagauagauagauagauagauagauagauagauagacagacagacagacagacagacagacagacagacagacagauagaauaauagauuucacuggggcacuggaggcuuuuauagcuuuuaauuuuucacauuuggguagagaaauucuacagguagauuugucacgccaugcucaucuggaauguauauugcuuucuuugcaacacccacuucuugaagcagcaggcuucagugguugcuuagaaaaccacagaaccacagcucuggggagaaacaggaaaguacca

SEQ ID NO: 5885 - RNA, 21660 nt, Mus musculus
acccaaauucccgcguuaaggccugggcggugaccucaggccuuccgagacuccgcccucacgcugcgugcagcgcgcgcucagccgcccuuacucuacacgcaugcgcaacgcgggccgagccgucacuucgcgcaggcgcacuucgaaaggcgcgcuuuucgguggcugcggucccggcagggagcacaggugggccccgguaggcugcuguucgccgcuaagccggcgggcggaggcugugguugccaugccggguguacuuugguuuuguuuucuucuguccguucuuggccucggguugucggagaggguggccuugggaagcccgcggccagacggcggcuggggcugagggacgccguugggcgugacgguuuggggucagucagccacagcuaccccccgcuaggacugcugggaaugcuguagcugguuugccaccuaaauguacucauuuugaguuucgugcuuucggcaauacuaacacaggugaauuuucuccgaaaaucagaaaugcuccagcaucugaacuugacgccuaaaauaacauccucaucaugaaacuuuuuuuuuuuuuuuaaauucauuccugcucagaaaauaguaucuacaguuaaccgucugguuauguagcuaauguauauuuuaaguauacgugaguuguauuuagaauggaguccccuaccugauguaugugucaauaccuagaaaucagacacacuccugaccccgagcaguuggacuaaagauacuuuucaguugugauaacugguuccaggccauacgcagucgcuacggccugaggggggaaccuuccaaagggaagaaauaauaauucauaaucuaucauauuucuaaguucuggggacccuauaaugcaacaaccugucagcuaaauaauggugcacgcuguuucuccccaggugacgacauagcuuaagagauauucucagagucacugcugaaagaacagauuauguauucagaauucagggccugggaaauggcuuagugggucaaagcugccgaaccugaggaccugaaucccuaagaacuguccugguaaaaagagaaaauucaguuccugcaaguugcucucagacuuccccaauuuauuacaauuaauuaaaacuuuuauguccagugucuaaagcuaggucuuacagcuucagauccuguguucuaaauuccuaugcuacuuugccacuaguaaacuagaguucuguaaaguucaaaaaugaugucuggaauauaguaggcccuccaguuuuuaaucauuuuaguggauaccaugaacuacguacuaaagaaaaucuaaauacaaugagaaguaguucuuguuugcagaagcuuccugucuaguuugaaugaccaaaacauucuuaaucagaaaauuaacaaaguaaagaaaauugaaauguaacucgguugcccauacuuuauagauuucuaucaagcacaaagguuaaaaugacuuagaaguguuagauaauacggucaguacuugugucauugagcaacagacuguuuuggguuguauguaguugugggauaugacugacuggaaaggaaggaaaacuuggucgauaacuucuaaauacaaagauggugguggaagaggacaguuuuuggagaaugacuagaauaggugauuuuaggugauagacugaaaugaagcuauaaagauaauuauaaucauugcgaaccuuuguggaggauauuuuccaaguuacuucuccuucagguucuuuuuuuuuuugagacaggguuucucuguguaacccuggcuguccuggaacucacucuguagaccaggcuggccucgaacucagaaauccaccugccucugccucugccucccgagugcugggauucaaggcgugcgccaccaugccuggcuuccuucagguucuuauuucugguguuguauaauggagaguaaaauaagguuaaagcagaugaaagcagggcuacuuacuugccucagaacuguugauccaguuucaauuuaaguaacaguuugacuagauguuaaguuucccauuauuauaagcagagauguaugcuuaccuacuuauaaugugguaaauuuuuuccacagcauugucagagauaauagcuauauuaaccaggagugguuacccuuuuacucccggugcuucagaggcagaaacaggugaaucucagaaacaggugagguugaggccagccuggucuacagagugaguuccagggcagccaggguacacagaguaacccuuucucaaaaaccuaccaccaucaccaccaucaaagcuguauuaaauauagcucacauagaaaguauugauuauuuagcuguacuuccagauaaauagaaauuaaauuuaaaauguagauauucuuuugcuuuaucauaguucuuagggaaccaaaugguuuucuuaaaauuuuuucaucuuaguaucuaggcaaaaaguuguacauuacaaaaguaguuuuuucauuauuuagugguagguugggcacauuugugucaagcugugcauguggauggcaggggacugcuuucaggaaccacguaggccugagaacuuaacuuggcaggccugugcuaagcucucuccuuggccccauuguauauuucccuaagauucuuuacaacaaugugaaggggcuuaugagacuaucucaggaaaaaucugaaauaaaaccccuaucuaguagacuauuuggcuuauucuuagaguuuauuuuuuauagguuuuaauuuuuaacacugagaaaugggggaaaauuuggaagauuugugccaucauguuucaaguguuuauucacgauaaaucauuaaagauaugaaacaugucaccaucuuucuguuccaugcagcucauccugugcugauaacaucgagaaguguucagugccugguaaaguacauagaccuugcuucacuuggaacucggccuugauuucugccguuggucauaaucagcagaguucucucuagugagucaguucuuuaacucucucagcucaauuuccacauuuguauagcagggguacaagucuucaaaucauuuucauaaucaccugauuugauucucacaaugguuccuucagaaaaauaugaacauccaaaaauuguaaguggcuugcauaauauuaucugauuuuucuuagaaaacagccuuaagauuuaaaguuucauuauggcaucuucauacuuaguuuugaccuguuccccucagugcugccuccuacccaccuacccuuucccuuguuccuucccucacuagccccucuugccuuccuguuaccugucccauugcccuauuucccuccucccuaaggaugucuaccuccucucaugaccaccuuuuguuuccauggucuacaaaauacauacguaaaugcacacacacacacaacacacacacacacacaauuucuaacgcuuuguaccuucuuauuacgugagucauugcucuauuucucaacuuccuaaaaaucacaaccucuucucaugauccccuucuaguucugaccuacaaacacauauaaauguguaugcacauaaaaucucuaaaucuagauuuugcauucugaaugucuuauuuugcauagcguaagauuuucaguugcauugauuuacugcaaaugucaggauuucauuuuucuuucuuuuuuuuuuuuuuuuuaugguuuucgaggcaggguuucucuguauagcucuggcuguccuggaacucacuuuguagaccaggcuggccucgaacucagaaauccgccugccucugccucccgagugcugggauuaaaggcgugcgccaccacgcccggcucauuuuucuuuuugacugcauagaacuucauuauguauuuauaugucaucauugauguacauugaaguuguuuuguuuuauggcugcuguaaguacuauaguuauaaacauggauacacuagcauuucuguggugcguggacuuagaauucuuggaguauauacccaagaguacaauauucaguuuuuuuugagcagcauuuacauugauuuuucuaguggccaaacaaauuagcauuuccacccccagggaauaaggguuucucuuucccuauauccuugacagcauuuguuuuguugaugacaacuauucugacugggaaauagaaucucaaggcaguuuuaauuugcauuuccccaugacuaagaauguugaacacuugugcaaguauuuauuagcuguauuucuuuugagaacugguuaguucauuagcacaguuuuugauuggaagauugagggaucguuuuuucaguuuuuuauauauucagaaggguaugugugugugugugugcuaaugaguguguacauuguggccaaaagaaggugucagauccucuagagcuggagucacgggugguugugaguagucaugugguugcccuguccucuacaagaacagcaagugcucuuaacugcugagccaucucuccagccgccuucacauuuuuguagaaucuuguaacuggucuggggucauagcuuagucuuagugaagugcuugcuguacaagcauaaaaaugaaaguuugauccccagagccuauauaagauaucuggcugggaggugguggcacacgccuuuaaucccagcacuugggaggcagaggcagacggauuucugaguucuaggccagccuggcauacagagugagucucaggacagccagggcuacacagagaaacccugucuugaaaacaaaacaaaacaaaacaaaacaaaaaaagaaaucuggacaggaaauaugguggcacauacuuguaaucaugcuguggaggacaggcugguccuugguguuuacuguccaaucaaccuguagccuacuuggugagcucccauucagggagagaccugucuccaaaaccagaguggacagugcuugaggaaucaucuucuccaccccacaggaggauauuuugguucucuuguauuuaguaagacaugauaaauggcuuaaaaagugagaguuuauaggaaauucuguuggcugccgagaagacuguuuucccuguuagauacaguagccuguaaguauuuguugagucuguuuaaucucugguguugguuaagucugaaguuucuuuguugauuuguuuggaugaccauucucaugagaaugggaaauugaaccauuaauuaauuuuaagucuuuuugugcauauuauuuuuuuuaaaaaagauuuauuuauuauuauacauaaacauagcugucuucaaacacgccaagaagagggaaucagaucucauuacggaugguugugagccaccaugucucggacuugaacucgggaccucuggaagagcguuagugcucuuaacugcugagccaucuuuccgccccugugcauauucuuguacauacaccuguguguggaggccgaguauccauauugggugucuccuguuaccugucacuuaauaaauccuucccuucuuuaaguuauuuaugaaagcuuuuggacagagucucauguaucccaaauuggcuuuaaacuuaccauguagcugaagguggugaccuugaacuucucuugcugaaucuaccacccaagugcuaggauuauaggcauguauaguuauauccagugugugugugcuagggaucaaacacuaggguucaggcauguuaguaagcagucuaccaacugcaucacauuucccaaguccuuucuuugguuaccuuuaaguccuuucuguuuaaacccaugaauaguuucucuguaggaaaauaacuuuauaaguaaaacaguuuagcaucuaugaaaucauuugguuguccuuaaucuugaagacuguaucauuguaucuuugugucacgaguacuugaaauauaugauuagcuagauguuucuuugacaaauaaucugucuuuauaaaugaaccuuauaaauuuuauuguacuuuuuuuuuaguggagaguuuuauacuuuuguuuucuucuugauacugauuugccuucaauuuugucuuguguuauagaaccuuugacauggagacguccagcuccaugucuguggagacgacuaggucugugcagguggacgaauggcagaagaauuacugugugguuacauccagcauauguacaccaaagcagaaggccgaugcauaccgugcacuacuacugcauauucaguaugcauaugccaacuccgagaucucucaggucuuugcuaccaaccuguucaaaagguauacagaaaaauacucugcaauuauugauucugacaauguuguaacuggcuugaauaacuaugcagagagcauuuuugcuuuggcaggaucucgacaggcugacaguaacaaguggcagucuggauugucaauagauaauguuuucaaaaugaguuguguacaggagaugaugcaggcuggcaagaaauuugaagagucucuguuggaaccugcugaugcaucaguaguccuguguaaagagcccaccgccuuugagguuccucagcuuaguguuuguggagguucugaagacgcugacauauuauccaguucaggucaugacacagauaagacccaagccauuccagggagcagucugagauguuccccuuuucagagugcucggcugccuaaggaaacuaauaccacuaagacaugccucaccuccucaacaucuuuaggugagucagccacugcagcauuucacaugacaccauuauuuggaaacaccgaaaaggacacucaaagcuuuccuaaaaccagcacaggacuaaauauguucuuaucuaaucugucuuguguuccuucuggcugugaaaacccucaagaaaggaaggcuuuuaaugacucugacaucauugacauacuuuccaauccaacacugaacaaggcuccuaguaaaacagaagacagaggccgaagggaagauaauagccugccuaccuuuaaaacugcaaaagaacaauuauggguagaucaaaagaaaaagggccaucaaucccagcauacaucuaaaucuucuaaugguguuaugaaaaagucucugggagcugggaggucgagagggauauuuggcaaguuuguuccuccuguaucuaauaagcaagacggaagugagcagcaugccaagaagcacaagucuaguagggcagggucugcagaaccagcacaccucacugaugauugucugaagaacguggagccaaggaugguugaacuuauuaugaaugaaauuauggaccaugggccuccaguacauugggacgauauugcuggaguagaauuugccaaagccacaauaaaggaaaucguuguguggcccaugaugaggccagauaucuuuacuggauugcgagggcccccuaaaggaauucugcucuuuggcccuccagggacugguaaaacucugauuggcaagugcauugcuagccagucuggagcaacauucuucagcaucucugcuucaucguugacuucuaaguggguaggugagggagaaaaaaugguccgugcacuguuugcuguugccaggugucagcagccagcugucauauuuauugaugaaauugauucuuuauugucucaacgaggagauggugaacaugaaucuucaagaaggauaaaaacggaauuuuuaguucaguuagauggagcaaccacaucuucugaagaccggauucuuguggugggagcuacaaaucggccccaagagauugaugaagcugcccggagaagauuggugaaaagacuuuauauuccccucccagaagcuucagccaggaaacagauaguagguaaucuaaugucuaaggagcaauguugucucagugaugaagaaacugaucugguagugcagcagucugauggguuuucuggcgcagauaugacacagcuuugcagagaggcuucucuugguccuauucgcaguuugcacgcugcugacauugcuaccauaaguccagaucaaguucgaccaauagcuuauauugauuuugaaaaugcuuuuaaaacugugcgaccuacuguaucuccaaaagacuuggagcuuuaugaaaacuggaaugaaacauuugguuguggaaagugaauauagcgauugaaaggagaagcuguuaucuaguagucgucuuuaccuuuagccucggaagcuugcugugcuacuuguauuguuuuggaguauauccugaauucugugccucagauuagaaugauaacagcuugacuacugacugauauauuaguauguuguauuugccuuccaguuauauaauauauaaacucauuucauuuaaauagaaugaccuuuuguuucuaagugaauucaaauuagaacuuuagucugguaauaauaaacuuuguuaguguaguauuauuauugcuuacauuugaaacagcauugcauucuugacuuagaguuaagaucuuaccaaaagcuagagugaaagcaacagggaguaaacuaccguaacccgugcuggcuuguaacuuguuuugugggcuuuuuuucuauuaaaauuaacuaauaaaaacauguuagaaauagcaagauguaaucuuguaucaggcauguagccugccucaaaagauaaguguggcuuuuuucaagggaucuggaaaguuuucuauuauuguuuugucugauaauucuuaagagccuauuucaaacuaaauauuuuuaaauuaaagagaauaaaaguuguuaguuuguuaccauuuugacggaguugcuucauuuugcuauaacuucaaauuauuuguuuuaaacaguccuguauacaacauauauguauaugauuuuacuaugcuuuuguagucuguuuguuuuuccccuucaacugguaugcagccaugguggcaugaagcauucucccugcaugaguuuccacacagcagugauauugcgggucugugccaccaugcacaguuagccagcuccuuugcuuuaaaguucagcaucauuuugagugcuaucguaaaugacuacagaaaucuuccuuuacauccuguuuuguuugguucuagauuuaacacaggaguugauacauuucuuuugugaauaugacaacaugagaugaaauuugaaauauuuuuuguaacuuaaaaaaaaaagauuuauuuauuugggagcuggagagauagcaauuaagagcacuuccagagguccugaguuuaacucccagcaaccacaugguaguucacaccaucucuaaugggauccaaugcccucuucuggugugccugaagacagcuacaguguacucauauuaaauaaauaaauaacauuauuuuauuauaugaguguucaaucuauauguacuccugcaugccagaagaggacaucagaucauauuguagaugguuaugagccacaaugugguugcugggaauugaagucaggaccucuggaagagcagacagugcucuuaauugcugagacauuuuuuuuagcucuggaauuugaaacaccuuuuuuuuuuuuuuuuuuuuuggauuuuuuuguuuuuugagacaagguuucucuguguagcccuggcuguccuggaacucacucuauacaccaggauggccuagaacucagaaauccgccugccucugccucacaggugcugccaucaaaggcgugcaccaccaccgccuggcuugaaacacuuuuaaugagugaauuuaaaaaguuuauacuucguuguggcuuacagccaccuauaacuuaacuuacuggggauccagugcccucaugacuacagcagacaucagguagaaugguacacauguauacauucagaugaaaaaagagaaucaauagauuuuauuuacacauaaaaucuaauuuuuuuuaaaguuugugcuuugguauaguguauauuguuauuuuucaucuaccuuuuauuuauacauugucgcuuuaaaacauuuugcagauuuccccuuugaaauacaugaaugucacauuagaacuuaagcuacuauuuuuaguuuuuaauuuuuauuuauuuuuuuucgagucaggguuucucuguguagcccuagcugucuuggaacucacucuguacaucaggcugaucuucaaauucagagaucugucugccaagugcugggauuaaaaguuuuuuaaccuuucuuuuuacuuucugcauauggguguuuugccuguauguauguccguacaccauuugcauguagugaucacagaggccagaagaaggugucauaucccuugggacuagaguuacaauuaugagcugucaugugggugcuggaaaugaagccaaggucuucuacaagagccucucaaucacugagcuccuucuccucuucuaacaucuuaaaacaucuccuaauaucccaaacuuuauccaugauaggacuugaauaugcagagugccucacaggcucuuaugcucaaucauaguggugcuauuuuggaagguuacagaaacuuuaaagagguaagacuuauuuauaauaaguaggucauugggguucuauccuuggguucugcuuccuuugugugaagacuccccugccacaggcucugcugccaauucaucuugaacacaaccuucugaaacagaacccaaaagaaucuuucuucugugaagcuucuaucagaguuaguuacagugaaaaauagcugagcccuuuacaauauagcccuguaugauuucuguauaaagauacuggaaacuuggauccuuagguauuaauaagaaggaauuucuuuucuuuucuuuuuuucuuuuuuuugguuuuuugagacaggguuucucuguguagcccuggcuguccuggaacucacuuuguagaccaggcuggccucgaacucagaaaucugccugccucugccucccgagugcugggauuaaaggcgugugccaccacgcccggcuaaauacaguuuuucuuaucuggagcuuacucucuuuagaggucacuuggaucuuaaaaguuauagacaguuacuaacugcccauugguguuuugauauuuuugugguuuuuguuuguuuguuuguuugcuuuuucaagacaagguuucucuguguagcccuggcuauccaggaacucacucuauagaccagggugaccuugaacucagaaaucggccugccucugccucccaagugcuggcauuaaggcaugugccaccacugcccagcugauuucauuuaacucuguaacggucuuaauuuuaucuuuuuuuuuuuuuuuaaaguucccaucaacacuacuugucaauacugacccugucaauacugaccuuuuuuuuuuuuuuuugagacaggguuucucuguguagcucuggcuguccuggaacucacucuguagaccaggcuggccucaaacucagaaauccaccugccucugccucccgagugcugggauuaaaggugugugcuaccacgccuggcaauacugacuuuuuacuauuagucaccaaccagaggccauucauuccccucuguagagcuuaguuuacuuugugucugggagaaauauuguucaaauauaucaaaaauauacaccuuagaacaaaccagcgucuucaacaaguggugugaggaaagcugauauaugcacauacagaggaugcuuuucucauccugcacaaaacuauaaauggaucaaggacaauguaagaucugagaucccaaaacugcuuaaaaaaaggcauaugcuuacuuuguaaugagauuuccaguagcacaggaaauaagguuuaacaaucaauacaugagacuuaaggaaacaaaaucuacuguacaguagagaagauuguggaucagcaguccacagaauggaaagaugaguguaaauguguugccauacuagaaaaggaaagaaaaauuggucuuuccaaaauaguuaugucuuggguguuucuguauuggauuguuggaguucccaggcuauacuuguagucugccuguggaaaggccagcuaacauaggucucguagggccuagucuuuaacuauugcucaggcagcagagcaggcuguggcagucuucagugaagaaauugcagagacugguccugcagaguucauaaccaccaagacccaguaggaaguggagcuucccacaugagaaugcuucucgauuuaugagccuguuaccuaaaaagugaguucauguugcuaccuuauuccuucuuuggcaaagcacugaguuucaggauacuuaagaauuuaguucuguuuuuacuuugaaacuuguuuacuaauucauuuuuuuuuaaagauuuauuuuguugauaugagaacacuguugcugucuucagacacaccagaagagcgcaucagaucccauuauagaugguugugagccaccauguguuugcugggaauugaacucagauccucuggaagagcagucaguguucuuaaccauugagccaucucuccagccaccuuauucauuuuucaagaccaaaacucucuacggucuaugaagagaagucuuuuuuccacauuccucucacuagcacauaggggcaaucacuugggcccacagaggagaucauauucaccucacaaggaggugaauaucuugggcucacagaggagaucauauucauucacugcugagcaaaugaaagacacuaagcagucuuaacccaugucauuuuaaaguauaaauugauuuguguccccuauaagaaaacccuucagugauuuuccauugaaaugaaaauaaaguuccaauugucccuagccucgaauauuuuauucuuuccuacuuugcuucgucccuuuggccagaugugaugaugucacaugccuuuaauccuagcauuacccuggaggcaaagauaagauugacuuacaugcuacccugaucuacauaguaaguuucaggcuggccagaccuaaauagaguguuucaaaaaauguuuccaauguaggaagaacaguggacagaauucugaaaauguaccaaaaucuugaacccuaauuccagcugaucuaguuacugcuggaaagggcuuugcagauacaguuuaauggaccuaaagauggaaaaauuauccugaauuauuuauauaaacccaaucuaguugcaugaauccuuaaagcagaacuguccugguuggugggaaaagagguaguagauucuaaacucacuccacaguguaaagcaugggcuuaagggaggccuuagagcugaccauaggucccacacucaagacaucaggccuauaaugugauauaaggcaauacuuuaagcuacuuccagugacuauagacugguuuacagcagagaaagcagagcuaccaguauugugcuuuacagaacugagauaacacuguguuguguaguauacuagacuuggaacuucuuagagcaguguagugugaaugaaaaugucccccauaggguaagauauuugaacuguugguccccaguuggugcuguuuggggaggcuuaggagguacuagccuguugaaggaauuaugucaccgagggugagcuuugagaguuuaaaauaucuauauuguauccauuucucucuggcuugcaauuuacagacaugagcugucagcuuaacagcucuaaucuuccuugcuuccacucugccaucaugaauucuuaucccuuuggaaccauaagccaaauaaauucuuuaguugccuuggucauucuauuuuaucacagcaaaaaaaaaaaaaaaaaaacguaauacuuguaaggauaacaacuaacaugcaccaacucugagcacagaaucaagggaggaucagaaguguuuauaaguguguguguguguguguguguguguguguguguguguguauguauguauguauauauguguguguugugaaugauugcugggaguccugccaaaaaugaucauucuuaccuugaacucuguuagcagaucuuggaaacugccuuuguaguuaguacuucaccacccuuucauuuugugaggccaaggccauugaggagacauuuaauguacacagugagaaauacauauauaauuuaaaauuuucuaggacccacaugaacaaguuaaaagaaaggaaaauuaacacaccaaugauuucagcagauagugaauauaaaaacagcuuacacaauacuggaucuuuuucuaguacuggguuuuagaagcacaauguaugcuuacauuuccagagcauucucaucauaagucauucugucaggcuuuccuuuaucuaccuauuagccagggugguaaaaccuuaacaacaggagcuggaguggugacucacuggauaagggcacuggccuucagaguguuuagguuugaucccuagcacccacaugacugcuaauagccaucugcaauuccaauuccccgggaacccuggccucuugacaguaucagccaggcaagugguauacagacagcccaaaagaguauuuauaaaugaagcaagguguuuuccuuuugguuaauuaacaaugaggcagaccuuuuuuuuuuuuuuuuuuuuuuuuaaaaagauuuauuuauuuauuauauguaaguacacuguagcugucuucagacacaccagaagagggcaucagauuucauuaccgaugguugugaaccaccacaugguugcugggauuugaacucgggaccuuccgaagagcaaucagugcuuuuaacugcugagccaucucaccagccccgaggcagacuuuuuagaggaagauuuagagggacauaguugacaaagugagauggugacugcuuguucccagagggcauucauugcaaagaaaaauggugaguaggcaugggcucguaguggggauccaaacaggaccaguagaagaaaggggaaaaucuaagaguucuauaaaacauccaaccuagcugggugugguggugcacugcacaccuguaaucuccaaggcugcaugcaagugggucucuuacauuugaggccaggacagguaagagaaaaaaaaccugucucaagcaaaaacaaacauaaccaaaccccaaaccaaaccaaauaacucccaccccccaaaccaucuaaaccagcuagagucaguuuauugaacuuguagucugcaggccccacccuccuagaagagacaaagcuuuggcuuguccaguacucagucuccuguuuuuaccagacauugauucauuccguuguuuguccaucccagaaagugagcuuggggauuccuaggggaucuuuaucacccugccccauuacauuaaaccaggaaaucacuuuuaaaccuuugaagggcaagguccaauacugcgcucuagaacugagcuucaugggaacaggcuggcuucugcagagcugccucauguaagaaggcuccccaucuugguauuucuacagaguugggcacugacaucuaaaacucggccaucauuaagcacugugcugcagccuggguacccuuuauccuagacuaagaucacgaggcaacaggagugguacaggccuugaauccaagcacuagggagucaguauuugaguuuacacacacaguguaguuauuguucacaaugguaaugcacuccauuuaguuuaaaaagaaaacaacacaaggguauuuuuaagcuauuggacaugaauaauuaauuuguaaaauuaaaggcauuugauguuguuaccuaagggaaaaguggggguugaagugaggguuccuuucagaaauuccucuuagaaaacacauuacauagagaaaacagggcugaaaaaaugauggccaaacucaaggugaaucuuuuuuuaaaaacagguuaaaagucuccauguuuugcacauauauaauauuguauuucaaaguaaaccugagaaucagaauccauagcaaaaaagucauucauccaauuccagauugagcaaagcaaucaaaccugcuucaaaaaguagcugugaggcaaauauggauuucaucugcauuuuaagaaauugaauguucagaaacccauuuuacaaaggaaucuuugagcaagcaacauauaugcauaacauuacaucugugacuacagaaguggauaaauucuauuucauccaaguuucugugagcucucaugccucuaagaaacguuuuggcuguaugcacgcuucugacccagagcaacaacauaacccccaaugcaugauaaguaucuacauaauuucacagaauaucaaaaauugcugcaaaacgagggcauuauuacaauuuaaaggaaaugaugcagauaaaucuauuuuaauggauacgcuuaguagaugcaaaauaaguaugucagugcuucauuauuuauuccucucaacuugccaaaauuagaguggaaaaaugcacacuaucuacccuaacauuguauacaaagaagugaaaaauugucuucuuagccaugcuuguaccuuggaaaaacuuaguccuauguguagcugauuucaaaggcucuguuguauuccuccaguuggcccacauaaucucaucuguuuuaggcauugccuaggcaauccagugcucaccaugggaugcaguucauaauucccuuuugaaugaaucaucucauuucauaguagacucaguaauauccuuuaaaaacuguuagacuaaacggacacaucugauuauugcugcccagucagaagagcacacuauggcauguacaugaugauaugaggacuacuuguaggagucaguuuuauuuuuugaccacgugggccuuagggguggaucaaacuuaguggcaaauaccuuuaccuacggagccauuuuucugucccaauacgaauaugugugugugugugugugcguguaucucucucucucuauauauauauauauguauauauguauauauauggaaggaugagaugguuauuuguucccucacccaauuuucuuuuuuaguuuauuuccugugacuguacucaagacagguucccuaugcugauuaagauuguaacaugugaaggacuggagagggccuuaugcgagaggggaauauggaagggaguagggaacagccagcucuuccuagacuggagggaggagaaaguaaggugucagggaagaaauacggaagggcuucacaguugugugcuguuaacuucugaauagucucccagaacucggugguccuuuaguuuuugugugcaguaacagaaugcauauacaauaauccauagggaaacuaaauuccucacacuucugaaggcgaaguucaagacuaaaguuuuauauccagugaaagcuuucuagcugcuugcuaacgugguagaggcaggacagggcuagacagcaccuggagaguagauaacagcaugagggaaaacugacaugguguccugcuccugggacaauggcauuaaaaaaucgugagcauguaacacaugugacccgucaucuaaagugucuaccuccuaauaccaccaccaagacaauuaaagucgauuaugaguucuucaaaccauagcacaaagguauccuaugagucacccaugaugacuaccaaggaguccagcagcauucuuaguaaaacuugcaaaauggaaauuucaaaauaauuuaaucccaggcaucuuaaaguuuaaaauaauaauaucaagauaaaauggaaguacauaucucacauagaguguacaauuuacuuuuuaaaaagacuuauuuauuuauuuauuauauguaaauccacugcagcugucuucagacacuccagaagagggcaucagaucuccuuacagaugguugugagccaccauaugguugcugggguuugagcucaggaucuucggaagagcaguguacuggcuaguuuugugucaacuugacacagcuggaguuaucacagagaaaggaguuucaguuggggaaaugccuccaugagauccagcuguaagguauuuucucaauuagugaucaaacggggaggucuccuuuggguggugccaucccugggcugguagucuugguucuauaagagagcaggcugagcaagccaggggaagcaagccaguaaggaacaucccuucauggccucugcaucagcuccugcuuccugaccugcuugaguuccaguccugacuuccuuggugaugaacagcaguauggaaguguaagccgaauaagcccuuuccuccccaacuugcuucuuggucgugauguuugugcaguaauagaaacccugauuaagacaagcaguaagugcucuuaacugcugagccaucucuccagcccucaauuacuuuuuaaaaaauauauuuauaugaguacacuuaagcugucuucagacacacacuagaagagggcauuggaucccauuacagaugguugugagccaccaugugguugcugggaguugaacucugaaccucuaugaagaacagucagugcucuuacccgcugagccagcucuccagcccaauuuaauuacuuuaauagauguauacauagucaaugaaagaaauagucuccuuucacugaauaaaagguacugcuuauucuagagacaaauaugagugaaugacugggaucauagauuugaucccuccaaauaccaugaacuuuuuacaauaauuuagcaaagaaagccauacaugaaggcaccuuucaauacauuaauagguauuucagguaggggucuuauaacaagaugggagaaaugcugcuauaggucaugaagucgaugcugacaugcugacaauacucuuaacucuuugagugcuggaguguuaauacauuccuaaacuuuuuuuuuuuuuuuuagccuguaaggaugugagcuccaacacagaguggggcagggaaugucuauucagcaggcuccagaucacccaggaaaaauugucaucagcauuuacaaagagcaacaguccaauuucuucacaccacuauccagucaaucagccuuugaagacuuuucccccuaggauuucuuuuguaggaauuuuuauucacacacacacacacacacacacacacacacacacacacacacaccagacuuccugucacugcgaccagauaccugagcaggaaagauuuaucuugguaauaguuucagaagccucaguccaucgaggcagugaggacagggugaagagcaggucagucaucuuguggccaggaaacagagaaggaaucccuggaaagcaauggacguucuccuugcccccuuuauuccacccuggccccagccuauccaucugccauucaggguagcuugagccgucuuuguucauaucucgagcaugccuucacagaugcaccaggaaguguucaucauuaaucuaaaugauucuaaaucgagucaagcuaacaauuacaucaccacaguaugcgucucaagucagaaaacaccuuugacuucuuuuguaauucuuucuacucacugcaccugacucucaagcaacaccggacaacuacugaauugcuuuuuaacauaaauguuaguuugcauuugcuagaguuuucauaaaccacauauugcaaccucuuaguugauuucaucaagggaaugcaauuacuuacuauguuggugcaaauauuaggguuuuuuccuuucuuuuuuuaguauccaugauaugcacauaacacaguggacuuuuugguuguuguuuuuaauccaugcacauuugaaggauauuugggguuuucuagcuuacaaacauaauugguaaacacagagcugaacgguuagugguaauuuaggugccuauucaaaaaacgcacaaacccaacuagggguuaaacuuuuuuucacagagaaaugacauuaaaacgcuuauagcacacgggucggcaucauauacuccaaguggauguucaucuuccucauaacucucuggguuggucucacggugaaguuagucuggauaacgagauggcaggcucuaaacagugcugaggguguguguguguuuggggugaagagaguccugugcacugcgcugugaauugauacaccuuugcauuucguuuuccccuacagccaccccagagacagaagaugcccuucuacuacagccacggagaguaaugaagcccucugacagcucaccgaagcucagauuugcucccuugggauuugagcccagaucuguuaacaucccgucauuuucugucauacucacucaugaguuggucagugucacuggccaguguggugagcagccagcucuuagaaucucagacugcauucugagcuagguuuuugagauaggcaggcuccaccugcucugaccagcagaggucaggaguguccauaggagcagcuagaggguucugggcuuccccacagucccugugggccuggcauuaacaguguuuauacaagaacugguuucaguaggcccaguuguugaguucuuaaggucaauuucaaaagcaagguuuuaauuucaaaacuaacccacaaguaaaggacucucacaaagcauauuuaacuaggugguaagccugugccuggccuuaaaaggccgcgcugcauucccaagcucccuuuaagaccagugaaaucggcuucccuaucuugccuucuguugccacuagggggcgagcgccucucagauuuuccccggcgcucggccagggacucuauccuucuguggaaaaaaguuugaguuuugguagguacccuugcaaggaauuccaaccuagauguuagaaauuuucagucuauugauuugcugaaaaagcucagguuugagagucuuuuucguauuuuaacagugaguuuagguccuuuaaaacucauaacuuuguuguuguuguuguuguuguuuuuuguuuguuuuucuuuuucgagacaggguuucccuguauagcccuggcuguccuggaacucacucaccaggcuggccucgaacucagaaauccaccuaccucugccucccgaguccugggauuaaaggcgugugccaccacgccuggcuucauaacaacuuuuuaaaaaugauuuuauucuuucaaaauuuuauacauuuaaauaaugcauuuaaucauaucuaucuacugauaccucccuccacucuccccagaggccuuuaccccaucacccuacuccuuuuuuuuuuuuuuuuuaaauugacaagccccgaguccucuuaaugcuguccaaaugcaaugggugugggucuguaguggguuccuaccacaguagccaucaacuucuaauaacuccuccgcuaaugggaucuuggggaugucuuccucauuuaugcuggaguuuuuacuggcuuacucuugugcaggucuugcacugguguccacaggugcugugagcugauguguuuggcugccguguguggcguauccagaagccaacaucucccagcucugccgacaacucuuacauucucucuguucacucuucugugcuguucccugagccugggacggaggaggcucaggcaggugagugauucauccacagcugagccugagaguucaucauccuuggcacuggcaggggagccugcauucacuacugcucacugcauaaaccaagaaaguggagagcacugcggaucuacgcgguuggcguuguggccucuugguugauuuuuuuuuuucccuuuaaugaguguggaguggccuuccuuaucugacuauauuugguuugaugucauuuugucaaauauuagaauagcugugccuguauguuuuuuaguugcauuucccuggaguucccuuuuccauaaauaaauugcuuuauccuaaug

SEQ ID NO: 5886 - RNA, 228355 nt, Mus musculus
cugagccaguuuggcggggggcggcgcaccuugcucccgcgcccgggguagccgcguccgucucucuccgcacgcccccgcccgcccggacgccccaggucgcuuccguccucucggcacggccgcuguccucgcuagccccgcgugggaggacgaugggucagcgcggaaaaagugaaugaggacggcggcgccgcagccagcgccccagucggccggcagagcaacccgccggcuccauggacgcgccgcgugcacuggcggccaagccccccacaggguaagcgggcccacgagggcgggcguggcucuucccgagguguugaggacuuggggcgccugggucguugcuccgguaaccguggcaggccuugcucgggaacacuuucugcgagaggugcugcugugaaagcccuuguguauguuuguguauguguguguugggggguggguggguggagggagugcugucccuccgugcagaaccccagcucugagcugccuucagccccuugcaauaguggcaauuacgggcggagggggacaaggaaaauccaggccugaaacuccagcugagucugucuggucccauacacagguuccuccagccacuccucgcaggcccuguggcccgcugcucccuaccucaaugacaaggggguacuuggucuguugggacccauguagccaggagaucuggggagguguguggggaagggacuucaugaacacucuucugcccaagccuuugugcugggaucucccuugugucugaagaggugaggaccuucuucaucggaccuguaaagcagagcugucaauccugucuucaggauccucuagugccucaacccuuuuaguuucuuuuugcugucuccacaccuugcggacagagauucccugucacacugaggauuuuacuugcccaagagaaacuugccuaacacaggucaaauagacuugcccuuuaaccccaacuccccgaaucgugccccuccgugcccaucucugccaggacaguugacaacccuugcagacuugguagauuucagagagcgccguggggcuggcuuuugaccucuucuuucuggagcaaauguguuaugaguguugcgaauggaaugaguugggguggguccgcaccugcucccgaaauggcccacuuuccacuugagcagcuggauuuucuaaggcggcacuggggacaacaaaucucuuuucuuuagcaguuaugucccacugacucacccgaucccuugcccacugacuuuguugcccaaguguuuauaaaagccgucuaaaccaguucuuuauucuuaaaaucuccccuggaggcuuccaaaaaaguaagauacauuucuaacucauaaucuugaagcuacggaauuuuuuuuuuaagacuuuucuucgcuaaggugugguugugguuauauaaauccuuugaagaaacaaauuccccuuaaaaaauagauaugggaauacuuuuucaugguaauggagagccccuaaaaugacguugggagauguaaacagaauugcuuuuaaaauugcgacuuuucuacauuguuacauaacucuauuuaaggggacugaauuauuucaccacuuuuuaaaaaaauaaauaaauauaaagggaauauuuagggugccugcaaagauccauagagugcagaaacugaugaaggugucugguaauagugaaaccacccuauguccuccagccagccugcucccuaggcagccaagaggccaacccagguuugucuuccucacugggugucacaagggaaaaccaaggugcuaugcuaugggugagagaguaaagcuuuacaaggcuugaugccucugaaccuucagcauguuauaugauuguuuccaccucuuuguccaagaaauguagaucuauuuuuguaacuuguuauuguuguuucucauuuguuauaccuugaauaaagaaacacccccaaauauaaauaugcuuauauauuuuuaacaaagauuacaaguuuaguaugacguauuuugaguuagaaugcaaagaaagaaaugcaagcauauuuuauauuaagguguauugauugccuaucauaaagaauugugacauuuggggcuucagaauguuaucgaaagcaauuagaauuuguuggcuuguaucugaaauuacuguuuucuuuaucucuugagacuaggcaguguuugcaaugugcuugagggauguuuguuuuuuaucugauaccacagagguuacuuauaaaguuacuuuguauaaacucucuuuuuccccaagugacagccacaacugaugggauaaauuuguuguuauugagaacaccucagucauccucgagcauuguagacugguugcaauggacaagagaaagauuagugaagggaaagacagaugggcuggugaauauaaauucaucuccuuagaguguuaucuuuguuaagaacacaaaugcaaauuuuuccuuggacugaaaucauaucugucuuccauaaaagcagcaacugugacagucaucuuccugggaaggagauuguaugaagauuuaauguguugcuuagggaauuuuagagcucauuguuaaagugugugugguguguguguguguguguguguguguguguguguguguguuugaaugugacugcacacauuuugugaugccuuaguggaaauuagagggaagccugggggucaauucucuccucucacagggacugaccucagguuggcuggcuggcuaguguaggaagugauuuuaccuguugacuagucucaccugucacuagucaguuucaccuagucagaagugauagcuagugaaauauuuuagaacacaguaucaagacagagggccuauuucuguuggcguccaguaugagcagccauacacuccuguuuguacuaaaccauaaguguuuucauauuaaagaaauaguggcuacauauuacauuugcuuuuggcuaaaguauuuaagagucucuagauccauccuuaauaaugcgaaaauaaggauuaucugucauaaaacuucuauacuaaauuugagcugccuuuuuaaagaugucacuucugagcuguucuuuauucugucaacucacuuaaguaaugcuaagccucugggugugggcaauacaccuagggauuuuacuuuuuguagcuauaaucuuuauccaugaggaauuagacauuuacagugucaaauagucagauaauuucuaucaucucauaucaaucauauaucaugucauaugucauaucaugucauaucaugucauaucaugucauaucaugucauaucauaucauaucauaucauaucauaucauaucauaucauaugguccugauggaccugaagggccacggaaauugcuucaaagguaucuguaaacaguugagucauuccugccuuaugggauucuagaauucaggccacccuuugauuuuucucucucaugaucucccaugcaaggcauauuugauuauuauugggugucaggacuguacccuggaaagguaauaauccccacauuuaugcaggcuugaauucuauggccucuuuaauuugggacuugcaaaugagguccuaacgugcgugcacuaaacuuuaugucuauaauuauuaagaaaacugugauuauaggauguaucuguaucccauaauaauuggcuuaagauacuaggccuuuugcacuuuguaauuaaauucacaauuauauuugcuuuuacaacugauggaagguuuuaaaaacugaucagaaauauuugauauuaaaucaguuuuaaaaugcccaaacaggauuuuauuuagacgugaacaaaguaaggccauucaacagacaguguauuuauuauauggccuuuuggcccuguacacauuuaauaauggggccuguggauuuuacauaucaucuaaguuuaguaauggguuucauucaaucugugcugaaacacagcacagcucucauauugcacggcccacugaaugcuuacagauuuucuccuguucacauuuaacuuuacuuaaaccauuuuuaauaaugauugauacugcugguguagauaaugugucuuuggaaauggcuuucagucauauaaaugacuuguaaacuguagcuuuccccuccugugaucugugucucugcugucuuccuucugucccgccacuguuaguuuccugucuugugaaagggccucauacagaucuccauuucccuucccugcuccuuccauucuauauuuucaacuuuucucuugccaaggggauauucucuauacuugucaaggguuuucguuuuacagugcuaagaauggugguagcuuucaagacaugcacuuaucagccuagacccauggugucguguacuuuacagugacaaauggcaguuuuccaacaguauuuguguuucucauuguccaccccaggcccuuccccguguuucugagccagucccccagccagcagcacccugugguaauuuaggauuuaaaaucaucuaucugguugcccucaucgggagguaaacugcuccaggcugggaccgugucuuccaccggccaaguccaauuaaaauaaguucccuagccaaaaguguuucuauuuuaacaacaacaaaaaagcuuuaaaaucaacugucaaaauauauuuuaauuaggcuuauuugauuagacacaugcccagauugcagaugcuuucacagcaaggccauuguagauccaauucccaccuacacccaaccaagcaaugccuguuaaaaagacuccagcugaagcugggcgugguggugaaggccuguagucucaacugcuugggagacugaggugggaggaugacaaguucagggccaguuugagcuagagaacagguucaaugucuucuuaggcuccagagugaguuccagggcagcccagggaacuuagacucauugucaaagugaaaacaaaaaggguguguguguggaaauguggccugcagugaucucuuggcacucuuagugguguagcuccgugcuucuaccauccagaaccaagccaaaccaaaacacacugcacaaaacaacacugccuguaauugauuuagaguccauuacgcccuuagcccugaacauuuuccaacuccaacccacaugaacucaggagucucucuccuccaccucccuuucugcucaccucagcucuguccagcuuuuccuuccuuccuuccucuucaccauagcucuguccagucuuugcugcucuaaaacccaguuggagagcccuuguucuaggggaagccccacaguguuccagacaaggcagccaggguacccauucuuuuuuacugcagcaccagaagguggucuuagugggcacuugaagugaccuggacucccauucucccguggaagagaaaacacugggaugagauuugggugcuggugguaaugagcagcuucgguagugguggccugcagccuggaugccggucaacugagcugucuggccucacauuuugugagggugaagcagugcuucccugugugaguggccagugcaccugaagaacagagcucuucaccugccuuauguucaguuaauuuuaaauggaaguacucuguguggguuguaggucugaguugacugucaggaucugcccaugguuucucagucucuggugccaguauagcauuguuucuauaauccugccacuguuucacacuuucugcccucagcuugcccugggagccuuuucuucuaucacaggaugguuccuggcagccuucaggccaugugagcuuuccauccaagggcuccaggaauuugguuaguuuacuggcauuuucucugacaucuccaaccucuccccugucagaaacugugaguuucguuugcuggucucauucugccugaauucagagcuccuuggaggcaggcguccugcuuuguguaguaucaucugccuguggcacaggagacagcugucauccaguacaccaaccccacaucccaauugugguuugauaagauagucuuagaacucacagggacuucagugucauaugauucaguguguucccagaaugugcuagauaccucuuuugaaaaaaaaaaaauccugacauuuaccuccgcuuucacauaccuuuguuucugccagacacugugugaacagacggaccaacuagugcugaagguucucugcucuguugaagcuugccaacaugaggccuuaccaugcaguagccccacagaggagcaggacacaggacaggcaccugcccuuugugacucaaguugugcauaucucuguucauguggccuuggcacaacucccauccuacgaccauguaggggaggcuuggcacagugggacacaguuccugacaugauggucuagugaggacuaggaggacuugccacaguggacugacagggggcagguggucucagugaguaugugacucuucucccuccucccaggguccucagaacucagcugucaggaggcauguccagacaguuucugaccuguggcgagaaaggaauccuuaguuugcuuagguuauaacugcaggaagugguccugagcugcacagaaugguuauguacuagcccaguucaggccucuugcagcagguguuucugauuuuagucuccagaucagucccuagugugcagacccuuacaaccccuucuuucuaggaccuugcagacccagcgcuuaggaguucccuguccauccccaggaggaagugucauuagacagucaccccaaaguguggaaguagccacaccuuucuauccaucagaugucaggggcuggcauacauugacuuccaugagucucaccuuuuucaucucacaucaccuucuuuuuguucacgguaugcagcaguguaauauuggacagcuugggaagagaauccccaagccauagccauaggcuagccgugucugggaaaaucacagagccucuugcguuucuccugccuuaaugggaugagcaaagaauauguguucucacaugaugagggcugucuacaaaguucauuaucuuaaauacuggguguggcuggacgagucagagaacugaaacagagcccuacccagcacacugauucugcagcucuaaguacauaaucugagcaauuaaauacuuaaagaacuuccccaaucaacccuggcaguguuuucccaaacuuaacgguuugggaguuguuuaaaaauaggcuugggugggaguguuaauucagagaagugaacacuucuguucagguggcuagagccuugauaauuaacacucauucauguucauuaaacaaacgauuagcuugaaagaggcugcuagaucauagguagaauuuagacauuugccacuuauugauguccccaacugucugauccccucucuugcuuccuaaaauuuuauguugacucaguauuaaguagaaguaaaacuguauccauccuacccggggauggggggugggggcuaagccacuuguaacaguccagugaugcucuaacagcauuguuugaauggugaaugaauuagagaucucuuucagcccuuaucaaaucaguugauuuauuuucaacauguuaguugggauacugaaaugcacucuuucucaugcuacaucagcccucugacuuccuacccuuagcuacuucucagauguuugguguucaugugcaaauuuuauagagaggcuaggaggacggcucacuggguaaagcgcaggcaugagaacccgagcucagaguccccagugcccauguaaaggcugggucugcuggcauguaucuguaaacuacagcaucagggcagagacgcugaucccuggggccuugguagccugccaguccaccauggaucucuccacacacacacacacacacacaggcacacacauaggcacacacacaguggcacucauggaugaguacucccacacacauacacguacacacauacacacagggugggggagggaggaggagggagagagaaagaaaaaagggaagucaguucguaaaguagaugaauuugaauuaaaagcaacacuuuaauuuuagaaauuuccuuauuauuuuuuaguuaaggguuaugguuuucuuaugagaggaaacagaaguucacaggcucucaguuaggugccaugcucaugcaucacuguacaggugguaugcucuagcucaucuugagucuuuagaugcucugugaggcuugacucuuccaggauauccccaggaucagaaagaaaauagugguuuucuccuauuuggaguuuagauuguccuaugacuuucuagccuggcauauagcccccaacuaacuccccauccuuugguacugcuacaccaaccuauaacacagaccuggggcugggauguucccucugcuggggacucuagcuuccuguaggauggggugaugucucugcuguagcgauagcuucucaccaucccuuugcuaaagaaauaaucuaccacaugcauccagaugaucuccuccuccugguaucugucggguggacacaacacuccugcugcauuuccaggaagcacauauucugagacucuuagcuggaacuuaacuuuuuggaagaggugugcuguauguggugggagaggaugccauucagaaguugguggcugcguugacagcauggcugaauuaggagaaggugaacucagacucugccuccugucuagcaagugcuucugccuugauccuggcuaaugaauuaauaaacaugaaaagccuucccuuuguacugaucugacucagcucucugugucugugcugauacuuuugauaaugguacaggugacauugggcaaagucaccuuugcccaauaauguacuucuuccuucuaugcagaagguuggagaaccuaaacuuaugaucuguuaguuguguuuucuugcauguaacuuuuggcaaccuucagugagagcuggaugauucuuuaacuguuccuuugcuguugguaaguggguuucauugagaaagguuguacuuggcacuuguagggcuuguaaggccugguguccuucugcaggcaaaugcuagaccagggaaggacagugugugacauuuguaacaacuugguguggcuuguacuggguuauugugucuggcauugccugccuucuuacaguucacugauucuuauuuauauuagucaguuucuuauuacugugacaaaauacccaaggcaaacuuaucaaaaauaaagguuuauuuuggccaugguuuucagugguugcaguccuuggucucuuguucuugaugccuuugggaaagugacagugcauuaugguaggagugcagugcaaucugcuuagaucauguuggcugggaagcagagacaggaagggcaggauccccagugggaucuuuguccauaugggcacaccucuguaagguuaugccaugcuucaguagcacuaaguugaauaccaaaccauuaaaauacuaggugggggaggggggagucacucucaauaucuaagaauuauauugcauacuaagagacacaaaaguggaaaacuucuucauggcuaauauauuuagcaucuaaugaaguuguuuuuguguugaauguccucugcauauugcauucuuagcucucuggggauccaugcuauugcaacaucuuccuccuccuccucuuccuccucuuccuccucuuccuccuccuccuccuccuccuucuccuccuccuccuucuucuucuucuucuuuuuucaaguugaauugguuuguugugccuguguuggauggagaagccugagcagcaucuguguuucuguuuuaaauggucacaguagaugauucaaguagaugacucuauuuuaacuguugguuugugggaagcauugguccuuagacaggcaccugagcaguaaccuuagagggaaguuguaugcuugagauguuacauuggugcugacuucucauuucugaauucaacacuaugcagguuucuuacaucagugaugcauauuugagaguuuaaugggaauugauagaugguuugcuaaaguuagccuucaugcucccuugaggagaaggcugcacauucauucacauaacuuuuuuuuuuuuuuuuuuuagaaaaggcaguguuuucauaaugaaaaauauuuauuggcuuaaaauaaacauguuuguuuuaaauaugucaguguguuacauggauuucugagagauguuuuucacucguccuuauuucuuuuguuagugauacaaggaguaaagacgugcucuguggcuuuggggguggcagugguggugaguuuugcugcagaagcuugacugugguuggcauuucugcuuucuuuuugugcuaagcaugucacacugcagaucuugugggguggaaaaguaagacucuccaagucagucucugucacugagacauggacagcuccuaccaaccgacuuaccagucuccuuguuucccaccccucucgauauucugcaauuaucuggauuauagaguuuuaaaaaaugauuuuagauuuaauuuauuauuauuauuauuauuauuauuauuauuauuauguguguguauaucuauuugugccagcuacagagugcauguggaaguaagaaaacuuucaggaauuggcuuucuuucuauugugagucugaggaaucaaacuuagaccaucagguuuauaucguaagugcuuuaucccugagccaucucacuguuccuggguuguagaauucaugagauaauuuaacaaggaguaagaguauccuguggagugagugccugccauauggugcuucccuuuuuccuuuucccuguuacuguuuucuaucagcgaacuaucagacuacaagaaggaacagagacacuaaguuaccaguauggaacaugguccuuacagagcauguaaggagaugugcacuguuucccauuguuuucacacaguagaggcauagcaaaugcuacuguaauaggaaacugagaacuuaguauaguguucagaaccauuugcugcuuucgcacaggaaaacagcaauaggaacaugauacaggucauaucuugaauucauaaauugcucuugagcagaugugaugagcacagcauuggaugugggucaggagagcugagcuacugagguaguacuugggugaacaggacaggagagacuugggguggauggagaagcucuagacccguuugucucccuugagaaguuuggauaucacauuugaguguggacuacaccuugugucagauuaguuaucauggcccggagcuuagugcuccucugcuaacagaagugucuguuccauguuucuuuuacuucugugcuagcaguugucuggcuccaugaagaugaaguccuuaacuaaucaucugccauuguauauucaauuaaaauggguauggaacucuaucucugaguguaguguuugugugacucagucagcaguguguucagaaaagaaacuauaagaauauugggacgauucacuuagaaauuagugucugaguauuggguaaaaugcuguacauguguauaagucgcuccagaagauauuugcauguguccugggaggagcuggaccaguaguugagcuaaacuaugaacaguauaucuauaacaucuaagagucauuuagagguugcccuguuuuguuuuguuuuguuuuguuuuguuuuguuuuguuuuguuugaaaguccucuguccagauagggcagggugccccaccaaccagugacagugucaccuugauaacacagugacaugauggauggcuucacauagggaacuuuuccuuucucauuccauuagguuuuauguccuuagacucuauaagggguaaaaaucauuuauccauagcucugcuuccagugagugaauaaaagagcauuaaucugagauuauagugcuuuacauuagcucucuaagaaggcuuuugaaaacauucaucuuuacugucauuuaaccaaccuauuuuacaaaguauagguuauauggcagugagagaagcaauagcuuauuuugaaaaugaaggccugugagugcuauauguuaucauaguuuucauuacacuggaaacacugaacuagugauuucauacacgccaaaacauggcucaccugcugucuggcaagugucguugucaagcucuaauaauugugccuggugcuauaugugaugcccuuuaaaagaacagaagcaaacuggcaguagaacuuaaucaucaagaggggaaaugagcccacauuaggguccuauauauaauguaaaagcaugauuaucaacauacucaaaauacacuauuggaaaaauggcuuuaccaguuuauccaacaguauaauguggcuauggcuuguaagugucccccaaucuuuauauguuggaaauguauuucccaaauuggucuuuugauggagaaguauuugggagguaacuagaauugaagaucauaauugugccccaugcuggcauuaguggcuuuucagaaaagguaaugagagcccacuuuacccagaagcucuacuuuauuacccaguaacgcagggcauagcuguauccgaugcugagcaagugugggugccaugcuuuagauuuuucugucuccaggaccguggaccaaggaaaucuuuguacauuuccuaaucuguggcauuugguuccaacaauagaaaguggucuaagacaaaugucccagaguggaauuccuuaucagauucaaguacuaggauaggugcuuuugcuuuauucgugcccuuccaaacuuauuaugcugagaguaaagucaggucuuuaccccuguuagcuagguaaacaguagauaaucccuucauaagggcccuuuuagcccaaggccaagcaccuguccucagagaggacauaggaauggaguggaauauaugagaggggaggcugagauaguuaagaucaggcagagccaaccaaaggcaaggccuagcuguugcagcuaagaaaugaugucuuugugaagcuaggagggugauagggucugugagaguuugagcuguagguugaaaauuggauaaagucuagcaagguggauuguggaaggguaccaacuggcaugaauagaagccaaaggacagaugaaagcuuggacuuauagucaccagcauacaugacuaaaucaguaggaugcuauagaggacaugagguagguaacaggucauguagaugccaggaugaggaauuuguggagggucagcaggugggucuugcuuagcauggcuuugucuggaugaacugugaaucaggccaguguuuuuuaguacaauaugacacuaguggacaaagguuguucucagaauguuucaugauuucagagagcaaacagggaaggaaggauggagauuagcugggucaguugugacaacggcuuggucuugcucucccaucaagaaugagguuggccagggagcugaaggggucugaagccccauaggaggaacaucaauaugaacuaaucaguacccccagagcuccuuggaacuauaccaccaaucauagaaaacacaugguggaacuugugccucuaacuauauauguagaagaggauggccuagucagucaucaaugggaggagaggcccuugguucugugaagcaucuaugcccuaguauagaggaaugccaggaccaggaaugggaguagguggguuggggagcagggggaggggggaggggauagggaauuuucagaggggaaacuaggaaaggggauaacauuugaaauguaaauagagaaaauaucuaauaaaaaaagugggguugguaucuugaggcuccccuacuuuaaugaaugugggggucaggguguuugcagcuguuggacaaucacuguggaaagagcauaguuggaaguguuaaaaucuuaucaauggcagaucacccagacaggaacuccacagaagcacgaggucugacaagcuucacucauuuccuuaucugcuggggugcugagaaugaguguguuguagugugacuacaagauaaggauucaucagaggugacuaauugcaggucucugucuccuugagggugaggaacuuugugacugacuuuggggccagguacagcugauccagugcauagcagaaguguggugguggggagagccuaggcaccggugauaucagcugagaguauggacauuggcaggcuugucuuguguguuuguauguguccucaccuuuaguccucauaaauaccuugugggguagguucuaauucuauuuuaaaagugaggacugcagaacacagaggguuaacuauuaugaccaagguuagcuaacuugauaccuucacuuauuaauuacguugaucaaaucucauguccuccucagauauucauggauaacaugcagggucccugaggaaagcccagagucuaaggugaaaaaguagggugaucaggcaggagcugugagaguucacucagguccuugcuaaccuugaccugggaggaagccuggguuugcuguaggcagugcuugguccauagucacauggcuuagaguuuaucccaguuuauccuuuccuuuccccaagaaaguauucauccugccuacccagugucacugcaacacagaaguagugguggcaggguaggggacauagacugaggccuguggaugugcacuguguauccuaauacacuaugaagucugcucuuugacaagugggggugucugaaacuuaaaagugagcaugaccccaagugugaauaaagcagucaagaauagaaggcagugaauuucuagucagagaugugugcagcuucuuaaaugugaucagugggcucaucucuccacaguugguaaggcuugucuuugagagugaauccccccucccaagaaguuuaggauauuguggagacacccaggcacaccacuggggaacauguuuccaugaggcccuagaacaggcuaacugaaucauuuauuuugagugcuuuucuugaauuuuaucauccauccaucucaguagaccuguaugcaggacuauuucacucuguguuuuggagcugaacauccuuaauagagcuaguuuaggguaaccagaaaaugaugcuauguucucucccuggguagcauuucuauugucaguaacaccugcccucugagagggucaccaacguccacggguuccagguccacaggcucauccuuacuugcaaugccuggggaagcugcaggaaccagugcugguaugcugggauuuauuaguccugcaagaggguucaagcuuaugacuuugggaagaaauagggacaagcaggaaaaaaaaugaguaaaaucuaaauaacuuuguucucugaugguuauucucuuuugguuccacagcaaaguugaagcaaaauauaauaauuuuaaauuuuuuucuuagcuuaagaauuuuuauauacagucuaucagauuuuuccuuccccacagaccaacuuuucccagauccucucuacuucucuacccacccaacauuauguucuuucuccuuuucucucccagaacaaaagcaaaacaaacaaacaaauaaaaagcaccuauaaucaaaacaacucccucaaacacaaaauauagcaacuccucaaaaaaaaaaucacacaaaccccacaaaguccauuucauguuggcuaacucuuucugagcacagggcccugccuuaagguguacccagugucacuccacuggagaaagcugaucuccccucucuauuacuugcaaauaguaaugcgauuagaaaugggacuuugugccuauuuccccuuugccauacuggggcuuuugcuuggcuugaacuuaaucaggucuuaucuaugcuguugccaucucugugaguucauaugugcaucagcacuguugggucuggaagauguuguauccuuggagaauguaauuuuuucuuaacagacaauucuauaccuucuaggcagccaggcaguggacccugacuacaugggacauugcucaacuccaugucugcacuucucagugucuuuuuuuuuucuucucacuccagcaccugcacauuccagccugcuugcucaggcccaaagauuuauuuauuuauuauauguaaguacuguagcugucuucagacacaccagaagagggcaucagauaucauuacagaugguugugagccaccacgugguugcuggagauuugaacuuaggaccuuuggaagagcagucagugcucuuuaccacugagccacuucugcagcccucucaguugucuuaagauugcucagucuugugaaguguguguguguguguguguguacacaaaauuauguuguuuggucuuugagaagguguguucuguaagcucagggaaagaacagaaaaagauuacaggauuucuaccagugccugccucuagcugucuggccacacaauuugugccaugcgggaugguucaugugcuauucagaugguucuucccaacuacaggaacucugaaugucgugacaagugucuuggaguggagucuucagugcaaguguaggagaucugaaaugacagaaaaugagucauuauauugggauguugauuggacuggagcuuuggagucuacuguauuuuacacaggcaaguccacuuaaagccugcuuacaaauguggauugucuucggucuuggcugccauacagaaugccucuuggcaguauuguuauuauggccaucauuguuacuacagaggucuguuuaaugauacuugauaaauuucacuugaacuucaugaagcuugugagucuuugggaaggcauuucauucucuacuuuccaaacagagaagagccaauguaccgaauaaagacagagaacagagacagacauggcaauucacaucugugguuuuagcauuaggcugaggcagaagagcuaugaguucaaggccagacugguuuacauagugagguucuggggcagucugggcuacagagagagauccugucuucaagcaaacacacuccaaauaaaccaaguguaacaaagcagcccguccugcucuguuaucugccuuugggcuggcucuauauagguagccugccuguguagcuauuggcugcuuacuguauugauagcaugucuuaucacaaaagaaagugacugaauugaaaacuacagauaguagugaucuauuacugcauaucaauguccuaaaacugugcagcuagucucagggacaguguuucuaauuuucuacgugugauagaagcucucuuguagccacuaugugucauucauacaaaacagcuagauggauccagcuguguugaccauuacugggauaccucagcucuuugcccugugguauuucucugcguauuuggaugucuucguagccuggucuccuccaccuucagauaaagaagugacuuggaggaaugaaggaggaggcuguaaggccuuuugugaccuagccucugaaaucacacaugacagaucacuaaauacaaaccugacucgggguagugguuggauugauuauuuuaaaacaccagugagccuauuuuggaauuuccauggaacaaucaucuggauuguccuuuuccauagcaaccuugucaagccccuauugaggaucugauaauagcacauaucaagaguccaaaaaagggauacguuuauaaccaaauccuacaugagguggaacuggcacacggcauucugauaguugguuuuucuauguguagagaaguucuuuacaugaguauguauuguuuauauaaauguucucaaaauggcagaaacuugccuacuauuaauaacaaaggauagcaugaccaagugucucaguuuaggacaguuuaguuuaugcuuguuauccuccuggagcuccuaauacuguccauuuugcucuccaauuacccuguccagauauagauauuauaaucacucagccugaauguuggguuuaccuaaguaaauaugagggcccccauucuguguugaugauagucaggaugaugcuucagauuacuaaguagcuuuggaauauacagaccucaccuccacccuagaaggcuguguagaggcagcauggcaugauucuucaagagguucagagcauuccuaaguuauccaguuggcuaaggaucacucauuuguucacaaaagguucauccucucaucaguuccuuuacuauauauauauauauauauauauauauuaacaagacacugccuguucucaaggagaccagaugcagaguucuguuuagucuaaaguaacuguauacauggaacauaauuuuuauccuuugcaggaaauguaauuuuuagugcaugguucauucauguugcuuagagaaaaggcaguugagcccaaauugcuggugcgcuuucuugauaggcucagcacucucugcgaguugucaacagcaugaaaguggguacagagucuuuguagcuuuguuuuguguggccagcaugaaacaaaacuauugugugaaaauacuuccaguguaauucaguuaguaguuuuccuguagaauuauuucucuguagauaaagucuuccuaaguaaaauaaaaaccucacaggauaaguaauuuguguaaaauuaucauucaguuccaaagcaaaacaaaacaaaauaaaauucacagaaauucucacaaauaagaaaacagacaaaggaaaugaaaacaaccuuuaaaaauguuuggcagcaguguuagggauugaacacauacauguucaaucccuaacauacaugauaagaaccaaugcccuuaucauggaaguuacguccaucccugcacugguugguuuguagucaguuuuacacuaguagagauauuuuugaagaagaaccucaaaugagaaaaugcuccuaucagauugcuuauaggcaagauguagagcauuuuuugacugaauacugaugugagagggccaggcuacugugaauggugccaucucuggacaggugggcccggauguaugggaaacucugaugagcauggccucaguucuugccuccagguuccugccucacguacguaccuguuaccucccuggauggugaacuacaagcuggaagaugaaauaaacccuuuuacucaaguugguuuuggugauuuuucagagcaauggaaacccuaagccaaucccaaaagcccaaauuuguuuguauugucauuauuuuaaucaguuaccuacaccauaaauuuuaaauuucaaccauguuugauuguuucaggguuaguucuuuaucauguuucuuuguguauugugaaggcuuaacaaagaaaugauccauuucaacuaauguucuacuauuuaacaguuauuuaguaacuggaucuuuuaaaaguaauuuaucaguguguugcauuuggguguuccugcucugacuacguccauaaaauagaagugagaacaagucucuacacaaguaauuaugaccaggacugugccaggcgaaugaguacaaaaggcuucaggaacauucaugguuaaagaaccaauuaguucugcuuaaaguguagggcccagauacauccaguuuacuuuuaugaaaggcugccucauaaaaugugaugugugcuucacaacugcagucaccauauaguguuucucuugcagccagaaauuguggucugcaccucuguuuucccuccccccauccuuuugccugcugcugcaaucaaucuauauguggguguauguuuguggcauuguguauagcagugcucucuuuugucaugcucuuuugcuaaacauaaugauauuuacucucauguaguaugcugagauucacacucuuuacugacaggccugauccaugcacagauuugcaacaguuagucuaacccuucuucaacugauagacuauuggaugauuuccuuuccuauuuccuaaagcuacugugaccauucacauauaagcuuugugugacacauaucuccccagcccucuugagugaauauuaggagaguauucacucaagaggcugggucacaugauuuggugcgcuuuuaauguuuaagggacugcuaggcuguuguacauuucaccagcuauggacaggaauuauaguugcuggacagcuuuguuuguuuuguuguuguuuuuuuuaaaccauuuuaaguguaugaaauuuauugaauuuuauauguaaguggcuuuguuuuagaaugugauauauguuuaguagcuuucugcagacaggcauaaccuucuuuaugagugacuucgcaagcaugggcuguguggaaagugugugaggcuuagcccucuccucccagguuugcggaguaaaguauuagucugugguucuaauucucaaguggcucaaguccuugagccaaggugucuucucuccaauuucuaguauuccuuguacuggcuaucuagcugaugauucgugcacaccuuauaaucaaccuagccacugcugaggcuggguuuaguguuaggcguuggugaccuggcucuuuagagagcuguaugcuguugcuaugggugaggugucacaagaggaacaggcacugaaacuucaggggaggcccuuguuaggggaaguaccagggccuuccucagaagauugguggacacacauggugaggagcaugugccugccagcauaaaggcaggcaguauaucugaaaugaauugccauucagauauuaauggcuaguguuauuauuuuaguauuucaguccuccugaaacuuagaaagaacagaaaagacugaucaugugaggaguguugcugggaauaaucugggaucguaggggagccccagaggguucgaccgugcugaagacaggcuuuccauuuauuuucagaaaggcaaccuugcacacccuuaagugcccuuucucuguauauuuaugcuuaucuuugugggcgggggugcaguuaaacuuauuuaacacaacauuuaaagaaagacuaagcagaaaucuuucaaugauaagaguuuuugcuuguuuuuaaugaaguaggcuccuuaaacugacauuuuauguuucacaugaucucugcugggaagaucucagugaugaaggucaggguggggguaauccagucugccuuggaacccaagugucccagagaucaacagccagauuuccaagcaaaagaaacggugcuuugucuucugguagccaacagcacaugacgcucguaaugcuauuguggcuuagccuucuauugucuuugggauugguaugugcguguuugauuguguuugcucaauguaauugugaacccugaacaaucauugcuucuccaggucagguggaaguccuuccauucugaggugaggcuguguaaauuagcacccuacuucccagcaucuucugaaggggugucuuccaacacagucuucuugcuccgguucugcuguuuuuucuguaccccauuuguuuucccaagguuuuaauggggccaauuugcaaggaugguaauacaaacagaaguaguauggcaagccaaacaaacaagcagauagaaugaaggagccuuuaacuaugagcacaaagcaguguguugugcaaaucaguuuugucuaagcauuucuaacaaguggugcaugaggaaaacaauaauuuccauuaucccgguuauugaaaguaggacauauuccaguugcucagaggaggcgucacuuucucuggcacugaaagguaauuacuugcaguuguuuguucgagucacuauacucccaacuauuuuguggcuugcugaaaguguuuacucaggauuuccagacccugaacgugcaccuacuguauucgagugugagaagugucugaugggguaguguaagugucuguggaaacagacugcugugagcacagggcuccacugagcaucacagagccaagagcauagcacuaccuguacugggcucaguggccggggugcugaaaguucugguagagaaucauaagaggagcaaguaagagggcaucugaugagauugauuuauuuacagauggcaagaaaucagcauugcauaaagggaggccaacggagagaggaucugggcaggaucucuccuagaggucacacagcuguauagcccaccaggagcccuggcuagaggaggcauuggaagaauaugaaggaucaguggauccuauauuagaaaacuguacccuggcagcaguggagugguacuaagagacaaaggcuuagacuguggcaauugcuuagacagaagauaaagcagauucugaguugccucgggaaggaggcuguggguugggaggggauuuaggcuacccaucacuaauagaacagagagcuacugcacaugggaacuggggaaggaaagggacuucuggguucuguuuguguguuaugacuuuuuggucaugagcucacagaugccuuugcaagcaauauaauccuaucacacaauagguauucuucagaggacaggacagguccaguucagccuuacuucguggagacucacugagucaccuagccagaaggguggaggcuggccugcagccagagcugccagcucccugggccauggugguuguugacucaggucuguaauuucagccauccguuugggguaaggauccaggugauucuuucauauagauugagaaugcagcgaagagcugcugagcagagccuaccuggagugcucagcaggaccgggugccuaugaguccacacuucugaauggaacguggagaucuccaaaugggccagagacuaacucugauuaaaaguugcuaaagccacagcagaaacugacacugccugucucaguuuuaucaccuaucuaucuggugggucucaccuucccucuucccuaaggauacggugacauagaggauuaagaauuuucccagggccuggaugcuaagaagauagcucaggugguaaugugcuugcugcacaaguguguggucuaauacucauguagaaagcuggacauauugguaugcuucugugaccccaaggcugcuggggaaggcagaaagugaacaggauaacuccaggagcuagcucuuuagcacaaucagugagcuucauguucagugagagaucauguuugaaaaaaagaaaguugagagugguagaggaagauaggauaugaaauucuaaccucuguuaaugcauaaacagcuacauuugcacccucaggcaaaugacacccaugcauauacacauacaacaaacacacauguauguaacacacacgugcacacacaugcacacacacacacacacacacacacacacacacacaccuaugguuaggguugucaacauacaggaagcccaguuaagugagaauuucagaugaaaagcaaaacuuaaaacuaaauacauauccgaacuauucauuguuuaucugaaguucacuuugaaacaggcaucuuguauuuuugccuacuguccuaccgugcacuugauucaguuuucugaaaguccaaacugacuaagaauaguacagacugagccgggcgugguggcgcaugccuuugaucccagcacucuggaggcagaggcagagggauuucugaguucaaggccagccuggucuacaaagugaguuccaggacacccagggcuauacaaagaaacccugucucgaaaaaccaauaaauaaguaaguaaauaaauaaguaaauaaauaaauaaauaaauaauaaauaaauaaaugacacccagggcuauacugagaaacccugucccaaaaaaaacaauaaauaaauaaauaaauaaauaaauaccacagauuuaauaaauaaacagccuaaacaacaaauauuuauucucauaauuccugguugcuaugaggucccagaucacagugcaaacauggcugguccugauuucaagugagaaugucuguaacuuacagauagcauccuucuucauguucugaaguaggagaaauggaggcacaugcagagagagacagagagacagagagagacagagaaacacugccccucaggcauguguucuuacaggguauccaucauguucucuagacucuugucccaugaccuauaugcuaauccuucaucuccaaguagcaccuugggcauuagguuucacaggcuccaggcuccaccuaugaaaucuacccaucuuucugacaugaaugugguguucuucagcaagcauggcuguaagucccuggggcaaagugugugaagugaagaccaaggaguagucuuggaaguacuguuugaagagggaugaccccgaacucuagacagauaaaagaagaagcacacucaugagccacuugaugucugucacuguucaucagauucugaagcccaaugcagugggcauaccugaaaaagaugccaugauaguuauaugccuuuuccugucaaacaugcuuaugauaugcuuugaacauaccuacuaucaguuaucccaucuccuagguuuaccuuugccccagaaguccucuugcuucuugugcuccuauuuuaaaaauuaccugacuaaaucuaguguaugcugccaggacacucaauggccaucuauuggaguaggguugauuuaccaggggucuauauucuuaaagaaagccccuccccucuccugaguugucauuaagaucaauagcuccucaauugaggguaaggguuccugagcccaugccccuccaggcuggaauauugccuggcuugaucuuaugcauguuuugugcaggaaaccacagcugccaaguugauaaggaaggugguggugucauauucagaagucaccgcuuugcuccagugcuccccaagcuguggcucucauacuccaucuccucugcugagauggucucugagcucaguaaugacugaacauucuacagacauuuauucucuugaaccaguuaaggguuucuacauuaacagccuaguccacuugcacaaagaaacuuuucuaaugagguccaaguuaugagcugaucuaugagugucuacucuaucugcaaguucuacauuuuuaguucaacuaagcauggauugaaaacaauuuaaaagcugcaucuguaauaaacauauacagacuuuuucuuacauuuuaaacaaggaagggaaguagcuacuccuauauaauuuauuguauuagguacugcuagggagaaguuaaaguguauaugauaauauguaagaauauauaaguaauacacucuggcuauuuuacaguaggcacuuuagcagguacaaaauuuugauauuuauggacuccuaguccaccaaaauguacucauucacuccauuaugaaagauaacucacuguauccagugacauuaaagggaagaacguuuuccauggauauuaaagacaaauaugugaauugaguucuuguuuuaaaauuuuuauuuuuuaaaauuaacauuuauccaguaucccauauggaguugauuuauuuuuuuaaauaaacuuuuguauaauuuaauaucugugcauguuugcuaacauguuacagauacauguuuauaucagggugaagaacgugcucaugaucccucauguuccucucucagucucccugaugacuacucggucugcucucccucacuguaacuuugaggauauacacaaacccugcagcauguaugucuuaguugggguuaucuuuguugugauaaaacacugugaccaaagcaacuuggggaggaaaggguuuauuugacuuauauguccacaucauuguuuaucaccgagggaagucaggauaagaacucaaacagggaaggaaccugaaagcaggagcugaugcagaaaaccauggaugagugcugcuuacuggcuugcucuacauagcuuggucaguauucuuaaagaacucaggaccaccaaacuauggguggcaccacccacaaugggcugggcccucccauaucaaucacuaaugaagaaaauucuacaggcuugccuacagcauguggaggcauuuuucaauugggguucucucuuuugugaugucucuagcuugugucuaguugauuaaaaacuagcuaccagccgggcaugguagcacacgccuuuaaucccagcacuuggaaggcagagacaggcagauuucugaguuugaggccagccuggucuacagagugagucccaggacagccaggguuacacagagaaacccugucucgaaaaaccaaccaaccaaccaaccaaccaaccaaccaaccaacaaacaaaaauguuagccaccagaauguaucccuuugagccuucacuuagcauuuguaauucugugugugucagcuuauuuuucuugguugcucagcaauagucuaucugugauuccaccagucuguuuacccauuacccucugaaggaccccgagguaguuuccaguguugugucagugcugaagagcugguauuggaguuucugcagguauguguuugugugugcuuucucaguuuguguugcuagggugaguauguuuacucuugcauuuaucuaaugacuaauaguuucauuucuuugcuauccaugcaucuauuuaguaaaauaaugugucuaaguuuuuugcuuguuauauauauaguuuuugaaguuucuuuauguagcaucaguuccuagguccuauaugugauuugagaaacuuugucagccaucauguucuuagcuucacaucaaagcuauuuguuacugugaagguugguggagauugaacucacgcauuuaugcuaugccuaugacuuaccacugaacagcauucgccgcagcaaaaucaaaguuucaaauggguaucuuuagguuaucuauucccaauuuuguauuucugguggguuuugauuucuuucagaaaaccuuuaaaauucugugaauuuucuaguguugaaaauguauaagcuuuuggcauuuuacuuaaaaaaucaguauuuuaccaccuauguggaauauuaccuacaggucaagcauuucucuucacagaaccugaaaucugaaacacuauaagauauaaaacacuuagagcuaaacuacuccaaaaauguacacauauuucagaauuuccccaaaccugaggaaucugaagcauugcuggugccagucauuucuuguaaggaaugccuguccacccaugagguauugucgugccuguugucuaggcacauugucaaggacugguugagaauaggcagucuauggagccggauuucuuaccagcuuccuuuucuucuugugccacguucauugccauguuucuuuuacaucugaaaaacaauauagcaauucuaaaacaguuuuauuggcuauaaauuauuuuuaucagccuucauuugagaaugucuuucuuucuucaacuuaucugugaagaguguacugcauucuaagcagcuuaagggaggaagguuuuaguuuaguuauggucucuaaugauucauucagucccugguuagccuugugugcucugguaguauaguguauggugucaacaagagcuucuuugccuugcugugggcaggaagcagcagagagaugaagacaugcccccuagugaccugcuugugucagguaggccucacuuccuaaaguuuccagaaccuucuaaaaaccugcauugagcugagguccaaguacugaacaugggaaccuguggggguuaucucauguucauuuuaaaccacagcggggcugcauucacuguauguacaaauucucugcaguacuuugcauaacuuuguuacuuccugagcauuguuucugcaucaugagacaugugguuugcucuaguugcucucaagauguuuauauuugucuucaguuuuaagcggcuuagaucgugauguccaagagugugcugugucuucagucugcacaggguuugcugaacuuugugaauguguaugucugugucuuuugucaacuuuggaaaguuuucugccauuaacaguugaaauacucauuuugcuuuucuuuuucuuuuucuuuuuucucucucuuuuuuuuuuucuuuuugguuuucaagacaggguuucucuguguagcccuggcuauccuggaacucacuuuguagaccaggcuggccucgaacucagaaauccgccugccucugccuaccaagugcugggauuaaaggcgugcgccaccacgcccggcuguucucucauuuuuuuuuuuuuuuuuuuuuuuuuuuuuugguuuuaugagacaggguuucucuguguagcccuggcuguccuggaacucacuuuguagaccaggcuggccucgaacucagaaauccgccugccucugccuaccaagugcugggaucaaaggcaugcgccaccacgcccggcugccuuucuuuauagaaucucauugacaugauauuuagacuuguugguaccauucauucaguagguucucaaaucuuuguuuugacaggcauuuauuucucucugacacucagacugaauaaacccauccauggacagguacuugugcugaggauccagcccaugagcuuauuucacuuauuggacuuccacauccccuauuuuccuacucuucugccggguugggggagggcagauagcagggugcaugguacuucuccagauuucuguguguauucuuuugccugccaucagguuccaggaugugcugaguccaggacugggaaaagaagagcaaacuaagccaggguugcuuugaauucuggucucuauucauuaccauuguucacuuuaccuagcucguguagcggcuguacacccugaguagcuucuguagcagcacugaaccaauagcaccuuccuggugcuugagccccucuccugcugcugcuuugaaacuucacuugucauucacauccagacaauggagcuuuauccagcacuaaaaggaaauagugaaucaagcuaggacaggacaugaagggcuguuaacuguguguauuacuaagcuacagauaucagucuuucaaagcuacaugcuguacccaucccacugacuucuggaaaagagaagacaauggaguuaguaaaaacgaucagugggggccaggaauuaaagaaagggaaugaggacagacuugcaccuuacaaaggaucuguaggucagcaaagacuaauggugauuuaugucauugcuccuuugugcuagacuacaggaugcacagcacccagagggaaagguaaugccaaccgcaguuguuggcaacaaugaugucugcuacagugcuccaguuuuaacaauguguggcugugacagguugugcugguagugggaaugguugugccuguguaggggaagggagcauuugggaacucgguaccucccuuucaaauccauugcaagccuaaaacuauuauaaaacauuuaagacuauuuuaaaauaaauucacacgucaaagaugauauaguaaaacacuuggaauguaguugaaaauuucaauuuguuuguuuuaaagcacagagaaauugaauuuuuuaaaagaaaaaacgucugugcauuuuggaaguacaauguaguccccaccccaauuuccucuucaguugucaggauaugaguguuggcggcuucuacaugcuuuauuggaauuaucaggaucuaauagauaauuuugaaucugcuagaacuuuaugauacguuuaaaaugugugcagugccuuucucagaacuuugccaugugcuuccauggugauucauugggucuuaagagcuaagauaguuuauucaucucucggugcugggcuggcacacaggguggggcuugguaguaaucugagaaugguaacagcuguaccaccauuccuuauaggacacaagugucucugaggagagugguuucccugucgccugccugaggcugcaugggugcugugauuagucacaacacacagccccaaaacagccacagacaaggcauacaguagcuaugcagagccuggaguuacguugaucucaaaacaaaaacaaaagacagugcuuguuaagaguuaggcuccuugccccucauuuuuguuuguuuguuugcuuguuuguuuguuuuuguuuuuguaguuuguuugugggguuucucucauuguuugguuuguuuagguuguuguuguuucggggguguuuugugguuuugcuuuuggaaaaagugaagcaugaagaggcaggucuguaauccacuggcuuggcugaugagagggagggacuugucuaaauauagcauugcugccgcuaaugcugguggaaggggcaaugggagugacuguacaaaggcggcucuguccccuggcacuggaggauacccacccucccucccucccuccccuggccucaucugaucagauaugguucucugggugggagcauaugaggcugugaauguggaacuccauucucauuggucagcgugcugccuccuuaguggcuaugguguaauuuccugcagcagccuccacauuuuuauugauaaaguuucguacaacauauugugauccugcuuuucugucccaacuucuuccagaacaucccugccucuguacucagaacccaacucugcuuaauuucuuucucucauuaaaaaucaagcaaacaaauaacaacaaaauaaauaaguaaguaaguaaauaaaugaaauuuaaaaaucaguaaccaaaauauacaagcaauggaccaauaggaccgaaaagaaaaaaaaugcccuaacgaagucauaugagacaaaaggucuacaaaaguaucauugaauuugcuuuguguugaucauguacuucugggcauggaaccugcccuguaguauaguuaauauacucagugaaacucuauuggaaaagacuaauuuuccuuugcaauuggguuucaguuguagagagcaucuuggcgaguggugugagacuguguccacugagguuauacucuuccucuugcacugggccuucagcacugagagaaacggccauucuguccugucagccuagcuuccucuccucuggguugauuaucaguguuuugauauggcaggccacaaagggaaauuagcuauggcuacagaaucuuauuacggaagaccaacucauggggauagaaagcauauucauauauguauaauaauuauuuuaucuagagaaaaugagcaaaaacaacauguauacauacaguuaaaauuuuaaaacaugaccaaaacuucuuuggaaaauaauuaaauugcuuaauaaagcuucuugaguuccucuuaaaugcuuuagcuuauacaucagaaauauuuaaauacaauuaggacagauacagacagagucacagugcacccccuuuauauauaguccagcugcuuacauguuuauaauuuucugacacucccccgcuucucauugucccaugugucuguucaagugugcgugacaugcacacacacacacuccuguuuaucuaggaguaagauauacuuaagaagagaucaucgauacauuucccggcccaccaugccccucccagccuucccacacuccauauuuauaacucauucccuggcgcugaguuccuaguccuuuccauggauuucuaaguuuccuguguaucuagccccucagccaggccaaccuucccuucacccuccuaaacuauuguuccucaaagaaagagcagagguagaaagggaggagaggccuuuaaggaaaggcugauuucuucuccaaugcugugauuguacugauacaucaaaguuacaccgaguucugaaacuguucuuugggauauuugauagguaaaaaucuuauaucaauauaaacauucuguuuuuuauaauuaaaauacugacaguuuugcugaucucaguaccuuacauuaccaugcaccucauacacauauucccaugaauguuuuagauauaaaaacauccauauaauuagagguuggagacauguccuuaucaguuacuuucaucagcaucccuagggcagaaaguucuugaaaacucuuccucuucuuguucucuuuggaaauuguacagaugacagggcuuugucccccauggaguggcuggauggggaguagcuguguguaggcuucugcuggccuguccacagauaucagacaauccugggcuccgaaguaaaacccagugcugcuaaguuaaauaucauugcaucauucaaguugugggaaagugcugagguagggucuguucuuggcugacugaccccagcuuuguaagagcauagcuggcauuuuaguuauguaaggcauaacauggcauugacuugaacuccagagcaucuguggccaucauagaagagacagggcuauauucuugggccuuggcaagagcaucucauccugcacuaggacagaugcugggccuguaguccuguucuuuagcugcugccuuuguacaaucugguaacaggcagggaccaggaggguauuuacaguaccugcuucagcuucccuccaugugugcuuguuggacauuggagggucagggccucugcuguaucuuauagcucauacuaaccaaguccuacugcuuauguauaagccucagauguuaccuucugcucuguggugcaggccaaguucuuccuugggcacugggccuccgugcccuuaagacuugguuuacacuggucuucuuuugaccugaaacuguccuccucuggaggcaucuuccuccccacuuaacuauuccauugaccuuuccaacuuaacaccuuugccucuucuuauguccauucucagguuccaucacagccccucacccucguccaggguucacugcaggggcaugcuaggcuuggguggucucuggcuuucugauggucuuugaaguuuucugaaggcuuggaugacaaaaugagagucacugcuggcaagauuggugagaaaguccagcaccagcaugcucugagggcaaggugacuguccaucugugacugaguguaugacaucacuaggcagggguugcccugacccagcaacuaccauggguagcgcuuccuuucucugaaguuugagccauccuccccuuucuuauagcuuuaggacccagaguuaucuagaaguuguaacaggccaaggagucccauucuucauuuucuccaaaacaaugaauugauggggucagagaccuuauaaauaagcucagaagguccuguggaugagugugggucauccagccaugucuuucuacuggaaggcagaagcuacaguugcuagccuucucggugggggacgcuaucaguaggagaggucagccagguggucagccaggugggauguugagguucuuccugaguacuuggcauugagcaugcugccugugggcugccuggcacccugggcaucuguaauuaaguuucccgguaacucuaauagaugcugagagcugagaacacuuaugucuaucucaaaauggcucaugggccagugugcauuguguggcagauaugcuugggugucuuuuucucucuguguuuccuacauggucuuuucuccaucauugaacgcauuucuuguucugauggggucuuauucucauccugucucucuuggcacauaugcuguacaaagacauguggccacuuggacuguagaggccagaacccuggaauaauauaugacccaguuggagagcagggccagaacucugcauaucaugucacccugcccuggcagaucuaaaagcaguaguucccaaauagcagcuacaagauguccuaauugaagaagaggaggaagaggaggaggagggagggagggagggagagagagagggagggagggagggaggaagagagagaacgagagagagagagagagagggagggagagagggagggagagggagagggagagagagagagagagagagagagagagagagagagagagagggagaaagaaagggagggagggagggaggaaggaagggaggaaggaaggaaggaaggaaggaaggaaggaaggaaggaagggaggaagggagggagggaggaaggaaggaagggaagggaggaaggaagguagguagguaaaggcugcuguguuugccugcugauucaguuuuacaugugcauagugucccaaggaauuuacucuucagucugguucucacuggagcugcccuugugcccccuuucuuugugagcaggcuucugguauugcucucaaguaucuggcauggaguuguaaucuagcaguuuaugugcccugucacuccccucccugcuauucucuucagccuugucugugucuuuucucaugguucagucccugaugaagugggcucucagacagccaagaguucaaaccagauuguuuauauuuuaaguuguuaucaccauggguguuucuccuuucagacaaaaccucauaauuaacaugcagaccuucgaauuaagucaaauuauuggugucagaaaagaauucuuuuuauuaacaaugugucaaaauacugccuuggcauuucacaccaugacagaguaacaaagauuuaaacuaguguuuucuagaaugaaucaguuguuggaggcagggagccccugaacuuggaauuccuacaugaaagauguuuacuuuuaagaguccuccacuguguaagacaaagaucguguugagccugugcaggaagcaugcugaguggcagauuuuaguggggcuuugucgguugagcguucccaagaguaagucaccacacagauguaagaauugucuagugugcuuggcaccagacaaccccucucaguggcuuauuucugccuuucuuucacagauaauuaauggucucaacuugguuccuuuguuugaaagcaagggaauaagacauggaaaacaguuuggaguccuuugugacacuaaagcaaaacaauaaaaaggaauuugaggguguagaaguaauaaccaugggcagaaaagaugccacccuccggccuggggugacuuagauauugggugagaaaggcuguuguucuagugguaauucuugucugaggcacagucagggaguugagggguguauuuauuuggucugacagaagauaggaagacaaggucgagugugaauuggaguccucuuguauugaaaggggcaagaagauacaacaugacagugaguuucaggcaaaguggguucuucaaggagaggagaggaaugcccagaucaaggaauagaaaaacugccacugugaaagagcccacuacugccuuaugcuacgagggaaaggacgaaacccaugaacaaguggccaaggaagacuguuauuuucacaaggccugaccuagcuugcuuuucuguugcuaugauaacuaccaugaccaagagcagcuucauggaguaaaaagauuauuuuagcuuauggauuuuauaguccguaauugaaggaaaccaaagcauaaauguguaggcaggaaccgagagaccauggaagaauguugcuuacugacuuggucccuauggcuugcucagcuugcuuucuuguacaccucaggaccaccugccuagggguaucaauauccacagggggcuggauccucccacaucaaacauuagucaaaaaaaaaaaaaaagcuccauaaauuugccuccaggucaaucugaugugggcaauuccuuaauugauuuuuuuuccuugucugauggcaguagcauguaucaccaaaaagcaaaaccaaaauaaaaguaaaacaaaucaaagcaacugacuagcacaaggcccaaucauaaacaggugugguaggugucaccagaaaaaggaauugcugaaugcagggguugguaugguucagugacacuuaaaaauaaacaucuaaaauagguuuuaugagaugcuggaauuccaagaccacugaagugacugaguauuuuaggaauuguuuuugauuaucagacaauuuaggcacguuaacuguuuccaaggagguaaaauuaguuugucucucuggcaaagcuugccauucugauuuagaaucucaaucuuuaaaugccugcuagacccagccacuauaaauaugcagcagaugagcugcccagccccucugauaggaggagcugagcguagaagaacaguuuuuugucuuuaaguggaggcccguagaagaagagugagugugauccaguuuucucaugacccagcaucugcaaggauuuucucaggaugucacuguagguaccaguuucuuuuaugauaaauggaaaauuugugauagugguauuucuugucuuaacucaggcaccuugacaguagauagcauuguauuuugagguggcuuuucugguuaccauccaacaucaaagcaggcacauauuuugguuauugcuuccauuguugcucauguggcauuccauaauggaaacacauggaggaaaggggucccauggcaucucuucuuuccuauaggcaguggauugugaauagccuuucgagcucacaggccucauuuggguuuuuguuuagacaucucaggacucuggagacagguuauagagagaaggaccuaaagacagcauaugugggauuaccuggccucuucucacccggcuaacacagcucaugccuaugagauauuuuaguuaucaagggaggaaauauucacggauauuuuaggauuuaggguagaacuaagugauuuuugaauuagucucuuuccugaauuaauuuguucucaguaaucugaauuuuguuuuugaaacuucaaauuaaaauaguuuuauuuuaccuuugguagaaggguuaacaggcuauuucuacuucuuaccuucaucgaaauguaacuuugguuucuucagagcgaaaguaauagagagcugaggaaaaggaugcugcacuggaucagcuugucugugacuuauacccuaccucugagcugugaaaccuuaccaggcuagacuccauagucaaguauaaaagucucagcuugagugggcugugcacaccugaaauagacagcuuagggcccuuuagucccucucuguguuaacaggaacucucugaaaugagucaguuuucagugcauuuacaaggauguggcagccuuuugauagagagccaugcccagaauacaugucuguaggucucugagcgcaccugagaacuauaacucaugagguaaaaucugagaucagucuuuguaccauucgucucuuuccauucccucucugugacccgcgggaacaucuguucacuuguuuauaauuuuagcagcucucugagguuugcuguaaacauugaaaugaagcauuuguugaaaaaaccacuucuacugguaguguacagcuguaauacuaguacuaaagaggcugagacaggaaacgugagucuuccuggacagcuaguauugcuaaauuuaauuuaaaaaaucccauguucgccgagcgugguaguacacgccuugugaggacagccaggacuacacagagaaacccugucucgaaaaaccaaaaaaaaacaaaacaaaaaaaacaaaacaaaaaaaaccaaccaaccaaacaaacaaacaaaaaacaaaccauguucaauaauaaacugucuaaaaauacauagugaucgauugagcaaaacuccuagcuuuggucucuggccaccgguacaugcagguacacacaugcuugcauauauguauguauacacccucaggaacauguacagacacacauguacacacaguuuuuuaaauguaaugaaaauuaaguaaaaauaaaauuaaaacccagguuauuauuaauguuuaacgagcgaugccacuauaaagucuuuuaauaaaaagaacuuaaaaaaaagacuucuagucccucuuuacagcuaucauguucuguaaaauuauuuaaugcacuagcuaucauacgccuggccuaagcaguuuggaaugucauagguggcuuuuagugacgauguccucaccucacagucagguuucuaaaggagccuggacauauggcgcuacacacaugguguccaggggaaguuucauagcaagagcugaggacauggcucacaagaagauacacagcccacaucuuggaacucccugaguuccauacacagcguuuggauuuugcccugcagggcagcagucagcaagcacuuuggcagagggucagaugguaaaugauuccagcucugugggccgucugucuuugaagggcuccuuggcucugccaugauauccaaggccacugagcauuucguaaaugagcuguggcuggguucccaugcugcuuuguuuaugggcagaggaacuugaguuucuugaaauaaguacuaggaaauauuguucucuuguuuuuuucaccaaucguuuucagaaauguaaaagucauuuuuagguugguuauauguugagaaauugggaaauuuuugaacaucuuguauacaccuacuaccauuuguaugucuucuuccuuuaaauuuuuauuuauucuugugugcauguguguguauguguaguaccguguguccaugugaagauaagagggcauccuugugcaguugguucucuuccacuuuuacaugggucccagugauggaacucaaguagcaagcaccuuugcuugccucaccauccauguucucuuuuaggaaaugucuucuucagagugcuaaauaccaaaauuuagguguuaaagacagaagguugagguuaggccuaugaugcagagacaaucugacaucuccuuagagccugcuuucuagugguucucaaguaggcauuacacuaacaaagaugcuuuuuacauauucugcuggagaaccuguguuugcaagaaggucugcagcuacaacacagaagggcccaaccccagugugcagcccugccugugcagggggucagagcugaagcucugugcugugaggcugacuagaaggcuacacagcagcaguucaguccucacugcagagaaaggccagccuguccacauuuucuagcucccauauuuugucuauacaaauaaauuuaacaaaaacaacuucuuaagauuucagcccuguguguugggagcaagcauauuucucucuguguauaugugcauaugcaugugggugcuuauuugcacacauguguguagaaggcagaggucagccuugggugccguuccucgggagcacucgacuuuuuugacagucuugcauuagccaggagcucaucaccugugcuaagcuagcugacuggccaagcccagagaucugccugucucuauuccccaauucugggauuacaaaguuacuaccaugccuggccuucuugacagcauguuguggagauuaaaaguggguccucaugcuuuugcaaaaagcacuuuaacugacugagauaucuuacccaccagcuuaacguuucuaaaauguuuuuaaaaguuagauaauaaaauguguuuuguaugcuuaguaauucucuaguaaauuuguuaucaaauuagcauugagggaaauagccuuuugaaucuuucagauugccccguuuaaagcuuuaguuuccauauuuauccucugaccuguuagcacaacuguuuucuagagaaauagacuauuaaacuccauuuugaagauuaagaucugacaguggauuauuaaauuuaugugugcauaccaucucuccuagggguauuugcauuuauaugaucuccugcuuguucagcaaaaggcauuggcucccuuaauccugucugagguguaagcaugccagauguuuaugcccucugucggaacucaggcuaugcuuucuuaccaucacuuccccacaggacuccugaaagcagugcuuggcacacagcaagcacauauuaaauauggcaaugaaugggcauauugagggaauuuggaacuaaauccaagaaucugugaguuuggaaugaaccuccuuuugaaaguucuuuugaauggacgacuucuccucaccaccucagagcugguccuggcacagagcuuugguaucuuuaagcugaauaaagaaacauuucagcuuccucuucccuucuaaaaaggauauauuuuauuuuguuucaaucaauccccuguguauuuuguugggcauugcaaauaugcucccauuucgagcugugcuuaggaaaagcauauuaguaacaacacagguacauuaauacaagucuacgucggaagcgagcuguguaagaagauuccagacagaaaccuguauuuuggaaaggauuaggcgccucauauuuucauucugcugacuugaagaagggaggagaagcugccaugggcauuuucuaccuuuauucugacagccuucaacuaucuuagaauuuucgguguguguguacguguguuucuucccgaguucuucagccucagagacaggacaggcggggagaguugguaaaacugaacacugauuuucuaauugaaaggauaagcaaacauggaaaggguugauaacagcccucagauucucccaugccuuaaauaaacuaagcaggucuugucucuuuacugagaaugcagcauggaagagguaagccuuaggaguggggugagacuaccauggcaccucuuccucacugugucuccacccuaucugggaaggcaacacccaggcuugaauacaugccucacauuccugccaagugggccagcaaguggcucugggugauggcugcaucucauuccuucucuuccuaaaccgugaccagcaguuccuugcagcaccacacccccuccuuuccugcacccacuguacauacccaagagcacaccuccagcuggggguugccgagaggacuggcagcuuucuggacugugcuaguagggauggaacacucauguccugucacuggcaaggaggggaagagagaagagaguuguauguuccuugucauuucacaagacccaagcauggauuccuuacuucuuguuugagcuggguucuaccaggugauaguauggcaaauuugacugcgccuugugaucccagcaagaaaauauuuacuguuauucuuuccagggaucuauucuucuucuucuuuuuuuuuuaaagauuuauuuauuuauuauaucuaaguacacuguagcugucuucagucacuccagaagagggcgcuagaucucguuacagaugguugugagccaccaugugguugcugggauuugaacucuggaccuucggaagagcagucgggugcucuuacucacugagcuaucucaccagcccccccagggaucuauucuauauacauuuuguaaugcucacauuauacuaauaaagugcccaugacuuauacuuaauuaaauauacaggaauggaaguagaggcauaaugccuuuucaaaugcaauugugauguggacuaugcuuggugaaccagacagaauggcuuuuguccuuggaguggauagacuccugggguuauuguggaaaacuggacaacagcccucagauuaaaaggcuuacccuaaguagacagacuguuuucuauauuagucuuauccuggaaagucaauuuuaaggaaaugaaggaauagugaugauuguuaucaugaugguaacuuuauggcagaaucucacuccauagucccagcuggcuuggacuaugucuuuaauuuaacuguguuauuuaauuuagguguguaauaaaucacugguugaaacuaagaaacugaugaaaguagguugcaaugguauaauagggcauauaaaaugggacuuacuuuuugguccuccauuuccaucaauuucacaaauuugcuuuuccauauuccucccaaggcaacuaaguuucacuaucugaauaaaaacauaauucuccauaguuuauacucuccagcacucagaggcaaauuguaaaauaggcacaguuaggugcuuuggccagaucucucuccauuuggacuugggaggaugggaaucuucgcucuagaauccuaugugcaaaagggcuggcaagcacccagcagaaaacucucuucucacuuuguucuuuaaaguaacucugguucaucuuuaaagcaagcaagcaagcaagcaaccaacaacaacaacaacaacaauaauacuaauacauguccuaaauaaaucuuuugcuuaugauaagaauuacauuucaaucuguuucuguuacagaaaauaauaauuaauauuuuaugauuaauuugcucauauacagguuguuaauuaccaaauugaaauaguuccacagcauguaucaauagguaacugaaaugcuacaguuugucguggugucuugugacuauaaaaugcuaaauacuauauuaacucaagaaggcuugcagcguuguaaauuacugggaaagacauuguaaaucaaaauauagauggaaccauggguagacugaaucccacauguuccugguuuuuauuaaagaugcaaagauacuguuuccuuagguugcauuaguggauguacauuuuaucuuaugguuaugaugugucaacauagacuauauuagucuauggaaaauuugagcuugagguugaagcuggagagccauaauagggagggaaauuacaggaagaaaaaaaauauugcccaagcaaccucagcugagaguaccugccuucauuccccauccuucugcucugagcagaaagucuagaucucuaaaagaacagaauuucauacauaggugacccuaauugggucacaguuucuccucuccuccuuggacugagauaagcucuguucccagaacuggggacacacugucucaucugugcucuccagccacuagcuaaugagcauucugcccuaauacugguggugaucugucuauggaccagaaacaggggcaggagucagugguuggggaccaucuccuuucucaaauuuuguaccaacucuacucugaagucccugggaggugcagggauacagaugucacuagcuuugagccaccaagggauguuaaaggugagaacaugaccaaagguaauguggcccugccccugagguucugccuuguggauuuucuugaguggguugucagagugcuauugguuaugaggcuuaaggccacuaucaugugaccauuaaggagggccacauaugauugaucuaagcaaagaggcuuccugggcucucuggcuugaagagaaggcaucuaaggcacuuugauuucuaccaauaauuuaugacacaucugcaauggcuaugugauuuauuuaugugugaugagccuguugugcaucuuuuagcacacuguguuuguuucauccucauugauuccaacccagcuaguguucugaugccaacagcuuuaaugagagugaaggcaucagcuucacuuagcuucagguauuagggacgauuuuuauuguuagcauuuuguuugguggucagcaucuucuggugauugggcugagacagaccugaguuggaguuauggcuccaucccuugcuagcuaucuuguguuuugacaguuccuuaauucaagucucaguuucaucuguaaaaaaugagaaauaaccccuccuuuauggguugccaugaaaacccaaggagacugugugucugggcgcccgccuaucucuucacugagcuuagcguaagcauuccauccguauuaguuaucuccucucccuccuuugaaauggggauaacacuacaaugccagcuacuuuugcauggauaugauuaugaaauguuugagaguugccaaaaugguguuaagugacacuagaccugugugaucaucagugggacaaucuaacaagaccagucuggccuguucucucuccuagccuuuaaccagaguccuugagcaaggcuggcagggcugaaaccuagaaccucucagcaugucuggaguucauauucucauggccuuugaaauucccacuauagccaguugagauucaacuaaaagacucgauguaugccuuuugcaauuuacccuaaagcacagcccucccucaaccugcugcaugagcagguaacuugcuacccucucucccuuuuuguccaggaaggaguuaugaauauuccccuugacagacuuuaucucugaguagucucugaagucuucacucauuugagauuguagcugagguaacugguagcuggccugucaccggaaaugccuguggguccuaaagcacaugcugaauuugcagcagguaaggauccaagccuagauucggagggaccucggaaaucuacuuacccagguaguaaagcgauguaaugaacugggcauaguuguauuagaugugcaugguugucaugacccagacagcauggggagaggaaagacugacagugggcaugaccuccugaacgcucaguccuuugcucagugacuccucccuuucauugaggucuccuucagcauuuccccuccgggcuucuccacuguaaggguugugcagccugaauucagaccccuugucaguucuuccuugggcuucugaagcuuucuugcuugaaggcuucuccuugcucacccauauucuauuggcuauaaagaagauauuuuugaagaauacccuucucagcuucccucauuuucaacaauguaccugccccuucuugcuauuccagugauacucaaaugcagcagcacaggaacauguuagaaucaaggcccugggcuccaguccagaucuucucugugauccguacucaccagacccugagugauuuucuucuuuugccccaguggaaugaaagugacaaaugauuucucagauaggacccuaugcccuggacacucucugaguuuggggaauuuacaaugaaucaggagucacuccauaugcugucacugcuccugcuauuaagaacauugcuagugaugccagaaugaguccuuaccccuugcuguugcugcccucaucuugcuuugcuuagcucacuagugcagugccgaguugcgauauacacauauggccugggaagauuucaucucagaagcuuuuuuacccagcuucauagagguuguauuaguguuguguccugugugaucuucugcugggguucucaguguguuucugggucguacucuguaggguaauaccuucuucauucuucucucaacaugugacaaaauauuuuuccugccuugaguucuuucuuggagaugugaccuccugagagcacaaaggccauugcccugaagcacuuucugcuauuucugggggccaaggccucugaaucauaagaaaccccaagauaagacacagcacauauacuuuggucuauaagcaugccacuugacuucccccagcucuucccucucaucucugguuccuauuuucauauguucucugaacaacuugcugucuacacauccccgauggggccacacaggagccaaacugcuaaauugaauccaggcuucuuauucuaucucuaucccuggcaugaugaggggcccugccuuuucucugccagacaagaaguguuagagucaucuuggauuucuucauugccuuggguuucacucuuucacugaacauucagucagcacacuucuguaugcuugaagucaccuuuuuuuugcauuggccucuccgacuuguguuuaacuaugaucucacauugcucauucaucuuauagauaguuacuuuggacccacuacccaccaauacuuaacaccuggaaaaacagccauagauauacaucaaagucucaccaaauccucacaucuucauauauucuagccagggagacagauguuaaguauacugauauaaaauacaaaagcagauagaaaagaagguagcagggcuguuguuuggguagauggucugcagagcuuuugugaggggcauuguuggguacagaacuccguguaaauagacaugaaccaucuugggguagagcaugucaaaugcccugggguacaguugaguuuggcaggucuaacuaagaguaggaaggccccagcauggcugcaguuauuuggccuuaggagaaauaacagaaauugaaguaggaaaucugggcaauuguggagaaauaaguguggaaagauucuaaaauucaggagauaacuccaagagauucuaaggaaaaguguaggauguguucugaacagagaagcccucacaccuccaggucugagcuaaaggcuauagccuuauuauugaccagccuguuguccuccaaguguuuucuacaacugcuagguuaaccuccuagccacacuucuguuuccagauucccuucccuagagaccgugaugcuuacugugcagucuaaguugaaaccuugccugcaagcucaauuguucauauguccagcuauguuuccugccuuuuccucuuaguucauacccuucguuccaugcuguucuuuaaaacauaacucaaggagcaccuuuagaucuuagccaggaaccaccauucucuucccuaggcagaaaauguucuuacucuuaacuugagcucauggagucuaguuagguguuuucuguguuuagcaugcuacuggggguggaacucacugugucucacucaccauaccucuuacaaaggccuuuggccaugugcuuccuuacaagggcacuugccuuucuaucuuuacucuagcuaugauauucaucuuuguugugacugcuuaggaaacucggaguccugucuacuacuguaggggcuggcauccuagacuuuguuucuacucuucugagcaguugugccuuguaaccccuugucuauuuuagauauaacagaauggagaaaugacucuuagcauuuuuugugucauauugguaaaaucccaguccaggaagcauggggauucuuuaccugcaguaguaacugucagauaggaagugguaacuacaagguaauuaaacuucuuucuagaguaccugucaucagcaaaccauuugguuaccuucauaaggccucaaagauucuucaucuaagcuuagguuuccuguuaguggugauaaugaaacuaguucuuccuccuaguggacuccuugugagcaaagacuguaucuagaguugucuauguacuaaaaaggauaaguaaauuaugauagccagaagggagcuauggucuccaccaguggcaccacuggcaggcagcacccauguuaguucuuuucagggauucuggcuucugaauccuaacucaaaacaguguugguacaguuguugccucuccaucaagugauaggauugcguucuaccucccagugauuaugugugccaauaaugggcuucucugaugcacaaaggcuugcuugggacacugcaaacuucauuucaaaggauccuggggaacaguaguuggaauagcuccuauuggaauuucauggcuggaucuuugugccuuuuacuucagccuuuuauuuagcucacuucauauagagggaaaaugcuauuuuuuuucuugucagaugaaguacacauggcaggaugacacagggccaguuuaaagaaauggguagcucuuuugcguucuaggaacacuaccuuugugcugggaacugacaugacuucaaaauccugcugauggcuuuccagagugcauuucagaaauccuaaccaaaguuaauguuauuauagugggugaaaauagucucuagcuguguccuaggggagacgacgacaugcugguccagggauugaggccagugucaggguauuauaguucugcugacaggaggugagcaucccauucggcaggaugaguagugcuggaauuccuacuggucagcugagugacuaugaagggugaggccaccucuagagacugaauugcucuuguauugguagcaggauuguuuuccuguaacuguauguagucuuucaugauaagagacacagagcucuagucauaauucauuguaagccccauaugaauguacgugccgggaggacaaggcaacuggucuaccagcaaauaauuaagaccuggaugaugccauuuccuauagugucugaggcuggccaccaauacacuuguucagaggagacuuggcaaagacugcucugugacugcuuggcccuuugcccagggaaagaugaagaaacgcucucagacuggcugaaugucacuguguacccagcaguaccccagacacgcuuauagacauuuccucacuugaucuuuaucgucacagaaacagcagugugagauggcugggaugaucccgcuuucaaucacaaugugcauuuaaaaugcuuauuuuuagacaaaggaaucuggcaggcucgggaauaguguaagauauucagauuaauucaaaaauccugugguucagguucuuauuaguaauuuugggaaauauacauuugacuaacagcuugacagaguacuuuuaguuaagugagggagaauacauagauauuuaaguauaggauaggaaaugcuaauacuuuuuaaauguagguaaggccucuaaauaucaucggaggaauaaaauaccacugaaccaaacacccauccagcacuaugcugugucugaacaagacuacaaguguucuuguuuuacaaagucccuucuggaggucagauggcagccaguaugcuuaugaaugagccaugagauguaggaccaugccuucauaauggccaggaacuagcaggucccuuuggagagaauucuaguuacccacagcucuaauauuugaucuugaggauucuuggagaguuuaauaggccucuuuacuacccuauuggagauaaugaaagaaaaauuaaaagagaauacaagaagaugcauuuagauuuacuuauguguggguggauuuugguugaagucuaguuaguuuaguuuguguugauuuuuauuugauuuaguucaaacucacaguucaguguugaagguaaguuuuugucuguuggauauaaaaagguaacacauuuuccuaggcgcuuugcaucuaggacucgauuuaauacaaauaacaccuuguucugcagugacagcaucacaauuaauuaugaaagggcaaauuacccuuucucuguucuuuaauaccaaaacaguauucauagucuuaacuuaucuucuaaaaauacuugguagcauucaaaaaaauaaagcggaaacucacugcuggccaacauagaguguuuucuaauaguaacugucagagaauagagcacuuggaagcuauucgggguaugaugccuuugaggaagaauuaaaaaaaaaaaggaauaaaaacgucuuuacuuucuuuuggggaaaauauauaaacacaaauagugucugucggaugagaauagaagugggaccuucccaaauaaauauaccucuuuauaugauuuugauuguagauguaguguuuuacauagucagaaaacaagggagugucaaaguugaagugaaucaugaagaagcugaaaaacaaaagcacagucugaguauguaaagccgauaacccaauugagacgguucuacauagcugcagugaaaacgugcauacaacucagugucacgauccuaaauguccuggggaagugcaagcaacccaggaaggcuaaagcaacccugaaagaacaguaaacaccauucuaggccuuucuucuaccugauuucagugggagcaagaagccuuucaaccaguguugccaggcaaccagugcugccaggcaaccagugcugccaagcaaccagugcuaccaggacagcuguguacccacacacaaaagaaugaagcuggauucaguauuuauacuauacagauaugcacauuauaaauuuauuaguuguaguauuguguauauguguacacaugaaccagccaauugaguguggauuacugugaugcacugcacaaguggaauaguacuuuguggagucaguucuguccuugcacccuuaaauggacuccgggaauugaacucaugcugucaggcuugugcagcaagugccuuuauccauguggccauaauaaucuaaaagcuaaaacugagaaaauucuuagaagaaaacaagaagaaacaauuuugggaucuugaauuaggaaaauauuuuuaaacacuaacagcagguacauaguagaccaacaaaagcuuagacaaaucagauauacaaacauaugugcuucauagauuacuaugaagaagguaaaaugugauucauggaauguuuuaagauauuugccuguuucuauaugaugcaggcacuucauccuguaaccuuucaagaucucuuccaccucuuuuguaaaaagucaacccaguuagaaaauugguaaagacuuucugcagacauuucuccaaaggagaaaucuaaauuguugauaaauccaagaaauguuccugauucuauuaaugaucuaggucaugcaaagaaauaccaugugaagugugccugugaacccauuagaauagcuauaauagaagagacaggaacaggugccaccaggaauguggaacaacuagaacccuccugcauuacuugugggaacauauaguuauuuugaaaaagugguuuauaauuacuuaaauuacuaaacacaacuuagccacaugacauaccaauuuuauucccaugaaaacauauguccaugaaaaaaaacuuguguugccaaauguuaauggcagcauuauuugcuauaacuaagaaauggaagcaaucaaaauguccauuaacuacugaauacacacagugugagugcucauacagugggguauccuguagcacucaaaauaaccaagggcuaauaaauacaugguguaaugaugagcauaaacuuugaaaauaucaugcuauauaaaaaagcuagccacaaaggccacacauuauaugguuccaucuauaugaaaugucuacagacauuuauaaauagacaaauauagacaaauauagaagaaaagaaggucaauaguugcucagaucuaaggaauuggaaguagaaagaaaauuggauacuaagguuucuuuggguuucauaaacauuuucuugcuguggauuuaugaaauauugaauugauauauuaucauggggaaaucauaugcuauguauauaucaauaaaggcgcuuuuaaaaaauucgguguuugaacuacacuacaaaacaaagacacaagagagaauguuccgauucaaagaugucuagcaauagaguacagugucugaaacuugacugugcuuuugacugaaaaauaucuccacaggaugaugugagcacagcugagaacuuugagcucacagugagugcggaguacugugugcuuagguaugcugaagcaaugguggugggauugaauaggguucuucccuauacccaagagagacaugauugcacauaacugauuuaaguuagcaugccuuuauacaguugguagcauccugaaacaagggugcagaagccuuuucuccaagcuuccucuguuaacauucaacucucacuccugaaauggcgugagauacugaaagacuggguguauuuugagcuuggaauucauagagaaaagagcuaugaaggguacagaaaauucaaauaucuguugugucuauugcauuuugugggaggcuaccuauucuuuauuauauggcauuuguccuaauuugcagguuuauuucugcuccucuaccagacacauggcauuuacagggugauuacuacucaagauauuuuuagucacuuaaaauucagaauauauacuacaaucuguuguaauacuaugacugccauuaacagugcucaaaauaucuuaaucagugccaauaauuggccagcuauuaaaaaaagucauuucaagcaggaaacaauacacauauacacuguuauuugaggaaaacauguagaauacauuuguuggcaaauucuucaauacaggacugucuuagucuuucaguuauuguaacagauuuccugauuguugcugauuuuuaaagaguaaagguuuacuuuggcucauagcucuggagucuggaaucagcaucuguaccugaugguggccucauaauucaucauaacauggaagaaaacuguuacaaagauaugugagcauguguguggaaugagacauaaacacuagggugaccucgcucaugccaguguaugcuaacuauuaguucguguggugacuaaucccaaccugaaaacacagcaguaaucccaacaagcuauucacuucuuguagguuuuucccagcuccccucugcuugcuguuacauaugcauauuuuguuggcaugaaggacuguugccacuuccuauauugcaucgagacucuuauaguugucaugguguuuaauagucaagguucaagagcaucuuuuaagccacuucauuaauucaggaacuugagauuuucuucuuaguuucauaagggacaaagauaacaaagcauagcuguauagaaucagagugaguguauuuccacgucagugauccucgcucuuuuacaguugcuugggaccuucaaggaaggauauuuuuuaaauaaaaauaauagucauuaucagauccagcuauauaguauuuuacauacagcuaucaguuguuuuguuguuacuucaguuugggucuggaauguuccccagacccaugaguuuaagaucucauccuaaaguggggcuuuugggugguagaauccaguggauggaaguucuaugguugaagugugccuuccaaagagauuugaagauucccaccuucugguucucucuuuucuuccuaucaugaugugaucagaacuaagcauccucaauuacuagcuuccaccauuaagaacggugccagcacaggcccaaagccacagagcccugcagucacagggugagauuucugaaacaaugaaacagagaacuccuaucuucauuaucuugcugucacagcugcaguugucaacuugacauaucugggaaaugggagcaucaguugaggugggcagaucuauugagacuucauuuuuuuuuaguugauaauuaauguaguaagguuccacccacuguggguugugccauccuagggaggugaggccuuagcuauauaagaaaggaagcugaguaagccagagggagcaaacuaguaaggaucauuccucuauggacucugcuucaagauccugcauccagguuucugcuugaauuccuguccugacuucccuuagugauggacugugacgacaaagaguaagcuaaacaaauucuuucuucucccaaguugcuuugcucauguuuaucacagcaauggaaggccagcuaggacaauugcauaucucaauuauuuuuccugugugguggaaaaggcaauuaacagcuguuaaacuuaaaucucacuacuuuaccugauauuuaauugaauuauauaauuauagucacauggacagcagguaguaauaaacuucugcacacaaccugcucuguuuuaucaguuaucauagucagcuaauaggaggaauggccagccauuuguucggugauggcuuuaggggacuuugacuuugcuuacuagagacaggggaagcuguguuuguugacuggccauauauggacuuugguccagagaaugcucauucuguacuugauuugauagagcuagaguucauagucaaaccuacccauaugcagagaacaugagccuccucucagggcuaggucugauggcuccugugacuccugggugcaaacugcaggauggucaaagugcaaaaauaaaucaguuuucacugggaagcaaaguaagaagaaaggaaaacaucgaauaagaauaaaagcagugacagaaauguggguguguccugcauagagaagugacauugcaaaaugaauuucauugagaaaauguagucauuguuaucuuuauguaauucagaugaucuacucuugaaaaaucuaagaaagucauuuccggauuucuuguucugccucauugaaaaaugugauucauuauauaaaaaugggcugcuacugugcuuccuuucuaggguuuuguucuguggagcacuuaaugagaauguauuuuggggaaugcucugugcagguuucgcagcagauuuucuaucuuguuuaugguuuucacauauucuuuucucuagcaaagauuccauugcagguuacagggcccauguuuuccuuugguuaguuccuagaaauagagccuuccucucaccacacucuuaauccugugggucacaaagagccuaacauuuggcugggucugaccccaaguagcucaagagagaugacaggaauacacauugguucagaaggugccucauuuaaacuaacuggauauguacagaggcagacuuagauaagcaggcagaugacucuagcaaaggguauguuuaggaaucauaaucaacccaguuuauuguagcguauauuagaaauaucagaucauugagcuucuacuuagucaacuuggaagaaguaaguuauuuuuuaaauugagcuuucauuuguaaguucucuauagcuuuggccagaaaaaaauacauuucuuaaaacacacauauacaaauauauguauguauacauugcuuucggcacacacacauauaugcauaccuuucucucaagacacacaugacacauauacaucuauguguauacuuuucuuucaacauacuuagacacaaauacacacaccaccaccaccaccaccaccaccucccucuagcugcccaggacugucucaaauuuagaacuggggaaaaugaacuuuuauguccuuuacauuuuacaacucccccaaaggagaaauagcuuuaucuaccuuuuauagcaagaggucaagagccucaagaggucuuguagcaaaggccaguguggaucuuugagagggagaagaaacugggagucccacauggguaucagacaagucaaugguagcaagaaggcaaaugccucugaaagaaguagagagcacccucacuguauuucugggucaaauuuggaauaauuugaaggauuuguuggcuacugguguucaaguuuuaaauccuaugguuuuucagugcagagaagaaagaauguggcauuccuaauuuaguaaugaaggacgugggcucugcaagcucauaugauaucuaaagguguuuacagaccuuguaagucgacaagaccuaaagaccccauguaccucugguuuauagaggggcuagucugagcugguugggaugagcuuuugugaugugcuagguccuaaugguguggacaugaaguaggcaugggaucuaauccaggucauuuugugaauacccuagaauuuuucuuuuaauauucucugauauuuacaauguggcuuaaaaagaguaauuaaaaugcacucaaguugucuacacaagaaaucugcuuugcugguucauaauugaucaagggcaaucuagaauaacaaccaccauaacuuuuauuucaggaacauuuagugauguauuuggcauucaaugccuuuuauuggguccagagccacaccuuguacuggacugguuuguguacagauaucagccuaucccugucauugcuggaacuaagagcugugccaaaguaugcagggugcggcugagauagugugugagaugugugccaggcauucuguuuacucguguagcuuuggggagcgaucaaagaugaacagugagagccaucaggaaacuugaaggagggggaucguuuggagcccucuagccacacuuaccaggagaucccaaccaagcuguuguauguagcuacuaccuggaaagaguacagacuuucggccauguucauccagauuaugcaaagcagugcuucucucugaauauuuccuuuguuucuaguagugaauauagauauuuagcuuguucuuugugaaggauuuggcauuugagauucuuuucuuguuuuaaauuuauagacuaguagauuuuucccuuuaacugcugcuaacuauuuucacugauuuuugcuuaaaauuaaauaacacgugcuacuacaugauuuaauuaauacauaccuuaauuuauauaugcagugaucuuuguuauauaacauucuggauaauauaccauuugugccaaaauaauuaucuuacaaaauuguaagguuuucugaaugaaagcuuuauuuugucaucuuucuuuuacaguuuuuaauacuaauaauaauugcuuuuaaaguuuuucuuucuaaugugcauugguguuuuaccugcauguguguuugaaggugccagauuguguuugaaggucccuggaauuggagcuccagacauuugugagcugcuugcuaugugggugaugggguuugaacccagguccucuggaagagcagccagugcucuuaagcgcugaaccaucucuccagccccuuuuaaaaauuucuuuaaaugaauaauugcuuuuaaauguucacauuugaaugaugccauauagcuuacaagcugccuucuuuacuuaauuacgugcuuuuuuuuuucaguuuaaaaugugaguuucuuaucaucucuaauagacuguuggcugagacuauauaacauguaugucacagacugaccagucaauuuaccauaaguagcaauguccuaaauauucaucccucauauccacagggauugguucuaguaaucucccaaauacccaaguccacaaaugcccaggucucuuauguacaaugauguaauuuuugcacagaaucuauacaguccucuuaaaccuaagguuuaaguuuuaccugacuuguaauggcuaguacaguguaaaugccauauaugugguuguuucauugcuuagguaauugugauaagaaaauaucuauugcucaguacagaugcuguuauuauuuugaaaaagggucugauuguguagcagacuugaacuugagucccccugccucuaccuacugagugaugagauuuguucuggucaggcuccaccaugcccagcuucagucaaauuuuuaaaaagucucucugcauuugauugaacuuguggauauagagcacuuguauucagaaagucgauuuuccauguuguauauuuuauguuuguugcaugcccuuucuucuggugcgauuaauucacuucacaguuuugccuugagcuuauauuuuuagcuagcuacucuugguuccucuaacuggugcaaaauuuggugagagggaugacgcuuaugcagcucgguaccaagacgaucagaacacauguugcagagcugugaggaaaguguugagaagcaaaacuggcguuccaauugaaggauugcagaaauggcuucccauucucacaggucuggguggaagugaagaggaggugagggcuaaaaaauaugagguguuuuuuacaacuagcugauauuuguugagcucugucagagguaugagaagaggguaguaggcagcucuugaacucccaggaggaauggggaagaggggccagcuugggagggaacaauguaugcaaccaugagaauuuucuauagauuggucauggucauggugaaguauagaggugaaacucugacuuugagagauguugaauaaauaggagacuuuuccccuuccccuuucuuggcucugcauucccuacacagaauugcuaagcucuguugaggagggcaugggguuagagcuuaggaaaggaucuuggcagaacuguaguggucaguaggagguuuggcagcaaugggaaggagcagccauggaaccuggcaugucuuuggaagucauuacacauguguuuaggacuaguucccauuucuuccaacagugccuuccagcaagccagggagaaagccaaggguaugugagguuugaaguaggccacacgggagcagaaacaaguggcuucaacacuggcuagaccccauaagaccugaccuguuugcacgugaaagaguuugcuaggaaaaaaucauucaucuuguacaucaggggaagacaagugaguuuuacccacuacuccaauauggucucuguuuuguaaccacuucagacuacauaggccuuauacugccagucugccugaucuuuugaugccucauguauuagcuuugaaauuuuguaauuuugcuuugguuauuguuugcacauaugguuguauacuauguacaugccugcugcccauagagaucagaaagggguguugagucuuggaacuagaguuaaggauaguugugagcuaccauguggguucugagaauggaacucagauccuuugcaagagaagcaggcggucuuaggaaauggacccugucuccagcacugugguuucccuuuugaucuccucuacaguggacaacugccaccuccucauauucaaauauggcagaaagcagaucgucucuuucuuguugguauuuuauagagaaaccuuuguuugugaggaauguuuucuccucuuuauugcugcauggacaugacagauuaaaaagagacaauauguagcagaagauggccuagucggccaucacugagaagggagaccccuugguauugcaaacuucauaugccccaguaccagggaaugccagggcaaagaaucggggguggguggguaggggagcagggcggagggaggguauagggaacuuucgggauagcauuugaaauguacauaaagaaaauaucuaauaauaauaauaaaaaaaagaugacagaacaucaaacacugaggacuaggaaaaaaccuuucugauguauuauaguuaaaaauguuagaaacacaaaauaaagaaaugguauugagucacacacacacacacacaagacaaagacucacuauagauggugguccuuuuguuuuuacuuaauucuagcgcucuguguagaaauaccuagucagcugacugaauacugguccuuggaagacagacuuugacuucaagggugucagugaagguuaauauaacauauuugguucagcagaugccauguauaauuaaagagcuccuaucuguaaaucggacucaauagagauuugucaggguaguauuuuuaaaguccuucccagcagugaaaguuaacaggauuauuuguuuaugacucuguuugggacuguugccaucuuuguuuucuuccugaagaaugguaccuaaguugagagaccaagagaaaggcugacuuuuauuuggacagcuggaccuuccaagagucaaagcuuccuacuuaggagccgaugauuaguuccgcaaagacucccuuuuccuuucaauagucccaacacaguuuaugauaauaauacaguugaaucuuuccccaguugugccaguuagcuuuugucaacuuaauagaagcaagaaucuuuugggaagggagaaccucaaccaagacugucuccauaagauuggucuguaggcaagcauguggauauuuucuugauuaaugauugaugugggagaacccaccccauuguggguggugucaccccuuaguaguccuaguuguauaaacaaguaaugguuaacuucuugaaucucuaucuguuauuggagaagagaaggaaaggagucuuuaugauagauaagcaaugucugagcacucagauuagcuugguggacauuacaaggacuuucagccagugcuuuagugugagucagaagugaugcucaagaauccagcccuguagcugggaaauuagaaaaacagauacagugaaaacucugcaguuugauucggaggaaacuauuucaucauaguaggguggcugcuuuuuuguugugauuugucaugagaucaggugugagauuuuuuuucauugguacaucaaauugauguucaaauguuucugauuuagggaauuuugaauuuuaguuuugaauuagggaugcugaguuuguaaguguguaauaaguaccaguaaaaagaaugccuuuuaaagguuugcaaauaauccacuuuugcuauugaguggucauguuuggaguucacuggaaauuuuuuuugauguuugcauuuguuuuguuuuuauuagauauuuuauucacuuacauuucaaaugcuaucccaaaaguccacuauaccgcccccccuccccacccugcuauccaacccacccacucucacuuccuggucuuggcauucuccuguacuggggcauaaucuucacugggauguuuuaaggaccaucuguauucaguuuuugcaaauaguucaagguucauuguucacacauccacacaucuaccuuagucaucccgaauagcuucuauaaaguucacaagugcuuuucuuauggaguaaagauuccuugagccagggcugcuguuagcuacucauaggugaacagcaaggcccacuucucaugggcaaaggugauggccuacugggcaguacaguagauaugagcaaaugcuuaagcagcugucugagaaaaauuguaguuuaauuguauguuuuacuuacaaaauggauaggcaguauauaauucacaaccacgguuaauauuuaauguucucuauaaucccuaaauucaauugauaaccaaagauacuuuggugaauuguacuaaauuccaacccccaaccacacucugguuauacuaauaaacaacugaggucugauguagauaucaguuaauaacuuaauuaucaguuaaaaaaaagauguaagagugaacauuugaaauucauccuuuucuuaaugauaugagauuuauauacaguacaugaaugcuguagaaaugcuucuuuaaaaguucugccacacucaaugugaugguucaauaugcaauaggcuucuaagugacauguauguuaagauuuugccaaucacuuaguccuagaccaagaguugaccuuaaggcugguucuuguuuucauggacccuggcaccuaguaauuauuaguguuuuucugaaugcaaagaagacuauuauuuguaacauacuaaggucaauguccuuuaaugaacuugugcuagaguacaaccaagcucauuuauuuauguauuucucucaugcccagauguugaauaauuaugacagcuaagagcuuuacuuucugacauuuuggaaaucuaauucuuggucuaacuagucauaaacgcuguguccuguuuaauaacacuuuuuuguuuucaugauaaaaauaccauguccauucagccuaaaugaggcccaaauucagguuuaggagggaaaugcaguagccacucguggacaguauucuucacccauuaggauucccagacauaaauuucccacagggcaagcacagguaacaggaaauaauuagggagugguaaacggcaauuaucaccuuuguuuuaauucauuuagcaaugaguuuauacagucuuauuuuucaccauggguuuguuaccaguaucccccaauuccgaggauuggguucuugagagccauucugggacaacuugauggcaguacuagauugauaccaggaugcuagacuagaaagaggucuaaaggaccaagaauuugauuauaugggaaguugaaagaaagauuccuuauucugucuuuaagaacgagguaaaguugcucagaaauagggaugauuuuuguugaguaggggacagagaucaggugccggcgacugagggcacuacaggccgacuggauacuaacauugugagaggacauuucucuccugagacagagccuuaguaaaacaaacaaaaaaaugacucauauauacucaaaaucaaaauacuugccuuucgcuuuaauaaaaugcacuacuguagcuugcauuuggaauuccuccaaaagauaauguguuuuaagggcucaguucccagccuuugguacuacugggagguuguaagagucauuauggggugauaaugugggaggaaauguauggaacauguauggggguauagauaccaacaccuuucccuucccuuuuucuuuauuugcuucccagcugccaaaggugagugaccuccauguguuugcaucguggugcacaguacuaccacagaaucagagcagggaugagugaauguggacagaaacuucugaaagcaugaucccacauaagcccucccuaauuuaaauuguugcucuuguuuauuuuaucacaucgauguaaaacuacugcagcucuauauugcugccuuacaaacagaagacgcccugcaaacaugaccgugcauggauggcaugccauguguguuucuucccuagucugagccauguucugauggcauagaugacucugcuugaggagucucaugaccacugcaucccuggagcuccaagcccagcuugcaggagguugcccagagucucuucuccacagcaaauaguuuugcuuuuauaacuuggaugaggggcacugggacuccccugacuuccugcacuuucugaauuguaugagcuccuuccaagggaacacuucaauauggaggaaauagcuacacccaaaauacccuccuuugaaaauauuuuuucuuuaaaaaaauaacaauuguuuuauuuauucccugauaaucucauauaguauauuuuaaucauaucuaccaccuccaacucuucccauauccuccccaucucccuauaucuacucacccaacuaacuguauucuuucucucuuucugcccgucuuucuuuccuauuccucuuucuguccucucuaaacacugggaguauauaguucguauugauugacuacucuugguccugcccuguccuacuauaggguccauauauuaagugucccuucauuguagaaaaccgacuuucucucucugaauggcaaugguucuucaaccauagguaggacuuagugccuaccuccccuucuccauguuggaauguugucuagcauguacucuuacaguauuugugauucauuugugcaucagcacugacguguuuggaaaacaauguuuucuugaugccaccagcuaccucugagcuuuacaaucuuuuuauucccucuucuacauagauucccgagccuugaacagggacagguguaauauagauaucucauuuaggauugagcauagcgauaucucuuguucucuaaauguugaucaguuugggguucagagaaacuucuuauaguagauaguauucuuuuaaaaaaaguguguguguguaugugugugugugugcauaaauucaugcacuuguuacauaugccuuggugcacacuuagaagucagaugacuucauggggaaauugguucucuccugcuaccacugggucucaggucaucaaauuuggugucaagccccuuuaucucacaugcuuguuuuguccuuuuaaauuuuuuaaugaauguagaucauauggcucaaggcauaauagaagaagaagaauauauggcaauagcucuuuaauauuuaaaaaaauauuuauuuauuuauuuauuuauuuauuuacuuacuuacuuauuaauuauauguguguauacuguaucugucuucagacacuccagaagagggcaucagauuuuuguuacggaugguugugagccaccaugugguugcagggauuugaacucaggaccuuuggaagagcagucagugcucuuaacugcugagccaucucaccauccccagcucuuuaauuuuuauuaauaccauauuaagacuucaaaauugauggcgagacuguaugaacuuaaggcauaauuuccuagauccuguugaguuuguguuuuauuaaauuaggaaagggauuugguguccacacuguugauauguauugagauuagcaaguuacuuagaaaauguugcuguuauauaagugcugaaccuucuuuucaacauuauuaccaauuaccuuucaaauaaguucuaguaugucuugcugaguauagggagagaaaugcauuuguagccaaauugcuaccaagaagaggaaaguguauuuuauuaauuuaaggucuuugcuuuuuaaaauagaauuguuuuaacuuucaggaacuaguagaguuacagauuacccugucagagugcccaggcaaaagaauuggguugcuggagauuagcacguuauagccaggcacugagaugaacacuuugcuucauuucuauuuugguuuggaagguuuguauagacuacaagaauuuugauguguguaugugugugggugugugcacaugcaagcaugcacgcauaagaaccuauaacuacuaauuugaucuuuguccucuucuuuuuuuuuccuuuuccuuuuuuuuuuuuuuuuuuuguuguuguuuguuuguuuuguuuuucgagacaggguuucucuguguagccuuggcuguccuggaacucacucuguagaccaggcuggccucgaacucagaaauucgccugccucugccucccaagugcuaggauuaaaggugugugccaccacgcccggcuucuguccucuucuuuaucacugaguucuaauauucugucuucuugauucguuuuacuugcaagucuuucuucugaguuuucuagugggauauugaguuuuucaauuuuacuuuuauuuuagcuuguguucuguucaauguuucuaucucuuuauuaaauuccauuuucaaaucuggaauuaccuuuaccuuuccauucagcuguuuauugggauuuucuugggcauuacacauuuauuaucuucucggaguucaaugaaguauuuuuuuuccuaucuucuuuaaacuccuugaauucucugauaaauuuuauuauucuuuuaaauucuguguccuggauuuuaucuaggaaguuuccauuaggaaacauuucuaaagaacuaguggguuuggugggagaccugcuguuaugaccauuccuguuguuuuugccuuugcaauuugaccugaguguguugacauuuuugguuguaauauucugaucuucuuuagauugacucagcaggagaugcaugaccugagcuaggccagguaagcuggguagauaggcuguuuaauuggacucaagguagauggcuuccgaacaaugcgucuagagcuagcucaggcaaagggaauucacagaugaagaggguucauggccauuggucuagaacuaggcuuacagauggguuuucaaaugguagaggguugugguaaggacagggagagaaagaaguuacuuacccagaaaaaguggauagugccuagagagguuucacaggcugcaggguuuggaacugauuuaaaagaaaugaacagccaggaaggagugggaguugcuggaaggaaacuuuaaagacaggaacacuccauaggcuuacgaagaugaggauaugagucuggauggagccuuagcccaggggacaaaaugugucaguuuccaguauggcucugguccaccacuaugugagacugugcugugcacacacuuugccaagagcauccauguaccagaugucaggaucgguuacucuauauaucucaccguucaccugggcaguaggaguuuugguuccuguuuguaguagguaagaacucuugaguugcaggaagccagcuggcagguagcagauguaaaauuucuauacaaauagcucuuacucaaacuccccccaaccuccccaagucuuucccauaguacuguccagaaugugagugugcaucaaagaaaggacuugaguauggaucucaccugucuuggcacuaaauaagagagggucuaggccaguagguucucaaccuucuuaaugcuaagacccuuuuauacagcuccucagguugugguggccccaucauaaaauuauuuucagugcuacuuuacaaacauaaauuugcuacuguuaugaacuguaguauacaaaucugauaugaagauggucuuaggcgaccucugugaaagguucauuugacaccccccagggggaugaaaaccacauguugagaaccucuggucuagacugccaaucauaaggugauuuguucaggagauccuuccuugaguucuucauggcuuuguugaccaggagagaaugaaccuuguaguugagcccacuauaucccucucucuauuguuuaaaaccuacucuucccagaggcagcuccucuucucagucuugaaucuguucucuggucacuccuccaguuucuauucucuguucagcucuuugguguccagcagacgugaaugucucucuucuuucugauucuugggagaucucaugugucccugucugauagcuauucuucucugccauaaucgcuccaggucugaauccccauucuauuucaagucacuucuggacaggaacuggguuucccaauuuuuagaacgucccaucaucauugugaaaacagcaaacuucacaacuccuguguggguggccauaaaagaccugugaguuucacugaaaugguagcuuucuuggaggaccaaacaaagacugaaccauugcuuacaccagcaagguaacaccuugagaaaggaacaguuuuuaguuuuccuguauaaggaagguacuagguggaauuuuggcacagcccacagaagugcucuaucagaagaguugagggaguagaagaugagacuagauaaggccugggugggagccauuccuggaacugugcuggggaaagguggagggagcuggguaagaggagugcuaggcacaucuacuaaagcucaaagccagcccuaaccaagucuguggcucaccuacuugauaacuggggagugcagcaauuucuauagaccuaaucugauaauucugcugcccuggagaggguuguccuuaauaacugaacacacagcuuugggacacacacauauggaguggugagagagacauguuuuguaaggcuuagagaaugauccaugauagucauaguuagggcuuuaaaaaauacauaaauaagucagaauaacagaauaaauaguaagagauagcaagcaguugucagaucaaguguucaaauauccagcaaaaaucaauuggagaaugcuccuagaggcagucauugaugguuacaggcagaguccuggacaaagaaaagcauuuccuuagacagaacuuccaaguaaaauaacaaauaguagcugaaaggucauacugucaaaucacagguuuacacacauucugcagaaccuaccuggggaagccccaucaaggccacuagcugggaguuguccauggcagggcacuguaaagacuacuggcaagggaauuacagagaccaucagccaaggacacucccugucccaugucacaaccugggccauggagguagaacucuaaggggagggaggcaggagcaggagcuuccccagcaaagcuccauaacuggagccuggagucacagugggaguaggagcuucugcucaggcugcaauuucgccuucugugauauggggccaaucaaguagugcauagaaccugcccagauagcuuccagaaccaaagaguaacagagacaucauaauuaguccuauaguucaaccuuccauaaugcaaguguccccuucaccuccagguuccaaaaaaaucuaaccuccugcuccagaacugcaaucuggauaacaugguauacugaaauaacaugccaauuugaaauuauguccuccucaauauuuauuuaacuuuuucccagguuaauuggccacuaucagccacaucuucugaaucuacaaaggcagucauugcagucauaguguuaaauacuagguaauuagaaaaccaccagaaauaaaccauauagcauguuaguauaaaaauggaaaauaagccacaagagggaaugacaaaaaauaaauauaagcaccaauuaggcuacugaaugcaccagaaugaauuuuuacaaaucuaacugaacugaaauucaucaaauuugggaggcauaaccaauuucuaacuacuucugaucaucauauuagccccagaggagauaugcuggcaggcugggcacucauuucagaucuaaacaacaauaaaauuaacaguucucacguggaucuagcaacagagcugacgagggugggagaagucagugucucuguugucucaggcagaaaagaaugccacuaaagaagucagggaaauauugaagauggacauuugcuuucaguaagccaccacccacccccaucagugggaaaaaagaacagagcuguauugaauuccuucucgcuaagugugaagaaaagaaccaaaugaaguaggaaucuuaagauaaagaugucagagccaggaguucaauaggaagccuuauacccugaaacauuguggcuccccacugauaagccagcucuauuucuauuuacuuuuuguaaauaacugaaaagcaaggaaaucugacuacacagcuuuccacacaacuaauaacugaugggaacugaacagaacucagagaaguucucaggaaagugaagccagcuuccagcaccuggggcuggggccucguauggcacagugguucaaagaaagaaauguccacccagugcccucaugcccaugcccuacagagacugccuuguuucuaggccugcuaacaaacuuuuguguauuuguucccaaaauagcuagaccuauguguaaauggaucuauaauguaaccaaaugccguauacucuuauuucuguuauuuuaaacagaguuuccauugcccaaaauaggcacaacaaacuuuuguuuuuguuugcugagggaggcaugcuaucauucaggauaccaggggcagacaaugugaaaacauagcaacccagagacacucugauuccauaggaacauuuucugaaccaagacccaagugcugggugcccuuuaauucccugucaaaaauaugacacuugauaaccucacugugacugugucucaaaauagggacugggccucacagcagauguuggggcuggugaaaccugagcugaguggcccaacaggcucugugggaacuggaaacacagccucucuggcucuuugucuaccaucucagaauuccugcaucccaucccuaggacucagaacugcccagagaugcuuuggauuccagaucuacauacucacuucccaaauaacaccuucaagaagucuaagccaagaucaccaccaauaacaacaacaacccuugacaacaaugaagcaagcucugucucauuggacuuguuugccuaguaaggcuggcaucauugagauugauggaucaauugacuggagguugggcaugagccugugagaagcauuuagcuucucaggccuguuagaguggggaaggaagaaaaguggcagauacuguuuaaugguuuuuuaaaauacuuuguuguguuugcuuguguguaagaugcucugcacuccugcaugccaggauccauuguuuaugagcucuugugcugcuccaagccugaucgugugucccaucugcucaccucacuaugcccaagcccucccuaguucaccaggaaucucaccuguuuguggggugagugaggaagcaccagguaaagagggugaucugaugcccuaucuuuugugucguaugcuauuaggggccaggacacuuauuacuguggcccaggauccccgaugcaagcccauuccuagugucuggauaugggauucugugucggcucuuagguuucagcaaguauguaacacagauugcuccauuuuugcgcuauguugcaggguuauaucugaaggcuuaggcaccaggaacugaauauauucuguggacuuugaagauuaguuuccugcagucuuuccuugauccccaucauacagaggugaaagagaagcaguagcaggguauauugcuggggcacuuauguuccuaaugguguagagauuugagccugguauuaacuuuuccccagucgcuuccucagggucuuauuucccuguccccucccucugugggacaccuuuauaggccacaccaugacucuguucuuuauagcuucacuccuuuguuuacccacucagugggagcuguaaggggaucagcagagacuuacagccauggagaggcucccuccacccccauauguagaaccaccaaggaucuugucauggcugacgcggggaaugauggagguaacacuggagucuucacuacagcagacagagcaaucuggaucuggcccagcaaggaguggagacuuagacauuuguaccauggaggauggcuggaugggaauuuucuagagaagauccaucuuugacuugaaaugauucucagaaguuggugaggcaggugacagagacaagaggcagaggcuauaaugcugcuuagaaagcucuugucuggauuccauuaggggauaaagcacuauagauuuagauacucguguuggguguguguguauaugugggggcagggguuguuucaguguguuugguguuuaucaugaggaagauuagaggagauggccucucccagaggaugcuaggcaccuacucucuacuuuccuagaucuacucuggaagugaccuugguccccaagggugagaggaugaucacaacuguggagguuugucagccagguaugccauugauguugguuacacagcagucuauagagaaaugcacacagcagucaaagguagaggagagcugggaaggauggccagauucccaucaacacaacugccagcugugccuucauuaguguccucaagcccuugacugcaggagagcugagacccauaggcauauaucugcuuuccuuugucuuuuggaucagcaguagcucuugugauuaugggacaggacugugaguagaacaaaauguaucuuucaggcuugaaaaaaauauacugccccuuaaagacaagcugcaaagauauaacaaguuucugguuguacagcuuaggaaagaagaaaacuccuucaggagaagguucuacaucauagcugagagaugauaggaaacagugcuauaugcaaauucaagaaagcuuaagcauguaagacuggcuggcaaucuggagggaugacucaucucuccaaaaauacucaggcaucuuccccaugggaacgccugugugccuacacugccaacucccagagguuugcacacucuuugggagggagaagcaggugcuaucccgcauccuuacuccauaggaacuccacuuuuccuccugcauacguccucuguucuccuuuguguuuuuuuaaugggucuaaauugggugggggagaaaauucccuugcugucauucugcaaaaggccuugugggcuuuuugcugggagcacaggcggugaaguacugcauccaucagacaacaaaugucacugugcuccuuuaccaggccuggugaacuccaguggaaucuguccugcagcuucuggggcugcacugacuaucguagaaaacccacuucuaacuagggugagcaagucaucuggccugggcauguacccaugcauuggccuuuucugcuuguuuucuuuguugagaauguuuaagccucaguaaacuaguauugucuuguuuuugaaaggagauacuccuuuucuggaauauucaacaauacagaaacucuaguuuuuaucugauccuggcucagccccaggguggaguauuugcugauaauaagucaugcacacuaugggcucuuucugaacuuacuaggaguugggaaauagcuaugagacucagcucucaaauguuccucuuugaauauguaccugaugucuggugagauaucaacauucccauauagacuagccccuggauuuagaggcugguaagggcuaauugcuuuuguuacugugggauagggaacccuaucaggaaagugaaucuuuuuauagcgaguuacugaaagcuuccuccaacccaggucaaaacuaaaauuuuauugugaaaagcauuucuuaguuuuccguguguuugcuacguaaaugagccuucauugugcaccuggaagagugggccaguguucuacucuuacacagauaaaaagguuuuccuuuaaucccaaaagaguaaaaauacuuguggcuaaauaguggucauugagcauugccuggucccaagaggagucaucucauauaguccuccugcaaacaccacuugauaaacuuccacauuuuuuguucugcucuuagggaaacaggccuacgaauuacagugguuuguccagguagagucaccugcuggaggaugcacagcauccgagaauuugcuggguuggaucugacauuuuagugacucugcaauagugcccauuacuugguuugcacuuauaagaggguauccuggggcuggcuucuaaaagacagcaccuuucucuugcccugaaaugagguguuuuguggguaagcuuauauccccacauucauugagagaugucguagacaacaccucuaaauagcuucuugcaggccauaguuuggaugugguuucuuaucuauuucauacaugcuuacucuaggccuugcuuaucuggaucuugaauaucugcucagaguuagauuuuguuuuaaaacucaaggucaaucaugaacacagucuuguuagagaaggagcccugaaugguagaagugcugagaccugagagaaggucuuaagguugccuuaccuuggggcccugucagucagcuugauuugccaaaaccauguucacaggaagaagauuugguagaccuugcuuuugaaaaguguuaugggugugguuauguguucaauggagguuuuggccuuagagguauugaugagcccucaggauguaacuggggccugccucagcucaacuacauauuugucaucagccuggguauauacuuccauguuucuucaaguuuaguuaugccuccauuuuuuuggaaaugauucaacaaguuccaaccauggagccuuugugguggguauaguuaguucucgggggguacugauucuguuuauaaagcuuggccauagucucauuaaaggaugaaucugagugugugcuggaaaccuggucaaaugguggcccucauccaaucccuauagcuucccccacagggcaccauuaugcuaagacagggcauaggaacuacauuucuacauuacccugggauuguuugguuugggaauauauuuuaggcaauguaguguacacagcaccuaagagaguaccugagguuuaaaaacaguacaucuggaauucugucauuuuagauauguguuuaucagaaucuugauaagccuguuggauccccaaugaccucaucagaauggagaggggaaaccugucacaugaaguugcugugaggauuggauacauaguguuuggcuugaugacuuguucauaauuauucagggaaacaaugguuggaaaacagacuguugcggauuguagauguaggaguuaaugcuggaccugaggauuccccucaccagcuucuuggcaccugacuugggugagagugggguuccuggaguccuuuguauauaaaguugaacacaaggcagccaaucagaggggguuuauggcaauagccacacaauggcgcaaucguuucugagcugcugguuuggggcuuauuacuuugcuugucagugauaaaccagaauguugagguucuuguuuucuuagaacugcuaucuagaauuguggcaaguaauuaaaacccaaacagaacagaggcagcuccuuuuacacucaaaggcuuccuuccaggagggaacaaauaugggaacccagagaccuccaggagagaaaggaaacacccaggugccuauagcauaaacagauugcuucaugauuaauagccaggauguauaugccagcucuaccugauucuacuagaaugucuuuagcaucagccaggcaggguagccagcaugggaaacugcaggaauuacguacuugguguuuuuuuagaggaauuaguaucaacaagccuuuauguucagugucugcuguuauuggguggcuaaaaaucacacaaacacacacacaaacaaacaaacgaacaaaaucugugaaacauaaagaagauuccccuuuagauguuggccugggggauacagagagaugggagaggugggaauuuucccuguucaguauacaagccuuggacucccuggugcuuggccucucuagucugguugaaggucacgaaucuccuguggaauuuggguuugguuuaucugucugcacagagacugagauuuucauucucugaaccauuuaacccauguugucauaagucaucucgcuuucaggaagugcauuucaagcauucuucucuucagugaaaagcuaucagaaauaaaauccagccaggggcccugaacugaugggaaaauaguaaguacucaggagcuuggauagaucuuggucccauggcauuugaguccacaaaugaugauuuggaaacaccagaauuauuuucucauauauaauauacuuuccacuucuaaacaguuccuccugggacacauccaguguucuaacuuggagaguuggaaaggaguuuggguugugugcuagugacucauccccugacgaacccuggauggaccuaccugguggcagcugagcagcacaugcccuggguguguccaagaggagcaggcaaggcccuagcccucaggaguuccuaacacucgggcagaagcugcgcccacucuaucaugcucccacaucccugaauauuagcuucugcagaucugcaguuugcguagaucuuugagaagcaccuacaggguaguacucaauugaauguucacaauuaaaugaaggugacucagggcagcuguucucucugugccuuucaaaagugccggaagcuggcauuuucuguuucuugcuauuacuauguuuuauggaggacauucaguguagcuauaccaguaagcgcggagcaggaagaacgggauccacuucuccuaaagcuguguguuuacgcuagaagcuucugcuccucaugcacacauccuuggcaaaccugacuagaaaauaucagcacgaguagauugucccuugguggaugacgagucaggagggagccaggcuugaggcaucaacaugcuccaccacagccuguuuccuccaucaggaucccugccuguuccacuccucaugcgacucuggaccucacaggagacaguuuaaaaucucuaccugcucccucuucaggcucagcauccuugcugcuuccugcagccugcucaucaaagccagccaccugugguaugaagggcagcagagguggaagcugaaaccucccgcccccaaaaggacagcagcagaggugugccaaagaaauaaguucacuuagaucugugaacugaggucauuguuaugcuggaaaaguauaacuuuuagaugguaguaaaaaaaaaaaaacgcagagcauaaaauagaccucuucaaccauuuucaggcaugugguucacuugugucaaguucauuuacauugcugugaguucucaccacccuccaucacuacaccugcuucucuauagaacuaacaucuauaaaauaucgacucuauauuccucuuuccccugcuucuggcaaccauuauaaaguuuucuaaauaauaaugauaauaauaauaauaauaauaauaauaauaauaaucaccacaaaugcacaauguguuuuaaaagaauagggugaaggcagagugcuaccaggcucauaugggcagggcugcucuaaacugccaccacuggauaauauacugguuaaaauuucagacgcuacauaaauugucuggguuugaggguagcucuccguucuuguaauacugguaugacgauuuauauuauauauuauagauaacauuuauuaccuuaagauuggcacagaucagaauaagagauaauaauaacaguuuucuuuuacuuuuuuuaaauuucaaaaaaauuuuaaauauuuuuauuagguauuuuccucauuuacauuuccaaugcuaucccaaaagucccccauacccuccccccaacuccccuacccacccacucccacuuuuuggcccuggcauuccccuguccuggggcauaugaaguuugcacgaccaaagggccucucuuuccagugauagccgacuaggucaucuuuugauacauaugcagcuagagucaagagcuccgggguacugguuaguucauaauguuguuccaccuauaggguugcagaucccuuuagcuccuugauacuuucucuagcuccuccauucggggcccugugauccauccaauagcugacugugagcauccacuucuguguuugcuaggccccggcauagucucacaagagacagcucuaucuggguccuuucagcaaaaucuugcuagugugugcaauggugucagcguuuggaagcugauuaugggauggauccccggauauggcagucucuagaugguccauccuuuugucacagcuccaaacuuuguaacuccuuccauggguguuuuguuuuuaauuguuuuaucucauauagcccagguuggucacaaaacucacccauguagcacaagcuggccuagaacugucuauuuucuaugucagccuucugagugcugggguuauaagaguguaccacuguuccucgacuuuuugauuuuuaugucuaugaauaaggagggaaugaacaauaacaaaauauaucaaaacaugcaaauacuguaacucagaucuuaugguuuuuaccuuuuauauugauuuaugacugcuuaccauagcagagaauaauaacugagugucauuccucagucucuguuaacuaugugggaacaucuggaaauuuacagccucuucuggaucccauugccugcuguucacaaucuaaaaugacaucauguauuuuacaaguaacacacauuacaguagcaaagcacauaucccaucuggcaucacccagacacugucauuggucauuguuuacugugucuuucuagacugugagaagucuauuacuauaucauauuccucucuaaauuuuuuuccuaaacaaauauuuugaagcuuauuuucuaaaaaaacccaaaacaaaacuguuuuugcucauugaguuuuauauuuuuaacuguuggucuuaauauaguauuuuaaaauaauuugcuaauuuauuguccuguuaguuauuuauuuaauuuauugauugguaagagucugccauugguaauaaucugcagguaauuugucugccauuagaaauuaugccauccuaucacaagcuucuugaaaauaaauuucuagaagucugucugguaucuuugaaaccucaaaccaauauacucacagaagucagcagggcaagaguucagggcgcauggugggcucucauugccuuugugugggucuggcccuggcacugcaggguggggaggacgcagguaggaggagcauuggggcaucagcugggcggguuccugccucuuccugaaacugaaugaguaugggccuucaagugagcuccaaaucaaccugggcugcacugaaaggauagguggauguuaggggaauugugaaaguuauaacgcccgggagugguggcacacaccuuuaaucccagcacuugggaggcagaggcaggcggauuucugaguucgaggccaggcuggucuacagagugaguuccaggacagccagggcugcauagaaacccugucucgaaaaaccaaaaaaaaaaaaaaaaaguuauaacaauagaucccaacgaaugcgaagugcuccugcguaaaucauggcugcugucauaauaaaagacacagggucuuuauaaauuaaggccuuagcauauaaauuaauguguauauacuuacauaugcacauaguuuuauauaugcuuaucuauacauauuccuauaugcauguauaggcauguacacacacacacauauguauguauucaauauguaaaaugcagugccuauguuaguugcuuuuccuuacuaucugguguccaucgggugagugucuuguugacgggggcugggacauugccacuaagguuaagugagcauucaagccacaguuuaaaauaaggugaaaaugaagacaagacguugcaugcuacaacuugaguccuuuugcagcccacagccacauccaugacaaugucuguaaugguagugucacacugagggacuuucuggauaauguuagauggauaauuuaguaccagagcaucuaauauuauugauccagauccucagaacugcuccuagauccugagcuggagaggauggaagcaagaacuuugcaaaaauuucgagaugcccacucacuuacugguggugagccagcauguauaaucccaaaagggccaggcuagcagacucagaugcacauucuuaacaccucaaccagaguagcuagaaaguuggacaugucgcuucacauggggaccacaauuuuaggauuuucuuuuucaaaaaaaugcuucccaugguguuucuuugaacugguuugguuuuuacuuguuuguggaagauauuaucuguuaguacuggagacugcugaccuacaacuuuaaaaggaccucaagguauuuaaaagcucucaaagguauuucugaagcaaaccauaaaugcuuuugaggacgaaucauuuggaggcaagcguaaaacccucaucuuaguguuucuguguuaucauuuuccagaaggaagaugaaggcccgugcuccgccaccuccuggaaagccugcugcccagaauguccacagcgaacagaaacugccccaugaugccacccugggaucccagcaaagccuggucuacaugaaggaggcacugcagaacagcaccuuggacaucaccgugguucugcccaguggacuggagaagcagagugugguuagugggagguaagauccugguaucuggguggagcuuccuguguuccuucucaugugugugggacaagaaggaaggauggguguggacugcuauacuuauauugaauuugacccagauuagaaugcaugcuauagauuggugcaagaccacagguagucgagccaaaacagucccacugggaaugcugugggcugacuggccuagccagacucucuguagucuuuaugggaucuaagccuaucccgguagaguuagggcucagagucuguagggauauauacauuuucaaaauuauuguauauaaaaauuaaacacuaugcugaugaguauugauuccagcuuugguauauacccaugacuggaauucuuguguucuaagauaccaugccuuuaguugaaauaggccauaucauauugucuuugaaauaguguaaaaaguuauuuuucaagcaggauuccuccuuguagccauugucccauauauaggacaaucuucacauuaacaucaaaggagguguuuggauuugagaccguucccuuguggcauuuccccaggcccagcucagagacucggaaccuuaagaguuucuguguauguuuauuuucuagaacagugacuacauucucuacacaucucccacaaaaccuuauaaugucagccguauauuauacuaucauaguuuaaaacugauuuuacaaugcaugccauccuaaccaguaaauguauaauuauguuuuauauauuuuucuaguugauacuuacugcuuucucuucucuuagauuguggcaucuggacaauaauucacaaauuuugcuugacaagcacaaggaaagguggaguuccuccuagaaaguaaaaauguuucuggaaaaugcuuucaagugaauauacugugcucucucugccuucaguaccuuuuccccuauagagcagaaguuaucgccauguaguucugaaagauuccuaccaugaccacugagagccuuaucaauuauucagauaacauucucuuucuaagcaggaaagcuuagagucuggaagagccagccucagcccagacaccucugucccugggcuuuucucugcugcaggcgaggccaugcuucacccuuuaauaauaagaagugggcugauaucagauuccagacuuuuauucauuuuuccccucuucugcuuaagcaguaguuuuagcaaagaacaugcucaucuugcccuuaagugcaguuuacaaaauauagccaguccugaaccauguauuuccugauggagaaaaaaaugcuaguugcugagugcuuaugaccccauucugcaaagcauaguuggcuugauuuuuuuuuuuuuuugagcugcucuugaauuuagaaacacaaauaaaagccccuaucuguuuuaaauauuaagacauaaggaucggucuuggaacuguuccugacuaaggaagaaggcuuggcaagccuuuaggagugagguuaccagcucucugcauggagggugggaaggaagccagcagcccauugcuuuaauuaggagcacaagggaagagaguaucuuugaagacacaguccucucagccccaggggagcuucauaaagggcucuuaaguguugacaguguugggcugugucaucuuaguguagagaauuagucacauccacauugguucacacagcuacggcacaucuggcagagaaaggccaauguugccuuuugcagaauugagggaaucucucccagucuucaguccuguaauucugccccuaaaaaccuaaacacaacagaauagacaaguucauaccugugcaagaauuccaggucaugagccuuguaaagcaguauaaggacuuccacuuccuuguuauuaagccuauaagagaagcuauuaaaaacaacucauuauuuuaagaaaggaguuaccauacccaauuuuccuccuucccuccuuccuucccucacugccucccuuacaucuaauaaaggagaauauguuuucugugaagaacuaacaagauuaaaggucuagcauuuaaaugaccaagccuugccauuguagaaaaggagagggguguuuucagcagugcaaaccuugguagaaggugcuaugcuugcuuagauaauagucguacucauuuuuguggguuccugguagauggcuaaauaugaaaauguucauuuauccuuugaacaaacuaaauaauaaauuacucuggacagaggguaucucagccacucgggaaacagaacauuugcugaguguggaggucugugcuauagagucuagacucaggagucagaggagccugcacuugcagcgguucuaccgaaaccuacacaaguuauaagagaucuggccuuagaguacugauuuucuuuaagcacaaggaaaaacaaacacauuaaaaguggcauguaaauuuuaagacaucccaauuaguuccuuaaggguaaguagguuggauccaagucugccacagucaugcacugaaugagcagcauguagaagacacugucuggauacagaauacuacagaccagcacuucucagugaaaaggcugaaaccccuuugggggucgaaugagccuuucacaagaauuacaucagauauccugcauaccagauauuagcauuaauauucuaacaguagcaaauaaaaucaguaaguaacaacaaaaauaauuuuaugguuggggucgcaacucgaggaacugucuuaagguaucaaagcauuaggaagaaugaaaaccacuucuggagacucugaggaaagguaaccucuaagauagaggugaaagacaaugaggacagaguuuuaaaagggaaagaguuacuguggucagaaaagggauacauucagggcauaaccuguccacaccugcucagguaaccacaucauauggccucauuauuggauaggacaaacaccagguuuaccuggacuccaagguuuagcuuaucuccucucuucacaucaaagaugccagccaguguucccuccagaugguuuuaaaguucaguugccuuaagagguuagguuagcaaccugcaccucucuguaaacccaauaguuagacaauuuauagacaugcaacagaugcaaggccuugacagaccacgucucuggcauuguauuccauucugcuagcucuagcauuuguuaaccaggaccuaggccgucuuaagacuggauucuugcuugagauuucagcucaaaucugaagucuugcaucuggccagcaggccucauugucuguggaucuauuccuggucucccaucuuguccuugaccacgcugguguuuuggauauguucucgggggagauccucagcacuggcugucugccaaggaccuugauuacauauuugcugccuugccucucagaugccacaugaacuggucagaccagacuuucucucaggaucugcacugaccucuuucuaugccucacccagugcucccgggcacaugcuggccuugguccauacaagaaacuaggacacaucggaacacuuaagauguggccaugcauacaaauuguuuauuuuaagaccaucaggauauaccuguaaaagcaguuggcauaccuagcacccagugauccacauggucaacaaagguuccaaaugugcauaucuugauauuuaguaucaagacauucuaaagaugagccucuacaccagucgcauuaacaacaccagagaauuuguaagaacuauagguuuugcagucccacccaagcuuggcugaauuagaauaccacgggugugguccaucaaacuauguuuccacaagccccaaaguuucagauagcauguggaugcagagauccucugcucacagcauacuuguggcucugcucuuggccaggcacucugucccaagagugagucugggcucuuacuggcccuaugacaugagaaaggaggcuguaguauacauagucuacgaagaggucucuucaucuuuacacaccagaccuaguggcuucaguaccuuucuaucuauccugugcaucugaguguauggucccuguauugcaggagggcuguuuguucuuuuguguucucucugacaccagccuuuguacaguggugguauagacccuacauuuccuguugcucaguagcacuaugaagacagccauauaagguagaagaccaguuucuuacuggguacuggucaggcaaagccauuuuugaacuuuguauacauuuagaaagcaacauauuuuuuaagagaaagaaguuuauacaaauucuacucauauuucaaaucuaaaauuagaguuuauaacaaguacccagaaacaguuuuaucucuguguuaugaauguuacaaggcacuguacagcagagggcaaagcagcaggggggggggggaccauggaagauagauggacaaaaaaauauaaaaagaaauuuuagguuacuuuuuaagguaaguuuuaaguaagccuuucuggcucagcuugcuuguuuuuggggugcuuacucuccccuuuuaauauaacuuuucuauuucuguuaagcuugugaguuuacgguaauggugauuagauagagaugggcugcggaagaauauuuuccucuuuuguccauguuccugggucuuuugaaggccccaucauugaugccaccgucucuaauacuuuguaacuuccaaacaugccugacucuuccuuugacauucugaguaugucugauuucuaaguuucuuucauuccuugggagaugggggaaaauauuuugcaauuuaagggucugaugucacuugcugaaagcaggguggcauucagucaaauacagaccgugauccucugccaaagcugugugaaauucacuuggaaaagaacagugaaguaucauguacuuagcaagcagugacauggugcaugcuacugagcuaacacuguuuagugucuugaauuuauuaauucauagaagucuccagcaacccucugagcuggacccuagccuaaugccaccacaguaagaagccaaggcauaaagcaaugcagccaguuuuccuggcucagagaggcaaugcauagcaauccuaggaucccacacagucuguguuaguuccucuaauagaacauggucacaggaaagacaccaguccuuggucagaggaugaugucaggaaacuguggaccaggggccaggacuucucuaggagaucuuggugaggagaggccagacucagcagguggugaaacgauggggaguggccaaauagccuugccagucuuuggaaaauucucuguggcccugugacacacugaccuacuaagaccucgaggaggcauauacauaacacccaauuaauaaagccaucagcucuuuguucauaggcaacaaaaggcaaguugggaucugauagaucuguaauaaaaccccaccggacuguaggcaagcuagugcuuuuguucauucuuaggcauugucaauaugcagaaggcugucuuucccuuucugaauagguuucuccaggaguaccaaagcuuauuuagaucugaggagcuucuuagaguuuucucaaaagccauucaguagcauguuaacaggucuguuacaaacuggaaaagaccuggcccccucacucuuuuguuucauacgggcuccugaggugcauacagugucacagucaugacuaaucauaacagcauccucuuaaauaaagugucaacccucucaucacauguaauaaauugacccacuguguuuucuuuccuguacgcagguucccauuaaaguucccaauucccacuagaguccccaggagacagcgccaccagggaccucacagugaaggaugguuagagcaauguggagcagcuaaggaagacaucaguccuaucugcccccaaccuccuuaccuugccauaaugacuaaucugagcugaguguagguucuagccaccaggaagcuauguuugucucucaaggcugaauucauggcugugcucuaugcauauugcaacaugcauggugagccauggcuaguuuauuguguucuauagucuuugggguuuggagguuuacucuguuucugugccuccccucacucucucuccuuaauaauaaauugagauagguagguuauagguuguugaaaacuguucccauccuugaauguugaaauauaauugcaacuuccauaggaugaaagauucucuaggaaaaccacaucuuuuccuuggugacuugagaggacagaggaaaguauuacauagggauugggucaacugauuuugaaauaucacuugauauauaaaguugagguguaaacaccuaguuauauacaugguccuaagucccaaacacugucaauacauagaguuguaugugcuggcuucugcuaagccaagaggguauguucucugcaguggagaaagccccaaacaaacuaugcaugcuccuuuucauugcacuuugauucagaccuuaauguuugaaugguaguaguaaggagauauacaauacuagcaaauaaaauucaguauuauuuuagcacuguucaaagacauuucuuugugcagaaggcuuuccugugguacaugaugcaugucacugugugcucuccuuuuuacuuuuaaguucuguguugagagaaaggugaagcuagaagaaucagaauugaaaacugcaguguuucuccugcucaugccuuaguuucugagucaauguugaauguguccugguccuucccacccaauauccuaggaacacaggguaccagcuucaugggaauuauuguuguacugcuuggugcaugcugcuaauguccucuuacacauaagaugugguaagcauugcccuagagauaauaguguuucuuuggagugaacagaaugaucuggauauuguucagcuacaauaagugagaaauauggcacuugggggauucuuuuggcauuagauuugcucagagggaaggagggagggacaaagacaaccacucauugcuguaauuuuuguuuuuucauuucauagcuuuucgaauaaaugaccuaguaacauaguaagagaucuguuauauuuucuaacuuaagcuuuuaugcauuuuccuuuauuuucuuaacuuucucucucuaucccucccucccucccucuccccccucuuauguuugucucuguguguguguguaugugugugugugugugugugugugugugugugugugugugugugugauuuuuauuguauugcagucaguuauuauguauccaucauggcaagauauuuuaaaaucaugaauagauacucaauuuuauaggauauuuuuaguacuaauugagauguauauguguuuuuaucauucauuuuaacacuaugauaugacacauuauuuauugacuugcacgcauacauugaaccagguuugaauuccaggauaagucccuacuuguucguggguauuaccuuuuuacugugcuguugaauugcaucaauauauuuuauggaggauuuuuguuuucauuccuauuucuuuuggauggcagccuccauuuugcugauguuauaguguggagaugcucagucuucuguuguuguugaagaguuuaagaaacacuguguguuauucuuuggauauucaguauaauuuuugguugcagccuuugguuuuagauuuucuuuuuaggugagguuuaauuacugauucagcuucuuuauuuguuauugguauuuucaggauuccccuuucucuuugauuuggucuugguagagucugucaguuucugcugaguaauaucuaaguuguuggcucauuguucaucaaagugccuaucacuuuuuucaacuuaaaauuuaguuguuuuuuuuuuuuuccaauacuuuacacuuacaaacaacggggaaauucaugccgugggcucaaaggcuguguagcuuuugcuuauagaauuuaguuaaccuaacaguuguauuuaacuagaaauggaacucuuguuuuuauuuauuaugauuuuaguuggcuauuaaaauggacuguuagcauugaaacugugaacaugccaucauagaauuaugcauaagaaccugcauguuuuagaauugcuacugcugucuuccucuugcuucgucucuuucuuuuuacaagagucuagucuuucauccagcuacaugaccauuuguucagccuuacucagacagacagaagggcaccuacagacagucuugacaaccaugauuuguuuucuccuuuucagccacgcaaugauggaccuacugguugaacucugccuucagaaccaccugaauccuucucaccacguccuagagaucuggucuucugagacccaacagccuuugaguuuuaagccaaauacguugauuggguccuugaaugugcauacuguacuucugaaagaaaaagucccugaagaaagaguuaaaccuggccuaaccaaggcuccugaggucaguggugcccguggauugucugagaacauacagagaugcaaauauauuuguauauacaaauagauauauacaaaucuauagauuuauaaccuauacaaaucuauagaucuguaaucuguacaaaucuauagauuuguaaucuauacauuuguacaugagugcgcaggaguacuagagaggccaguggugaucuuuguuugaguuccaaacacgcagcucuguguugagauuccuucuuuuauagcagguauaacugauacuuuuauaccaggcacgaacuaggcuugcuuacaggagauaaaacuuuccaaauuuacuaauguuuauuguuauaacacugauccuuucuagauuauacagacagaacuguuguaggacaagcuguccaucagaaccuucuugaagagggaaaauguucuaaaucuccauuuuucaguauaauagucacagguucuguguggcacccgaacacuuggaaucuaguuaauauuaugaagaaauagauuucucagguuuauuugguuugacuuauuaacuggugacugcuuucuugacacauguauuucuggguuucuuuuugcuccagcaggcacaacuccaaaccgaacucacuaucuuagagagagaggagagauaggcccuuuugaaaaaacuguuuugauuuuugauuuuugcuauuuucuuucgguuaugaaagaggggagugguaauaugaaguugaguaggggauaagaagugggaagaaccugugaggaguugggggagaagaaagaauacgaucaaaauauauuaucuggauuuuuuaaaaaaguguuuucaggauauuuauacuguugcauccagggaaugucuuaguugucauuuuauuacaaguauaaauuaccaaguaaaauuaauuccaaauucuuacauggcuuuguaauauuuuugagcauggccuuaaggcucuaguuaaggcuaguuaaguacuagccgaaucagauucuugaaagauaugcuuaaaccuugauuucaaaacuggcaguuauuccaguaauuuguuaccugugaaucuuuuguuuucagugauuaguaacauugguuucuuuucauccuaaguuuguaggagaaucucacuagcacuucaaacauacgcaguguuucauggagaagggacauccuucacaccccguggcaucuuuuaacugcuuuggcuccagggacauaguuccucuugcagaaucccaggcuggagcagagcccuauauuccuccuaaauuccagcucauuaaguccacuaagccugcuauucagaguccaaggggaccauggcauucaucugucacucuccucacaugcuaccuugaucuuugcgagggcuuuguacccuguggagaauagugagggugaauuggaguagucugcaugaagcuuugacuccuacaauguuuugaugggccacuuagacucacuauagguacuuauaaucagcaaauuuagagaaauuguuuuucuuucugauuauuaugucugguauuugagaaaaauuaaaugcauuucuggcuuaguauaaaaaauguauagugcauuuguacgcauauauuuguauucacacauaugucuguguauauauguuauauguacuuauaaagucuuuauaaacauauauucauauauacacccauauauucauguaauguuuugacuucuuaagcaagcaguuuuguuuuacaagauuuauucuuaaaacuauuucuaucauuuacaaacaucuuuccuuuaggaaaaaaauacaaaugauuuguacccaaguuuaggcagacucugugcaaggcugaacauuuagacagaauuuaaacuaagauaccucaaccaugccaguuuuucccuguuguuuagcaguugccaauuaacaugagagagucuagcaaacaucucauauucuguucaguuauuuuccaguauucauuaugcucuuuuuauuuuccccuggacccaccaacuuuguggaagaaagaucaggggcuggaaguauccugccauacccaauccuagaauugaaacagaaauuaaaacaauugcaggaagaugcacucauagaauucauaugucugguguguucuugcagaaaucuguacgacugguagugaacuaccugagaacgcagaaggcugucgugcgggugagcccugaggugccacuacagaauauucugccagucaucugugcgaagugugaggucaacccagaacacgugauucugcucagagacaauguugccggggaggagcuggagcuguccaagucccugaaugaacuagggaucaaggagcuguaugcgugggacaacagaagaggugagacuugcuacauccuauauauacccugaagagccacaugguacgugcccugauauguauguaguaccuggacauaagauaugcacauaaaaccuguauucugccccugcagcugucaggaacacuaucuagaggugggcaugggaagcuucaggcaccuggaguuuucugcagugguaaaguaggcagaagagucuagguuguugucuuauccuacaaugcuaaguaugucucuuuccucccaugucugcaaugccuuuuaccuucugucuuccucugagcucuaagaaguaacagcuaagaaaagaaaugguaaggagagagagugcaccuuuugcuguuacuacucaaagacuacuuagaacauugugugagcuuuguuucaguuguccuugcucccaggguuuagccacugcgugaaucuaggaucacuugccagaagcacauugaccgcccucugaaagcucccaauucuggagaugaguccugcagacaaauucuacacuaguuuccugcuagugcuguagcuauggugugugugccuguggggcuuuccuggacaaucauuaguagcacccuugagugguggccccugagaaauggugcuuccugcuagugcuguaccuauggugugugugccuguggggcuuuccuggacagucauuaguagcaccuugagugguggccccugagaaauggugcuuccugcuagugcuguaccuauggugugugugccuguggggcuuuccuggacagucauuaguagcaccuugagugguggccccugagaaauggugcuacagggcaguguauuuuuuauuuagauuuuucugauuggcauagugguuucaauuuuuaguuaauaaucagacaaaaacauaauuuauaguccucgauuuuguaguuuuaagauggacuuucagaugugcuguggaacucugcccuugugacauagcugugcuaucaugaacuuagagcagccaugcagggacccuuccaagaucgggcagacuaacaugacugcuaugucauuuguuauuacucuccagaucagcugacuuuaaaaaauauccagucggucuuuuauauguucuuuuauagccuuuaagauacagguuuuuagauaauuucuucuaaaaauguguuuuuccuucuuaacaaauauauugugagaacaguggucacggcgucucuuauaguccaguccacacuuuaccuuucucagcccacgucuucccuggggaaucuguauucacccucucaccugacauggaagaaaggaaguguaagguagauggaagagccuccuuaaaagaggaucugagagaauauugcaucaaguucauugcugccgaugcugugguacuugagauugaguucagagccucaugcuugaucucccaaccaguagcucuuaaaaacaccgacagugcucucagcaucaguggcacaggcccagcggcuccgaguguguuugguuauguuuaaauuuggauuacagaauauuuuagagaaaaagaaacaaaaacugucccacguuaaggaaucugagugaaaggcuugcacacugaggccucuguuacauaccacgcuuggacaacagaagaacagaaguccaaaugcauccuggagaagccauacaagcugacccucuguuaaggagaagccccacugcucccaguuaucagagacauggaagcugaagccuucagcagggcuacgacucagcauagcucuuacaaucuacuggcacaaagugaggccaauuagcauuucagcucuuuacgugaacuagcuacuccaaagacccugaguauacuacucacugccaugacagccuauuucccugcccuguggucggcaggccccaaggccaacuguaugccuuuuaccuguaacaugccucuuuuggugaccuugguuaccaaccauccugcuccaugucuguacuuauccugcugacuaccaaauaucuaagagaggagaaucuuccagaggguguccuugggaacccuuuucucuucugaagaugaucagcagaacugcuagggugcguguggggugcccuugaaagaggcuagggggcaggacuuagccuuuuccucaucucugcaguugauggagaaaggggagauggcagcuagagguuacugugcuguuggccaaaugccuccacugucugaacaccgaaggcgcagcuugaagaauuccaaggcucugcugcccucugugcucacagcgagcauagcagccuguugcugggacuaagagaccaggccuggagguacaggccagcucugcguaugcccuugucucuuuugcgggugguguaaccucacacuugaggcugagggaguaguuaguuagaucuuugguuugggcugcuguagaccuccaaguuguucucauuuucucguugccugccuuuuccaguucuucugaccaaaacgcagucugagccuucccugagcugucaagguacugugagcucacaggcugcacucugcauggcuccagaugggagggugcacggaagugauaugucugucagaccucaaagaagaguuuggcuagaggcacucuggggaggggagagggcuugcuggguugauuugagguuaugauuuaaguuuuuauuucccugguuuuuuaaagacaagaauaccuuguguaagaauuugcuauguaacuuuaauccauagaaaucgcugaaacuguugacagaaauucuauagcucagaauuucaggugaaaguuauguguacagaaguaacaucaguuccuauugccuugacuuguuuuuuauucuuacauuugugcuuccugccuagaucuauccuagauguuauagaguguccaccaacuugggauugaaacugacccuuaucuaucauagaaauauagguauucaaaggguuaguucaaauuuggcacacucauugagcaaaucucugcuauauacaugugcaugcccauauucgugaagagguagcuacauauauuuaucugcacguauuuuuacaaauuugcauaagcauauauguacaaauauauacacaggugaauugugaguuuaaugaguccuuuagacuuuucacauacccauauaggcauguauauauauauauauauauauauauauauauauauauauaggcauguuuauauauauauauauauauauauauauauauauauauauauauauaaaggcuaauauccuaugaguuuuuauauuugacagaaaguuugucauuuuucuaaaguaugugauagcagauuugauuuuuuuuaaauaaaauaaaugaaagaaacugcagcauuugcauggauggcagucugcuauggauugccugagugccagagcugaguggccccauuuaccaacccauagccaaccugccucaucaacagaauuucucacaaugucccuuaaggaacaccauugucuugaauagggcacacacauacauaaccacuguagccauccugggagauucugcuuggcgauuugggcaguuaggggcuggggagaagugaacuuuacuaccacuuccuuuauucaugucuagagucuagugauagugcaccuuacagauagauaagcuaugaugauaauggccacuuggaccacgugagaagggaagucccaccuguucucuaccagggacuuguuuagugaccauggaacugcccagauuccacuuuucccaucuagaccaacagcugcguuggacuucuaccuucuccaucucuguugccacccaacuuaccuucauuaucauccccaucacuuuaaugcauccaaauuggaagugcuuucuugaagauuaaaugugagccuugaaaauaagugucgugcuaccacgcgugaucauucaucuuaaagcacaugcucucuagggaaaucuauguguccauagcuuacugcccugguaggacagccucgcugucuaugaaggcuuagccugauaccaaugagagaucuuucuugcuuuguucucaccuuacuacaguguuuaccuaguaucaggaaccucuuauauagcucuguucaauucauaggcaaagcccuuaaaaauauauuaucaacuugaggccuaggccgggguugggaaaccugaggcccuacugcaccauacaguugcuaguugagcaggagaagucaccuuuccaaacaguaugguucuggagccagggucauccuaacucuucuauaugagguggccucaguccugugaccgccacuucuauucaggaaaagaaauaaaagauucaguuugcuuucaaucucucauuuuccuagguacuguaauaucaccugugugcuagcaacauauuuucuuucuuguuuaucuauggguuucuacaguguuaucaauuuuaauauauccuugucauauaccauucaauuggaaaacuaauauaaacuagaaauagacauguuaaugcaauccauuguuuggauaugauauuauuuguggugucaauuuauuuuuucuuccuaguucuacacuaaguaagggguuugaugugauuaacuuauaauuaaugcaugugugucugugggucuguacagcugcaucauauaaguaaguccuuugguuugguugcugugugaaucagagcccacuaaucuccuuagcuaagccucuugcaugucauuaagugcccuggccugcccaaacaggacaaaagauuugcuuccugcaggagccuuuaagaaccacugggcuccacuuuggcuuuguucaguagagugcauucauacauacuuuuaaauguauugucuuuuauguucuucuuuaacuuagguaugaaaccacacaucauuagaccaaaacauuaauggguguuugcuggauuuggguuauggcaguuugucauggcaguuguaaacucauggcaguuugucaaauuccacaagggaauauuuccaccaguggacuagaggucuggcuguccugcauuuugaucugggaaaauugaccuuucuauucuuuacaaauaccugccuuguuuuguuuuuguuuuucuuagcucugucauaucuuuauguguuggaagagaagaguagggugaauaggcaaguaagagaauauaaccuugaaaaggaaauguucugggacuggggugaagacaacuaggaggcuaagagcacuucuugcucuuucagaggaccuggguuugguucccagaacacacccugcuccugaacaucguaacuccacuuguaggggauuugccguucccucuggaccucuguggacaccaggcaugcacauaguacauaaucauguacuauagggaagcacucauacacauaaaacaaaucaauuuuuuaauuaaauuaaaagaaagaaaaaaugaugaccagaaucccuggagauccuguucagacaguaaccaagucucuuucacucuuccuccguguucugggaaagaacagggacgucaugauuuaauuagcauuuuuaccuuacuuauaccuccuaaugcagacugcuuuugcacagaugucacaacccuuggagcaaugcuguuugauugggcagcaauaggcaucuguugcguuuagaaccugaaguagucaaagauguucaaguucuccaaauggagaaacccugccagccucagguuaacucugccuuugcagacucagaacccaagccaguguaaaccaucagucacauucucauugaccaugguaaagcaauaauauucuacuuauuuuugacuagcuaauuauaaaguuaacaucuccaucuuuaaugcagcuaugggcaaauauaaaacgacacaguuugcacaaggcuucucuugaaaagcaucgcuauugaccauccauugauucgguucuuuucauccuccacaaggacaaagccacucagagaaaaugcugccuugguuguuaaaaaccuguauaagaacuucaugugauuuccuguggacugcagggcuuugagguagcacggaaggcuuugaaggaaaccgugaugacuuucuucuuagaacuaacagauuaaaggguucagcuaagguuuuaacaaguggaguacuuaaucucauguuucaaaugcugaaaaguaacuguacuacuuuguuuuucuuccagaaauguuuagaaaaucaucacuuggcaaugaugagacagacaaagagaagaaaaaguuucugggauuuuucaaagcuaauaaaaggagcaacaguaagguaagucacacacaagugacccugugggguguaaaggacuuucucacaguauuucuacugcacugucuugggauuuuuaaaaauaauuguauuugcugauaaugauucuuccccaaaggcuuaaggcagcuauuuaaggugaccguguuuacucacggguagagcagaaagccccuggacucucagccacaucuugcugagugcucacauucauacagaacucugccgaacucaguacacagcccucggggaugugagugagggaaucuugcauuauuaauuuuaaagaucauggucauugucuaugcaaaugaauccagcuuuccagcuugaaguaugaagugugaaggcagugcagucaagaacauuuguaucuguuuuggaacugccccauuuucuguaguuuuuaaguguuuggguuuuuuaaccuuuuuaacacuacuaaaaucacagaacacuauaauuguuucuugucucguauucuuugcucaauaagucuguauucauaauaaaaaaugcaauauuauauaauaauuuaaagucauacuacaaagaguuaaaaugaagagcuuuauuuuucuauucaauuuaaagagccucaaaaucauaaauaccuuccaauuaucugucagagaacaaaauaacacuauuauauccuuuuaauaaguauauuuuacuaacauguaguauuuguucuuugcuaguaauuauggcucaaaaauacaaaguugccgcuaaaguaacaacuaagugaguaaggugguuugcuuuguaagcauaaaaaccgcaagaauuugcugaaaggacccagauauagcugucucuugugagacuaugccggggccuagcaaacacagaaguggaugcucacagucagcuauuggauggaucacagggcccccaauggaggagcuagagaaaguacccaaggagcuaaagggaucugcaacccuguaggugcaacaacauuaugaacuaaccaguaccccggagcucuugacucuagcugcauauguaucaaaagcaucaaaagauggccuagucggccaucacuggaaagagaggcccauuggacacgcaaacuuuauaugccccaguacagaggaaugccagggccaaaaaaugggaauggguggguagggaaguggggggaggguaugggggacuuuggggaaagcauuggaaauguaauugaggaaaauauguaauaaaaaaacaaaaaacaaaaaaccggaguuuguauccccagcuccuuguaggaagccagcuacacguguaugugagacauguauacacauaccacacauacaucauuuuuacaaagaaaagacuacuauaaguaauugaccucaucccacucucugagaugggacagucucuccaucuaugaggugaggaagucgcucagcucagcuucguagacuuuggcucuuuccuucugagccugcaguucagaaggaaauuaugauuuccucugugcuugcuggugguggugcuaaaaccuaaggugcuuugccugguguccuugaacuauaccaagcucugcccagcuguggcagcaagcagcacauucuacuagacugcugcaugaauuuccagacacugagcaacaaaacucucacauccuuagagauuucacagccucuucuuccuuccucugaaaccuuguaaugguauucucauucugcuuugugaaggaugaaguauauaauuauauauuuugugcucuuuauccuguuugucuguguucuuugaaaacuggugcucaggguaugucucauuagugagaucuuuuuauucuuaaguagcucacccccccccccccccguucuuccccuuccuuucguggccucuuccuuucaugucaaguauaaaugaaauuacagaaucagaauucuuuagggcucuuaauuguguuuuuguuccugguauuguuuagaugaacuugccgggacuguguuuucugccguccccuugguuaccaguucauaauaaaacccuaauuccccauccuucaucuuagaucuagcugaaucugcaacucccucacugagacauaguucccagcagauaaagcaacauagaaggguagggaaacacuugguuuagcuaggaaggcaacugugaaagcuugggguuuagagacacucuaacuuauuuuaauuguuuuauuuauuuauauuccaaauauuggcccccuuccugcucccuccucuaaaaguucuucaucccaucccccuccccuuugccccugacaaggugcuucuccaccaacuccacccaucccccucaucucucucacaucccccuucccugggcaucgagucucuacagauauaggcacauccucucccacuuagaccagacaaggcaguccuaugcuacauaugugcuagaggcccuggaauagcccauguauguucuuugguugguggcuuagucucuggcagcucccagggguccauguuaguugauacuguuuuuggucuuucuauaggguuacuaucccccucagcuucuucaauccauccccuaacucauccacggggguuccugaccccucaguucaaugguuggguauaaguuucugcaucugucucagucaacugcugguagagccucucagaggacagccaugcuaggcuccugucugcaagcauaacauagcaucaguaauaggguaaggguuugguggucgcccaugggauagaucccaaguuuugccagucacuggaugaccuuuccuuuaaucucugcuccguuucuguccugaauuucuuuagaccggaacaauucugggucaaaaauuuugaagguggguuuguguccccauccuuccacuggaggcccugccuaucuacuggaaguguggagacccuguaccuuuugacaaugggaagggcaaacaccaggaacccagguccuaucagggaaagagucacuggugauacacagucugcccuguucauuauaauaauuucuucuuaugcaauagcuugucuuuucugccuugaacuccuagggucauuuaucacgcuuuauguaccucaucuuucauuuauuacugcuuuauuuaaauguauuuuugcucuagacaucauccacuuacuuacucagcccugucucuucuggguugcucaguagacagggcugaguguguuaugcauauacuuccuagcucuuugccucuguccuugcuauaauuagagauuuuugcaugcucaaugcauccuugccuagugucccuagaaagcugagagagaagaucaucacuguacgucaguaugguaaagcagcucacgucuuuguaauuuagucaguuauagugauaguacaugcuagaaugaacaccugucuuaaguccucgaugucaaucauccauucacauugcacagugcuuaguaaagugugacuuucaauuucuucaucuauaaagagcacauugaguaaguaacuuuaaaacgauucuuaaaaucauguggcaugauaacaagcaggcaagcucugaucucaguacagcauaaaauccaagaauggcgccuuaggaaggcauucgaacugaaguuauauucuaguauguugccuuuaaggaagaauaugaauagguguguuuaggugaguaaauauguauacccauaaaaauguuaauaaaguauaugccuuaaagggacauaauuauggcugaggcaaguaaggacaaagguuuaauauuuuaauuuuuaaugcaugucaauuuuguaucacuuuugacauuacucauacucaaaauaguuguuucaaaaacauuccuaaaugucaaccuaaguucuacuugaaaguauuaacucuuugauuaagucccuagauucucauuaagaagcuagggaauugaguuuucuaguuaguucucucuaccugauuaugccgcugaugguauauuguuguuugccuuuuguggauagagauggaaucagcuguuugguaaauggcuuuuuguguacacucaagccauuaacuacacagagaucaaaaguugaaaucuuuuuaagacccaguuaaucaguugauuugcuauucuaacuuugccaguuuauguccacuacuauuucuaaauuggauauauuuucaaauaaagaaaugcuuuggggaaagaagaaaaaagaaguuuuuuucccaagaguuguggauucagugguugauuuugagggagugcuuugguuaggaacuguuucaaaacagcguucuaguucauaaggugaggaacaagcaaggacucugcauccuccauugccuucaagcuuggcugugcuauuguuugucuguuuggggguucuguuuuguuuugguuuugccuucguagcuguaaggauaccugcucuuguugggaguuuauuuucuccuggaguugaugguggggugcauguuuguguucuaggcugagcaucuugggcugucaggugcagauagugaugaggacccggcgaagucagcaucuggaggggacuugaacgugaguacuuaauccagcgggugcuucugcuagccagaacuucucauugcagauaacaaacuggagacuagcuuuaguccacgcuguugcuucauuucuagaggcugcacauaguuuccuguacuuauuuggacaguguucaauauuuuagcugauaguuuauggccacuggcaacucagauuuauuaggcucuguaacuagacuucguccacagaacccagaaaggaaucucuuaaaacuccauuuuccccacauuuuaaaauuggcgucuugaaaguuuucuuauaauguuaaauacccaaaacaguauaaaucauugcaccauaugaguacuuauauuuugaauauuuuuaguaaaagccuaacaucuaccucuaaaauuuauccagacaggguauaaggggauggcucagugccuggcaucgacacauaaagauaggaauggcugcuuugugugucuauaaccucagaguuggaggaucaaaauaaguagaucccggaagcucaggggccaaccagucuagcugaaaugucaugcucccaguucagugagagacgcugucucaaagaaagaagguaugaaugacagagcaggacauacaaugauccucuggcuucuacucagcccauucacuagccucuacacacaugcgcuaaugcacacgugcacacacaaauuaccugggcauacucuccaugucauuaaugaugcuacacucuuaguuugcacaucaaaucuuguucuauccaguguguuuuugauacuugaaaauauuucuuaacaccuugaaauaaagucugaccuagaaauacucauuuacauuuuuuauuucugugacuauauagcuuucaauuugaaaacauuuucauagguuguuuuguuuuccugagauaggguuucucuguguagcccgggcuauccugggaucuacucuguagcccaggcuggccucaaacucggagaucugccagcuucugccuccugagugcugggauuauggaaguauacccccaucaucuggcuagguggagauuuuaugaugauuucaagauaacauaaagauauuaaaaguuuucgcuaugauaucauuaaacccgaggaguaaauuuuucuugcagacauuucuuaauaaaaugaaagaugaguugucuuucacccauuccacagauacagaaaagucucaguauuacuucagugcaucuuuccacauguacucacauaaacugaggagcauguucuaugaauugucuauaaggguggaacaauuuugccacaucagcaccguucacuucuuuaaugucuuuccacacaacauacuccaaagcacagugaccuauggucaaaaauuaucuuccaaauuuguucauggccaaaacuugggagccauuagcuuguagccacacuggaaugggugauuucugggagguauaaagggagaaaaagcuguguuagcauuugucaaaugcucaucacauucauuguucuuuucccagugguuaauuucuaaaccgucuguuuguaagacucaaggccuuuuaaauaaucuuacuuucuacuaggcuuggcaaacaaauucuuaaugauuuguauugucaugggguagaagucuauuugggggggggucaagaauggagaauuuuaucugagaacagacuuaggcuuguucuuugucaaggucugggguuggugaaagucagcucauucagacugaggaaaaugcuugucaucuaagugaauuggcucagcgagccuaagaaaaagucaaacuuaccuuaguuacaaaaguccaauuacaacuuaaaguucaaggaaauaaauaaauaugugccccugguaauuauguacuuuugucucuaagcauagcugugcugagacguacucaucugcugugugcacuuaaaaacacaaguuaaugcucugaccucacgagcuuccuccucucgauguccuuauguuaaugcacuaugaaaaccagacuuccaccuucauuauagccaccucuuuuugucaaguaagaguguuugcaauuuugaagauuuaaugcaauuccagaagcuccauugagcccagggacacacacuugcucaugucuuuucccauacaaaucacaucagacugaauagaauuauguaaugauuuuaacgacaccucuucuguuguagucuuaaguaaguuccuacaugaacuaaucucaucagccaggcauuguguuuguuuugcuauuaaacagacuuaaaucaacagaagauguuuugugaucgccauaaauauauugcucuuucaggcuugucuuucaucaaccuguuuuaucccagagauguugaaaaaugucuucuaauauuucacacacucgauaaacaaacugcuuuuauuugaguagggaaccuauuauauccuagggcuuucaucucacauauuugacgcuauuauauaaccagguaguaacucuuccuauauuaaugaaugguagcuuaguuuuguaguaggcauugcuaguuugugugagcuauuuugauauacauagaaaaaagaauauaguuaugaugugcauggcuagcuggcugaauaaguagaugaacauguggauggauggauagauggauggauggauggauggauggauggauggauggauggaugaauaguaaguagaucaguaggugggugaaucauagaugagagauccugggcaaaaacuucauaggaaauauucaaagcauuuaaaaauaauguaggauccugcaagcauaugugaccauagaucuguuuaugaaaacagagggcacacauuuggauagguuauucaguaccauuguuucaguuagguuuguuuuagaaccaguuaaguuaauuauaaaguuaauuauaaauaaaaauuuaguugaaaaauuaacaagcaagaagauccaagaaaaccugaaaagccuggggaaugaaaagccuuacugaucuauucaagcagacuuugaagcuuugagaauucuagcagguagcagcgaugcaguaggaaaauauggagccaauuguacagacaauacagaacacuguaccaucaacucaacagcaagggcagugaccaucaauaagugggguugggaaugaccaugaagaagaauaaacauugugcauguuccccagcauacaccagaaaaaauccaaagaucacaaucugcauguucauauugaaacuuggcacgugaccaccaaaaaccaugugugaacaauuuucuaacuguggcucaaacucaaguuguacuaaugagaacauuaauaaauuugacuguggggggcaaaucuugaaugacagcaugaagaauaaaggcauaaggaagcaauccagggaaagaggaguggcaacaagaggaaaucugaaugugagaauaguauagaaacuguaaaacuccgaauaucccauggaagagggccauagagaaggcaucuuuaaguugcuaaguacauggcagugaauagacaaggcagaaagaaaacuuauguucauaguauguaaauuauugacaauaguugaaacuuagucaugaaaaauacuacuuauacuuacacugaaauucucuuuuauuauguauuagauaguaaaauuuuggaaguucacccaucaccucuucuggcuaaucuuuggggacuuuuaaaugugcuacuaagcagaauguaaaauacuauagcauuuaaauuggaggauuuggugaugucuauccaaacuauaaguagauuuauuauucuuugcaucagaaauccuacaaauagaaaccuaucaauuguaaauauccuuugccagaguuugugaugauucaggagaccauuuuugcagcauuauuguacuagcaggagcuaaacacccaggggcccuucagugggggacugagagguuaaacagccaccauucaguaugauugaggacugcagacuugugagggaagaaaaagaugauuaccuauugauauggaguaaucucugggauaugugauuucuauuagaaaaguccauggguaguuguaauguaaaaacaaauaauguaaaacaaagucugaaaaugaagcuuugaucugcuaggugagccacucauuuuggaaacaauggaagccuaggagcagauggcccagcuugaccuagccuaguuguaugaucucuuuuaaucuuccaaucacagacacagaaacccuacuuccagagguggaugauugaucaaaucugcuggacuuguugaguccauuugugcauuucuuaagaacacugugcuaccauuucuugucacuuugcuguuguccccugcaggcaaguacacccuuaacugaccagagggcaggauccaauugcaucagccauuggggucacaggaguccucauaauguuguaugcucucuauuuugaaggacugaaggcagcugucccccuccuaguuauacuguggacuguguugacugccaguauguagauccagugauaagcugcaaaugauccaucucuugauaccuaauauuucuaggcccugugaagggcuguguauugcuuuacaagcuguguggcaauggcuuugugagucuuggguacuccucucccaucgggcugcuuugagucuuugcagggcucagcuagcaccccucacaggaagccuuaugaaauggugaacacaguggagccuuaucagagaggcugcagauauuuuugacugcuuuuucuuaaaaagcuuuaaguaguuuauuaugucuaugaaacaaacaaaaaacaguaugaauguagauggucugcguaacccucuucucaggcaaauucaguuucuguaaacugaaguuuacuuuguuccaagauuuagcuucauuugucauuuguaucucauaaaauauacuuaguaccuuucuaaucacuucaaauacuuuucuugaaaucccacacuuuccaggaagauacucuuucuaugcccacccaggggaauguacuucagagaacuugucauuaguaaaggaacccugagcaaggaacagaccuugucuagaguuagccaugagauauaaucuaccuuuaacaguccccaucauuugcuuaaaaauaauuucuacaaaugcaccaaucuaaaauucauuaagagccucauugauacuauagucuugcuaccaugcagccaaaagcuuuuugaugcauguaucaaagaaucaaugaucaaaacauaaauaauauugaaauuagagacaguuuauucaugugcuuuguucaguucaugggacaaacugugauaacauggcauugucuccccugugugggcagagccuccugcaguguuuggcaguggguucuauauucaacacuugcuuuagucucuacccucaggcccugauuuuguugaugccagacauuuaugacuccagaaaauaucaaggaagcccaugaacccaggacaacuuagaaacaguuauuagaaauaccaucuuaaagaaauugugucagauuucccaugcauuccagcccgucuuccuucccagcugccacuggucucuggguaagacaaugaacucccagagguugccagaaguguguguguagagcugacuccaccacauggugucaguguucccacaaguacaaggagucaggcguguccuagccuggaaaagcucaagauguuucuggaacauucacaaauugcuaauaagaaaauauacccugaaggcugagcccugugcuuguagaguagaacuaacuuuuguuagaaaucaauuuuguauagacuguaucucuauauuauuuauucaaaauuauaaaaugaauagcagauggaaauuuuaaaaauauauuuuuauuuauucuuugagaaugucauacaguaaauuuuaucauauccagcccacuucccaacucuaacucugccaagaccacaacgcccucuauugcucugaacuuaaucucccuccccacuuugucuuuuuacccagaguccaauuugugccucuaauauguggaugagcagacugggaaucccaucaaaugcuuccagucaccaagguuucuugucacuuugagccuuucuuagugguagagucacugacacacaaacagauuggcagcuuucauuucuuuccuccuucauuuaacaucauaugcuuaaaauuuuuuugcccuguuuucauagcaacauagugagaaggcuggauguguuuccauaaaaggaagucgggcauccagcucaguggaaagcccuugccuagcauaccagacccugggguccaucugcagugcagccagggaaugaaugacucugggcagugucuguuggcagcuggacucugaccucauagugcugucuuucccuguguuggguggauucaaaaucaccgccacccaaagucuuuaggggaagaacgugaugcugaggagggggacacggugcaggcucucagccauuucuugaugaagcucauguaucugucacuccuugcuguugacucaugcaguccaccauugucuccaaaacugguuucccuuggaagauuuuuguuuguuuuguuuuuuaauggagcuagcagaagaauuagugaaucagugcaucugggaauguuauggcuuucagaagacuguuacuacauugauucccagaagggcaugccccugccagaaacaaacgccauaccccugugaagcugugcagcuuugcauuucuuuucccacgacuuaguugugaaacacuuauacacuagagguauauagaccucgauacacauuugagaggaauuaucaaauauuuauucucuguacuugugaaaagugguaaucaaaguguucacauuaggcugaugagaugacucagcaugcaaaguaugaggaccuggguucaauuccugggacccacauggcagaagacaagugacugcacaaguuguucucugccugaccucaauaugugccccccaugaaauaacaaacgggaaaaucauauuagaaauaaaauaaucauacuaugccccuccucaggccaguguggaagccacuacagagacauuuauguuuaaagcuucagcgaauucuccucccaaaguauuugcagugagagcucagauuaguuccccuuauccaaaauacuuggcagaagaaauaucugcaguauuuguguuugguuuucuagcugauaguccuuaauuuaaaaguucaaaaucugagaggcuucacagugggaaacauaagcauccugucagcacccaaaacaucuggaaugccagaguucgcuagguuucuaauuguccaauuagagauguguuuaucagcauguguuacugaaguaacauagcuuaagacagggagauuacaaagauggcuugggguggguaaaguguuugccacacaagcaugacuggguucagacuugccagcacccacucauguuuaaguuuggcaaugugugccuguaaucccaacacugggagggaggcagaaacaggagaaucccagcgacucuuaaaaguaaagaguggagagcaauagagcucuaccauucacauguggucucugcaugcacacccacacaugugcacaugcauguuaaagucagaaaaguaagacaaucugggaugcauguuagccuguccuuuuauguaugugaucuuguguuccaucuccauaaauacucuuugucucuguugcucucucugucucugccccucccuuucucucuucccucccucucucccuuuucccccuucccuccuccucuuccauuuaaaaaguagaaagguuuaucuuaggucacauuuugaagauuucaguucauaguugauuagccuguugcuuuugggcuuauauaagguagcugcucauaggaaaaauguuucagagacuacucaucucuugguggccaggaauccaauaaagaagaggaugagauucaaauacuccuaucaaagcuauucuccuagugaucuaaauugucuucacuaagcuccaccuugaugcuaccaccuccuaccaagaaguaagccaugggcuuucagauguuacuccacacucaauaauggcugaugcuuagcgugugauacuuaacagagccugaaaaggugauucaccauagugagcacugaguuaaaaaagaaagcacagaguuuuaacuucuacuaaaaacauaguauuuauagggauguuggugguagaaaaugucccuuuuaaacacgaauuuccucucuguucccuuaaagaaugaucugcuauuucuuacauccauccuuaguuuuuccuggcucuucucccuauucuuuaacaaaugaauauaaagcuuggcucucucuuggcugcauguuuauugguuuaaguugcuuuagauacuguggagggaugacuugaagaucgcuggacccaugguuauguauuacccaugccuaaacagaaaccuaggaugcucuuugccucccuuggcuacucuuccaccccuaacccaucauuaggacaucugcuuccugcaaggagaacacagaaccucacauuguggcacagccccuucgccaucaccuugccagggcugauuucccccuccuugugcacagucaguguagccaccuuguaaccuugggcuuguaguccugaugcagcuccucuacagcuagagagaugcuaucuguagcccccuuagcucagggccuagcagaucuggcuaccugggcaggguacuucuuccuuggaccuccccacuucucuaaccucaccucucuucuuuuauuuuuauuagauauuuucuuuauauacauuucaaaugcuauccugaaaguucccuauacccuaccccccugcccugcuccccuacccacccacuccugcuuguuggcccuggcauuccccuguacuggggcauauaaaguuugcauuaccaaggggccucucuuaccagugauggccaacuaagccaucuucugcgacauaugcagcuagagacacgagcucuggggguacugguuaguucauauuguuguuccaccuauaguugcagaccucuucaacucucuucuuauggugcuccugcaaacuuccggggcacauuugcuugcgccuugaucuagaucuguguggagacaggcuuccuaugcuauggcuucuuuucagagaauuguagaaucuuuguacugcucagcaccuaugcuaucucaaacugcucacuaucuuguucuaauccucuggauuuauuuucauuuugcacccugagaaugguaggcgcugggccaaugugcugugcacagacguaauacaaugaguuauuucuuccugaagaugucugauguuggguuguaugccugccagcucucuugucuacuuucucccuaggcuaagcagccaaggcagaucaaguagggcaguuguguguucacuggcagugucuaaccccagcuuuucugcagugcuggagugaguucaucucuaauguuugggaccuugcaucagguauccugugacauggauguccacuccuacagcaucuuucaaagcucccagaauucccuacugcugcauuuaccuuccauuuucuuccgaauagccagcuuuuguugugacuuccagguugaaucaggcauguuuuauugauuuuuuuuuuuucaucuuaagugagucccaaauugaccuucucuccuaccaugagcauuguuuacaggcuguggauucaugacugaggagacucaaagagccucagcauccuauuccugugugcaugcugcugaggguucuucugcacuuuagaaaugcuccuagccccaauucauacggcugaagaugaacaaagccacccacccaucucccacagcucacagacaaugucucgucacacuuauauuguaucauuucuuguuaaucucugagaaucacaguacauacaaaugcuguugccucucuaagcccagcaucucugaugcucuccucucccugaacacaugguuccucugaagcugcauucauucccccacccagagaaagauguguucuuuaaccaguguccauaaacagugcacaauauuuuuguauaguuuaacaagugaagacuccuuuauuuaaccaacaaauggaaaaauauauaacuuuaucuguacaauaugauguuccuauacaaauagacucugugauagaagcugaucauaguaacaucucuauuaauauuacaaauaguuucuguggcuaaagcuuccaucagcauauauuuucaagcauacacaacacuguuaaauauaauaaaucuaaguauugucaccaugaacuauaauaagucaccuuuucugaagugaugguuuauuuucuaaugucugggcuugauucaugguauaagaacaguuaauauugauaggguaaaagauaagggagaggggacagagaaacaccugaaggaaaugauaaacaguguaaaacuaaggaagaacacucagccaccccgcagugagcauccacacagacaugccucccugagccuuccucuccauggccucugacucagucucgcugcugccagcugugcugaugcugugggcuugaggcuauggugcugagauggaagcccauucuccaagcuagggguucacccccucguaaggaguggguuacucccaggggagaggaggaaggucuucucuuaaauucccacucugaguucccacuuaaggggacaucuggacuuccagcccaaguguagaacaguuuaaagggaauggagacaaauggcuaagaaguaaaauuuccaguuuuucagccauauucuuuugugauuuggaagcccucccuuacauguuuaacuuuggccauguuguacauguauggguacaugugugagcaugcaccugggacguaaauaugugugagaaggguguugccaaugacuacuauuggaaacacgcauccagagauaggcugaauguaugaucuaucacaacuccauacuugaccuccacuguguggugaggaagaucaaagaauucuuuuuaugucacagucagaaugaccggcuuguagcuuugcuaagagggcuuuccgcuguggaugaagccaugcaccuguaauuagagagcaaagcuccuuugaagggcggcuucccauaaagcuaugugauaguuccugccaugucccccguggagcuaggugucuccuuuuggggugauaacuggguugagcauucagaaaggauauuucaccagggauggcauugagauucaugcugagauaauuugguaaauuuggacaauaacuacuucauauauacucuggggagguucuuuuuuugaauggaagaaagaucacaaaaagcaaaaggguaagaaaggaauuguuugacuuccucacuugaaaacauaguuauuuauuguuauuuuuaaugcauuccaacuuuuaucuaaggauuuuaaguaaaacuauacauuuaaucauaauuacuuaguuacuuuauugucuuuaauauuuguuuucauuuagcauaauggauuucugucuuggacuaaaaacauuuuauauguguuuauuuguauguguguguuuguauauguuuuuguguguauguguguuucuauaugcauguguguauuuaugugugugucuguguguauguuuuuguguuuuaguauguguauauauauguguguuuauauauguauauguguguuuuguaugugugcauauauaugagugggugugugugccaguguauacuaauauguaugucugugugugcauauguguguuuuauaugugugcauauguguuuuauguguguuucucuuuguuguauuuauauguguaugacugcauauggaauuauaggugugugucuaaguguguguaucuauguaugcuuucuauguguauguauauguaguuuuuguguguuuauauaugugugcguauuucuguguguacauguguauuuauaugugugugucuguaugaauguguguguucuguguguguauauuuguguuuguguguauuuauauguguguguauuuauaugugucucugugugugcauauguauuuauaugugugcaucuguaugcauguguguaucacuaugugugucuguguguuuuguauguauguauaguguuuguguuuguuuguguauuuacaugugaguguauuucuaaguguguauguguguguccaugcauguaauuguauguguguguguguguguguguguguguguguacaaaugaugaagcuucuuuuagucucacucucuaguuaaagugauuugacucugccuuguuauaugcagauggaaagguauugaaugcuggcaauuuccugauuguuguagguuguccuccauagaaaucuuuauaaauggauccagaguacaugccucaaguaaaaucuaaacaacucaaauagauuacuuaaauaauaguaggaaggugcuggucugcuuauguuccauuaaaucaaguauuuaugcuauuuaguauguaauacuccauagauaucuucuucugaguauuuauuuauuaacuugagaugaggaagggaguuuggacuaugcagaaaaaagucacaaacucucauaaacuauguauacaaucauuugucacuauuauuaaaacuuuaucuucuguguauuguauaucagugacacugccaaacagugauacugaguuccucuuuccagccaucuacaugagugugacuaugccaaaaucuaccucugcuuuuuguuguuuugauuaucuucugacuucaauaaccaauugcagcuggcuuuuucuuuuaaacauuggagccauuugguaguauguaaauaaaugauuuuuaaugcuaaagagcaccauuuaccauuauuuuucuuaugaauauuacaguuauuaaucccaauuacauuaaauaguggauaagcuggaaacuagaguagaaccauuaauuacauguaauaauauauucaaaguacagacaaggaaaacugauuuuugguccaauuuguuaguauucguauccuaaagcagaucacagugcuucagcaaagcuaugaugcacacagaaaagaauggauuuguuaauucugaaacuucugucacagaaucuagagucaaaucuacgaguguguaaaauuaauauuaugaacacaaaacuauaaggauuuuaacauauauaauaaugagccuuccuaaugagggcucugacccauguucuguuuguuccugcuugucuauucugaggaaucuuaacauccagcugcagcuguaggucugagcuggagaacacugguggcucagccagaauauuuuccuuucgagccagagaaacaaaaaugccccucagcccacccccauccucugccccuccaaggcuaucagguccgcccugcauccguauuccaaggaggagagaugaugcugccuccaagcugauuagugcuuccauuggccugcuuguaaagcuccuguaaaucucagaauacuuuuuggccuuugccagcuucucucuuuaacaaaagacaaaaguacuccaggaaucgagagaccagugaaaagcuuaaagcagugauuugacagcacuuaaaaaaaaaauaccugggaagccuugaacauaggaauuaacgguuuauucccuuuucucuugcuuuugguuuggcaaaugugcuaagauguuggagagagagaugguuucuauacagaaucaguaaaugcugcaggaauaaauggcuggagcagcuggcaggaacuucucaugaggccagacgagggcauggaaggugaaccuugccaccaacuacauuugauuuauacuaaaucccugggucaucugagaaguggaaggcagagcagcuguuacacagccguggauauaaacaccccucuacuguggcagagacuagauuuuuugacuuacaguugaaauggccuuucuucugaaauucuuuccugaaccagaaauuagcuguuaccuuagagcaguugccaugccuacucuuuugccugugccuagcaaccaguccuggaacauuuuauugcaaggacagccuuaccauuucaaauuuuagcaauuuccucaaacacugucuaaaccuuuauggcaaaguugcagaguuuguaaauuaaacauuaauguuuuuuuuuucgagucagaguauauuuucccaaagaucuuauaugugagcuaggcauggcuauaaagccagaucagauuacugaagaaauaucugcugaugucccugcguuaaagaaugcacucaggcuccugcagguccuggucuugguguguacgugggaggauagcucugcuacguccccagcaugccuugcugugaguucucggucaugguugcagugcagagaggcugauuagcaccuuuucugcuuuuuuuuuuaaaugaccaugcacaugucuuaaucaaggaaguguuggacuuuuuggaagcuuuuuucuaguaugaaugcuuuucauuuuauauuaaagccugguaauacuugaaaaaacaauaggacauuuuuuuuccauugucauuauuguagguaagauaaaauucuauuugcucaguuuguguaaugcugcuaauacaugaguucucagggcugaccauuugguguugcauaacaaucagugugcucuuugcugaagaagacuauuucuuccauucccuaguauuucuuaguugccuguacuucuuuguguaggguugaggccuuuuuggcugucacucauccauguuaacauuucuguuguugucccuguucaccucauuuuuagaucauguuagugagacuuuaugguuauagcuucugauauuuccaggaugcuuacauggguacauuugugucacacauaccucgguggugaccaauugcucucuaauuagacuucagaucugcaagagggaaauccaauaugguauuagaaaccuggccaacuacauagggcuagugaggucaggaauuuuggagaagaaccuacagcuacaacuuuauuaaacccacauaggcucucacuguguucuaaauacuuguuccugaacccacagagaagggaauuccucaccucucaucaaagaagcuuaucuuugcaacagacagaaaccauuacagaaaagcacacagaaccaaagugcagagcuggagaacccagcuccaauggaaaacaauuuacaaaacagguccuacaccuaagacuuagggaacauugugaaagaggaggcaggaagacucacaaggcagaagaucagggcauuaaaucucuuucuuaaaccucagaauauguuugccaguuucucugcuucccuagcuagguuauuguccugugaaaacucuuaaaaaggcagacuaggugugguaggugaaacuuauuuuaucuuucugcagugacuggaagcggauguccacauguaucucaggcucagucacuuaguguacaguguguuagagacuggagcuaacagacaaaauuuauauagaccuugguuuucugugauuucauggaaaauuggcauaaaucagugaaauuaagguuagaaaguuuuggguaaguucagaaaacgaggggaguccagaucucaugguaguuugugccuaaaugaccugagaauuuuaguuagcucagagauucuuauucuauuuugcucugaggauauuuauuggucaugucaguaaggggagaauagcuaacgcuauuugggaugagaggcuggugacucucaucucuaaucaagggcucucuaucacuucaaaauucaguaucuaaaaguuuucaccuaaguucaugucugaaaaggugacaucccaucucuaagacccaauauuuugugugggaagaaagagagcacacuucuuccaaagccaguaacucuuugaguucuagagcucagugucacgccuugacuuugauuagccguuguugguuuucgucuucauaaagaacugacuagacucuuugugaaaugacacuuaggguuuggucccuuguucccaccuccaguccaauucugcuuccuccuggagaauugcuuaucuuuacacacuccagcagggaguugugaacaugcugaggacuccccuagggaguugauacgauguugaggacagucaagauaccuaagggugauugugguaaccucugacaaugcugucuguuggaggucuuacuagaauacuaaaugcuagguauccuagucugggaugagaacaagagacagacaacugucuaccugacaccuggaauugagucagaaucuggguaggaucugguuccaggagcuauacugaaccuaccugccauguuaacacaauucaaguuuuaaaaauuaacuuauaaaaucuucaaagauauuauuuuuaaauuaguuuuuuuaauuuauuuuuuauuuuuuucaagacaggguuucucuguauagcucuggcuguccuagaacuaacuuuguagaccaggcuggucucaaacucagaaauccaccugccucugccucccgagugcugggauuaaaggcgugcgccaccaugcccggcuuuaauuaaaaauuuuuauucagcaaaauaaaugagauucaugcaauaaaaaaaguuacaacacaaaacaccuuuaaaaagacccuccaaaaaauuacuacaugaggaaaauaacauaaaggaaggcuuaaaaagauauaaaauacuuauuuuauugaaaauuauaaaaaagguguccaauaaucauauaauaacaaagaacauuaaaauuuaaauccaagugaaauauucagugcuuugggccugaagagauggcucagagguuaagagcacuugcugcucucacagagggcuuggaaugguuuccuagcucguauaugacagcucauaacucucugaaaguucaguuucagggaaucuaguguccucuucugaccuccuuggccaucacacacacacauaugguacacauuuauacaugaucaaaccagagagaaugccagaacugagaagaggaaguggguacaaagccccaccucuaaccaagaugcaauuugcaauugauauguguuuuauaaaauguuuuaaaugaaauggcuacauagaaccucauacaaggcauuuaaaagaccaagguaauuucacaggcuuguuuugugauuagacaggcaagcauaguuaguggugaacacuaaggacagagggagugaaggcacaugauuagauaggauaaauggaagagaagcaauuuuggaugcagaauugugaaaugcauuguucugagaaugguauuagugauacugggaugccaagcaguacaggagcucuccauugagugaagccaaccuuccuaaugagagagagcaugcgagcuugugccuauacuguguguuaaauauguacaaaguugugugugugugagagagagagagaguguaugucugugugugcauguguaaucagcugacuuuauauauaaguaaauuaagcagcuuggaugauucuggcuacaugcuacuggcaaggaaaauugaaguuggugcuccucuuaaauuuggagauaguugagucaaguugguaccaguaaaacaucuccauaacucuaguuauugagugagcaaaguucuuucucuaguuugcuucuuauacuucauuuaccagaacucuuagguccuguguucuugagguuuuccaaggacaagauggagacaacuuguagaggaaagaguuguuagggguugcuuauaguuucacaugguuauuuaaugacuaucauggcagcaggcaaguacacaaggugguggggaguagcugagaucuuacauguuaggacaauaaccacagacagagaaaccacuaacugaaaugguauggguuuuugaaaccucaaagcccaccuaaugauacaacuuccuccaaggcuaugccugcuccaacccuccuaagccuucucaaacaguuccaacaccuaggaaccaaguauucaaauauauggggaacauuuucaaaccaccaaaguuuuuguaauuaaggucaaugauaccaaagucuaaauuucuuucucaggaaauugaauaguaaaauuuaugauugaccaagguaaccugguaguugcuuucuccuauaaguuuuuuuuauauguuucuuuucuuuaauuaaagcaguuauuuuguaacaucuugcuauauaucucaggcuagucucaagcucacaauccucagcauuuggaguuauaggugugugcccccauauccagccacauaguuauuuuacacauggagaaugaguggaaaccuuagccacaagguuaaauaugaaagcagaguuuaccagaggcucaagcaccaucucuucauuccaagagauguaagcucgugagccuuucaggcuguaggaacuaugaguccugaggacaaggcagugauuaaaucaagaggcagucacugucuucacagagcccacacauaaauggggagagaaagauagacaagucauuacauaaucauaaucacuuaagcacuuugaaugcucccuaugugccaagaacucuuuccugcuugauuacauguaguaacucaugucguucacaaggauaguucuguuauguaggagcuauucauuucaguuuugaaagagagaaacuguuacagagacaaauuaaaacuugcccaugguuauguggcuggugguggcaaagcuagaaaucaaaacucagacaguaucucccuaguuugaggcuuugucuuucucugcauugauuuuauguggagcauauccaggaugacuugagcuauagauaaagaucaaugugagugaugguacagcuugaggcaugagugcuuuuguuucuaauccaaaauuagaguucuaguucucuaagugucuuuucugcauauaaauuucuuuacuucuuuuucuauuaagaaagacauguauccauuacucuguugaggggcaucuggguucuuuccagcuucuggcuauuauaaauaaggcugcuaugaacauaguagagcaugugcccuucuuaccuguuggaacaucuucuggauauaugcccaggagagguauugcuggauccuccgguaguacuauguccaauuuucugaggaaccgccagaaugauuuccagagugguuguaggcaaauggauggaccuggaggacaucauccugagugagguaacccagucacaaaggaacucacacauuauguacucaaugauaaguggauauuagcccagaaacuuaggauacccaagauauaagauacaauuugcuaaacgcaugaaacucaagaagaacgaagaccaaaguguggacacuuugccccuucuuagaauugggaacaaaacacccauggaaggagcuacagagacaauguuuggagcugugacaaaaggauggaccaucuagagacugucauauacggggauccaucccauaaucagcuuccaaacacugacaccauugcauacacuagcaagauuuugcugaaaggacccagauauagcugucucuugugagacuaugccggggccuagcaaacacagaaguggaugcucacagucagcuauuggauggaucacagggcccccaaugggggagcuagagaaaguacccaaggagcuaaaggggucugcaacccuauugguggaacaacauuaugaacuaacuaguaccccggagcucuugacucuagcugcauauguaucaaaagauggccuagucggccaucacuggaaagagaggcccauuggacuuacaaacuuuauaugccccaguacaggggaacgccagggccaaaaagugggaguggguggguaggggagugugggggaggguaugggggacuuuugggauagcauuggaaauguaaaugaggaaaauaccuaauaaaaauauuuuuaaaaaaugaaagacaugggcaacagaugauuaaaagaaaaugggggugucauuaaggugauuucuuaagaaugggaauuguuucuagaaaccaacaauuucauguguuugguggcagguauauauuuguucacaaggaacuguugucaaguccuacacuguuggccugagauccuucaaagcuuucuguauaccauuacauuuuuguaugauuuccgaagguuagaagaagcuguuugggcagaaggguauucuguguaacaacacaccauaacacaucacaauuucuacagggagauguuuuauuuuuuauuuauuauuauuauuauuuacagagggagauuacaggugaaaaagggucgauaaggaaggacugggaaaugaauagaauuguggucucugaugugaaacucacagagaaucaauaaaaauuauggaaaagaaaaaagggagaaccuggcaauaggagaaacacucagugguaaacgaauccucuucuuggccauugcaguacacugcaaugucaagagccugucuuugcaaucucuaagaacuuaaucccaaggcacguugaaacuuuaagauggcugaugugacauguuaaaguuuuaagguagcagauuuacaucuauaguuuagguagaaauaccaaaugauucuagucacuaaguguucuuaaagguuuagauuguuucaugauugagcuucacccaugaaauuauaacaguaugguugccuaaacaagaccugaaaaugccaguaccaacagaacgacagcaccaaugugacuggaggaacucucacaaggccccaccccuacugagaagguauaggggauuauugacuucagagaaaaagagacuagauccgcuccugacguaucacagagaucacuuaugagcuucugauagugguccagucucaagcagcucuaagcauauacaucugagcaacaguaaaugaacucaagaaguuguauuuauacgugugugugcgugugagugcaugugugugugugugugugccugugcaugugugugugugugugugugccugugcauguguguguguguguguguguguguguguguguguguguaacaauaauaauuaaaguaaaagaggucaugaacuugagaagaguagggaaacacagaaggaauuacagggaggaaagacacagcacaaaugauguaaauacaguccucacacuugaauuucucaaaaaaaaaaaaaagcauaaaauguuuccuaggggaauaguaauaagaaucuugcuccaguacuuuaucucugccaguagaaacauaugccacuagaagacugagugggugguuucaagaagaaagaucuuacugaugaguuguuaucugucucuuccuuuacagggcugcguaacaacacccaacucaccauccuugcauucucggucccuaacacugggucccucccucucccugggcaacaucucuggagugucuaugaagucagacaugaagaagcgcagagccccuccuccuccaagucccaagcugcugggucaagacaagguaucagaaaagguagggcuuucacacuucucacaaccaaaucgucuuuacacugacccaguuaacucuacugcggguccuuggaaaugcugaauucuuuacucuugaguaaagaauuuaacacaauguguucagagugaacaucugagcuuuauuuagaaguaaaagugagacaccacucugcuccaguuacuaagcuaggaaacuauuuuggggucuuugguucuuaaggacucaaugcuuguagauuaacauuuguuuuauuuuagcacugaaauuuugggggugucagagagaucacuuaugagaaauuacauaaacaaagguacuuggaggaagcuaaggcuugugaaggaagcaaaguaucucaucuaaaugcugcacacuacucagauucacagaaaauggacacgugugcauauuaaguuguuuuaaauaugauaugggguucaugucauaggaccuguauuuaagaagcuuuccuuuugucuuuggagcaguacaaagccuucuaaggcauuauaucacuagacauggccccauagaucacauccugagcagugagccaccuaaccuaugguuucuaccucuccucuuuccuucagcuaccugcugacacccagaagcauuaacuugaaaugucuaguccucucuucucaggacuagggaaccauaugacacuauaaacuuuucguauccugacauuucugguauagcuaacugcacuccgaaaauauuaaacagaaaguuccaggaaaaaaaaauauacauuuaaucuccacacuccucuaaauagcaugaugaaauccauagucauacucuguccuucuagaacaugagccaucccuuugccgaguauaucuaucuuguauuacuaucuguuuagugguugauaagugacugucugaauuaugacugguucucaugauguuguaguacugugaucacuuauuugucuuaauuguagccuaaaagcuaaaaauagucacucaagcaguugauaauuugccaaagagaaccuuucauuaaguggaaaggugaaauguuauugaaaguauagaugucuauggaaacacagaguaucggagagaggggggcagggggauuugagcaccuaaaaaauguguuuguagagaugguagcuaucugucuaaucaccucucuuuuccaagcucugaacaaaauacugagaugaaaucaugaaguuuuauuuuucuaagcacauccucaacuggaugacguguugagaguaccucugggggcucaugcuuuugacuguuccaagcucugcaucaucacccauaugcuugagagugagggcugccuuucucuucuuugcuuuaucugacccugcaucccagauuccagggcagaaggcauacccugaacacuggcaucacaugaagcaugcugaguauccuuuuauucuuugauggauuucacauucucuuucuugccuggugccuuggcaacucuggcucugucugugugucauaacucugaagaacgaacauggacacucuuuaggugugaaucauuuuuccauuagucaaaagauggcuuuuccuggcaacauuguuaaauauacuagaaacuauguccauuccaccaaacuuugaggcuuugccaugggucuuuguuacagcugcagguuacugugaguggguccuaaugucuuccuugacaucugauuuagucauuuuuucacugcugucacaaaauacuugcaaaugucaaucuauuugcaagggauuauuuugguuacacuuugaggauacaguccaauauggcagggaaaccauagcaucaggggcaggaacaucugucacaugucauccagagaacagggagcgggaagccacugcucaguucuccuuuuaccuuuuauucauaccucaguucaugaaugguaccauccacacuuagcacaugucuucucucaguuaaaccuugcuagaaacaacaucguagacauaagcagaagugcguuacuagggucuuucuaaagcaggucaaauuugccaugcaaauuaaccaucgcaauaucuuuacuuaucugucugucugucugucugccugccugccugccugucucucuggcagccuaccagucugucuaccuguccuguagaugucuuuauuuuuccagaggacuucuuaaccuuguauaucagaaaccauaucuaacccccauaggcucuuuauucaugucaguagaaauuuauaucaaaauccuauaauacaacacauuuuagaagauguucugguuuuuuguuuuuuuguuuuuuuuuuuuuuuuuuuuuuggcucagacacucauuucuuuugagauuucugugauaauacagcaauauucugauaaagagaaauuuagucccagaggcacaucaguuugucccacgcuugguagaacaauggagacgcuaugugaagcuguuuccuguggccacaguucaucucuuuaaucaguuuacauuguguacuuuuucauaacacccagauguauugauaacauuagccauuuccagccacccccaagaugccucuuuccuuuugguugggauagauauuuuuuagugaugaaaaauauguguucuggcagcaggguuauguaaaagcuuuucuucaauaagaaaucuuaaugugguggagcauagaugguacaucagcauuucaaaauugucuucuauaccaagauguuaugcuuuguuuuucugaauuuaauuuaguuacucauacuggauagucugcuggagcagaaaaacauauaguaacuggagaauugggaacucuaaauggaaaauaaacaguacauucuccccugcagaaugagcagagccccucugcagcuauaaaagcuuccacugaaaucuguuuuauuuggcacagaaugaguugagaaauugguugcuggaaaccaugucccuuuuaaaguaugugaguaaaguacagauugcauuuaagccuugccuaugaacauccuucuuucuaaaaugaaauauauuuuguuauuuaccaauuucugggaaaggaaccccaaaaaauguguuguccugguuguugggaaggacaucaguuccuuuuuaugaauuuccuuccaucuaaagauaaguuguuuguuugaaaaccuaauuuauauguagcugcuacuaaaaccaaaaucccgaguaagaagaaaauguuuaguuucgggacaugguuaguuuaugagaauacuuagguuuucauguuuacaugauccuuuuucuuaucaacuagguggcaaaauucaaaauuaacugucagugccuuaaagauagaauaauuuucccauguuccauuuaugugaaauguaaaaauguauauuagguauauauuuuaccuaauuaaauacucaugauuugaucaucaguauuuauuuuuaaagguaauuuuuaagaagauuuccuagaaauguuggaacugggaaauaagcaaugccacuuuuauaaaaaucucucugcagagcauuuagggggauuacugggcagaaggguauggucucuuuaggcagaggauagugccuuucuucagaguccauugcucuggccaugcaucuugaccuuaggcuauuauggugaacuuucagguagaggugggcagagaauggaagggugucacgguagggcucuaugaucuagccaccuuuuaugccuaccaaacuauaugucauuuuguucaugguauaaagaaaauguuuuaaauguauucugaauuauuugaaauguuucauucuaauggucggcaccacagacuuccaacugacaaggauucuuaacaguaucuugggcuuuuugccuuaggguuucaaaauaauuagcaauguugacuaugaaaacaaaaugguaaagacuuguuacgaucagguauuagcaucauccaaaguaggguuuucugugaauguguuccuuauuuggucaaaaauacugguagaacacucuccucaauagcagaaaugccauucauuuuucucaugcuuugguuaaguaugcacauggauacauaaaaucucguagcauaugaacagacagaaugaucauagauguuagaaccuuaacugaaaacaccacugcuucuuugauuuagugguuagaauauuccugaaaauccuaaaacugcugaggguacuuccaaagcaauacuuuauugaaacuugaaaugccuaauuuaccauuagacuucaagggugauccuuuuuguuguuuguuuccuuguuugagacagggucucauagccuagguuggccuccagcucacucaauauguuuggccagucacggauagccuugaacucuugauccugcugucucuaccuccugaguucugauugcuggcauaucucccaccacacucagcuccagggcuuuaugcauacuaagcaagaauucuauauccucagcccuuuaaagacuacugcuuuuuuuuuuuaaggaagcagaauuuuacuauacguagaugacuauuuaagggagaguuguacuauaauaauguauuccuucuaauauucaaagaaagaauaaaaggaggauagaaucauuagccuuuuugaguuagaacucagaaaagugggcagaguuaacagaaaaguuaacuaccaccaccauggcuacuucugauagcauggcauacugcuuucucugucauugacacugcccuacagaaaggucaccugggcugagaugggcucugcaagucaugguacuguggaggcccuguaaauuuggccaacaaugcaagaguaccacagguacugugaggugguuauugcugacuacuucguugaaucuagaauaaccagagaggugaacuuugguuccaccuguggaggcauaucuaaauugaauuaauugaagugugaagacccuuccacuccaguggacaccauuuccuagcugccauccugucuauauaauggaggcuagggcaacagacacuguguucaucccuguacuggcuaguuuugugucaacuugacacagcuggaguuaucacagagaaaggggcuucaguugaggaaaugccuccaugagauccaacuguaaggcauuuucucaaugaucaaggguuucaggccccuugugggugggaccaucucugggcugguagucuugguucuauaagagagcagacugagcaagccgggggaagcaagccaguaaggaacaucccuccauggccucugcaucaacuccugcuuccugaccugcuuaaguuccaguccugacuuccuuuggugaugaacagcagugugcaagaguaagcugaauaaacccuuuccuccccagcuuucuucuuggucaugauguuugugcaggaauagaaacccugacuaagacaaucccucucugcuccugauugugggaugugaacagcugugugaagcucccacugccuuggcauuucugaaaugcauuaugucuacccuugcgcagaacaaccuuucuccugugcugcugcucucaggugucuugucacagcaacaggagcagaagucaagguaaccaccuucucuugccagccucuguucccuuccuugauuucuuuuagcccugaacguguagucuuacaaaacaaagucuguauccuucuucacuaguaucuccgguauauagcuuuuagcauaccacauaagaaguuugaagaaacacagaccccaaaaucccaagucgauuguuguagaaagcagagauagacgaauguuuaguacuuucuccuggcuguugggcaguaaaguucccuucauucaacuggccccaggucucacaaacauauuaauagugauuuaauaacaagcuuuugugguguuccaaagacccuuauggccacuauccuauguagccuagugguuguucuaucuguaaacaauguacaguuauugucuucauuuuaccaaugagggcaauaugcuuagaaagaacaaaugaggucauaggguaguuggcaugccagucagugauaccuuguagacuaucuggugucuuucuuacauauagccauuggagguaacgcuaguugggucacagagauguguaacuguccuuugaguggaaaacaugcuggagugcuucugaucuaucugcacccuuugccaguucuuacauugcuaagggggaaggacaauguacauuguacugaugcgauaaauagacuucacaugaccuuggcuggcaggagaugcagaggguucagggauguuugaaauggagcuuacucaccacugacaaggaaggccuguuugcuaugugagggucaaacucaagagaugaggaaguucauaagugcugaagggagaucgcucuccacauuucacaucacucaugagcccuuaagaaacagcuucuuccugcugucagugcaaucagcuuccucagcagcucacucugugugucugagagauacaauuacuaccccaacacuuggcagaaauaggauaaaaaucauuuuaccuccauaugcauccuuugucaaaaaccuaacaucaaugggcaugaugcuggacuuuugagagaguuauguuaaauaaauuauugcaacuaucuuuggcuuacuaguuucaaagauauauaagcuuaagaauucugaagcucauauuaaacucauauuauuuuuaaaauuauuuuuauuggaauauuuaaauguauacauauaaugaaaacuaacaaaagaucaaaggcauuaaagaaaugaaacuaaguguuuggauguguacaaaaacaccuuucgaagcauauuuagaagcauaacauucuaaaccuauuacuguauguauagccaaaaacaugagaaauauaucuaacaauguagcuuaaaaguucugugguucugagcugcugauuuuauuuacuuauugacuccacacaguuuccaacucuguuuauguacucauacagaaugcuaugaaacgucacaaaccuugacaggaauggagaauaaaaauaaguaauucuuugggccuagccauacuaucacugaguucauauucuacaaagaagugucacuaaguuguaaauguuccacauauuaagugugccugacuuuuaguaaaugagccaaacuagcacaaaaguaauuaucuagacuugugacagauuuuuguacagacagccuugugauggcuccauuuacaucuauaauaugaaaauauaacacaacauuuauggcaaccuggaacagcuuuguaaaaaguguugggucaguggaagugcagagaugucucuaguguuugggaggcucccaucgauguucucuggcgauggagaaagugcgggcagacagcauuguguucagcugcaugguggaagacgggcgcuuuuccaacacaaacaucccuaagaaccugggcggcucccuuccacugcagagccugggaaaacaggccacagaggaaguuccuugguggaaacagcagagcggccauacugagggugcgcgguggaaggaaacggcagcuuauuuuagcuacuggacaucuaccuuuuguuuauggacccuuuccucucugacacgugcuguuaaagaaacaaauguggcuuugaaagagauuagauucuuaccuauuuuuagccauucuuaaagcauggcauuuuagcgaggcucucagcuaaaucaaagcaaaaugugcaauguccauuucccagcgggaaacagcuucauggucagcggaaaagggaagcggugcuucguguuccggcacacuguuccaggguuccuguucaccucauucuuucucacuuugucguugguuuugcucauccagcacuccaacaaagaaauaugugaaauuggcgcuucguuauuacucuuaccuucacaucuugccucuuuagugauucuucuuuuuuuuuuuuuaaauuauguguacauguguggaggaugagguuguauauaugaguucagauuccuauaggguccaaaagaugccaucagguccccugaaacuggaaguacagguagaugcuccaugggcuuuuggaauugaacuccaguccucugcaagaauuagacuuguuuguaaucacugagcaucucuccauuucccuugcuucuuuacaucuacauauuauccugauuuuuuucagcuaucuugauaaucauuauuaggaaaagugaguguaagaacacaaaucuggauuuaaaacuugcaguaugaaacacccuacuuccuuucuuggaggcaugaucuguuucagaagcugauccuaagcacugaguuacccgguuuuuacuuuuuaaucuuaaacuuacguucuggaggggaggcccuugguccucugaaggcuugaugccccgguguagaggaauaaugcuagggcagugaggcaagagugaguagaugggugggggcgcacccucacagaagcaggcuaaagggcgaugggauaggggguuugcugagaggaaccgggaaaggggauaacauuugaaauguaaaaaauaaaauaaaacauacucaucaacuauaugcaguauauauagugaauuguaguuuaaauauaggucuauucacaaaauucacaugcaugcugacaauccauauuuugauuuuaaugaagccuuuauaaaauauuugcauguguaaauucaguuaauggugaaaaagcuaauaucuuuauuuauaaaggaggaggcugugaaaauaaaaucuucuguucugaacucaguagucucugcucaggguuugaaguaguuaaaugaccuucauguuuucagacuuuugauuuaugcaccaaccaagcucauguaauuuuaaugucuguggcauguuuccuuuuuauaccuaacaaacugaagagggagccuagaaaacucaaaaagauauuugagaagaauauaccugacaaggaauuagcauuuagaauauuuagauaauuuacaauucagcaacaacagaguaacaauaaaacaauugcaauggaacugauagacuuguuucaaagaaaauauacagaggaacagcaaguucauggacagcuguucuguagcacuaacauuaggaacaggagaaucaguaaagccucagcaugaacucacacuuacugggaggacaaugauaaaaaaacagaaaggagagaacaaaaugccaaacauguagauaaauuggaacucuugugugcauuuagugaaaaugugaaauacccuagugacuuuggcagugcuucucaaccugugggaagugacaaccuuuucacaggagucauauauuagguaucaugcauaucagauauuuacaauucaugacaguagcaaaauuacagcugugaaguagcaaaaaaaccuaauuuuauggcugaggucacauaacugaaagggcagcagaauuaggaagguugagaaccacuguucuguggugaagugugucaauuacucaaaacaucaaaaacugugucuuaaaauuaucuuucuaguauuuaaccaagaaaaguacaaagcaaggauccaagaaaauauuuccauacucacuauacucacuguagacaacagauucagugacccauugguagaugaaugagcaaagacacuguaccuguauuguggauuuuuuuaguuuauaaugggaauaauucugauaccugacuggacauggaugaacauugaggacauuaugcuaauuuaaauagccaguaacuaagagacagauacuauguuauaucauuuauagaagaugcccagaaaguaaguggugacuguuguauauugggagagagaagggugggugagucuugcaaggugaaaagaguucugaguaguaacugcucugcuguucauguugaaaccauuaggauagugacuaugugauuuuauuucaguuaaagucaaugauuucaccacuuucuggauaagauauaaucuaaagaauaauucuuuuacuuaaacauaggaaauacacauuccagugaauaaacuuagguucauuuuugucuaccuuuccuuuucuuucuauauguuguuccauuugucagcaugccuuugauacauucuuggagaaauguaggcuuuaaaaggcuguuauuuuccuccuaguuuuuguacuuccagauuuagugcauucucucucucucucucucucucugucucucucucucucugucucucugucucucucucucucucugucucucucucucucucucucucucucucucuguguguguguauguguguguguguguguguguguguguguguguguugcauuguuuugccaaaaccuagugcaacaggaaacaugaaagcauguugugugucuuugcugagguggcugcaaugaauuagcaguagcagcagagacuguaaagauaucuugguacauaaaagucuaugcucugcagaugucaggaucugaacuuaaauuuccaguacccacauagaagcugagcacauggcauugauaucuguaaucacagcacuccuuuggaggacacagggguagagacaggagaauuuccaaaagcuagaggacaagcuaaccuggcuuguauaauagaaaaaccacagagagaccuugucuuaaacaagguggagugcuagcauuaacauguaagguuaucuuccaacaucuccacauauauugugauauuugcaaacccauauucauauacauaaauucacauacacacauuauauguacauguaucacauacauaugugcauguacuuacacauauacacacacagugacauguugaaaucaagucauaguucagaaguacucuucuuucucaucuauuuuuauaauauugggcagguuauucaaaaggacuuaauaaucgacacucuugacuuuuauuuccaugaaguaaaauagccugugcgcaugaagaagagcuuuugaagagcuaauguguuuauuaagacauguaagagugcuuaaguauuagaaaguauuuucacauauguaaaucaugacauaaagacuuuaugccaaggucuuacccuggagaccuccuaaacaauccuagacuuguggacccacuacagaccuacuacaguuugcuugaucugaauggaauguagaaauuaaagaaguaugguauuauccguaguauacuugcuaaaccaaguuaacaaaagggaauaaaaauguuaaauacaagagccacauuaaggcaaaugagggaggagcaagugaaggaggauaacugauaacucaguacuuguuccacccacacucaaaauuacacuguuagcagaugaaagcugucguuaaaagggagugauugucagaucagguuagaauacaucaugagggccaugguuugaauaagaagaugcaauuaaucaaaaaggaaacagagaaaucacauaaacaccaaaugauagacagcugucaaaguuuguggcuagcagagaaauaggcuuuaagagagaauggccaagggugagaguggacaaggcuuggguauacccacaguggccauggcugccucuggaaauuccacgcuucacagcucaagaacucacugaguuggucagaaugcaagcaggaaaacagcucucccagaaguuucuccuggguuuaaggcugacagauaaaauuguaaggaaagcuggcagccugccaaaugcuuauguuuaugaaguuggcugugggccacagcgaaucacauggucuauucucugccagcuuuagugaacuucugaugguugaaaggauucuguacucauuccuggauuauacaugcuuucuuaagcagaccccagaaaacuaagaagugucccuagaaauauguugacauuaagauagggaagcuuuuccagagaaucuuaaaauuaucucuuucccauguuccaaauaucauuagaaacaaaguagggaucagaggucagacuugggaggaucaggauuccauauaucuuaugggcauaagguaaaucucauucuauauuauauaaucagaaaggaaaaugguuuucaauuauugugauaaaacacucuaugcaagacgaccuaugaaggaaagcauuuaauuugagucaugugauuuuaggcguuagacucagagagaggaacagaggcauggaggcaggaacagcugagagcuuacagugauccacaaguagaaagcagagaaagagagagcccgggaaugaaguaucuuuugaaaguucaguauccaucccuggugacacacguccaacaagaucacacaucccaaucauuuccuaacaggucugccaaucugggacaaguauucaaauguaugagccuauggaggacauucucguccaagcaccacagugggccuuuguaaagagccauagcugcagugcaauuaugaggacaugaauuuuuucauguccagaagacacuauuucucugcaguccugccuaacaucuggcucuuucaguguuuuccaccucuucugcucuugacuagauguauguaguuuguuccugcagauaccugccacuguggcuuccccgccaugauggacuguacccugguaguaggacaguauugaacccugucucccuucaguugcuuuugccagagcaauuaucauagcagcuggaaacuuagaaauuaauuugaaugauuguuucccucagcaucuaucuuucuuuuuaauuggacauuuuuuuuauuuacauuucaaauguuauccccuuucccgguuuccucacucccagaaauccccuaucccauucuaccucccccugcuucuaugagggugcucccccauccacccaccuauuccugccuuuccacccuggcauuccccuacacugggacaucuaucgagccuucauaggaccaagggccuccccucccauugauguaugacaaggccauccucugcuacauauacagcuggagccauguguacuucuuuguugauggcuuagucccugagaguucugaggggucugguugguugauacuguucuuccuaugggguugcaaaccccuucaguucuuucucuaccuccucuguuggggaccuugcacucaguccaauaguugucuacgagcuucugccucuguauucuuaaggcucuacagggccucucaggacacagccauuucaggcuccuuucagccugcacuucuuggcauccauaauagcaucuaaauagcaucuaucuuagaugucuuuaggucguagugauucuuccuuguuguaaccuuauacuuacuauuugcccauguaaauguuaggugaguuacagaaggaaaggaaagaagguuaaaaaaaagaaggaaggaaggaaggagggaaggaauugguagugaaggaaagaagggaacagagaaaggaaggaggcagggaaggaagaggaaggaaauagaaaaaaauggaaggaagagaaagagacaaaggggggaaggagagagagacagagagacagagagacagagagagagagagagagggagagagagagagagagagagagagagagagagagagagagagagaagggaaagggaaaggggaaggggaagggaagggaagggaagggaagggaagggaagggaagggaagggaagggaagggaagggaagggaagggaaaggaagggaagagauuaaaaauacaaacccaaguacuggcuuauugauagaaaauaggcaagucagacuuauauuccaugcuugggcuuuuuuuucucaagucauuuaaaaaauaaauucucuuuuucuugucuuuuguuuguuuguuuguuuguuuguuuguuugagucaggguuucucuguguagcccuggcuguccuggaacucacucuguagaccaggcuggccucaaacucagaaacccgccugccucugucucccaaguuuggggaucaaaggcgugcaccaccacuggccagcaaaagaaaauucuaaauggacaaucuuaguguuagauuuuagguagcagagaggaggcaauaaagggggcaaagaaugggggacugaggcagauccuuaacaguuaugaaugcuauagguacagguugauguagaguuucaucucaucuaucucuauaacuuucagacaaagccgugucuucuaaguuguuuguaggaugaagagaucuuacauuucucagaaaugaaacuaugaguuaguguguaaccuauguuaugaacagaggacauagaacauguaagacuuauacuauaugaugggcuucacucuuuuuauagguaggggaaugaagcauggugaaugugugacccauauuauguaacuguauuccuguugucucugacauucauccacuaaguguguuuuuaccuugcuuauaucccuuuucaagauccaauugcccuuuucaggggucaggguuugcuaucauuuuaauuuauucucauaacauucuuuaaaguaugccccauguuuuucuuucuugaauuaccaaagacugugaugauagauucaguuucgaugucagcaugccuacacccaccuaugaagauauuuaaaaagaaaaaaacaaacaaacaaacaaacuuaguuucuuagaauccuugagauuuccagugugguuguacagguuuguacucccaccagcaagacaggaguguuuuugcuccacauccucaccagcauguguugucacuugaguauuugaucuuaacuauuguaguugguguaagguggaaucucagaguuguuuugauacauuucccugaugacuaaggaugcugaacauuucuuuaaaugcuucuuacccauucaagauuccucuguugagaauucuguuugucucuguacccuauuuuuuuccuuuuuuuuaaaauuagauauuuuccucguuuacauuuccaaugcuaucccaaaagucccccauacccacccccccaacccccuacccacccacucccacuuuuuggccccggcguuccccuguacuggggcauauaaaguuugcaaguccaaagggccucucuuuccagugauggcugacuaggccaucuuuugauacauaugcagcuagagacaagagccccgggguguacccuauuuuguuuguuguugucugacuucuugaguucuauauauauuuuggauauuggccuucugucagauguaggguuagugaauaucuuuucccaaucucuaggcuucuguuuagcccuauugacaguggccuuugccuuacagaagcuuuucaguuuguugaggucccauuugucauuuaucacuuguugaucuuagagauuaguguuauguucaggaaguugucuccugaaccaauagguucaaggcuauuccccacuuucuguucuauuauguuuaguguaucugguuuuacuuugauucauuuggacuugaguuuugugcagggugcuguauauggaucuauuugcauuugucugcaugcaggcaugcagucagaugagcaccaguuguugaagguacuuucuuuuuuccauuguaugguuuuuggcuuuuuuugucaaaaauccugugucuguagguguguggguuuauucuagggucuuugauucgauuccauugaucaaccuguuuaccaaugccccacaguuuggauuacuacuacucuauaguacaguuuuaaugucagggauggugauacuuccagaaguucuuuuauuggacaggauuauuuuagcaaccugggauuuuugcuuuuccauaugaaguugaaaauuguucuuuuaaggucucuaaggaauuguguuggaauuuuggugggaauugcauugacuauagauugcuuuuggcacauauguaguagaugugcagcuuggucuuucugugagcccccuaacaacuggagugacagcagucccgagucuguugccuaccaaccaagggagcacuccauugacaguguucacuuagacucuuuccagcuucucagaggaaccuacaaauaaagcacagucccaaaauuuucuacagagccuagaucucauaugaagaaacuguuuaccuccauugaauaguagcagguuauauaacuuuuuuauuuuaauuuccacagacuuugggaauagguagauaaugugugcuuuguucaguacuucuuacuucaggauaucguuuuaucaguuaaauuagaaaucaucccucauccauuuccuagaugggaacuucuggaauuuuauuugcaucugacaugcuuguucacacagauguuguuuguaguuacuucacgacagacuguccuuaggacaugcaacacacauacaugcaugcacacauauacauauguacauacacauacacacacacacacacacacacacacacacacacacacacacacacacacacauaccucaccuaccuaccucauaaaaaaaggaacccagugcagaccaauguaaugauugcaacaugguauaccaauggauuuucuuuguguuacuaacaggaguaugggugagggauuauuucaaggaauagggaugacucaaaagcaggugcaucauuagaguguccauuaaaauacauuugacagcuugugaaaguuacaguccuagaacuagcucucaguacugcuuguaggcagcucugcaaaucucuucucucugcaguucugcugcugagucuccucccugaguaguuguuuaaucuuuuauauucugcuggaaaguccccucuagaauccuucaaauuucuguucuuccagacacagaccuuuuguuuaccugcugagucucaugagccuccccuucucuuccggagggaauauuuuaauuugaaggaaauugcaauguauaacaacaaugucaagaauaaacuguaggcuuauucucugauaggaagaauaaacucucucaaguucauacuccacaaggaugaguacauugcagaauccucuacagugcaucacugacaacgagggcgcauacucuauuuuugcugugauucaccuggccaaacgagaugcuccugcauuaaagaucaggauguucauccugcuccaccacccccauggggggacaaaaaaacagaacacaagagcccugugguuugguuccuaccagucaauuuuaacugagagagguauucucugggccucacuguguggaccucacugagauggcucagcagaacaggguagugcugaggagagcccacuccagaaagccacagccuccauaaauauuauaaauaacauuauuguguccuuugacucaacauauuaagacuucaacguucacuuuauuuuuuuuccacuucugucuuuccuuucuucccugaaguacuacuugucugggaucuugcauaaccucugcauaugcucacccagaugugccgucuaugauccuagucuuugaacagccuucuagggacacagcagcccaguccuauagguuaggguggccccaauuuaagccccugugucagcuggcaccagcccugaaccauagcacuuuaccucuaaggucuccugagaccuuucuugcuacacuuguacggcuuuuugugugcuacuucagugugaaaguaaggaugaugccucggcaucccaccauggucuaggccacucagucacauacccaucccuuuucucuccaccuugugcugccaugauagaagcagaugcccagccucccuaagcuggauccuuguuugccuggcuaacccuucuccuaggagacugcuccuucccuguucuaguucuuuaucaucuucccccaaaccucuccucuugauccuuuccagcagcauagaacuguguucaucaguucacucggccaauauucccuaauguugugccaaguccuguauugggcauggaggaaacacagguaacucaagauagucuaagcccuuugagguuucuaaccauuacccugauucaucaggcccauaauccccaggaccauaaguccugcccuucuugaucuugucuuauucucaguguuuguuucaacauucacauauaguaagcauaaaguuauagauugaaugcauccguccaaaaaguagcauugcuuugguaugaacacucauucugacaguacuuugugaacauccugcacaggccaggaaguauuccagggcaguggguuggcuacagacuccucccuugugaagcacaaugggagccuguagauuagcugaaugcauacugcucuaccacugucucacuuggucaaacaagggcacugccaugugugaagagcagugcuacuuaaacccuugcucaaauccuccagcagcuuucuugacccuucugagccuuuuuuuuuuuccuuuuugucauaaugaaaaucacaaccacaucacuucuuagggucuauguaaugauuaaucacaguaguggcucauaggaaagucuaaagcacagaucuugccuugcuacauguuaggaguucaguaaacaguagcugggucuauuauucuuucuuugucaagguggauaauguggccuugcucuaucuuccagccccuccuuucuuaccuauaaaguacagggccugcaugucugguucagacacuguguuucuuucgugacauuuagcuggcuucccauuuauuucaugcacauauauagcauuuuuuucuaacagccucugcagccagggaccuuugugaaugcucauuaauaauucuuacauuagcucuguggggugagugcuaucaugaucccacuuaaaaugaggaaaccaagacacauaaaaguaggucacagcccaggcagacugguuccaaccuuguuugucuuuuagagcgauuuucucucuuuuuaaauacacuuuaauuaaaauauaaugaugucacuuuuuccuuacagcuuccuuccagucccuucagaguccccucccuccaaacucguuccaugucuuuccguucucacucucaaaugaaaggcucacucuuuuuaaauuauuacauguaauuauauaugaauaugcacaaauauauaaauacaaccuuuuuuucauuuuuauuagguauuuucuucauuuacauuuccaaugcuaucccaaaaguccccccauacccucccccccacucccccccaacuccuacuucuugacccuggcauuccccuguacugaggcauauaaaguuugcaagaccaaugggccuaucuuuccaaugauggccaacuaggccaucuucugauacauaugcaguuagagacacacgagcucugggagguacugguuaguucauauuguuuuuccaccuauaggguugcagaccccuuuagcuccuuggggacuuucucuagcuaaauacaaacuuuugagacuggugugugugacuacuuuguauuugauaacaaacuagggacucaucccugagaaagacuaauucuccucccuagcagucauuaguugcuuguaguucuugccuagagaaccuagagaaauaucuucccuucuaaguuagcaugucuauugauacugaacuuguucuguucuucuuuacauaacuguugcuaggagacuguuuugcagcagacuuuugccccucuucugugauguuucccuaacuguggaugcaguagcuguaguguagauguauccauuggggcuuauggacugggaaauggaaaaauggggugggagagcaagacucugacuuggggagggacaauacuaaaagagaaggagggaggagagacaaaaagcaccuagaugcugugugccugcgugcaugcaugugugugugugugugugugugugugucugugucugugugugucuguggguggucccauauuuaugguaaccaacagcuaucuaguuggacuuaggacccacucaacaggaacgaaauuaugucugguaauagaacccuaguuaacuuuccagagcuagugaggcuguggauuaagagaauccacuguugccauuuugcuagaccaguauaauuucuucucuaaauucuaacuuuuauccuuauaccuacagauaaauauagccaucacccgucaucaaagaagguucucuuuacaggaaauggaaaccaguacagaaaacagugggauaaaccuuauuuuccuauagaauaguuuuaucaauguguuuaugcucagguaaccaaaauagaggaaaauacuggccuuugagaacccuguguucccaggggaauccugacuuaaggcauggcagaucugaugcuguggugccuccggaugucccaguucccaccaggcuggcugcucuuggauauugaagagccaagauugagauuaagaaaucuguaccaucuuccccaagaggucucuguucucuguguuccuguacucucaucugguccucacaggcaccaggggagguaggcacuguuucuguccuaauuuuaaaagaggauuuuuuuguauacagcuuauucaauguuguuuggucaguauauacagaccucuaauccgggcagucuggcuuaccuucaugccaagcacucaucuccuaucaggcuuuccuuagcugcucuggcucaaauuauuuguggauauaaucuuaggaguagaagaauauuuaaaggacauuauauauaauagucaucuuguaagcauuugaacaaagugcucuucuauacacacaauaauaaugcuaauuauucauauucuauuauauaugugccauucucauucaaaccaccaggauaccuguguagagaugaaagcuacaaagucucacagaagacaacauauaugcuuuuaauuacuuugcauaaaguuucuauagcaugccaugcccuagcaaaguauaggggugggggggacucaaggugagaagcaugaagcuagaugucucauagugagaauucauauguauaaucuuuuaauuaacaucuacucuccugaaaugcuuucugaccuugaguuugauacuacauauaauugacacaaugagauaaagaaacuaaguaaccaaauaggcccaaggcagcccagugcucucuaaacugugauaucaaaugcacuuagacuauagacauuauuuccucguaauugugaaagcuagaaaaccugagcuacaagggcugcggagauagaaucugaugagggaccccuucuaguuuuaucugacaucugucuucuugcuauguccuuagcuggcacauuaucuagggaccauuuugggaucuggaacuuuauaaagggcucugauucaguccaacaccaugaccuaaucaccccuaaaguccccaucucacuccagucuaauaccaucacauuggagcuuagguuuucaauauaugagccaguaggaaagaugcaaaguauucaguguauagcaaggugcaguuccugguuccagagaggaaaggagcaugcuccacagacaauuagagccgcaguuuguguugugcauucuuaaagaguacccuaaagagauuuuuaagugucucuaagccagaaaauucaagcacaaacugguuuauauaguagccagucacauggaacauuaagaaaucuaguagcuuguagucacuugccacagcauuggaugacagauuuccauucaagcugcagcuacuuacccucaccccugagucauucaguccuggucaggaggccaacauaaagaacagccagagagauucuguuuugugcccuuuagagacagaauaacaacagugugcccacuacuuagcuguagaauaaaagucaaguuaucuucuauaagccucaguuucccuuucuauaaauuaaggagauaggcuggugagauggcucagcaggcaaaauacuuguggcccaagccugauuaccugaauuugugccgcagaacuuacuuaaacguauaaagaaaaacaacucuacuauaguuguccuuucaucuucacagguguuccaaggcacacacgugccucuacaugucuuauacccccuuauacacaaaaucguguuaaauauuuuuaaauuagaguaacuaucucuucagaaaggguccugaggugguucuaugagaaacacuugacaacuucaauaaaugucuaauagauguuuguggcugucauuguucauguuuucuugaacucuauaaaccuuucuacuaaaagucuuuaagcagguuaaaucucuaaaaaccucaggagaacuauuuugcccacugggacuuaucuuucuuauuggagagccuuagaccuugccaaacccuuugugaacacggugccuuaauuagcuuaguacaaguggccugugacuggauggcaccugcuguuccacaagugcuagcugaguggguaugauuggcucugcagaagcauuucagugguggcaugaggcagcuuuggcagagccucuggacuuuaaugcuucuccaaaucugaaauuaggagggagcagaaaccaucuuucaguaggugaaauugcuuuuccaaauuagguaugccugaguuguuuucuugccccccucuccuaauuaacucuagcuuauuguggaugugcagcagaauucuagaacaugccaccaugcagacaucacugggagcauagagaccuucuguuugccaguaugaauuauagggaaaaaaucuauaccccaaauauggcccucaagccacaguuaaggcaguaucuccagacuagaagacuguauaaacauuauagaauuaccuuuccuccacucucuuugaacauguugagguuggagagucuguguaucauuggaucucuuguauauagauucagucacagagcaaugacucagcagcuucuuccugauuagaagaagauaaaguaaauauaacagcaugaguaaaauaacagcaugagcaacgucucacuguguuggacgaagucguugagaagcaagacaugguucuucaucuauauccuccuaguacucuggaaguugaugccggaggacaacaauggauucacauauacggaguucuagccuaagcuacagagagacuccgaucucaaaagcuaagaaaagaauuuacauauuaggguauaguggcuagaaaauuauauagguaggcaaacccacaguguugaauaaucacaauuaaugaguggauuaucuuaagccuagcagaaguauucugguuaaaaggcuuucaauguuagcagcaacaacuucaguggaaaauagaauuacugccagaggccaaacaauuacccaagaauuccucaguaguugaguacaaggaaacugcagcuccagagugcuuggcucaccauaccaccaaugcuaugcagaccuagaaguuagaagugccuuagaauuuagaauaccauacuguaguugauauuucccaaaacauugcaagguuugcuguucaguuauuugaaaauaugcugguggccuuuuauaaacucaguaugaggcaaucaucuaauaaggguucuuuauguuauuaauguuauaaaacaaaagaacaaugucuaaucuucaucacucuuaaguaugcagccgugagacucaccagacccauagucuauuucaggcacccacaucaguugccucucuuucaagucccaggagauccaacacccucuucuggcuuccccaggcaccuucaugaacaugguguacauacaaacaagcagaugcauccacauaaaauuagaaaaaaagaauaagucuuuguaacuguguagaaauuugagguauauacacccuauacugaucucaaauuuuucuaccuuggaucagcaauccccuauaccccagcagccauuguucuacuuuuugugauuuagaguuuuagcuguuagaugucccguguaaauggauuuaugcauuauguuuuuaugacuggcacauuccauuuaaugugauuuuuccaaacguuuaucuauauuguaacaugcuuuauaguuucuuuguuccauaaggcugaaugcacuuuucauaauacauacaaucaacuucagaaauuuagguuguccaugaaucuuggcuauuuggagcagcuauuuguauaauggauauacacauauuuauuugaaaucuuacuuuaauucuauuuguacauuuuaaugcauguacaaaguuaaaggcacagcuuauaugcuaagucuauuuuaauuacuugaggagcucucagauauguuucauaauuauuguaucauuuuauauuaguauuccuguucuugagaauuuuauucauauauacaguggaacacugucauuuauuuucuuauuuccagccuccaacuccccauaaauucucccuuauauggccugcucccaauuucauguuuuguuuugcugauaaccugcuaagucccauuagugcggaccauauguucaugggcauggggccauccgcuggagcaugggaaaccaaccagcggccauacauuuaaagaaaaaaauagagaagaagaauucuuccuccucccacagcugucaacugccaaguacaucucagagaggagugagaccuagagaguacuccacuaucaguucccaaauguuagucuggcugaugaugucaucaugggcagaacuugugaaccaggccauggcuggugugagcuccuggguaugauagacuuguugagucagaaguuggcauuuccuagcacugcuccccaucuuucaguucuuauguuccuucugccccuucuuccuggauuuucccuaugccuugguggugauucggagaaggaguagguugagaaauacacuacauucagagcugagcacucagucaucucuccuuaguccuuugacuaaguccuaagaccauugcaggaaaaaagcuucucugaccaagguuuagggagagagcagcccaagucuauaaguauaaacauaaauauuuccaugacaauuugacaacauggccauuuagcaaaauaacaguagcaguuuuugugcuagggccugugacuucuccagcuguggacuuuuucuuaucagaauuacagacccaggcauugucucuucugggacaggccucaaauccaauaagaaugugguucauuagccaauaacagucacaccacgaucugcgccaguggacacaucuugucugguaggucaguauuggcuaagaccauugauaccuccauucccccugcaaucugcauggcaccuuccagugcuaugaaagcacguauauuuugagaucaguuugagauugauuuuucacuuucuuuagccacaguguguggugucuucagcaauagaaugugugugugugugugugugugugugugugugugugugugugugcaugcaccuuuauugucuuggagaccucugggaucucacugaccaguaacuccuagguagguacuccaugccuugcacugauuuuuauuaacuaaucuaaauccguugugagagauauuauccaccugggcaggguaauuccaucugugcuccccaccccuuuucaguuauauuuugaaaucagcuuacuagugauuuuacauaaagcauuuuuuuuccuguaucuguaauuuugguuaaccuacuauuuucuccucuuccccaaaccccaucccucccccucccuucuugauuauuuuauucccaguuuuacacuuuguuuuugaucacaugaauuucacuauccuuccaauuauccauuuucauuggauuguaagguuguaggcuuacaaggcuucccuggugcuacccuccccugucccacuucuauagucgcccauccauuucuucuucagccuuccaaucccauucuaacuacaauucccuauucuccuccccuuaacauauacaucuccucugaaaaagacacccuucuaguuguuuagugucaagauuucuauuguuuggauaaaaccaugaccaaaugacacuugggaggaaagggucaggaacuacagguugaaaacugcugguuuaaauauuuauuuauuuuuuaauaaauaacaauugugugucuuuauggguacagugugauucuugaaacaauuuagaaaaaguuaagcuaggcauaucuucuaccucagcccuuuggcuuuuucuuuuuguggaugaaaaguauuaaucaucuguucucuuaaguaauuugaaauucauacacauuacaguguuagaaaccaugguuaccaucaggcagcaugacaauuuguucuuucaguuuaucuaaaauaugguaucuuuugauuuaaguguccucuuucucucucccauaguauguauagucuguguucuuccucugacaggcacguagacugccuguguauuuuggcuuuugugaguaacacaagagagcaaauaucccuccagcucacauguguccauccucugcauaggugcccugagcgggaagggcuggaucauguguuccuauucgaugagccuucaugcucauuguuuucuuuauuuacauuucaaauguuguccccuuuccuaguuucgccucagaaaauccuguauccccucucccccucccccugcucccuaacccacccacuccugcuuccuagcccuggcauuccccuuuauggggcauagagccuucauaggaccaauugccucuccuccccuugaugaccgacuaggccauucucugcuacauaugcagcuaaaaccaugagucucaccaugugcuuucuuuguuuggaacucuagggguacuuguuaguucauauuguuguuccuccuacggggcugcaaaccccuucagcuccuuagguacuuucucuagcuccuucauggaggacccugugcuuuguucaauagaaggcugugcaugcucauuccuuccagugauaacaauauuucucuuuuccauauccuucccaaguuauuuuaucaucuuucaaaauaaucauuauuguaaucaguauggugguuuuaacuguuauuuccuugauaauuugaucauuugacuuguugagccauuuuaauauucuguugauauauaaaacaagaacugguuuuguuuguuuaggguagggguuuacacugcugaacacucagguuacagcuaugagucacuaugccugguuucuuuuggcucuguguucagacccuuuggccauuguuuaacugagauuaauguguaguuguuaguguuucuuauauaguuuauauuuugucccuguauuggauugagucuauaguuucaagcauuucucccaacucauuccugcauuucugaucucuuauucuucucucucucuuccucucucucucucucucucucucucucucucucucucucucucucucucucucucucucucucucucucccuguguguguguuuuucugucuuucucugcuauacaaauguccuuuaguuuggucugcucauauuuguuuccucuuguuuuuguaaccuuaaccaaggagagcaaaaaucaaaacauuggcaauaaaaucugaauaagacucaaguaaacaagaguauauucaugguuuagauauuaaaaguauuaguguuauuuauguguauaacgcccagagaacucugcagauucaauacaaucaaaacuucaauguuguuuuucacagagacagaagaaacaauccacaaagaacuacaaaaagagcccuaguaaacgaaaccccaugggguugggggagagagaaauaaacaguggaagacagcacacuccaugauuucaaaguacaguguaguauguuauaaaacuauuauaaucaaagcagcaacagagagauaacaucaaaauagacuagugaaugagaugggacagaaaggucagagauacacucacugguuuacagucaccugacuuucagcaaaggcaccaagugagcccagugaggaagaguuucuucacuaaauugcucucaagaaacuggacuuucaugugugguagaauaacauuggaccuuuaucucagcccaugcacaagcuuagcucaagguggauuuaaagaccucgaaguaauaccugaaauuaugaaacuguuugaacaaacuauacagagagcucugugaccuucgucugggcaguuauuguuuuagaucucuauuuuuagcagaugguuuugucaguggauucuuggcugccacuguguuuuuuccgcacaccuuccuacauaaccauccaccacuucugcucuacaaagggucuucugggaagaagcucucaucucauggucugcucaugugcagcauuuagcagucccuucuugauacucugcacugauucucucuagcuuugucuuuggaugauuaccuuacagggugucuuucaucugcuuuacuuugaguucauuucuguuggaauccuuugaucuaccugaaguuuuacauagugagauuuugauuguuauuucuccagauaagccacuaucuacccuuucccccucuuuuuuuuucugggaguuuugugaugcguacaucacucccugccaugucgucucauagagcacucaccuuccuucuuucuuagaaaguccucugccucaaucauuucuaguagcauaccuuuauguuugcagaaccuuuguucucugugauuagauuugcuggguaaacccuuaaggacuucccagcuuugcuguguucuacagacccagcauguccucucuucuuuggcuuuugucuuuguguucaucuuaaaguugcucacauaguguuccucauguugcuuacucguucaucugucugucuggccucuuauaagucaugaaacgcuaccaagaaaauugcuuuuaauauuuucaggccaccacucuccauuucuuuaggauuauuugucuagagauuuaacuugcugcuucucucacgacacaguuuucuggacuuuuauuuguuauuguaaacucuacauuuuaaaaagaaagcaaagcaaaacaaaacaaccagaacagaacaacaaaacucaugcauccucccagaccauagaguuuagcauuuuauggaugcaacaggguaguaaguccaucugcagaucuugggaacagcucaaacuuugccuguguuuguaucuucucuggccucaugugauuguucccagacagauauuuaugauuuucuuuuuuucaaguaguauauaauuuuuuccucccucugcuguuggucugugguacugcaggucucugacauuacaacuggucucccuuggucuggguaacuccccagguaucagaacuguucuacucugcacuaccagucaaaugugaccaaaaccacucaaucaugcaagccuauauagaaaucuaaagcaucccauucccuuaccacucuuguaaaccccccccccccaaauaaucuugagcugguacuuacuucugauugugccgugccuuccuucguggcaaugccaggucucugagcucuggaucaaccagcguuuaaauucuucuuucuucaauuccugccaucugcccacauccaaaagacaucagcucccuaggagcucuccugucacucuggaccgauccaguuccugccuaggcaacccuucuuaaaaucuggaaaguguccuuaugauuccuucuccuuccucccaagggagaucugagcugugcugacuuugggggaagggaugugguacuuaaaaugaaucgacuugcuuacucagguucauguggcugcucuugcuugaguggucugggugcugugacucccuggcugaucacaaccauucucauuaaagcuuugugagccacggguggauguuaagucacugcuucuguggaacaagaaccagggcuuccuaucccuccaucuuaauguugcaaaugauuuuuaaauugggauacauaaauuuggacucuguugucuucacucugaauuuuacaucuuuacucaagaaacuaaaauaaauggacuuaauaaauucugaagaggaaaggaaaagauaaauguuggggagagaaauuugagagucuuauaaggaacaguagauuguaauaaucaagacaaacuucaaauucaacuaaaggccuuaguucuugaugccucauuuguccaacugaguaacaguagcuuaagaaaaugcuuaaaguuuacauacaggauaaggggauggagggagggcgaagaaugauuaugaacauaaaaguaacagcaugugagaguauagauguaguaaguagcuuaugauuguauuauaauauauacaucagcaugugagaguauagauguaguaaguagcuuaugauuguauuauaauauauacaucagcaugugagaguauagauguaguaaguagcuuaugauuguauuauaauauauacaucagcaugugagaguauagauguaguaaguagcuuaugauuguauuauaauauauacaucagcaugugagaguauagauguaauaaguagcuuaugauuguauuauaauauauacaucagcaugugagaguauagauguaguaaguagcuuaugaugauuguauuauaauauauacaucagcaugugagaguauagauguaguaaguagcuuaugauuguauuauaauauauacauauagcaaaccaucaccuucagcuccucaaauauaugcaauacuuucuuaucaacuauacuuuaguaaacaggaaacuauggcuuauaaagcaaauuaaagucucuccuuuugaauccccaugugacugaauaauuuuuuaaaaauuauuuuuaaauaaauaauuuuaaauaaugaugguuuucaggaggugcuaugauaaaugcccgacaaagugggggcaaguaaguauuuacuccuagggacaugacaggcaucagacagacccagaaccccacuaggcuacugcaucuggggcagacuccacugcaccccagaguacagaguaagcugaugacugaagguuacaugccugagcaggaaaagcaugugacgcuuuuucccaagcagcuaugcucccaacugcaaccagguggcuucagacaucagacauggcuaagucagcaccaaacagauagugugcuucauauacuccaagaggggcucagagccuuuuccuccuguuccacucugcacccugaagggaagucagcugagaacccuucugugugggaagggcagacuuaggagagaaaucugcacagguggauauguggagcucuuuccucucagcagaccagauuucugcccggauguccagggaaucuuauaauugugugaauagacacucugcuccaaaacaauauaaguggucauccaaaaagcacagauacguguccacacuuuggucuucguucuucuugaguuucauguguuuuacaaauuguaucuuauaucuuggguauucuaaguaccccccggagcucgugucucuagcugcauauauaucagaagauggccuagccggccauuaguggaaagagagacccauuggucuugcaaacuuuauaugccuaaguacaggggaacuccacggccaagaagugggagggguggggaggagaguuggggggagggcauggagggcuuuugggaauagcauuggaaauguaaaugaagaaaauaccuaauuagaaaaaaggggaaaaaaaccaaaaagcacagauauuuuaagacagguuaaaaucagauuaucagagauagguuggagaguagaaguaaaggaaaagagacuuauaggaaaugcaacacauaaaguuaaaaauaauaaaaauaaaaauauuguaaugguaucaaaagaaaaugagagaaauauacccaauaaagaagaccauauugcugauuucaaaauaaguagaaaucuuggaaauugaauaugcugcaacauacuuuaacacucaagaaaacugggcagucaaauaauggaaauuuccaagaaagaggcaggaacauuagaggaaaaacggauaauugguucacgaaccuuugcauucgaaugauuuccuccauguucacagaggaaaaacagaaagaauaaaaguaaggcaaacccaaaagguagaacuagaacauucugcaggcugcaggaauauaaaugccucagaaaaagcaugcucugccccagcauggacuaucuggucacauggagaggacacuacaggucagcagcagggaaggaaagcaugcugaagacugcaccacagugggguuuguaucccaugggcacagugacagacugggaacaggcaggccuguaugguuccacuauuuucuaauaguuuacuuuuccucuguacucguguacaguguaauaggauaaagacauuuuaggaucugaacauuuuuaaguucaaagucucaaaaaucacguacagcuuguuccauaaacaggaaaucuacagaguaggaaaagugaauuuccuggaaguucagcuaggaagagugaguuaaguacuaagucaguuccccaggcaggaugcaggaggaugcaggaggaugcagugacgcuuccucuucagggcugggcacggggcaacacguaaggacuucguauguucugugugagaauguugaaccacaguggcuuugagguaaagaaccuguugaugagaaugcacuccugaggggacugauaguggaugaugauugaagucucagauugcagcuuuggaaucauaauggagaagacaaaucagcccuuguguguauaagaacuaacucccuaucuuuuggagcagcacgucagaacucacaaaucaagacaguguaggaacuguccucugugguaaaacagugaauucuaaaggaagguguuuucuguggaugcuacuaaaguggaagugcuaacuaagugucguugacaacuaagcuuugaaggguuauuugaguuuguuugguuguuuucuuuuuuuuuuccuuuuuuuuuuuuuuuuguuuuuuuuuugagacaggguuuccucuguguagcccuggcuguccuagaacucaguuuguagaucagacuggccuugaacucagaaauccuccugccucugccuccugagugcugggauuaaaggcguaugccaccaugcccagcuuuggcuguuuucuuaugcaaaguauaacaaagaacuuugagcacauaacaagauuguugugguauauuacagagccaggaaauaaaaagcaucacuuuuaaaagagaaaaaauuaaaauuagaaaaaaaagauaugccuauaguuaguacuugcucuaaacaaaaugauuuuuuucaccuuuuauuggcauauacauucacuguuucaccauagagguuugcauauuuuauaguaaauauauauuacuguuaauauuuauaaauguuuuacagauauacacacacgcacccuucuaguuaagaaaggaggauuauuguagcuuagugcuguaucaauucuauguucuaauauucaugaagcauguuuaaauuaccagagagcacccacaucagagcugugguacuagugguugaugcauaggcuccagcccuggaaagcuuuaguaaugguuaggcaggaccuuacuaugaggaacugaagacaagaaagaguggagucauccucugcucuuaugcccuuccuuuucaaugaaucucaaucaagugacacgaacgaguuguaacuuugacugcuaggaggacaggaaaauaauugaguccuucagaagcaaagaguugugaucagugagucacagacuuuacuuucacuggggauaccugcccacgcugcugguaguguuagaauuccauuuucaucccauccgaggcacagcuggauaucuguucuagaaugggagacugauauccccaucuuggucugaaggccccauauagagaugcuucacugugggccuagaugcagaguaggcaugguguggcuugugcugggccugguuguucugggaugucugcaggaagaggaagagugggaucuaagcuuccaucuacaagcacgucuccuauuucaggaugaauaaguuaauucuuuguucuucaguaaggacaaacuacauuuucuuauucauaugcuuaggaaagucugcaagucuccaaaaaugccuagaaaauaggcacuucuugcacaaaauagggaacuagggaauuuggaaguaacccugccacuucaggucuacaccaaagcaugaaagaccacagcugcuuaagagaagcauaauuggacaagcagugugacagcucuccuuuuauggccaugccacccagagccugccucugaggggcaugcauuccauguguguuuugccucuuacagaccaacuaauccuuuuacagaccagcuaauccuugcuguccuuuauugugcuuccuaggccucccucagcucacaggcugaucuccagaagaagaagaggcgggcgccagcuccuccuccaccacagcagccaccaccaaguccugugguccccaaccgcaaggaagauaaggaagagaacaggaagagcacagugggugagugaauguggccugcucugugcaugucugggaugcuugcuuuaagacacucuuguuaacccuggcagugguguccuuguuaacuacauuaaccagaaagcaaguaugcuaaagaaugucuggaaaugacuagcucugaauugccuuaauaucuuauuuacacugaggaaggcauaaaggaugugaagauaguggagaggauggaaugugguuaaagaacgcagaacccgaggagacagugacaaguggggcucaugugaguggcuguggcauguguugcugacuggaggauauguguagaggcuguuugaaaagucgucugucauucgaaagacaucuuagaccucucaugguauauagaauuuuugccuuccuaaccugaaugucugaaaucugaaauucuucagaaucugaaaccauuugaacaccaacaugauaccacaaacuuguaccauggagcuugguuuuaugaacaaaauuauuuuaaaauuacauaaaauuaccgucagauucucucuauauaaauuauaaaugaauuuuauauuuagacuugaguuccaucaccaagauaucucaucauguauauguaaauguucuauaauuagaaaaaucugaaauccaaaacaccucugguuccgagcauuuggauguuagccuauggguccccauuuauacacugcugauacagcuagcaaagacccaaugcugagaguaagagaacucaaaagaaccaguauagagucuuugacaccucuaagcaaggaguaaccuguaagaucauuauaccccacccuugugugcuacagaucauaggagacaacacuaagggcuggaccuccaagauccaugagccucgggaggcucauuuuuguuuuaaaaucuuuuaguauccacuauuucacuguaguaagaauauaaccaguuauugcagagaagggauuagaacuuugcagcauuggauucucugguuaaaauuuccauuagaacccuggcugaagccaugagccauucacaguuuccgacaguccauuguuuccccaucgacaacaagucuuuagccccacagggacaauacucccaaucauaagugguugcacugucaaauucuuaaauguuaauaagggugaguuggcuguuggucagcauucuuugcuuuacucaguacuuuauuuguaaugccuggcaucucauauccugagaaucaguuauccuaagaaguaacaaccuguguuuuauaucuguucuucccauuucccagaggaauauauugucagaauaaaaaagaagggguggagagauggcucagagauaaaggcuucugccaccaagccucauaccugaguuugauccugggaaccugugcagagaacuuccacagguuauccucugacauccacaugcaagugaugcccagacccauacucauguguguaaauacauauacacuaaauagccagacaaauaaauguguaaacauacauaaacuaaacaaaugaacacacaaagguacaaacaaacauauacuaaauaaauaacaaauaaauagaauaaaaagguucauuuaaagaagcauucuuuaaaagauugaaaagcacaacaaacaauuaccaguucauuugaacugugcuauucuauuucaugaugagagcccuuuccucccuucaagcucuccuccuccuuuuuaugaacaaacagcucaauuuuaagggagaaauugugggaauguuuuagaaauacauacuuuaaguagcaugucaauuuguuaaaucagcuuccaaacccaacaccccauuucuagucaagggaggaccaaagccucauauucccugaaccugggcccaugcuggacacgagaucagcugguggccauagaugccaacagagaugugagacauaugucuaaaacuuaaaacuguacuaacaucccuucauugagagagauuacaaagagaagauguggaugguggcaguuugccaugcuuccuccuacccaguccuagacuuguuuguggggacaagagaauccagaaucccuuucuuucuaagaauaacguugcccuuugaggacaggggcugguagacaggucuugugguuacugcuagguaaauggcuuugauauugggugugacuguucuaaugcagagggagcuggaauuuggcauuguguauggcuggcuuggugcagacugaggcugaaguugaaauugaacauggcuguuuugguauuugacuugguauugaaugugauuuguuuagcauuagauuugguauugggcgugaccacuuuuugguauaaaauuugauguuguauacauaugcuuuguuguaggauuugguauuggauauggcugguuuggugcagagugguguggggugugguguugagugugacugguuuuaugucuggugagcaauagcaguacaccauucguuaaaagauaggaccuccuuuggcuuaaccuuugaauccuucccauguagguguuggacgucaggugccacaaaagccucccagaggcacagcucggggcccaccccaguuagugcuccccccgcccccacccuacccuccuccugacacagaugugacagagccugucaccuuuccuggggaaggcgcugguuccgagaccucagagcugagacccaaacguacgugccucuuguugccauuccagcuauguguugaccaucugucuuucuggucucuacugguauaaagcuguguucagacauucccuucuugcuuuuggacaucuguaccuuuccuuuccaaaugcucaaugcaaugcaucuagcuucacagagaaugcacugugaaugucacacaguagcuuguaagaaugauguagucagucagugguuccuacugccguuagacuugagcugaagcagugcucaugaguagacagucggugaggagcugaugcucuugggguugggaguuucuuaagaauguguacagauagcaacaaccucuggcagaacaaacuuugccaguuugcugaugcucacucaggguggauauggaugcauaucaggguaguugguguccaggaauugcaaggaugacguuuauaagucagcuuugaaccaugaccaguggcuaggcauuggaacgcuucucuguaagucaaagaaaccagaucagccaaagaagaagcagcuuuagucuauccacagccagaacuaguguucuguuuugcauuuguuucucacuaugcccugucuccccucaaagucucuugggauucucuuuggauguuaauaaguaugaauagcauuccuacuuugagauggauaagagcuauacaagccauacauguuuggaaggcauuuccugacaucaggccugugacagugcuucucgaaaagcaggcuucuucauagaccauggauucuaauggugcagugucauacugagguagcccaguuagcaauaucugaauaauccuguacuguaggaaguuugugcuuuuccacuauugcacuuaccuuuuacugucuuugaaagugauaauuuccugccggcuaacuuauuuccuuucuuugggcaaaauaauggugauucaguuuacuguuuucuacaaguaguucuuauuccuuucaacuauuuuuauccucuuuauauugagcauguuucuucacgcaaacaaauuguagguauuugauauuuaagaaucaacuaaaaaugcuggagaagugguuaaaagcaaucguugcucuugcagaggaccuagguucuuuuuccagcacuuacaucaugacucacaaacaucuuauaaaguuauucugacuuccauggacaccaggcaugcacaugguacacauacauacaugcaggaaacuacuaauacacaugaaaguaaaaauaaauaaaucuuuaaagaagaaucaacuagauagcuaucaauaaaaugcuagcuuugucaccucaaaccauuguggcaucucugaagagcccccucacaccaaggcacauagcgauuucagaggccaacucuaugacuguuaauccucacucacagugucaccucccuaguggggacaagugaauaggauuugcugagugagcccaguaagcucacuucaugaagagaagacaccuacaagaucugcaguauaguggucuacaaaggguggaagagccagguaaaggccugaaccauauccucaacuugccuuucugcagacccucauacuuaugacacccagcaggcaggcuagggcuguagacagaucccauccugcccugagaauuccucaguggucugaaggguauggaauaaagcagcagacaguuagaaaacuugauguccucuugcccuguggcucaguuucucauccuaugguaacugccuucugucuuugaguuuacuucuccagauacggcauuucuuagcccuacacaucaucaaucaccuuucuuccguccuccccuacccacaaggacacauguaauagaguagacuuagaggccccagaagccauuagaugagucaacaaaugccauucuguucagucuuccuuggccccugcaauccaguccagccccucggacaugccugaguccauuccuuucuccugugugugcaccagaaucuuaaguauucaaugaaaagcugucauguugccuaauuagcagaacuggccugucaguugcuuacaacauugaaaauggaucacccacccaaucaggcagacuacaacuugccuuuuuuaauucaggauuuaaaaaauaggaaaaaagaaaaaaaggaaauguuguuccauaaagcagccaucuaguuacuccucuaaccuugucuugugaaaggcaaaaguggugggcauauaaaguauuauacgcuccucaccuacucuccuaaucagaauucuggcugcuugaggccacauggauucuuagcagagauauuuucaugcuaccuccaaacuccuauguaucuccuccugcuuucauuuuuaaaacaucauuccucauaaaggaauuuccaugccuucagugggaucuugaguaucucacacauggcaucucauauagacuccaccuuagcgcuacuaucugaggaaauuaagccugaaugucuuauguaauguugugaaaaugucuuaccaaaggaccucagcccucugucuugcuuuguuuaccacauacucuuucuugcauugagcugaagucguccaugggacacuuugguuuuugcauacccauugugauuuguacagcagauguaauuaccaugaaguuguuagucuuucuuggaaguaguaagcucaacuaaccuuccuaaguuugagaagugauggauuuuuacacagaugugggaaggcauggagcagguucuuagaacucugugcuguuuugaucacuccuacucuaccuuucuguuucaaucauucccucccuagcuuuuauaaauacuugaucaauggccaugaaaccacacuuaccuauaaugggaaaaaacagaaagacaggaucuauguguauacucuugcacagaugugagacuuuugaacauauuuaggguuaagagcucagaagacagagaaaacagccauacaugugcgagcuuugcuuuaagaguccaccuguuacugccuguucacaagcccaacuuggaugauuccagccuagauacagguuaauaugaguucuauacaugccagauugucaagcaagcugcauuaucuauauacauccugcuguuuaugagcaagacuaccaucuuucuggcuugagauuuucuaggcccuuugcuuguccuguauuacagauguauaugccuaagguaguugaagguuauuuucuuacuuauguuuuuguucaucuuuuuaaaaauauuuuuauuauuacguauuuuccucaauuacauuuagaaugcuaucccaaaagucccccauacccucccccccccacuucccuacccacccauucccauuuuuuggcccuggcauuccccuguacuggggcauauaaaguuugcguguccaaugggccucucuuuccagugauggccgacuaggccaucuuuugauacauaugcagcuagaguuuguucaucuuuaaaguugguucuugauauaguaaaaaucacucucccauucagcuuuguuauacugacaucugcuugaagcuagagagaauucagcaauaucauccuaacuauacuuuagaauauucucaguaagucaacauucgguuaaagaccuuuuacuuaagaaagauugaaaaucucaguggaguucaguauaccuuuucugcuugcuucuuuauucuuuuguuggaucuaguccuuuaaaugugaauaccucuagaauaguucccaaugauauccuccuuauuaauuuccuuuacucgcccuggugauucuuaauaaagaaaauaggacaaaguagucaugagacccuuaucacuuccaagaagagcauagaggauagcuguggcuuuaagcuuagauacccauuccacuccuuucuuuuggagcuaccuggaugucauaagugagcugcuuucacgagaccuugugguaauggacuaaagcccuauguccacugagcacaagacuagauccucccaguggcccauugaguuaauguggaagaagacucucacuaguauagcccacacauguuggaucccuugacuggaucuuguggaagaccuuaugccacgaucaucuggcuaaguaugccugguuuccaggcauucugcaaaaguaugaaauaauacaugccauugcuuuaagcugguguguauuaguggaguuuguuugguagcaguaauuaacuaauacuagugauaaguaaaugaagccugucuuuaugggcugcugucucucuccaaugagggaacgucauuucacagagcagggguggcagaaaugggcccaaacuggucaccagagauccagguaugauuuccuucuuaggucuuaggucucaagcaagaagcaugugguucuuucuugggucacaucuagacacuagauguuucagucacagaagacugucucuucuaauaacucuguaggaggaagguaacucauugaaaaguaucuucauggcucauugaucacauuggguaauacauuggccuaacaccugacaugagugacauuaccuuaagugaaccaggccuauccagacaguaagguuagaaccagcucugcucaagagauaaggaaguugaugagcagcagauaccaugguuaauauuguguacacagcuaagccuccgguuugguuguuaucugaagagcauaauauaguguguuagcaaguaaaagagaaguguccauugggaaaggacauauguaagaguagccacaaagacaguacggccaagcaagugaaagccaaaaaucaccagggaacacuccuucuugagaaggagcagugucacccaggacaagccaccucagacuuugugucuagccauaugucuccuuuucugcuuuuacagagcagaggaaauacugauagaaugcugagcaucagaacacagccauccugccucaccugcacagaucuguuccauagauucagaugccaugaucugaauggacuggaaaguucccgacacaguacauauaccuuaauuuuagauucuccuaaaccuugugaugaaauuucauagcauccaucuuuguccugccuaggaccuguaccgucccuuugucccuguauucacacuauugccgccuuuagugucacuugguagcaucuccauuuuaagaauaacuauaggaauacuguagcauccauguucaaauaaacuuuauuuuccuuaauaaugaccccaagauaugagggugcuaucaauucagacaugcuuacuuuaaaugaaggaaaagaaaauuacauguugcacuugcuaagaucuaugguaaagauuuaaauucaacacacacgcaugcauaugucuaugucucugaauaguuuuaaguacuuuaauauucucaguacuuucuggcuuccaguggggaauuuagaacgcauucuuuguggcugaagauggauauuauacaccuacauaguauccagagacuagagaaucuggcuucuagauaaucuugguaauaagaagauagaaaaguaguguugguaguguuguguaucuuaacucauaaauccuaauaauguuagguguuuaaaauuacuccugcuuuagaaaacauucuuucauauuccuaaguaaguuaacuauaaucaaagcauggccuuuuaaaaagccaacagaaagcagaugugaaguuuccucugucagagaauaaggucuugcuucugccagccauugucuauaccuaccuagaauuaagcuuccuuuucuaugagccaugaagucagcuccuucauggucaaaacaucuugcagauucugcacaaaugaaugccauagaugaugaagaagagugauuaagcuccauagcuucccaaacccuccuguuacccaguuugucuucaacaugacugugugugaaugguucuuaacauaauuuuaagagcaggagacuaauagcucucugcucuguauucuuuaaucuuguucauauuaauaagcuuucauauuucccauuagauaucuacuuacacaugcaagcacuuuauaugcaugucuaagccaauaauacuguguguauuuggauuuugcuucauagcuuucuaaccagcuuccauucugccagcguuugaaucugcucuaaugaaucacuuuuguagaacuaucccaugaguugcacugaacuguuuauuuucaggauuuacaguacaaucauaauugggcuacuaauggcucaucaguuacagauuccaguuagaaggcccuggggauuuucagauagagcacauggagcucauacugaagcauugcuuuaaauuuuuuaauuaaauuauucaaugacuaucauuuuuguacacauuuucuguacauacuuugaggaaauaagucuuucuguggauauauguuuacaagagaauuggcaaagaauuauaguggcguagaaaaaaugaggucauuuucuccugcucucagcaguagcaaccacuguaguguucugauuuuaaauugaaaucacuucugggucuuuuggcuaagaucauguguagaauccucuuuuaaauuugaacagaaacccuauucuaaaacacguuaaggaaauucuaagccagggggaaaggaucagagagaacaauuagcauuuugaauuaaaaguuggucauuugagugugauugaugaaaaaugaacaauaauaauccauacuucaggcaagugacucagcagagaugcuaagaaccgagagauuuggagcauagccuggcaguuugcagaugcaggcaugugaucuaacuguacucugggagcaaaugcucacaaagggauggugacugguaacaacuagagccugaacagagagccugaagcuugugagaugaggcagcauuuuggcagaugccuuuaaaccugggucugugcuccuaagucaccuaaucucuuguucuaaaauucagcccccacccccaauuaaauaugucugcuuuuaaaaacaaaccuguuaauugcaaagcuccuugaagucugcaacuggguagacauaagagcaagcacagcgacguucacuuguucacuugcccuuuucuccuauugauuuguuacuuuccuggucauggcaagggagcuggcugcacagcugcuccugcugccaugggaaaaggcagagcauccaggaaaacaggaaauggauugugagcgaauagccuguuccauaaaacagcaggaaaguauugacugugggagcagagucugucccugacuagaucuucagcuuguuauuuuuguaccuuggacguuauuauccaccccccuagaacuaauauaggauguucuuuaaaauagaaguaaggaaagcuacagucuauguagagcauugaagaaaaaggaaauuugguaauuuaauucuucuugguaauuauuuuuagcacaucuugucccuaacuuggaagagauuuaaagaauuaaauggcaaugcaguggaauuggccuaugccagcacaugaaagcagauugugcaaaguccaagaaacuuauaagccaauuacugaauagaauuauuaauuaaaaauguuaagagugauuuuuuucauuuuuuuauucuuugagaauuuuauacaaugcuguuugaucauuuucaucucccccccccccaacuccucucaguucuuccccuuuucuuaacuaccaaauuuguuucuccuuuugguuguuuucaaacuauguacaguuuauauuggacaguuuauguguagcccuuuguucggguguaguugcccuaauagagguuacaccguuaagaagacugacucucccucucccggcaauugcuaauaacuccuuagcuaggugccgcacuucauguccacuucuguccucgcuaugcugggauguggucugguuugaucuuguucagguuuugugcacacagucagaaccgcugugaguucaucugugcaacuguccuacuacgucuggaaaaauuuuuuaguuaucuaccccucugccucuuaaagucuuuuauuccuucuuccaccaugauccuugacuuuucagagaaagcaauguacagauguuccauuuagggcugagaggauuuaaagcaagggaagauagaauacugggccauaaggcuaggggggaauaauggacagaaaggauaaauagguugaggaauguaagaacaggauagaggagagaauauagggauggagaacaauacuaaagauauuuuaguaaagucauaugaaaccuacuacuucuaaaauauacgcacacacaaauauaaugacuuuaagugaaauuacccugcaacagagcaguaauguaauuguuaaacaccauaugcuuacaaauaaaaagcuuggugccauguauggguuacuacucuuggaguuguuggagaaugaggucccaaaggcccucagguaauaguaauauuaucagugcucuugguugcccuccagaacuugaugguaagaaccuuucccugcagacaccacaaacuggaguaauagaacacgaacaaaucaaacuggcacucaccuggaagccucaucccuuacagcuagcuuuuauaguucugaagaugcacuaugcaugcuacuagagcagaaaaguaauuaucagccuuauccagcugugacuccugcaagccacaauaaucauuggcuuaacaguacgugcagugguggcacaauauuaugggaguaaccaacuauuuucugauuggauuuaaagccuacuucacuucacaugaugaaauccauaccugguaccauuauugagagccuaaggccaggcaucucgagguccuaggaaagaaccuagugaagaaucaguacaguauuaaaccaacucaucacaaucuauuguuaaacaguagauuaguuuaucucucagcucuaaucagggaauguuauuuguacuauaaguggugauuaagacagagauacaccuuugugagauacacauuuauauaagcugacugcuauaaauuaaggcauuuagcaaaaguuaaugaaagcauucuguaagaaucaauugguuauauaaaacuuauaaaaacaguauuacauauuuuguuucuuauaaauauugugcuuccuaucaauagugcaacacuacuuauaauuauuuauacuuuucuugcuggacagcugguuacuauuuaucguuacaaagaaauaccaaauguaaauaaauaaaauagagaaaagaaguaaaauuuucaggaaaccuagagacaaguuuaucuuuauuuuucacaaauaaguaaagcacuguguugacuaaaauaauuauacccuuagugucuuaaaucuuuaccucauagcaugaaaucaaguuaggaauaaaacuuuuuaaacaugaaguguuuugagaacuucuuucuggauuacauaaauuuaaguccuucgaagaaauaaggaguggccguauaaguguuuagggaugcugaaaagaacauuaaguacuguugcuuccuuuugucaguuaaaggaaauauggucuaugcucugagcacuuucaucucccuuagggagccaugugccauaguguaaauccuaaguccuugauuucagucccuaaccaaaagaccuuaaaacuucaaacuacuucccugcggaaguccuuucuauugcaggucagucuugcccuaaagaaaacagaaacuuaagauucaaacauuggaccccagcauacacuaaugcuucaugucuaucuccaacuccaugaacucucacuucuaaauuugugcuugggcucagccuagcaucagcagcaucaagaagggauaucuaaacaugagaacauuauaaagcaagaccacccauuucucauuaguucuacaaguaguuuagacauuuuccaacagguaguccugcuucuaacuggagagcuauuagcauuuacaaagagcugcugggaguugggaaaucaguuucuucagcccccugagagggucccgugcccucaacagaugauccuauacccaugucuguaauggaaacacuaaagugaacccaauggauauuuuaagugcauacaugaaguugagaacaagaagugguaggguaguagcaaggaguugagaaggaagaacuugggaggguauauuuugucaaaacucauuauauacauguaugaaauucucaaacgauaaaacacuaaaauagaugagguaggaaaugacuuuuuccuuccaacuaauagguguuauugcuguuuuauuugguaagcugaaagaccuacagugagugcaaugacaguuauaacacauuuuucacuggagaugaauucuacugccggaucaauagaccucuuuuaacaacguaucuggaaaaagacuaaaaaaagcaaugcugacgucaauuggccaacaccacucugugugcaauguuaaaucuccaggguugaagugcaugauaccagcaggcgguuguuccaccaagacuuuacauucauguuugccaucuauuuccucuacaguuuauugcugugcgucguucccuacgcaugccaagcguuccugauggacaggcuucuuccugccucaggcuuuuccugguaucucugcuguccucgcucugauguugcugucauucuucguucucccacuuucaggacaaaaaguguucauuuguaccucccauuacuuucuuuagaauuuacauauaaaugcaaaaaugacaaagacuuguuugagguucauuuuuuuuucuuugaagggguaaggacuuugcaauaugaauuuuaaguugauaauauugacuuaucugaaauccccggguacuuguauuucuuacuguuaaguauacugcuuuaucugaauauauccuuuuuguauucaauguuaucuuccagaauuuagucuccguuuuccucaaacauagauuguauacaugauuuuucugguauugucaauuugaacugaauagacauauuccaccuaccuugugaaacaaaguauugaacacgugcacucucaccuucuggaaccuaggaucuaggauuuuccacaugucaguucaucacuucaacuccuugagguaucuguaguuuucccauuauucuguccuaugccagucagcuaguuuacagaacaaaugaaaaggggagauguuuuuuccuucaccugcauuauucauccauucuucuuuuccauucgagacucaucaagaauuuaccugguacuaggcauugucuggauugccagaaaauaaaaguagauaacaaacacauggguuuuacuuagcugugcaagggagaaauggugucuuucauuugacaaauccugguucuaagauuuauacagauggcagggaugccaaagaauauaacagcuaugucuacaaggggcuuuggcucuuccaagaucccugugcaaccgugcggaaacugacguacuuacugucacucccaucauccaagacagaauagguaagaaggaucauauuuaacaugcaagguuaagcagaaagggcaaauguuucuugcuuacuuugaucaacuuuuuuuaauguacaaagauacguuugaucuggagagguuuuucauguuucucuccagaagaaucuuuuaaagguugugcuuagaguaauuuuuaccuacaagauuguugucuuguugaucacaaugaaaacauuagcugaaaacuauaggaaugaucuuagccgaugcugguaugugugugugcugaaacaauacaagcuggagcuacaggaaaccuauacaguugagggaaagccaaaaauuaaugagaaucucucucuuucugucucugucucucucugucucuaucuucucucuuuuucucucucucaaaaaaguccuuugucuuuuuguuucuuuucuuuuuuauuuuccuuuuugcauugaaauaaaggacuuuugucuggucaauagcagucauuuaaccucagaucauuaagugggaaaucuaaacaagaaagguaauguuuauaaaauggugggaaagcaucaggauuuaugagccagacauucaagcuuguagaugauuguauauaauuacagcaauaagcauuuuuguuuuguuuuuuguuuuuuugguuuuucaagacaggguuucucuguguagcccuggcuguccuggaacucacuuuguagaccaggcuggccucaaacucagaaaucugccugccucugccucccaagugcugggauuagcaauaagcauuuauuggagaaguaucuauuauacagaagaaagguggcagcaaaacuugagcacagagggaagagugaugcugccuaugaaauccuuggcuaaaguguaggagauauggggaaaaaaaaagggugagaacagaguuuccacagacacacauccauacuacacaaacaugaagggaaaacaguuaaguacaugacaaacacagcuugacugcaaaaguuccacuuacaggaucauaaaggucaccuaugacauggauggcuagucucugacacucccugguuuaccucuaugacagaacacccgaaacccugauacaauaaagucagacagauuaguaucugcuauacauuauacuagagucuuauaaaaauuagaaacauuaauuucccccagugcaucugccuuucagaaaggcuucuccucucugacuuacuccagaacccauccaugacuuuguaggcuacgccuucuccugauaagccagcuggagaaaaaacauguaaugccuuuucuccauaauguugugcaugcuaucaguaaaagaugauaguucccauguccugacuggagacccacaaaucaagcagacuagucacugacauguccccuugcacauucauagaacagaaagagccauggagaauauguaauccauaguaaaugccaaggaaaaagaaaaauuagcuauacuuacuugucaguuuuaauuggcuuaagcacgucugcuuuuacuauaggggucuguacaguagacagggagacacacugagucuguaaauugcauguguuuugucucugaaugugaagacucugaaagccucucauuuuaaguaaaagcuguuaacuuugcagcugaaauaauuuggagaucuuuuccaacuguuuacucacuggaauuucauuuucgcacccauuauaaucaaucacacauugcaucuguguuugugaugcuuaucagcugcuaauuuucacaguuuuuguguuaauuuggauccauaauaugauucaguuuguucacaacuuuuauaguucauauaaucagauucaaaauauuucuaugugcaagcuaacauuucccauaaccaaacaaacuuuuugcauuagagguaggauuauagccuuuaaaaaacaaggaugaagguaaaggccuuccacacaagaaugcaagguucauuuaaacaucacaaucaauuagaaacuguuaagguccuagaguucaucuaguauagaguguuugcugcuggucuucucuuugaagguguaugugugugcgcauacuguuguauaauucagacucaagggcuguggaucagggaaauaguucaaaauaauauuuaccucauuagucgcaaugccuaaacaacaagcaaacuucaaacauuucacugaaaaccaaggccuaacuagugcaagugugaggcucaggaagccucuuuggaaugaggucaucuuucucuucauuggcuggauggagucaguacuugcugacggagugguccccuuuacaucgucacuucuauguauauuccaauuuuaagacacucaaguaacgucuagccuuuugucuucuucuucuucuuaaggaaauaguuccuuuuaucauaaugcacgaagcugcauaaccaucagaagacagugucugccaauaaucuccaguaaagaacagaagaaaggaaagaggaaaaggacacagaaagaggaagagcuuucaggauuaugaacauuggauaguuguaaauugagugaaaggagaaaugugagagaaaaauaacccaaaccugaguccagauggaagaauugaugugcaccacacauucuucuugggccuggaauagacuagaauucaagaacuccugcaucuucuggugggauauaggaggaaguggccuaggagaagguaaaauauccccugccucacacaaagcugaaaacaggagaaggucaagcugacuccaccagagugcguggcagggauacauauacacgcacaugcacaugcacacacacacaugcacgcacaugcacacacggugugauuauaauuacauggccuugcugcucaauaauguuuccuguguaaaaguuugguuuaacucagaaugcuauucccugcuggagcauaugagaagccuuccacacagaccuaugucccuccaggcaaacugagcagcaggugccccucugcucaaaauggaagccuucuggucuccuugacccugacauucauauuggcaccuaggacucuuggaggugcugccuuuccacuuagagaauuaaagggagaguaauugugucuuacagucaggcuccucgcugucugaccagagguggacagagguguaaaauuaaguauaugcuauuaauagaagcuucuguuugcgcaggagaaugggugguucuugguagcaauaaagagccuuuguuuucauggccaguuucucuuuuugcuaugugcugccugaacucugaagcaccucauugacagccucucuuuccaacauuuuuuuucuucuccucaguuuuuuuuuuaaauaagcaaacuuaauuuaugccacagugucucaaacguuucuuucugugauucauagccauuuuuacucugcaaauaugcauauuuuguggacaaauaacacauuauucacauaucuauauauaccacuguaugucaguguuauauauaaauccaguuaggauucuagcaaaacauaguuucuagugacacuguaaguuaaaugagagguaaaacaccauucuaggaguuaacuaggagauuauugaauuguaguuguugaaauuaaugucccuuauaaugaaguugccuugaucuagggagaaggaaaacuggauagggcauguauuccauguagucaucuagauauauauauauauauauauauauaugaaaaugcagauguguaaauaugcacacaagaaggugaccucugucccccuauccguuuccagaggaaaugugagacuauucuuaguguuguuuucuccugucagggagccauaaauguguugcucauacauuuguuaaccguccucuuugcuauccuaaccccaccugacagccaacugacagggccagcuucaaccagucuccuucuggggaguuggcagcgugggugccagggcagaaucuuuccaggcuccagugagaaguaaugcccaccaacccacauucuuugcaagcuugguggucccuaaggggcugguuuauuuaaggcaucuuuggaaaacaagugguuuuggcugcauaaauacaaccaccagggggagcucugguuauccuguuaguguacugcucugcagaauggaaacaaagauacaaaacauaaaccccagggcuuugcuuuugugccggucacacagaacaagcaggcucggugacuacagucuuaaagcuggucccucucuagucgcacaaagaaugaaauaaagccaaaagaaucaaccgauuugccugaaaucacacaguuaugggaaggccuguacucagcuuaguagauucuccaucugcugcugcugaggugacuaguauguggucacauuaugacugugagcuuaugugugugugugugugugugugugugugugugugcuacuauaucuuuguaucauuuauacauauacacaugcauaauuuagaaacacacugaugcacacuguaaacauauguggaggcauacacaacacauaugaguauccaugucauauacauucauugccaugcauucaucacuguugugggcacacuauguccauauguacauucguaacacguauacauucaugcaugcagacauaagugcaccgugugugugcacaucucaguguauaagcuggcacaguauaugauauuauuaccuugugccugccaguuugccucacucaagauauucaugagucuauguuuggcuuuguaagaagaacugugaaucuguccauuuaguuuucccaggaaucguuguuggccucuuuuauugucugucuuagguaacuaugaccagauaccuaagaaaacaccacuuaauggagggagaguuucuuuuggagcacauuuugagguaucagggcauguuagcaggagcaugaggcacuggucacguugcaucuuaguuaagaagcaaagagugaacaagaggucgagccagcuaugaaacaugaaggcuccaccccugaugaccaacauccuccagcaaggcucuaccuccuaaaguuccauaaccuuuaaaagaagcacuaccauuuggagaaaauguauugaaaugcauggacauauggaauacauuguauaucaaaccaccaugauuccuaauuugccacaagaaggaggucugaaaauugaggagagcaugaucaaaccaucauuaaaauggagaguuaccuaucuuuggacaggucagaaucucaugcuaucauauuaauauguuccggcuuccuccuuuaucauuaacuuuauacuuauuucugcauccauuggauguuugaagccuguggagcacgugacaacuagaaggugguacauagugggucugcaagaaggacucagcuggagacggacaggguuuuguacuccauggauucacuacucauaggguaaaggcaugagguaaaaaaaaaagcuacugggggcccccauuuuuauagguuaauucuucaaucuuuaucagagcccuaacaagucagagcuauuguuaacauccucaguuuacaaauaagaaaacuuuggcacagaguaacuugucugaggccaaagacaaguucaucccuaugccuagacuuguuccuugccagucaugucccacgcacuuagcuuguauucuauuuccugccuucauuaugccugccaguguaugggccgguguugugcauugucucuggcuuccccuuuuuaccucugaaaacugcccauauaccaacaaaaggagaacgcagaggauggcagcccuuaccauuugagguauacagccaguggucuggucauauuugaagcucauggacuggguccacagccaccaguugauauguguguuaaaacucuauccaacagcaagugcagagauuuagccaaaucaccaugcuuacauacuucccagacauggacaguucucaagacuagacuuagacucuucuccucagccacaccauacaagaguccccugccuugcuggggcuguuauuacauaucagcagcucaaacaagccaugcccucucugccagcucugaagguuaaaagucugugaucgugaugucaauagguuaguucuuuccaaugcucgcucauuguuuggcucauggaugacauuuccuccacugccugcauaggucuuccuucuauuuuggggaucuaaucgcuucaucuuuuaagaauacaagucauauugucucaugcaaagaggccugccuauggccugacuuacucauuuacuacuguaaagcccuuuuacacaaaauguuucauucugaauuugcugugguucuauguuuuuuuuagaacaaaucuuggaccaugauugcugucaucaucucgugguugcuaaggagauaguagagacaacagaguacgaugcacccaugcauaaucaugggacaauacuagaaccugacucuagggacuuggccuuuuucaagcuacuaacucugcugacuuucuccacuuaccaugacccugucucugaagaagccacuuuccugugggcauuccugugcuuacccuaacugacuuucauucugcucacaguaucuagaguagcugcaguucugaacgcacugacuuccccacugacuagcagagaaaaccuguccgucgcaggagcugcuuccagggauggucaguaacugugacagccugcaccaugcugaaaccagaagccccucuagcucaugcugucccuuuucugacguguacgccuuagccuccacuggggucuuucaagcauuugugaauacaugugcaccuaugugcuguuguugcugcugcaugcacacgugugaacacacauacacacaugauugaagccuacuuuguaucuuaguugcauuugaauuuugggauuuauagaucauucauagucagcucaacauguuuuccuguuuauucuguuuauuugcagagcauuguaaagaugcuucauauuuauggacuuccgaauguuuucugaaaucaguuacucauacuccucucguguaaugaauucuauccaucuuaaagguugucauguugucaccaguuuuucccagcuaacaggacuucugaggaaaccaagccaagauauuaaccauuagcuacagauuguguugccgacuucccaggcaaaagggcccuugagacucugcuccagggccuggcggccucuguguuuugcuuagacuuguuuuugcuugaccuaugcaaggcaucuuaaauuguuuguauaaacugcugaaucaguuaguagcucuuaauuauaacuuaaaaaaauaacauaaaaugugcaacauuagauauuuuugaggacaugauucugugguuguugggguauuuacaugacugcacagcagacuuccagggcuuugccaucuuccaagucucacucuguauccauuaacuccaguuuugcccuuuuccucaacuugccaaucacacucccaucuccuguuuuacaauaaucugaugcucuagguaucucauauagauggaaucacaccacauuugucuuccugggacugacucauugcccucagcauaauggccucgggaaucauucuuacgguagcacacagcagacuugcuuuccuuauaaagacucaauagcuuccauuguuuguguauaccauauuaucuuucuccauuuauccauauacagauauauuuguuuauacuucuuaucaggaauaaugccagagggaacauagauguacaaauaucucuucagagucaugcuuucuaucauuugucauuaccaauccagaaaugggcuacugaaaugcuacuugguaugccuuuugucuuggccuguuccaagaacugucacucuaaaguuagaacuagcucacucaauccaaaguaagucucaugugaguucuagagucaaucauggugacugagccacgcaucuagaaugcaaugaccagaaacaaguaacagcaaggggagugagagcuguuugggucacuaagauccuugugcuaggaaacuagguuguucuccacauaggagagaaacacuucugagcaaccccaaccuugaaguccuucaggauaggcaagacucaagcugcuugggaccagcucuuaacucuguuauuacauaaucucgggcaauuuaauuguucucuucugcaauuucuaugaaaagcaaaacuguccuugagaauuauacaagcaaauaaauauauaaacauuuagagugauaaccaacgugaaacaaaucaaaauuaguaugaaaguggcuacaauucaaaauguaagaaaguauacauuaaaaccuagauguguguguguguguguguguguguguguguguguguguguguucuuauaauaaaaagagagaaggcaacaucaguuuguccugugaagguguuaugggguacaguaguaccucuaugccuuguaaguggcugaugauacucuggauaucuucgacauccaaucagaccacuccugucacucagccugucucucacugaagucccaaggucucuuucaauuucauucucaaauuuucaaaaacuagaaagauuaagcaacuuaaguccucauuguaaauaacaacaaaacaaaaccagaagaaaauuuuugaucauguuaugaaauaaaccaaaauaaaaccucauucucuacuucauaccccuuccugagaaaugcaaggcuaaauugcuauuuuucuuuucuuaaaauauugucauugcauggcuccuuugacagagaucuuaaaaugugucuuuagcugcucuugaaaaugaauguccugcaccuguugaacuuccaccauuucccagggacccucuggugcucuaccacuuccccugaacugugacagugaauucuguauugcaugucuuugucagauaggacugaugaguuugacuucuguacacacuuuucuuuauccuucagagaauucucagcugucucaaugcuaaugagcaagcacucaucuuuccauacaacaacaaaacacaggaaugaauuagcccuggcuuccccugggagcacugcagagaguguugaguugaaaugccuggaguggacacuucuugccacuucagagacacaagcuuaucuucagaccagcucagugcugaucaaaaagucugaaacuuaggccugagcucuacugcuacacugacuuucaguaucuggugaggguacaggauccucaagcuacagagaggcaguugagcccuaaagcauauuuccuuggcugugacuccuguacuucucauaggacggguaaaagaagcaugaagggagggaaagagagaagcccuuccaaauauccaugcuggauauucaguuacacccugggaaagccgauuuuggagaaauuacaccauugcuaauugcauaauuaauuuucugaacaacuucagaguaugagaagaauaauaguuuuuuaaugaaauguggauauguuaauccugccuacuguuugggucuaauguuugaugcaauuaccccucaguagucacagagaacucuggaugucuaggucaccuacaugaagugguguaguauuuccauguaaccuacauaauccucacauauaucauuuacauuaucucuagauuacuuauacuacugaauauaauauaaaugguuguguuguuuaaaggaaaugacaagaaaacagucaauacauguuuauuagagacacaaugcuuuacuugugggacuuauagaugcauagagauauaucuguguguguuuuacagucauguaucucaagagaaacuguauuaaaguagagacugguucaugugacuagagaacagaaagcccuaccaucugccaucuguaggcuacagccucagaauaccagaaaggcgagucaguuuuaguguaagauuccucaagccagagguucugcuguccaaaggugaugagaugcccccaggcaaacaaagcauuuuguugucuucugacccugggcagauuggaugcuucauucugugaagccugaccuccagaaggcaugucuuuuucuuauaaucuauacuaauuaacaugcuaaugucuccacagcagccucagacacccuacaaauaguuuccucacuucgacucaucagaugacauauaaacaacugucaagaguucaccccugaccacauggaugccuuuaaaccacacuuacucuccaaguauagauaaugacaaggucuuaauaucaagcaacacaaugcagcucugcugcacacaaucaaaaacuugggauucccuucuuccaggggcaacacccuugagacaugucucagccauuuccugguauaaaguuagauaauuaagugcugacauaaaugucacggagcggaaagaagaccaaaagaaagcgauguaucuuuuugcauaguuugcauauaccuagaaacauauucauagcaaaacaagaagauggcuguuuucaucauuucuguaacaguauucaugauauggacugguauuucuaucaacuaacuucuuuuuggccuuuauuaagagccuagacuggucauaguucauuacuuagugcaauucuucauucuuaaaaguuuaguaguuggccuggaauggguuaggguaguuuccauugaccuuaaucauagaacacuguaauucugagauaugccccaagggguagcauguauucuagagacauucuucccuacuucugcaugagauguaguccaguuuacccuuuguagucuagauuagucacccuagccaucauuguaacccuuuccugaccuacaagggcaugaagagcccaaagugaugggcagucuuaacuuucagcucaauaaaguccuuguugugucuacucauagaacucuaggaugaggaaccauaagucuguaaaacauaaagaugagagaacaggaagcagaaauguuguuaguggguaacucagggguaaucuuagguaauaccacuucaguggacccuuugagucuaagguauguuaagaacaggaccauaacugacuccacacuugcagccuccugaaguauugugcucagcaucauaugguaccagcauuuagucagugauaccugagucuccaaaagacccugguucuaccaggauguaaagacacaugagaaaugcgugaauucuguuugccugaguccaucacugacacaauagauagagggaacaaaucuuaaauucuuugaagauaaaguaagugaauaaacacuauagugcggugacauaucuaauuuucuucauacauuaucaaacuuucuucuguguguguccuuuaaaacaaaacaaaaaaacacagaccagaauuaaaagcaaccaaauguaauccaugauuguccuaaggaugaguaucucauuccaguuguuaguauuuuccucaauugcuaaucuaaaaacaugccagguaaaauuugguaauagugaaccauccuuuccuuuuagcaaaggaaaaugaggaaugccucaaguccugagagcugaccuugaaaacuuaggucuggaccucaguauccaugcagguuauuuuggggauugguaguuuugcugaggugaguguuuucugaccaauaaagccaaguuauuuugggccgccauaauuguguguuagacaggugguuuguguaugaaacauuuaauuuacugacuguguagucuguugauuuuggauagggcuagaaacaauucuauacaaguuuccccaaaugaugggcucagcugcugaucuugucaccauuacaaggagauacacaucaccaagccugcuugaguggcaagaaggauccgugggaaaaucauggugugacuuuucauggucuauaggcuaaccacucaguggaauugagcagacuuuaggugguaauuuugcaggauauauauguguuagacaagaacacauuauaugaguguaaaccuaguugcauaccuuucuccacauauuuuaugguauauuagucuuuggggauuaccacugaaacacaaaagaacaucugucagggcaucuuucaauauucaauauauaugcuuuuauucauuaguacaaacccaggaaacaguuugaauaaaucaucuucacauuuugugcaagucuguaugucccaaacuuuuggcaauguacacaaauaagaaggcaaacauaaugaacuggcagccucauugcuggggcugcagaugugggugggcauaucagauggguaauccuuagacaccuaggcuuucacaguccuggaggaucccgcccccaacugccugcccacauucauaugcugcuuuaucacauuauggcaaugcauuuggaggggauguguagaauaaugaacauguauuguaucugagaccaagaugucagauguccaaaaucuuugacagaccccacucaccugacaccucuaguggucugaugacugaaggagaguuuuaaucaccuacauuguguuagaugaaaagaagagggaaccauaagaaagaaugcaggaaggugaugguccuuguguuacuagaggguagagccagccuccguuacaccagggcaugugauggcaugcagaccugaggcuacugagacagcaaugaaggaacuuuaagagauucuugagcuagagcaagaagaauuagccacuugucugcauggaugccauggaaaacaaaaauucaggaagucacucacucaccuuuaggcucuuagucaaagggagggagggaugauauuauaaucuugauugaucuggaacuucucagccccuauacaccugucacucagguagcaaaagaccacugcaaggcucuguucaguguaaggcauaugauguggucugaauccaguacaggacauugagcaccuuguauuaugcugagcagcuugaaagcuucaugcguuugauaguuuuauagauaguaaacuuaagaagucaccaguaugaaacuaagaagacauaacaguugaagaaaugcaaucuaugguaaaagaaaagcagcuaucacuuuauauuuuaaacguuuuagaaacacuaaauacaagguuuugugauagauauauggugacaguuucauuuuuaaucuuuaaccuucacuuucaguacagcugaaaggggguggagguaagaagaugacaggugacuggucugacgcuggaugggccucugggaaucaugggaggucauguggguccagggacuggcgucucugagauguucaacaucaaaguggcauugcaggucccuugucaucuugccugagauguggaagacgacucacaguccucugagucuuuugcuaugugccaugcagaagauuagguuuugaugucaaaagucucaaauugucaucaugaauuuaauaguguagcaguaagaugccuuccucacuggguuagauacccagacuccagauacaccuuguuuuuacaguuccuaggcuuguggucucagagggcaggaaggaguguuuaaggggacacucaaagguaaauaguguuuguaagagaguaguuugacuccuuuuucuuuuuauauuggaaagauacguuuucuuucuaaauggcgguaaaugucaaaagggaucauaagcauuauucgaaccuagaauuuuuuugaaugaguggaaauaaaaucuaccuuuuccuaacaugucuaucaauaagccaggagaacucaaaguauauguaacagaaaacaaaggggaaagggacucaagaaaaauagcaauaaaaauucaauuggugggcauggugagauggcucagcagauaaaguugugugcccucaugugggaugaucugaguuagaucucuagaauucaugugaugaguggagacaagcaaucccacaaauuaugcucauaugccaugagucaugucgcgcgcgcacacacacacacacacgacagauagauagaugauagguagagauagauagauacauagauacauagauauagauagauacauagauagaugauagauaguagaugaugaauaagauauauacauagaugacagauuuauauaaauauauagauaugugugugcauagauagauacaaagauacauagaaaauaaguaauagauaguagacagaugauagauaaaugcauagauagaugauaaauagauacauaaauauguagaugcauagauaugugauacauuagauuggacagauagauaauagaugauagacagauugauggauggcuagauagauaaauagguguaaaaaaaaaucuuucacuuuuucuaaucuuccugagaaccuaaggcacaaggcaucaaggacucuggaucaaauaguaauuauuuccucaagaaaaaacggaaaguguucagggccaagggaguucuaaacuuaagagcaaauuuaaaaaggcacuuauuuguaaaacuuacugagucucuacuagguaaagccuccaacaacaguuuaauauaacauacaaaaauauucucugcuugaccaguuuuauauuaaauugagaucacuagugguagcccugcagugccuuaugggcagcuaugcagauguaggccaaaucacuaacccugaagaccuaaugaugaaagaugaaagugcaggggaugauacuuuucauagauugccuugucgauguggcagaugccucaccugcucugacagacccgagucacagucacuuccaaauugagccccucggcaacuuggcaaaucccgaaggucaauuuucugagguguugauuaaauaaaagucacauguuuuuguacacuagacgacuuggagacaguguuucuauuuugacaguggaaacgauggcuuccuuuuguucuuggcagcagcaacugcucuccacucccagccuuccuguuccauucagaggugaggccgcagaaguacuuaagaaggacuugaaguguuuuuauuaaaaaauacuuucaaauccucugcaagccuuggauauaugugacuaaaacuuguucaauugaauguaaaggaucauucagcuuagaaaauguuaauugcaaauauucuaguacggcucugauuauauuuucuuggugaguuaauauaaccuuacuugaguuaauccuugccuaagugagcuuuugugauucuuuuuaauaugcuugcugcuuuucugagucuggcagacuuucuaucacacauacccucaaggguaggaaaaauaauuuguuaguuggacuuuuaaaauauuuuaccuauuuaguuauuuucucuguauguauaggaguaggggcaugaaugcuauaguacagauauaaggucagagaacaaauuugagagucaguucucuuuuauucuguggguuaaaaaaucaagcuaagguuguagggcuucacaguaugugucuuuaccugcugacccauuucucuaucucugaacuuuuuguacaauuugcaaaauaggaaucaugguaucuccacuggaggugucauacgaauuaaacagaagauagaugcaugccagccacagaaugcaaagacccaguucuaugaugagacucucaaauguaugcauguuguccugaucucuaucucauagugauuagucaauacucaaauacuguagauuacuuuucaagccauaauauuaccaugaauuuaaaacaaggaauccuguuuggcuauaugcuaaagaaagcaugugucuuagugugucucuuacugugauaaaauaucuuaaucaaaagcaacuugaggagagaaguauuuauuucaucucacaacucucaggucaaaguuaucacugaaaucugucaaggcaggaaucuggaggcagaaacuauggaagaauacuucuuacugcuagauucucguggcuugcccagccugccuuguuggguggcauaagccauggugagcugaguccucccacaucaaucauuaaucaagaaaauucaagacugacuuauauauaggcagucugacaaaggcauuuucucagcugagguuccucuucauagaaaacuuaauuugugucuagucuaguuaacaacaacaacaacaauccagcaagaacagcauguaaaaauaaaauggaaccuuauuuugaugaggacuaaauguaaagacugaccagcaagccaauauagugauuacuguauuuagaaacuuaguuaccuaugucaaugcauggcuuaacucaaaaagucaagcagucuuucagugcaguggaauucuguuuuuguuuuuguuugguuuuucgagacgggguuucucugcauagcccugcuggcuguccuggaacucgcuuuguagaccaggcuggccucgaacucagaaaaccaccugccucugccucccagcccugcugggauuaaaggcgugcgccaccacugcccaguggugcagugggauucuaauuagucuaacucuguuccaugugcagcaucuaggacuacugucuuuaagccuuuuguaccaaaauaagaauauacugagguucuugaaugccaaggaaaccuacuuccugccguugcugccauucucauggaaacaugagacagcagagaauuaccagaccauuuguccuccauacucucccucccccaaccccuucguacaucucacuguguagcugcaacugguugagaacucacuguguagaccagacugguguacucacaaagcucuuccugccucacaagugccaggauuaaaggugugcuccaucauggccagccagaccacuuuuuaaaugcauaaaagaaagauugauuaaaggaaaugacucuaaagaaaauaaagauacuuaaaacuucagaaauggagcagaauuuuuaaaauauuacuuuagaaauucucaguauauuccccuaugcauaaagcauaauuaaaccauuguuaaaacagucaaguguuuaucaaaacauuuaugaaaauuacauauucauccaucaaaauauacacacuaaggggucagugugaacuucuuuaaaagaacaccaguaccacagaaacuagucccaaguaucaauagaugggucuauaaaaaagauaaaaguuuucuuacagcaaagaggaaaaaaacagcauagcgugcagacagucuacagaauggaagaaaaucuuuaccagcuauacuucaaacaaagggauaauauccagaauucacagagaacuucagaaguuaaauaccauggaaacugccaaccaauggauggguaaaugaacugaauagacgguucuaaaauauagaggagggugaagcaaaugaccaguaacuaucuuuuauuggauauuuuauuuacauuucaaauguuauccucuuucuggcccucccccaaaaaccuccuauuccauccucucucccccuguuucuaucaggguguuucccuacccaccaacccacuccugcuuccccacccucaaauucuccuacacuggggcguccacccagccuucacagguccaagggccucuccucccacugaugccugacaaggccaucuucuacuacaugugcugcuggagccaugggucccuccaugugcacucuuuaguuggugacuucgucucugggagcaauucggggucugguugguuuauauugucauucuuccuauggggcugaaaccccuucagcuccuucaguccuuucucuagcuccuccacuggagcccccaugcucaguccaaugguuggcucaucucuguugucaggcucugacagagccucucaggagacagcuauaucaggcuccuuucagccagcacauccacaauagugucgggguucggugacuguauauaggauguauccccagguggggcaguuuuuguccuucagucucugucuacaguuggucucuguauuugcucccaugaguauuuuguucgccuuuauaagaaggaccagagcacccacacuuuggucuucauucuuuuugagcuugauauggucuaugaauuguaucuuggguauucugagcuuuugcacuaauauccacuuaucagugagugcauaccauguguguucuuuugugauuggguuaccucacucaggauaauauuuuauaguuccauccauuugccuaagaauuucaagaauucauucuuuuuaauagcugaguaguacuccauuauguaaauguaccacauuuucuguauccauuccucuguugaaggacaucuggguucuuuccagcuucuggcuauuauaaacaaggcuacuaugaacauaguggagcaugugaccuuguuagauguuggagaaucuuuuggguauaugcccaggauugccgagaagcaccuaaagaaauguucaacauccucagucaucggggaaauguaaaacaaaacaacccugcgauuccaccucacaccagucagaauggcuaagauaaaaaaauagacauaguauuacuugaggaccaguaaauauauuuuuuauuagguauuuucuucauuaacauuucaaaugcuauuccaaaagucccucauaccacccccccccacuccccuacucacccacucccacuucuuggcccuggcguuccccuguacugaggcauauaaaguuugcaagaccaagggccucaccuuccaaugauggccaacuaggccaucuucugcuacauaugcagcuagagacacgagcuccggggacuacugguuaguucauauuguuguuccaccuauaggguugcagaccccuuuagcuccuuggguacuuucucuugcuccuccauuggggccccugugauccauccaauaccaguaacuauuuuuaaaagugauuggggaauuacaaaugaaaaucuauucugaaauacuauguugcuccaguuagaaugacuaucuucaacaaaucugacaauaaauguuuggaagggauguggaguggagaaaucuuuauucacuguuuuacaaggaggggugcaaauuaauacagccauugugucuauaaguuuggccgugucucucaaacuuaaaauuagaacuaccuugcaacccugcuguuucacuccuggaccgcaccaagaacuccauccccuacaacagaaauacuuggguugaggugcuuuauguuuauuguugcuuucguuacuauggcaaagaacugaaaucaaccuagcugcccaccaacuagaugaaucgauaaugagaauccagcucugaagaaaaguggagucacaaaagacucaggaaaaugaauggacauagaaugaauaauauuacgugaggucacauaaccucaggacaagaaaaaaaaauaaaaacauguucugccucaugugcagaagcuacccaauaauauacguucauguguauucaaauguguaucuggguacuguguaacaggcaaaagagaaacaagacuaaacaggggauggggagggaauaaaugcaggcaaaaacauaugaggaaauuauaaaagaagauauaaaguuaaauuuuuucuaguuauaacccuguagauuuuuggugguagauaaguccaugaaaauauacuugauagcaagaguaugaaagccaucgugaagcuccacagcuucuauuuugaaugacuacucuaacuguauagaaguuuguugaguuguauuuggaucugaucucauuauuuuugaugugugaauauuuuugaaaacuuuuuauaauaaaguuuaaaauaaaauuugaagaauguucauggaaaguaaguacccauccuucaaaaaacauaugcauuuagaaaccuuuggucaagguuuugauaucaacauguagaacgaaaaauccuacaacuuucuacagggagauuacauaaagaaauuguguuaccauacagacucccacguaguggggcaaggagcuagaaaagggagacaccugacugaguacgaccuccaggaaggaagacuugccucuaaaucacacuggcauugcuccauacucaaagucaagguuaggaggcaauggaccaacugucugacaaaggaaguguucuccagguguucuccagcaagcauauccuaaauuggauuauacuccuguuuaauacaaauaaauaugcuuagaaaagguaaggcauggguaguguaacugucaaauuacuaugcuuugaaaauaaagguuucuacaauugaaaugucuaucuugagucagaaaaaaaaauguaaacauuuacuagauagaacucuuucauuguaagaaauaacuuuaucuugaaugacuuaaucaaaacauauguguguauuuaguugauauaacuugaaauucuaagauauaagucuuuaccauguauuugauagcuucaugaacugaaacuuuuuugacuaugcuucauuucagccagugaaaaaagcauauaccaguuaucauggccagcaauuauucaaaacucacuuuuccgauccaguuguugaagaugaaugaggcuagauucuucaauaacucugacagaggucaugagaaaauuuugcuacaaccaguuccaaacauauauccaucauuagaccugucauuauguucaaguuuuucacguuagccacguuuuguuuuaucuucuacuacauuuuguagcuaggguugguuaggagcaauggacucacccagcaauugaaaaauaggcugcccgugagaugguuggaugauggggaggaagggaaggagguggaggauacaaaagcagaagcaguucuuuaugcauauuuuuaaugaaaggguuacagcaauaagaauguaacucuaucuuauacugaaguaaguuugcauuuucuuacacugagacucuaauagguacauuagggcuucuaggacuaggcauaguucacaugcugaagggauaaggauaaguugaugcaaagaauaaaauauuugacucuuaagauaaccagagauguggccauggucuauguugaguuuucugauacugccuccuucaccaugggauggucuucagagaccuggcccuuuggauguauugauaauggcauucagaugagauacuaaacaguuuguaucaagcuaacgaggauauaauuuugaagaguagcaagccagcuucacauuaugagaacuaugagaacuggcaaguauuggugagaaagcacagcauuuacacacacuagugaaagcagacuccauguggcacugaugacagaggcucucucggcucccuguacacaccucugagaaucugcauauaugugcacaugcagucauauauguaacauacuggaacccuggccacucagcaguacugagcauuucccaagcugccuaugggaaauuaguccaccuaucaucagacuguucaucucgaccuuccaaaaaguuuuccccaaaaccugguucaguagucagcuuccuggcuccccuauuuagaaugaauguucaauucacuaccuucccugaauauucucuacagacuucauccccucaaaucuucaacugccacacugugcuuauaugugucucucaccaguucuguguuucccugagagcgcuccagaccuuucaagggagccccuucuagguguccuguaccuuuucuaaaacugaugugaauaaauacacccgcaccauuccauguccccuccaggcuuuccaaagacucuucuucuuuauaaaugcagacauucuccuuaagcacugggaaccucacuaggcugcaguguuuugcagucgaugagccucucugucaggaccuaacuaaagcaguggaaauacugacaugguugagcaugucaguauaacacuagugacagcgaacgcuuccgaauaucagguacuuuccaguucuucucuccaaccaaauugauaaaggaccuaacuaugcugcccaauuauaaaucauuaagcauaauuuuugugacaggucaauuauuuuuggcauauaacagaagaagagcuuuugaaaauugaauggaaugauguagccauaagaaaacucuuuuauuucaccucugccugcgcgaacaggguuuuuuggugcuuguaucugaugaaaaugaaaguuaugaauuaacuuuaugcugaaaacugccucauuuuagcaagaaggacuccagacauuuccaggcaacccaugggggagaaaaagccucauuggauucauuauaagacucauuagcaguauuuuuuaucauuuuguuuaguaaaugucaacauuuuuaguguguuuguguagcagagggugcagcccagugguagaaugcuuaucuaaaauacacaaaauccuaacaucacagggaaaagggaaauauuuauacugguuuccuugauuaguaaucauuguggcaauaacucagcacacaaaaggauuuaauaguauuaccaaacagugaaaagaaauagaaaacuuaucuuucacuuauaaacauuuuauacaaaaggguuuaaaauauaucuugaacaaaaaaaauucaguuaagaucauauuuuauuagacuuuggaauggaaauuaauucaaggaagaagagauguggucuaaagcccugccuauuagaggagauuuuuauucauuuuucuauggaagcugcuggucaugaaaauacaaugaguggcauuuugaguccucagauuuuaauguuuuaauuaaugaagcauuuauaugaaauaauaagaaggcauuaauuuuuguaguacaguaagccuguuacaaccuguuguaauucuugaauucaugauggaaauuuuuggguguugcuuuaaaaaagggaaggagaguguggugguuuagaauaacucgggaaauacagaaaaguauacuuaaauguuucaugugacuuugcaucacuaguaagucuuugccuuacuuuccccuuguucucuaacauagagaacuaacaguacuucuaacauagagaacuaacacaguagauugagauggaggauggacaucaccuguugacccuggauaguguauggaacacacaaggcacagugugggacacagaaauauuuugucuuuuucaucuaggucauauauauaaauuuaguaaaaucaacuuuugaggacucuccuuucauaaugaccagcaaagaaaaaugaauaugaucuaagacucuuuccuuuguugaucaaaauagcaauaaaagguagauucauuguaaguauagcuucucuaugguagaugggauuuuugucuugaggaacauauggaaauuugaaguuuuagaagugaaauacuacaugugaccuacaaguauucuagcuugucaacaccauaugaugcugaguaucagugguucucuuccuuacccuucugucaauguacuaugcaacaucauaaaagaaccuuggaccccaacaguggucaaucaaaaugucauuuuaaaugcauacuuuacacuguacuagauuuaaauuuuuuuaaccuggaucaucauagaucauugucuacuugaagagacuaauguuuaaggcuuaauauuuuuccccguugauguugugaaagacauguauaaaugaacuacagcacugagcauaguugucuaacaugagcuaauaguuaguaacccuuagcauuaaauccuuacacuuuaacuagaaauauuuccaagucccuauguggauucuguugcauggcuuuacagacuuacagcagacagaggaaggauaaaguucaaagggugcucaucuggaagagaacuuacuacgaauuuauauuaguggcuuucacuaaggacaaaauguguuuucacauuuccaaauguuuuguuguugaauacaaaaaaagauuguucccaucuucauagcaaaguaaauuugacaucauauuaauuaacuuaaaaaauaauggcccucuuugaaaaggcucucccucacacacacacacacacacacacacacacacacacagagagagagagagagagagagagagagagacagagagagagagagagagagagaggauaauaagaugaagcugucaaucucuuuuuuaauuuuuauuuauuuauuuauuuauuuauuuauuuauaugaguacacuguagcugucuucagccacaccagaagagggcaucaguucccauuacagaugguugugagccaccaugugauuacugggaauugaacucaggaccucuggaagagcagugcgugcucuuaacugcuaagccaccucuccagccccugaugcuguccacucuuaagauacagaacuaguuaucggggaaacaaugaaugagucuuugccaugucuuaagauuugagauuucaaagaauagucuaagucuaucagagauucgagagauuaccacaaccaacuuauacuuauuuuaccgacuggcaagaggaguguccagaggucagcaaaggacuugggcuggaguguggccuucagacucagaauucagugcucuuuggauccuggugugaggguuggaagcuacauguagaaaggguagaacacagagacugcugcacagccagggcaacuccaccuacuccuuuucucuuuagaauggauaggaacaaaacaccuuuaaccauuaucuccuuucaaaauuguggggaaaaaacugauaagauucauggagcuaaucuuuggagcuagccagaagaaaaggugauuguggcucauggcaucugagucaaacaaaagauucuccaacuggcccaaaugaucagaaauuaccugacaguugaugccaauugagauuggccuuagagagacauuuguaccucucugaaaaucuguacuucuuugcuucucaagagggggucccggaaaacauucacauagccccgaggacccucuacaaagccucugcagauguggcccuuccuugacuauagcugugccuacccuguauucugagugauauuaguuaccacugaccuacccaggccuggcauccaugucccccagcaucuguaagcauuuguacaguuacuauuuuaauuaccgugugacuucucuugggagaaaucggauaaagcuucaaaaaguuuuuucccacaugcaucugguuggcucugucagcucacucccagguauagaugguaugacauggcuguguccuagcuucauccuguaagacuaucauccagaggaaauggaaggucugucuggacaagagaagaacuuuggccuuagcacucaccaugauaugcucugaaggguccugaauagagauccauuugacauuucccuaaguggcuagaaaaaugguggagguaagauggacucucccuuccauaacugaugucucugagucuccauaggauucaggaaccaagggaacuucccuguccuaagcacucacacuuaccauagggccagcugagaaaugacugagagcacaguaguaacuaccgaagagaugaaagagagaauauacacagcacugaauauuugugugucaccuccuauauacaaaguccuuuucacuccauucugccuuacuuggccuguagaaaguucaugagagucgucaaucaccaugggauggccauuaauuugugccuguccccucauaaacugaguugggcuugaaaaccauguuaccaggucccagucagucauggagucugcuccauccuaccagccaccuggaaauagagaucuuaaguguuaucuauacagcacugugaggagccaagaaacaagucuuuuagaauuugaacacaaaucauuaggcuuuauucuuuacuguuacaagguguuuuuauucagcacagaaaaguaauuauuggaccugugauuuagcuacuguucuauugcuaugaagagauaccaugaccagggaagcuuauuaaaagaaaguauuuaauuggaaggaugcucauaguuucagagagcuaguucauuugcaucaugucagggaacacugaggcagcacugaggcaggcauggcacuagagcaaugguugagagcuuguaucugacccaaagguugcaggaaaggggacagugagucuaauguaggcucuugaaaccucaaaguccaucccccagugacacauuuccuccaacaagaccacaucucuugagccuuucuaacaguuuaccaacugggaccaaaauauugaaauaaaugaaccuauggggccauucucauccaaacuauaacagccuguuucuuuagugacaguggcaaaaagcaaggcaggacgugcuccaaaacuagucccagccacacccauagaaauaaucccagcuccacucagugggucccaaacaaagaggagacaaaagaaggcugagaagaagagguucacaccaggagucgggaggaaggcuuugaaagguggauaggacaaaugauccaaacucaugucugaaacugucaaauaauaaaagcagucuucacaucacaauaugaguggggacuggggaauaguucacuuaauagucaggaaaauguucccuguacaagcguaaggacgugaguaugauucauagagccaaaaagggcaacaagaaagccaaagggaagggagaagugaauggcagcuagcagauccucccuguggcgucuggauauguggcuucaagggaucagaguucugaguggggauugaugucuggaguaagaagcauaggagcugacucaaaggcuguacagagagaagagaacaauuucaaagcuucucacuguacagagagaguagagaacaauuucaaagcuuuucaccaaauaguggacaaggauuguauguagguuguguaaguucaugugcauugauuacuuuucucgugccuaugguaaaguuccugaggaggggaacauaaaggaggauagauuuauuuuuggcucacaguucuaggguauagccauuguguugaggaaggcguggcagcaguaacaugagguauccagucaccuggcaucagaacucagaaaacagaagugaguguugcugcucaucuugcuauuauccaauccagcacccuggcccaccgaaugaugucacccacacuuaaugugugucuccgugccucaguuacuucaguuaaccugaucuagaaaucccuucauaggcaugcccugauccuuagagauccugucaaguugacaauaaccaugacacacaggcagugugucuucuauagucuuucuugucacguuuugcagcugggcguggcggugcagaccuuagcuccagcaaugaaggggcugaggcaggaagaugcugagccucaagauagccuaaagaagaaucugaaaacuguucuucuucagcaguacucugaaauuuaaugcauugccuucugcauuugugccuuucccaacccccuucucuguacuucuacauuugcuuugagcuccuuuuugugaaguuuguauucuuuauaacuguucacuuuuuuuuuaauuguccaagaccucacauaaagcaacacaugaaggaauuucuuuuugcuuuguuaauuaaauauuguuaguugcauacauuugcacauaugugaggccuacaaucauauaacaagcccaggggcuguuuaugggaaggagagcaaguuuggaacacaguacaugguucuagccucaaauuuuaagaucagaaaacuccaugucuacugacucaacugaaacucuagagacuauuuauagacuuauauccuucaaacuacagcucuacagcuuucugacacccuggaagagaauaaauucaccucucacaauugcuaguuaaccugucuccaguuagcaggaugacuguaguuuuuccuaucaggucucaauagagacaaacucuaaugucaggagaaagccacacagagcucugcccaccaucucccugugugcuuuuaccuaaugcuuaaggacauuaacuacugguucuuggguucugauacuuuuuaauuuuaccuucccuuccaggcucaucucuuacucacacaaaaacuuacauuuccuaaaguauuaaaauuaagacagguccaaauguugaggaagaaugucauuagcauguagaccacauuuccaacauuauucuauaagguugcuggucagaagguuccauaccagaauggucuguuucuguucauucgucauguuuuuguuugcuuguuuguuuaagaaacucauuuuuauuauugcuguuguuuuugaaauuguaauuuguuuuuccuucccuccccccaaacccuuuuauauaucccuccuugcucuuuuuaaaguucauggacccauuuucauuacuuguuguuauauauauacguguauguguauauaugcagucauuuuaagucaggagucagacuacaaaaaauugucuuuauuaucacuaguuugaauauuuaaccaccacaguugccuagaggaugcauguuuaaaggguuaauuaaggguuugaagauguagcuccuugguggagcccuuuccuagauuguacaaugaucuaguuaaauccucggcaccacaaagauagacaaaagacuaaccaaucaaguguccagguuuucaugggauaguuugaauucacuuaugcauacacacaaggcuccuucagaguuaaaauguuuuagugaaugcuauugguuugacagagggucuuccuuguuuggauagcccugaaucacacauuucagagucaaaaggaugucgcccauguuaggcagcaugacacucugaguagauuuuguuaaccugucuuuguauguccccuccagugagucugccucuggggccuggcagccacugcagcauggguggagucucucaggugccagcggagagugaggagacagcaucugaggacacaaccgaggacucgggggucaugagcucucccucagaugccaucucccuggacucacaacaagacagcaugagauccaaggacaaaugguccacagaccaggaagacggcagugaccaggaccuggcuggaacuccagaacuggguccccaaaagagcccaucaugggggaaaagugguucaggaagcucaauucuaaggugagucauggaaccaggaucuaguuccucucugacuggaggacaaguuucaguagcuguauccucucuuugaagcacuuuucacagcacuggucccuaccacuuucuccuaucugaccuuguucaccuagucagcuguguaagaaagaaaaguaucucugaucucuaagcaugacagagacacuaacuuauccccucaagagaugaccucaugucucuccuuucgagaaauaaaaaacuauagguuggagaagguuaaauauuuugcagaaauuaccugucucauuguguuuccaaauauauaauguugaacauugccaggugcaauguaguguaaaaggggguugaaaccucauguccugugucuggcagggggugagacgaagggcaucagggaaaaagacgaagggcaaagggaaaaaggcaguguggguggagaauuuaaaggcuuuaucugaggaccuuugaaacaacacuuuucuuuuuuuucuuuuuuuauucgauauuuucuuuauuuacauuucaaaugcuaucaccaaagcccccuauacccucccugcugcccugcuccccaacccacccacuccugcuuuuuggcccuggcauuccccuguacuggggcauaugaucuucacaauaccaagggccucuccucccacugauggcugacuaggccauccucugcuacauaugcagcuagagacacagcucugggggguacugguuaguucauaucauuguuccuccuauaggguugcagaccccuuuagauccuuggguacuuucucuagcuccuucauuaggggcccuguguuccauccaauagaugacuaugagcauccacuucuguauuugccaggccccggcauagccucacaagagagagcuaugucugggcccuguaagcaaaaucuuucuggcauaugcaauagugucuggguuugguggugaaacaacccuuuucaaaaccucuaguuucuccuggaaaguauguuauagacuuuauguggagaguguuugaaguaugcuaugcaucuagauuuguaugucacaucucgcaaacuuaaaauguuguuaacuaaccuaaacauucauggccagacuaaacagauaugcagcucauuguggccaguccucagguaagcucuuaacuaagggcauaggaguaccuucacuguccugugacuuuuaucaugaguuucugugaguuuuaucaugaauguccaucuguaaacuuccagauguagauacuauugagauaucucuuguaguauaguacuucaaaaagucuguguacaaacauauuuggaaacauuugcucccuuuagcuucaaugggauaugagaggaucuugaauacuuuauagagaauaucaguuuaaacaugccccuguaaaagaccuccaugugguaguuaggaugagugcucccuugagcacuguuugagaacucuagucaguuccacuuuccugccagguucauacuuaauacagauguagaugccugagucaugugacuagagagagacugagucucuuaaagaaaguaaugaaugccuuuggggcuggagugcuuaaagagcaccuguugaucuugcagaggaggcaguuucaguucucaaguacucacaugguggcuagcaacuaucuguauuauaaagcaucuaacauccucuucucaccuuugcaggcaacagguauucguguguguguguguguguguguguguguguguguguguguguguguacauguacauacauacagucaaaacacucaaaaacauaaaauuaacuccuuuuaaagugucuguugugaggcuaugccggggccuaacaaacacagaaguggaugcucacagucagcuauuggauggaucacagggcccccaauggaggagcaagagaaaauacccaaggagcuaaaggggucugcaacccuauagauggaacagcaauaugaacuaaccaauacccccagagcucaugucucuagcuacauauguagcagaagauggccuagucggccaucauugggaagagaggccccuuggucuugcaaacuuuauaugccucaguauaggggaacgccagagccaagaagugggagugaggggguaggggagugggggggaaggguauggaggacuuuugggacagcauuugaaauguaaaugaagaaaauaccuaauuuuuuuaaaaaagugauaaguuuuauguucagauacaaaauacuacacugaaaacucagguuguaaaaaggcagaagugguggcuuaugguucaaauaaaccauagaagguaacuucucagcagaauguaggugggcagugguagaguagguaucuuucagguguccaagcuguaaauggucaguuaagggaauuaaagccuguucuagagcaugaguagcccauaaucuaguuaacauugugagggaaaagaacucacagggcaguggacuugaucucagccauuuacacacacacacacacacacacacacacguggggggggucgggggggagacagagagagggagggaaguagagggaaaagggggaagggagagagagggagagaaaaggagaggaagagaauauaauaguggcauacaucuucagaaaauagugguuguagugguugacauaguaauaaggaauguguuuguuucugggcagccuccuauggaggacacaugcaauauucuggaccucuguagcuaauguuuugucucucaucccacauuccuggcucuacccagaaugauuccaauccaauaucuagcuucugcaacuuuucuuaagaugucuauuuguguucccaaagugguucaaccugaaugagucauaaugaugguaugagaccaggcuauguugugucccucuucaucaccucugaaugccagaccuuaggagaugggagagaucagaaguuaacuucuugucauagcaagcaagguuaggacucuaggauuagaguggauucuaguaaguugucaugcaugaccucaaugugaggaaaguguccagcaugggauugcucacuagguaaguaaggauugcuuaugccuuuaaacuuaggucuucuguugucacacuucuuuugcuuaggaugucacuaaaugcuguuuaaaaaucacuuaaagaugaaacaugacguguaaaagcucagaaguccugguuuucacagcugucuccuuucucuugucuuuacauguuuaaaucaucuuuauuuggggggggggauaagauugccuagguuugcauguucaaagcagggacacaaauauuguauuaucucucccaagaaccuguccaaaaaucccaugagggucacccucugcuauuggguauccuuuuucuaugguguagacaggugauauggcuucagaaugguguggcuaugguuagagaguuagcucauugccacuauggcugucucuucuuuggugcuuguauagaugaguaccacccaguagcccaggagccuauguuuuaaguuuaagaagcucagucuucuaaaaacucugucuucuaaaaaaaaauaaacaagugagaauggcugaccauaauuccaguuuauuauauccaguacaguuugaaaagaggguguuuuuccuucaacucauuugauuacauucaccuggaaauuuuucacugcccugauuuacccuguaacugggacaucaucuuuccauucucuuccucuaaacucgguacaaaagauaaauucccaagaagaagucugaccaaaagguauacacacacacaaauguaauauucaugugguauuggucccuuguucugggaucacccaagaguagcacuuugagcuucaugacugguuuuguccugggauguaguuacaauuauugcuggauguacuugcaaaucuuuuccuguccuguaucuuuuacaguugaccagcgccaacauuucuuauucuaauugaauagcuugacaaaagagugccuuuggccugcaaauccauuucucccuucucuuucuuccucaguaaaauugaaauauguagaacagugagggacagguaacugagaugauuguuucuguugcugucauuuacaauucauggaggaaaaagagaaaucggauuuguuggauaagcucuaugacuauuuccaucucugcuugccuucucuucaaacucuaacaucuuugucugaauacaaauaauagacagagaagggaaaaggagaauggauguuguuccucccacucugggaggacuaagaauggaacuagcaauauuucuaaagaguggacaccccccccccuaaucuggcugucaucaggcaauuuaucuguccauauaucaccaucaccaaauuccaaguucuaagguuccuuuggggagcaucaguuaugaaaguaagaugugaauaagagagaugacuguagauuugaguuuucucaaaaguguagccaaauguagucacaucccaagccucccaaaguagaaaacacauuauagcgucugcaucccaaaagacaauagaaagaauguaagagccagagaugagaaggaacgcugggaagcacuaucugcucuacauggcauggccauggugcccgagaacucacaucagcugugguugcccgccaaagacuugcacaaaauggagccuguccagagucugucaugcuuugaggagggggucucaaggccucaccccucucacauugucaggagcuguugacaaaucaugguugcugagagaaggggaagucacuuuccucggugcuauggcuacuaguaagcugcccacagucuaagaaacugucucccauccauagucacacuaauuaagcuaauuaaacucaguggggucccaaguaacaguaaaaauuaaacacaugaaggugggagggccuguugggaagaauaagggcucaacaguaucauuaagaggaugggaaaaagggaugggguaagauggucaagacauuaaccuacauguaugaauuuuucagaagacucuuuuuaaaauagugucuaugugugaaguacaguuucuuuguuucuucggaugaagagggaccccucucccacucccacccuuugccucacucucuacaugguaacccuucaaagaccuuccuggccucaauugguugguaaaugggaguagagacauacauaauugcagucugagaaaaauucuuccccuucuugcaggcauguggucccaaaguagcuuuauguucagacugagacucaacaaggacauggguccugaauuucuacagcauccagcaucuggcucccuaaacuagaacuccaggaacuguggccccaaaaguuuuuggaagucauucauauaauacagaccauaauaucuagaaucguagaaacuguguaacccaggagcauuuauaaagaacaacauguacaccccugagcauucauaaccaucggcauucagaagcuacagcaacaguuagaagcaugucaaugcauuguacaguccuucagaguaguauuagaacacacaagaauauggaagucaccgggaauacccaucauuugguagacuacuugcuuuguaugcaugaggcccugauuugauacuagagaaaaauguggaguucugcccuauacuguagccacuuagucauauuagcugagaagcacuugccacauggcuguucacguugaaauaguuuguacgugcucgguaaagaaauucguuaaucacauguauaaauaaagcuaaaauuagagcaauuaaaauuaccuucacuucucuccuuucaaaucagacuacaagaagauguaaaaucacauauauggcccccaauguauuuugcacacuaguguuagacucugaagccuuaucagugaggaacacuuccaucugcaaugagggggucaagcauaugcaacagccaucccgucccaggcuuucuaccucuaggcuguccuaaucacucugcagucacaggguugcuuuggucuucaucagcagauuaaacugcucucugaaaacaucgugauuuuccucucugauauuuuucacagcuguauacaucucuuaaaagaacucagccaaaucaaaaccaagcauaccuuaaugugcugugagucagaaguaugccauuuaccuuuucuuucuaauagcaaguagaaaggaaaacucagcaagcuccuauuugucccagcaccaaguagaggaugauugccuguucucaucugccgggagcuacauaaacagugcuaaggccacgcugggccaaagcugccacagcuggaugagaggcauaccccccaucuccacccugacucccaaagggcaguacauaugaggcgaaugagccucccagaccgcugggauugaaagucccucagacuguaugcagcaguagccugaacauuaucacauucucugcagucauugccuccaguugugugugagaaaauagaccuggcuguguuuauucaacaugugcaggcugauagcaaaaugcccacuggcugauugcuugccuucuguuuucuuggucuuuagccacaacaaaccuccaauaagaacuauaucuuaagauuuggucauaauugagggugggggaagaagccugggaaugaaacauccgugcacauuugcuucaugucagcagaugaguugcuuucugcccacuaugcacuauucaaugauauaugccuugugcuguccuauaagcccauagggagcuaugcuucaagcccugugauuaaguccagguaaguguuaaagaggaaugccaguauccugcaucuguguaacccuuuacaaaaguggagauggacacacaggaaaaacaaacaucuacucccagacaucuuagauagaaaagcaaaauuggaaaauugccauuggcuuugaccuuggcuugauaacccuucauggagaagcucaggccuggaaaauagcaauccuugggguacaucugaaguagaucaagaugaagaagcagcaagaggaucacacugcuaccuuguuuagagauuucagggacuuggcagcuuuguaaggaaccuaagccaagggccuggcaguggcuagaccuuucugcacucuacaaggcauccagguuggcuaccucuggcauaugucuauuccucuuccugaauaaguaugacccuaaggacagagugccagggagcaauaggaaugugcuggcaggaccuaucaucacugggugccagcaucagggggugggggcaagggaaauguuuaaguccauaugagauagugagaggaaacggacuggucaggaaaaaaggacacaaguaaagggguaccuuuaguaguauagaacucucguacuugaacaagacaguucuggauacagggaagaaacugagaaagucuacucaccuagagcagagcugcuaauggccagaguaguugagacugauccugaguuagguaggaguauggugaaggaccaaaucugcucugaacuaacuguagcuuucucccugauggccggugagauccugggcccagccaucuccuauaggaaacaagguuuugcauaccauuuauaugaagaaacauuuaaacucuuuuacaacaaaaaagaaauaauuaacuagagucuaaaaauagcauuuaagguuuugcacauuaaaaaagcuuuaucagacucggugggggaagcugggagaggguagcgcuugggauguaaauaacuaauaaaaauuuaaaaaauauguuuaucaggcuugagaaauagucuguccagcaaaguggcuugcugugugagcaugaaguacugaguucaaucuccagaacauacuuaaaaaaaauaaaaaauaaaaaggcucaguguuuuuaaugcuagcacaauggaggcagagacaggaucccuguagcucacugagcagauagucuagccuuuguagaaaacucucuagagagucccugucucaaaauuguccaugaucaugcauaaaagagcacccaaauccacccgcaugcuuuuuaaaauugcuuugucaugcuagguucauuguaguaaaagucucugugauuccuccuuucagaaagguacauugacucguuccuggcucacccuuguccaugggcauaugugggguuauagcaucacuguuaaccuauauauaguucugggucuugguuuuguuuguuuuuuuuuuccauguacugugcuagaagcagcauuacuugguguuucuccgaaggcucucugauugucaugguuacuaauuggacuguauuucuccacagacucucugacaucagaguuacugauuuuuauugcccuuuacaauguagcucuccuaacugcugaauauuuuagauuuuuuccacagaauacaaugaaugcuguuauauuuauauuuucuccuucuacugaauugcuucccuacaaagauaaaguauuuguugauaucugauuccauuuugcuuuccauuuaaaccaacagcaggcguauguguuuguuguauccacugcaguuucaaggugauuucuuuucuaguuuaacauuuauuuuuaaagaugguggaauuugaacuuaauucuuacaggcaaucuucucuuuagugucucuugagugauagaaccauauagucuuggaacaaagacaaaugcuuugauauaaaaguauauauguguauacauauaagcauccuaaacuacaaguauaaaucuaaacauaauuugcuuuauauaucaaaugccauuuugccuagcaguaucuuauuuuccuuugccauauagugcagcaaauauuugaguuaguuuuuucuucacauucccugaaagagaaacagcuuuaacaaacaacauugaaacaauuaaaggccaaaagcaaagcaaugggaaggacaauugugcaccucuugugguccuuauuaauuggucugcaugcacacacaucucuagccagccucuuuugucuagccugucagaggacauuagcugagaccaaucuugaagcuacuuccuggcucccaaauggacauagucacuaagaaagaaagacucauuuauuagaaugaauuuuuugcugcguaagugaggauuguacaaggcacauuucaugcaucauuaucugggucugauuagcaaugauggaaauugguccucaauuuuaacaaucagcggaaaggaaccuucagcucucgcugaagacggacaauugccauagacauuucugcauuuucugcacaauaggaaaauggaggcaaaggcccuugcagaggcagcucuuaaauuguuuuggcagcacuugucucacauaugccauucucccucugacgcaaauaaaucaugaccuugcuguccugagcagcaggaugacauaucuuaggaugcccugugccacagggggccacauugucccucauggcccuagacauggcuaggccaccuggucaaugcagccaacccucacucaagcuuuggaacaagugccaccugucuuugaaugauaugugaccuugcacaugucagugggucucuuuuuaguuuccuaucuaaacaaugacagugacaacaccaguuacauuacagaccacuugugaggauugcaauacuaggauuuauacauacaaacaaauucuacuuggaguccagcaggcaaacacucuuucccuagcacaaaggcaugccaugcuucuggggcuugcuuugaaaggccucuaagaaggaagccauagugaaggccaagaaugggagcuuuuauacuacuacaguggguauaauguuuucuguuguucaugucaaggucuuuacuauuacaauaaaaagauccaaagguaguucccuucugugggcgacacaaugagguucccaagcucccuucccugcuauccucugcccaguucaggaauuaagaugcaguaauaugaugaaaaggaaacaugucagacaauaggaaagccccuuauuguagaggagugaauugguuuuuccuuuucaagucuugcagguagauuacugcuaaggggcagcacagagggaggcagggcuugcagaauugaaggguuucugaauacuucccauacagccccauaugcucugagauucucuuugacagcacaggaaguuaaaaaaaaaaaagugcccuauaccagagccuaaagccuacaugacugcagcccaggggaugcugauagauugcagauugucaggaacaggcuggcaguuuagagucaugugugaagacacagcccuggcaucaugacauacagcugcucaucaggugccucacuucuuaagaugucagcugcagugcagugcagcuauccuggagucuuaccagcacguuugcuugucuaguacagcagagagaaaacauggggaccacaucacaccugcauggacuucagcuguugauaacaguuuggggaggauauaagcauaaccuccaaauauaccacauauuacauauguaacuuacaugcugcguauaauauauauggacauacacaucauucaugcaaauaaugaaucuuuucaguuccaagaauaguggugucacagcaaaugugggacugcuuagccuugaauaucgacugacguuucuggaaaaaaguuacaaguccuagucaaugcauucuuuguuucuuugguauucucuaggacugagaaagccaccaugccuaccaaugaugaugaagaccuauucaucacuggccacuuacaucagacccuggcagaacuugaugaagaccuggaagguaacagccacaguacccugugugaccggaccauacgggcaaucacguuuucuuagcacuuuggugugacucuauaagaaagaagucuuggguuugcaacuuaguuuggauguguuuugccuguagguaaagguugaacuucucucucaggugagggcuguucgugauggacugauuuuugucaggguuccaagcaauauuaaaaaaaaugucucaguaguuuuuaaaauaugggcaaguaauacuacuuuuuauauuaagauauacuagacacacauuagagauuuaaauauacaaaaugagccagggggauaugagaugcacagagagaagcagugccuuuauuaaaauguaaaacucauccuugguagugcaaaacacacaaucuuuuguccaugaugaacaccucaguguggagcacccauggcacugccguucucuuaacacggucuuuggaaaacacuagaagguuaagggagaugcaaauaauuguagugaauaaguagaaauuccuuuacacaaagaacgcuacacuauuuucuucauggcacacauuaaauauaaacuagaaaugcaaagcaaugacaagcagacuugaaaacugauccuguuuuuagucucuugucauugguauuugguugacagcucugggaauccuaaccagccauguagacucccccagucugugaccacaugacccacugcccacuggaucacuuaguuuuuuggagagucgguguaauucugaagacaccaagauuuacuuauucucucuuuaagaaauuaaaacuagagcaagucauucuacaugccuuucagugcuucuaguggacacaagaaaugcaagggcaaaaaucucggugcacccgacagagaauaccuugcagauacuaaauguagacaucuguuuuauuauucagugauuugauaaaauaugguggguaaguaucguacccugaaccgucauggauaggcaaaugguuccgggccuauucuggccccaggcagaugcagauuauaaaacaaaacaaaacaaaaaaauauuuaacguguauauuuuuuuaccaaaguaguaaucccugggaaaaucaaaguauuggccaugcauucacuaacucguugcuaauacuaaacgggugccaauuggugaucuguguuugucuuucucuacaggaauggaagaaaauuaugaaacagauacuagcucucuaaccaacucugucaaugguguauccaaccacagucugcaagaagccauaaucccugauaguggcguggaugacaucccagucacuuuuaucggggaaguuucugaugagccuuuugacucagggcuguucuccaguagauguaacaaugccacuacuuuuaacacggggagcauugcuagccaaagaucucaucuguccccaucucagacugagcauagccagccauucguaaggacaaguagaaaagagccugaucccuccccuccuucccaagauaacaggaagagaaaucagccaaccuuagccaacacaucugaaaaugagaauccaguugaaacagaccccacaguuacaucacuuguuucaaagcuuuuaauagaugacccaaaagcaaaggauaaaggcaaagugcaugguucuagucacagugagaagacacaggcaggucauggaauaaacucacugcgagugaauccaagagaugguaaggaugagagcuccaauucagcacccccaccauggucucaucauggccaggccuuagggggaagcuauggacucaaguauggccucacgacauauaaaauuguuccucccaaaucagagaugagguguuaugacagggaugugucccucuccacuggugccauuaagauugaugaacuagggaaucuggugaguccucacaugaacggaagcaggaccauauccccaccaucagcuguugucgaaacagacacuccaccuauuggaaaagucaaagaguucuggaggcgcaacucaauggaaaaguaccuuaaugggccggcugagugcacuaucaaaagggcccccuccaccacuaucacugccacaccagaaaaaccacagcaagauaaugggaugaaggcagccuucacagugaccacuccccagcagcagccugccucacaggaauauggggcacaccuggaggaagagagaagccggccacagucagcagucucuuguucugugaaagugccagcaucuaaucccacagacaucacauuccucaagccucaaagaagaacauccagccaguauguggccucugcuauugccaagaagauggggccuccaaaaguccaugcugauguggugagaccacauaaggcaaccacugaacagugucaugaagaagcaaagcuggcuagaucuccucccaccaggaaagaugaugcagcucccaaccuacacucagaggcaaggcagcaugaacaugggacaaaccagagcucugucugccuucccagcaacccuggugugcaauugccagcaggaggccaucccaaaguagaggucaacagcacauaugggaagucaucgacucaagacuauccugcugcuguccacagaaacuccuauuuccucccaggcagaucuucccauagggaucguguuucugugggacagagcugugguuucaaugaaaagcaaacuacaaguaaccaaaaggcaaauucaacaucuaacuucucgcaggcacuggacaaggcgcauccacccccucugcucuuggcagaggcccgugacucugggaggauacugaugaauggcucugcacgaaccccaggaaauugugagcccccccacucuccaaaagaauccacccugacuagcuauauuaucuuacagacagaggaaaagcccaguucguuaucuacagauggucaagacgcagaugauacucuaccguccagcauuuuugggccaaagaaaaaguucaagccugucauucaaaggccacucccaaaagauguaucccugcacagugcccugauggaagcuauccacucaucaggagggagagaaaagcuccggaaggugaauguggugggugucagcguuugggugcagggagcucccgagcaggucuuccaucccuguccuagaucuuuagaagaaagacuacaaaggcagagcugcaaguuugcuggcuucauuuuaucuacguucugucucuuucuccuaaugcauucgaauaacaacacuagagaggcugaugauuggauuuagcuuguuaggcucuggcaguccaguggaaaauaugucaaucaauaaguauugguccagaguaauauugaagccaagguguggggcuaucuguacuuugguccagaagcauucuguuagcuuugugcugucauaaugaaauaucugaaaaacuuagaaaaaggaaagguuuaucuuggcucaagguuuggaggauuuaguucauacucacuuagcuuaugacuuuugaucuuguugcaaagcaacacagcaucgugggagcacauggcaggucaaaugcucaccuccaaaccagggaggggaaagagagaagugcccaucauucacuucaaauauguccuuucagugaccuuggacacucaccaguauuaccuccuaaugucuucaccagcuccuacuugugauaggcugagaaauaugccuuucaugagugucuggggaaagucuugacacucugagauaguaagacacaggcaggaccacugcuuucuguacagccuuguguugcuaaacaugggaauacauucugagaaccgcauggaguuugguuucauugcugugugaacaucaugaggugucacacaaguccauauggcaauaggccagcacucuauggggacuucuuguugcauaaauuacaucaaugggagauuuaaaaagaaugcugcugguguagcagguuuuaucauuuuggaugaagcuaaaacaaugggaccauauccuaaaaauaguuauccacgacaaaauaaccauacagccuauaguauagugagugcauaguacaguagcauagucacccacacucauaaccaagagucacaacuguauguaacuauguaccauacacucugcauguuuaaaaguacagugaauaggcuugccuauacuagcaucaccccaaacaccugcaaaguucauugcaguaggauuuuagagucacugggagacagaaauauuucaucucuuuuuaagacuugugagucugcuaucaucuguguaguauguuguugacuggaacaugugaugggauuguauugccauuguacaguaaaaauaacaauuuugcgacccuccauuaucaggucauuuaacacgucaaaacgcuauuacuaagcuaauaucaauaaugaaaagugauuuccuccauuuuucagaugaggaagcaaggcagggugagcuuuaagugaucuggcccagugucccccacugacauucucauccauguuuucaagauuucagcacacuugucagcuagggaaggcugggagaagagcagaaauagucucacaguaagagacuaauuuuugaugcaaccccaaaucuauagccuuggcucuucuauagcugccacucaacuuucuauaggguuaugucaugguagcccauacaaguugaagauaucuuaaguugaaaaagccuuuaaugugcuagacuuagcugagcuuaggucuaucucccugcauaugguuagaauauuuacauccgccuacauuuguacaacucaaagacuacauuagucuaacucgaagacuguucuacacauguguugaaugacucaguaaaguuuugaguguugugcugaaacuagaauagcaaacgguugugugccuaugcuuugguacuguggcucaguugaaugcucuuuuaggaacuuucugacacuuccuuuaagcagacaggggaauugaugcugcugauauggacuuagccuucccuuaucuucagagugaaauauguuaacuuuauuaauacucuagacugcagaacagacgucagaaggaaggccaaagaaaccauccuacguggaggcagagagugagcgaucugcccuucuggcagccauucggggucacagugggacucucagccucaggaagguaaggaaaugggccucccauuuauaacagguucugaauccugccuacacuuccccucagcagacuaagccaaugccacuuagcauccauugcucuaacuacacggcagccagcaucagagcugugaauuccauuuguuuggcacauugucacccaauuccagauagcugccuuggccucugcucaaacaaagugagagaccccugcaccaaugacauuuuccugauuuuucugcaggucuguccuuguacacuaacauuuuccaaauucauucacacacucaucgugaucucaggguaggauaacaaggcccugccacccugccuacguucauagacaaaagcaacuguaggaagauagccccgaacuugcacaacuguaggcacauauuaauugaguuuagaggcaggacagugcaccuaugacugucacacacagaguuuaaggaaugaugugacuuguacauuuucccugggguuuuaguggcucucaacuuccacccucacuuggucaaaucugugugucuggcuucuacuucuuaucaucacaugugaaagaaauuauuagacuagagaguauuuuuauacuccugccauaguggguaccuuugagccguacuuuggaagagcauggggauauauguauaagcagacagauuucuguuguccaugguucaucguuaggagcuguuugagguuuacugugagauggguagcugugugcugucuucucggaaaggaucuuuacaugaauccugucuaucgggugcuauaccaaacaccauggacugggucacuuagaaacaacagaggcuugcuucuuacagcucuggaagcuagaagucaaaggucauggcaacagcagaauugguauuguguaagguugucuugcuggucccuaguaccucaacaccaaggccucacauggcagaagguucaaggaacucucuggugucucuuuuauaggguacugugucuauucaugguagauacacauuuaugcacuaaccucuucugaagccucucacuccauuguccucgccauggagugucacagaugagauggguacaugggcauuuacuguaguaaucacuuaacugucccauuaggugucaucccuugccucugaggagcuccagagcuuccgcaaugcugcacucggggcuccagguuuggauaaaccucagcaagaagaccuuggccuuccacccccaccugcccugccaccaccacccgcuccagccccccaggcuccuucagccuccguaacaguuucuagguucagcaccggcacccccagcaacucagugaaugcuagacaagccuugauggaugccauccgcucgggcacaggagcugcaagacuaagaaagguaagcauucgugcagaaaacagaaauggaggcaaaacugacuaggcaucccagcuucugaaggguaccaccaagggguggacaaaaaagaguugacuugggagaaagccagcucuucaugcugccugcugcccauguggcaagguuuaagcuaaacccaccucugucuccuaaccccaaaucaaugcuagggcagggucaggcuggaugagaauccacagugcucccuggaggaguguagcacccuuaaccugcaaugucaucaccaaucuucccauaucuaucuuuaucugccucuuuuugccaacauaacacaaacuugcuagugaauucaaagucucccugcagaacaugcacuguuuucuucccccaggucucuuuuggcagucaaaugcaggucuacacaucuauuucccaccaguauacuguagaaaacuguggccccugaagcaguauuaucaaacuccaccuggccuucaagcucuguuucagcucaauacuauccuaugaauucacugacuucuguggcuauauaugccuccuugauauguuauuuuagauuuucuaagagagcauuucugcuuccuaaacugugcugacccugaagaggucaauagaaaguuaaucuucaugcuugcgaaaugcacaaggcucagaggauccaagucacucagcuuugaucauacagggacuggacucagcauagaagguucuuguugcccaggcuguauccucuaaggaaaacaugucaugaaacugaggcugggacacuuucacguaggcuacuauuuccagaaauaagacagacaucuccuuguuccccacuuagacaccucuugugguggaaggguagagaggguccuaggacauguggcugagaaaagcuguccuuuccucagcacugguccauagguaccccauaggccaccagcucuguugcucagagcccccuggguacucaugaauuguaauuuucuaagcucucuuggaauccauuaggcucagcucccugguuagcccccacuuucuugagcuuguccugauuugaggagagggcagucauagcuaugcagguacccaaaacugacauuaaggauguaagccaucuuuauuggaggcauagcccacuucaggucccuauccaguaguacuggagagugacaggcuucaagcuggcuccccaugguuucccauuucuauggcauucauguauuucugaacuuguauggugaauggucgagaagcagucauagaagucagacagagguggcugugaauccaccccugaauccaccuccucugggcucaaaacagccauuucccacugccugaauuccagaggugugucuucuuuagagaaguccugagcaaguaauuuagugaagcccaucacaagacuuuguuucuuaguucauaaagucauguuucucaacaagaaaucuauaagcaacaucugaguccuaaauuagacuugucagaaguuagaacccacaggcuagccaaguuaaacugucuaugcagggacuuugcuuuaaaguuugggauaauuaucuaucucauuugcuccucuaauauauucugaaaacacugagugucaccuaucugaggacucccucccuuccgauuucagugagcuacucaaccacaauuugaaaauauuaaguaauuaacaauugaugaguggaaagaaccuucauuauagcaaauggguauuaguuguuuaugguauuacuuguuuaugucuuccugugccuaauguguaauauaaacucuucauaccuacccuaauaggugcauggaucuaguaagaagcagaguguauauagguucugguacauuccauaguuccaagcaccccugggagcucuauggaggggaccagugaccugaaagcuauaggcaccuaguugcucucuauacacacagcucaccaacugguguuuggagcuuuucaaaauagacgcuacucuguccuacagugauggaaagaccccaaggcaagagaaacuaaaagacaaugcuacacagcuaacaggugguuacuuacaaauugaaaacuugagcuugcuuucucugagaacucuuucuucugcuuugcagaaaguuaaaaagaagcaagauugcaaagcaucuggaagacuaaguguuucggaaaguaugggguagaaaugaagaagagagaauaagaaggucugaauaggcauguccaauugaagguuuagaggagaggaagaaauuggccacuaugaaccccaggcaugcuugaagcaaaggucaucacaguuacaauguuguagccaggguaggggacacagcugucauuucccacaugaccagcuccuuaaaugugaucuauaggaucaaguuuugauuauauuucuuggauugacuuaacucuuggguuucuugcacacucuggaaagcaugagucagcauuuguuuaagaauuuguguaucaucuucaguuacaagguguuuuggggcugagagcugggugcuggguaauggaggcaagaugacacugaacaggcucuugucacucaucugccaccugcuauagacuggcauaggaagccaggaugggauagcacaacuuccugggcaccaccaccccaguccucauggccugcacugaccucuccuagguagagcuugcucccuaggggcauuuccacaccuuuauggcugcuaguuugccuucccacugcagcugucuguagagcaccaucacagucccauggugguuuuaaaaagccagccagccagcacuuugcugcuguguauagacaacugacuuucauggcuccugugucaaaacuuguagacuuuuccucuauuccuuuagcuuccuuucccuguuugguccaacugcccuugaggaaaguauaguagaucuguggcauuugcaggauggacugaacuaucuacaguugggcaaacauguugcuuuucaugccugaguguucaguguacgugccugcucacaugggcccuugaaucgagcuucccaggucuuugugaaaggcuucagugcacaucacacaaugcuuauugccuccgagaaagccuucuucccagcucagauccuagggugagaggcuuccccaggauuuagaaguuuaaaaacaacaaaagaaccugaccaugguggcaaaaugggaugguugaucauugggaagauguugcucaugauacagaacagucagcuugauggagaaagaaaauuaucuuaaagauggucgcauuguuuuucaaaaugaucucaguaacaguugccuuuauggugugaguggcccaggucuuuggcugcugauggcugcuguaaccacccaugugucuucccaggaugccccucuucucacagacaguuucagugugcacauccaucuuccuaugaucuuguccugcuuuucccucaguccuucauucacagcaaagguaaaaacaaccuugcauauccagcagccuuggcuaaucuauguuaaaugaauugugucagagggccuagaaugcacaccuuguuuccucuuaucaguguguucauguaaacaugagaauggcagugccucagucccuaugccucuaguaagaccugccaggaugccgggcacugacagaccuguucagagcagacagaggaauggaaugaaaccucauugugccuacagaaguacugugccacagagacacagagcagagaaagagccauucagaacaacuaaaggacaugguuagacuccaccccacacagaggguauaacaggcuccugcucuauucuccaggaggaaaaccauggcuuccauuugauagaccgugugguacugguauccuaagugacuuuuccuggcaaaauauuccuaggucagcaccuuugcucuguccagacaucuuaucagcuccuggcugccuugucaagugccccaugagacacacugagcucacacagcacaggugcccuuuuucccauuacaggaaucacagauauagacgaaagcauuuuaugccccuugaccucaacaggaagcccaaagaacugauuagacauacauaggauguuaucaggaagucgcaaucuagggaagagaacagcaaacccuuccuuuucagcagaggagaacuccauguuccagggaguagggaacagaaaucugugucagcacagaccugguucuugaaugacaucauucauauacugggcccagguuguucauuaugcaagccuagcuauguguaguuaaauuggaaugccuucaagacaggcagucaagauugucuacugacagcucucccaaguuccguugucucugaaaauggagcuaggguaaacacugggugcauuugucuuucaugcuuucacucugaacucccugauaagcuccuucagugcccaggcuggcucaguuuucccacaucaucgccauuuaauuuucccuucagaauacagcucauaguucugaguuccccaagaacuaacuaaucuaagugcuauaggaugugggccccauuuugcacaacauagucuugcacaaggcucacccaucauuguaccaucagcccugucaauagcuucugguacagagugggcacugggucgagaucugaacggagaguuaaggcagcauaucccaauuuauggcaccaugcacaucacagcccuccuuugcauccucccguccaugugcugaaagcucaugucccagagaaucauuugaaaauccugccagauauccaauucagguuacaaauacaccuuucuuuucuuuggggaaauaaaaugaccuuugggccugucuugucuuccucccuggcuuguuuguacccucaccugucacccaguugcuggaugcccuggauuccucugugccuagaaucuucccaaccaaccuggaagaaaagccccuaauuagugaaaacccugauuucuuggggauuucuucuugccaagaagucauuccccagcacugugccccaacagcacuggucagucaccuuugucaggcagagaauauucuccuuggccuggaaggaagaaaaauaaaaguuuaaauauuuuuugcagcuuuuuguguucuccagugaccccccagaauacuuuccuuuuuuguccaagcaaauaauacuaacaccuuuuaaacagcaugugucugucaggaagccccaguguaugucagccacauccacacugaucucugcuguagggccugcuccuuugcccagacucucgcuccuccucgcacaugcauguuucucagaugcuugucuguuggucacaguacuugcggcagugugccguaagccugagcugacauccuuugcucucaguauaugcuaaagcuucacugacaguaaccugccuccuuaacuugcuucugugaaagccuagcuacaucuccccaugcuguccuuuugccguuuccuuuuguauauacccaauacaugcaugagcauuacuuuccuucacacacuaagagcuguuccuauccagauggcaucaucauauuguccuugcugaugguggacaagaauuccaggucuucuacacugccugugggagcaaaggaugagcagcugcccugccucuccugucucccuuaccuuucccucaccaacugccccauucccacuuauccucaugugcugucagauauucaccuagguaagguaucccaauaccuccagaaagcaugacccaguauccuagcauuagcugagcuggagugcucacucggccuguggcuccauguccaaguaauauagucucuaucugcagugugccccagaaacccguauaccgaaagaaaagccuaaugggagugcuugcuacuguuggccagcuccuucugcucucugccuccuugcuguagaaagaauacauguaccuaccacacauggccugucauauacugccugcauccacaguaugcuucuauaggcucaaaaccuugggcugagccagguauggacugaaaccuccaaacccaagagccacagcaacccuuugcucuguguggggaauaaugucagaacaggagcaccacagaaucacacagugagugugugcugcccagcccaucaugaaaugacccugggcaccugggaguucucuaacacagaccucacucucauuuuuccaguggaagauacagguuugaaaauugugugagcaacucucagagauucacccaaccaagguauaaguccacaguccacagagcaugcucuagagacucacaaacauucugguuuucuagugugggauucuuuuuaugaacuaucucaaagcuggcugaaggguuuccuugaaagccugccuagacuucauggucauuucuugcucugacuccuauuaaauacaguucagcaagcuacauuuuuagucauuuuagcaugaaugauuuuuuuaucauuuuucauagaaaagaugucaaacuuguguagcaaauaccccuguauccagucccaagaacuuuuggugagaguuugcuguauuuauuuuagcccauaucucuccaucuucacaaucuacccuucuugccuaucugcacacacuuuuucuccuuuguugagaucucaccguguagcccaaguuagcacugaauucaacaguccuccugucucagaaugcugagauuacaggcaugugacucucacaccuggcccaggauuuuauuuguguacaauagaaguacauugcaaacauuagcaaugacuccaggggaacuuuaucugcguguuacgggaguuuacuuuuuacagcuguuuuacagguaaaauacacauagaguggcaugcacacauuuaaggagcucaaggcucauuuuaaugggacuccauccuacccaucuugagacugguuuuugaaaaagucacaagaaaaauaaagaugaaagaguauagagucccuacagguucgucaguauguggacauaugugauuuuuaagcuauucauacugacugguucugccuuggggcacaguuuguauaggcugauuguagaggaaagcgucugguaaaguaggaaggcugcuaacccguaacaguggagguaggccaguagaaucauacuaccugagaaaaauggauagggcacaccuugaaaggacauagcuuuuaaaauauacucaaugggucucugagagcuuaguccagaagguaauuucagggauuagauuuguuaucugucuuaggcaaguuuucuauuccugcacaaaacaucaugaccaagaagcaaauuggggaauaaagggguuauucagcuuaaacuucccacauugcuguucaacaccaaaggaagucaggacuggaacucaagcaggucaggaagcaggagcugaugcagaggccaugaagggauguuucuuacuggcuugcuuccucugccuugcucagcuugcuuucuuauagcccagagauggcaccacccacaaugggcccucccccuugaucacuaacugagaaaaugccuuacagcuggaucucauggaggcauuuccucaacugaagcuccuuucucugugauaacuucagccuaugucaaguugacacacaaaaaaacaaacaaacaaacaaacaaacaaacaggcaauacaccauccuaucuuaagcaccagacauuucggaaaaguaauuagcuaucaagccacagggauuacagucccugagagacaccauagcagacugugaggccuguauccagcaucuccuaauccagcagcaucugagcugugguguagaaagggcgcugacacaggcccauuguccuaguuaggguuccugcugcuaugaugaaauaccaugaaccaaaagcaauguggggaggaaagaguguauuugacuuacacugaaggaagucagggcaggaacauggaggcaggagcugaugcagaggccauggaaggguacugcuuacuggcuugcucauccuggcuugcucagcuuucuuuaguauggcuccaccuacaaugggcaggacacuaacccaucaauuacuaauuaacaaaaugcuuuucaggcuuaccuacagucuguuguuguguaggcauuuacucagucaagguuccaccucucagaugacuauagcuugugucuaguuggcauaaaacuaugcagcacauccaagaacuccuuguuuguggagcagagcuucgguuccagagcaucaaagcaucugcauacauagugaauguuaaagaagagauggugacccagagcaauccggagaccugcagaaccuaguggaguguuuagcagagcagaguuugauaacccaauacacgucaaggugcaagaaggaccaccaauggagaguggagggggagaauuuggagcucucauaggcugagaauaauuccuucaaaucuucccaagcuggacucaaaauguugugucuuuuaaacaugcucuucucuuagcagugggcaacaauuuucaugacccucugcugccccaaaauauuucaaacaaggaccaaccuacuuccaagugaccacaucacauaacaaagcuuaauaauauaugcaugaauaugaaacuguuuagcaaauuucaaggaaaaauuuggcagcauauggcauccagucacgaucaaguaacaaaaugguaggcuagucugaaacaguaauuaaugacuggacaugacugcaccugccccauaaugaucccagauauuagaaaauaguuacuguaccuacaucuaaagacuacacauagcaagcauguucaugauuauaacaggauuaaauuauaaacuaauaauaacauggccccaggaaaauccccaaauauugaaauaacauaguuuuaaauaaaaaggcuacucaaaggagaauuagaaaguagcuugaggugauugugaauuacagcaugaaaguguggagugcugcuacaguaguguuuucaagagaaauucauggugcuucguuguucuaggaccggauauucuucuguagaaaacuagaaaaaagaagagcaaaacugaaaucucaaguuagcaggaaaaaguaaaggucauagcaggaaucgauaaaaugaaagaggaaagugauucuaaaaguuaaacccacagcucguucugcaacaaaaccaguaaaugggaaagucuggcacaggauguaccaagagaaaaagugguuuguuuuguuuuguuuuguuuuguuucguuuuguuuuguuuuguauuguuuuguuuuguuuuugucaauuuuaggaaggaggcauaauaucacagauucuccagauauaguaagagauuaugauaugaaaggaauaucacaaacaacuucacacauggguguguuacuuuaaacauaccaaugucaaacuaugaagauacaaaugcaaaacucccgaagaaauacaugagcugaacaaacuccacaucugauaaagagacuggauaauaagcaaaaaaagaccucacgcacauaugugccauacacauauucacacacaugcacucacacacacacagacacauaccacacacacaccacaaauacaauacaacacacacauaaauacacauacauaccacuuccaggccuagauagcuucgcuaaugagcaggucccaguguacucuaugaauccaauuauugauuccaaucccagauaugauaagagaacaauaugagcauggugauguuugguguguccuagaacaugagaaauguguucaaggagcacaauguuaauguuuaaaaucuauucccauaugaacuacuuuuuaaaagaagaaugaauaccugcucagcaucaaaaagaccacaaaaugccuguuuucucugccuuuuucaacaccuaacagagcaaaaaaggaggagggcaagaagaugggugcacuuguuuucacauacaugcucacagaaguuuuauuuauaacugccucaaaguugugaacaacugcccaucagaaaaagaaugaauaaacaaauaugauguguucauucagucuucacugcaauaacagugacgcugaaacaugcaguaaugcagaugaguucaacauaauuaugcucuaagaaacauggccguaaaauuuagucauauuguuggauugcuacaaaauuccagaaaauauaaacuucuguguaguuguuaggugauuggugacauuugagaacugaagggaguucugggaaaucuugugagugguggugugauccugauuguugccaaggugccagagggacaugcauuacuaaaacauaacuuaaucccagcaucaggaggagcaggauccauuggacuguccauaagugagaguccagauggauaguaaguuccgcauaagacuguguuucaagugcaugcauaugcugucuaccugccugccuaccugccugccuuucugucugucugucugucugucucuuuaucucucuauuucuaucaucuaucucuaucucugaggcaggggugaugugucugugauauuuuaguuguuaauacaguaaacauuuauuuaaaaacaaaccucuuccuccuauguaccucaaccaggacagcuaccuuaagguagccuccucuggcaugcccuccugcucucaauucugccugucuucuccuggcuaucuucuuccuagagccuccccucacugcauuggucgcugccaagauguuggauucuucucccccugcaggcuuucaccacaaggaaucaggaaaaacuuuuuuuaacaguucauuaaguaccuuucaaaaaagugcuuccaugugguucucucaaaccaaaugacaguuuucccagcuucuuaguguucuagacuccacggugaagauuuucugcugguuuggauuaacaacugaagucuaacucaaggaucauggagggaggagucuggaguuuggagggaagcacuauuggaauguaugggcuguacuacucugggcuacaguaggguccuuuaugaggugcuaccaccccuuggccauuuuugaacaugacccuagagcugccucuuuagcuucuuuuuaacucauccccucucccagcuucuucuguggcucauauaugcaaggaacaccgauggcgauggcugcaucuucuccuaaaccuuccaguagguuccugcuauacuucccguccaucuccuuaacucauuuucagaggcaguagagauagacccccaguucuugauuuccuguuguugggcuaucaggagaaaacuaaaccgucaggaucuaugugaucuuuccugucacauagaggaaguacuuccuucuucuucauccacaccacaaacucuggucaugcacuuuauauguguggagugagggagucuacuaggguuccugccuccaggacucucuuccagcaagacuggugaggggaacaaaaaggagcaaugagaugcugugggagggaccugcaaauaaacauccacagauucuauguuacuuguuuucucacaagucacuggaagguuauaagcauauuuguauuuuagaaaggucuuugggagagugagaagcauggccaguggucuagaucucaauucuucaacaucuuuuacaaggaugagcaugcauaacucucuucuguauacuuuguugcccacagaggcaguaacucuacccuucuucacugcagguucccuugcucgugugaaguccuaccacugaagagaccaccuguacagcuccaaguaucaucacuuuagaaauccacaugacaggaaaugaaaccuucaagaaguggcgguacuuuccugucuccaggccaacuugcccacgguggauuuucaguguuccuacauaauggucaaagaggagauacugcuuugcugugugacuugugugccaaggacauaugaucugccucugaaugcucacaguugccaauaaacugcucuuguuggcagaguaaugggaauacacaggcuggagcccagcacucacacuugauuuuagcuaugggcacaaggaauuaugcccuaaguugauuuuuggaucuuugagacuuugaccacauacacaugguuaaaaucacuuaugauccuuugaauucuagguguacaaaaacauaaaucaacagaaauagucagaaucuauuacaugcuccaggaugcugcuucuggaguaagaagcaccauggaggaaggcugcugagaugacuuuugcaggauaagaaagcgucagauucguauuuguauuccucacacagugaagccucacaccucacagaugaucuuggacugugaucugaccaacuagcuuuuaaaauuccacuguugcugcccagaauagcagcccuacuugacccucugagcaagacauuccuggcuccuuagaagaugaugggaagcagagaugagaacacuggaaggguuguccguuuucuguauagaugugucccacuuguauaguuuccccccucccccauccccagugucccagaaggcuaugacaugcaucagguuacugugaaggagccuugcauggagccugagauuucaccaguagccuucugaaauccugcacagggccagagagcagaguguugaggaccuauauguagcagagggcaguccacauugugcugcacauucuguggcuuacauuuuauccugacacacuuuggcaugguccagcagcugcccugguauuauaugacauucuuauaguacauuguggguagacaccaucuuuaaagaauuuaaacucagcaggaaguuuugugauuuuuuuuaauguaucucuaaaaccuuuucuuauauggagaaaaucaagacagcaauauaagucaaaaugaguucaugauauaaaaucucugccuuacugaaaaaaaaaugaaauccuuuuacuauuucccccuguuuuaaaucuaggcaucggguagagugggaacuugguauugugugauuaacauugcuaaacuuucucagugaggcaagagcuaccagccaauugcucuuagucacagcugucugcucuuucucuuagugccacaaauaaaugcaaauccaaugcuguaacugucguguggacuucaugcuacaguguccauccugccuacaaaauggagggauuaaucuuuucugcca

SEQ ID NO: 5887 - RNA, 36517 nt, Mus musculus
gagucagaguauauuuucccaaagaucuuauaugugagcuaggcauggcuauaaagccagaucagauuacugaagaaauaucugcugaugucccugcguuaaagaaugcacucaggcuccugcagguccuggucuugguguguacgugggaggauagcucugcuacguccccagcaugccuugcugugaguucucggucaugguugcagugcagagaggcugauuagcaccuuuucugcuuuuuuuuuuaaaugaccaugcacaugucuuaaucaaggaaguguuggacuuuuuggaagcuuuuuucuaguaugaaugcuuuucauuuuauauuaaagccugguaauacuugaaaaaacaauaggacauuuuuuuuccauugucauuauuguagguaagauaaaauucuauuugcucaguuuguguaaugcugcuaauacaugaguucucagggcugaccauuugguguugcauaacaaucagugugcucuuugcugaagaagacuauuucuuccauucccuaguauuucuuaguugccuguacuucuuuguguaggguugaggccuuuuuggcugucacucauccauguuaacauuucuguuguugucccuguucaccucauuuuuagaucauguuagugagacuuuaugguuauagcuucugauauuuccaggaugcuuacauggguacauuugugucacacauaccucgguggugaccaauugcucucuaauuagacuucagaucugcaagagggaaauccaauaugguauuagaaaccuggccaacuacauagggcuagugaggucaggaauuuuggagaagaaccuacagcuacaacuuuauuaaacccacauaggcucucacuguguucuaaauacuuguuccugaacccacagagaagggaauuccucaccucucaucaaagaagcuuaucuuugcaacagacagaaaccauuacagaaaagcacacagaaccaaagugcagagcuggagaacccagcuccaauggaaaacaauuuacaaaacagguccuacaccuaagacuuagggaacauugugaaagaggaggcaggaagacucacaaggcagaagaucagggcauuaaaucucuuucuuaaaccucagaauauguuugccaguuucucugcuucccuagcuagguuauuguccugugaaaacucuuaaaaaggcagacuaggugugguaggugaaacuuauuuuaucuuucugcagugacuggaagcggauguccacauguaucucaggcucagucacuuaguguacaguguguuagagacuggagcuaacagacaaaauuuauauagaccuugguuuucugugauuucauggaaaauuggcauaaaucagugaaauuaagguuagaaaguuuuggguaaguucagaaaacgaggggaguccagaucucaugguaguuugugccuaaaugaccugagaauuuuaguuagcucagagauucuuauucuauuuugcucugaggauauuuauuggucaugucaguaaggggagaauagcuaacgcuauuugggaugagaggcuggugacucucaucucuaaucaagggcucucuaucacuucaaaauucaguaucuaaaaguuuucaccuaaguucaugucugaaaaggugacaucccaucucuaagacccaauauuuugugugggaagaaagagagcacacuucuuccaaagccaguaacucuuugaguucuagagcucagugucacgccuugacuuugauuagccguuguugguuuucgucuucauaaagaacugacuagacucuuugugaaaugacacuuaggguuuggucccuuguucccaccuccaguccaauucugcuuccuccuggagaauugcuuaucuuuacacacuccagcagggaguugugaacaugcugaggacuccccuagggaguugauacgauguugaggacagucaagauaccuaagggugauugugguaaccucugacaaugcugucuguuggaggucuuacuagaauacuaaaugcuagguauccuagucugggaugagaacaagagacagacaacugucuaccugacaccuggaauugagucagaaucuggguaggaucugguuccaggagcuauacugaaccuaccugccauguuaacacaauucaaguuuuaaaaauuaacuuauaaaaucuucaaagauauuauuuuuaaauuaguuuuuuuaauuuauuuuuuauuuuuuucaagacaggguuucucuguauagcucuggcuguccuagaacuaacuuuguagaccaggcuggucucaaacucagaaauccaccugccucugccucccgagugcugggauuaaaggcgugcgccaccaugcccggcuuuaauuaaaaauuuuuauucagcaaaauaaaugagauucaugcaauaaaaaaaguuacaacacaaaacaccuuuaaaaagacccuccaaaaaauuacuacaugaggaaaauaacauaaaggaaggcuuaaaaagauauaaaauacuuauuuuauugaaaauuauaaaaaagguguccaauaaucauauaauaacaaagaacauuaaaauuuaaauccaagugaaauauucagugcuuugggccugaagagauggcucagagguuaagagcacuugcugcucucacagagggcuuggaaugguuuccuagcucguauaugacagcucauaacucucugaaaguucaguuucagggaaucuaguguccucuucugaccuccuuggccaucacacacacacauaugguacacauuuauacaugaucaaaccagagagaaugccagaacugagaagaggaaguggguacaaagccccaccucuaaccaagaugcaauuugcaauugauauguguuuuauaaaauguuuuaaaugaaauggcuacauagaaccucauacaaggcauuuaaaagaccaagguaauuucacaggcuuguuuugugauuagacaggcaagcauaguuaguggugaacacuaaggacagagggagugaaggcacaugauuagauaggauaaauggaagagaagcaauuuuggaugcagaauugugaaaugcauuguucugagaaugguauuagugauacugggaugccaagcaguacaggagcucuccauugagugaagccaaccuuccuaaugagagagagcaugcgagcuugugccuauacuguguguuaaauauguacaaaguugugugugugugagagagagagagaguguaugucugugugugcauguguaaucagcugacuuuauauauaaguaaauuaagcagcuuggaugauucuggcuacaugcuacuggcaaggaaaauugaaguuggugcuccucuuaaauuuggagauaguugagucaaguugguaccaguaaaacaucuccauaacucuaguuauugagugagcaaaguucuuucucuaguuugcuucuuauacuucauuuaccagaacucuuagguccuguguucuugagguuuuccaaggacaagauggagacaacuuguagaggaaagaguuguuagggguugcuuauaguuucacaugguuauuuaaugacuaucauggcagcaggcaaguacacaaggugguggggaguagcugagaucuuacauguuaggacaauaaccacagacagagaaaccacuaacugaaaugguauggguuuuugaaaccucaaagcccaccuaaugauacaacuuccuccaaggcuaugccugcuccaacccuccuaagccuucucaaacaguuccaacaccuaggaaccaaguauucaaauauauggggaacauuuucaaaccaccaaaguuuuuguaauuaaggucaaugauaccaaagucuaaauuucuuucucaggaaauugaauaguaaaauuuaugauugaccaagguaaccugguaguugcuuucuccuauaaguuuuuuuuauauguuucuuuucuuuaauuaaagcaguuauuuuguaacaucuugcuauauaucucaggcuagucucaagcucacaauccucagcauuuggaguuauaggugugugcccccauauccagccacauaguuauuuuacacauggagaaugaguggaaaccuuagccacaagguuaaauaugaaagcagaguuuaccagaggcucaagcaccaucucuucauuccaagagauguaagcucgugagccuuucaggcuguaggaacuaugaguccugaggacaaggcagugauuaaaucaagaggcagucacugucuucacagagcccacacauaaauggggagagaaagauagacaagucauuacauaaucauaaucacuuaagcacuuugaaugcucccuaugugccaagaacucuuuccugcuugauuacauguaguaacucaugucguucacaaggauaguucuguuauguaggagcuauucauuucaguuuugaaagagagaaacuguuacagagacaaauuaaaacuugcccaugguuauguggcuggugguggcaaagcuagaaaucaaaacucagacaguaucucccuaguuugaggcuuugucuuucucugcauugauuuuauguggagcauauccaggaugacuugagcuauagauaaagaucaaugugagugaugguacagcuugaggcaugagugcuuuuguuucuaauccaaaauuagaguucuaguucucuaagugucuuuucugcauauaaauuucuuuacuucuuuuucuauuaagaaagacauguauccauuacucuguugaggggcaucuggguucuuuccagcuucuggcuauuauaaauaaggcugcuaugaacauaguagagcaugugcccuucuuaccuguuggaacaucuucuggauauaugcccaggagagguauugcuggauccuccgguaguacuauguccaauuuucugaggaaccgccagaaugauuuccagagugguuguaggcaaauggauggaccuggaggacaucauccugagugagguaacccagucacaaaggaacucacacauuauguacucaaugauaaguggauauuagcccagaaacuuaggauacccaagauauaagauacaauuugcuaaacgcaugaaacucaagaagaacgaagaccaaaguguggacacuuugccccuucuuagaauugggaacaaaacacccauggaaggagcuacagagacaauguuuggagcugugacaaaaggauggaccaucuagagacugucauauacggggauccaucccauaaucagcuuccaaacacugacaccauugcauacacuagcaagauuuugcugaaaggacccagauauagcugucucuugugagacuaugccggggccuagcaaacacagaaguggaugcucacagucagcuauuggauggaucacagggcccccaaugggggagcuagagaaaguacccaaggagcuaaaggggucugcaacccuauugguggaacaacauuaugaacuaacuaguaccccggagcucuugacucuagcugcauauguaucaaaagauggccuagucggccaucacuggaaagagaggcccauuggacuuacaaacuuuauaugccccaguacaggggaacgccagggccaaaaagugggaguggguggguaggggagugugggggaggguaugggggacuuuugggauagcauuggaaauguaaaugaggaaaauaccuaauaaaaauauuuuuaaaaaaugaaagacaugggcaacagaugauuaaaagaaaaugggggugucauuaaggugauuucuuaagaaugggaauuguuucuagaaaccaacaauuucauguguuugguggcagguauauauuuguucacaaggaacuguugucaaguccuacacuguuggccugagauccuucaaagcuuucuguauaccauuacauuuuuguaugauuuccgaagguuagaagaagcuguuugggcagaaggguauucuguguaacaacacaccauaacacaucacaauuucuacagggagauguuuuauuuuuuauuuauuauuauuauuauuuacagagggagauuacaggugaaaaagggucgauaaggaaggacugggaaaugaauagaauuguggucucugaugugaaacucacagagaaucaauaaaaauuauggaaaagaaaaaagggagaaccuggcaauaggagaaacacucagugguaaacgaauccucuucuuggccauugcaguacacugcaaugucaagagccugucuuugcaaucucuaagaacuuaaucccaaggcacguugaaacuuuaagauggcugaugugacauguuaaaguuuuaagguagcagauuuacaucuauaguuuagguagaaauaccaaaugauucuagucacuaaguguucuuaaagguuuagauuguuucaugauugagcuucacccaugaaauuauaacaguaugguugccuaaacaagaccugaaaaugccaguaccaacagaacgacagcaccaaugugacuggaggaacucucacaaggccccaccccuacugagaagguauaggggauuauugacuucagagaaaaagagacuagauccgcuccugacguaucacagagaucacuuaugagcuucugauagugguccagucucaagcagcucuaagcauauacaucugagcaacaguaaaugaacucaagaaguuguauuuauacgugugugugcgugugagugcaugugugugugugugugugccugugcaugugugugugugugugugugccugugcauguguguguguguguguguguguguguguguguguguguaacaauaauaauuaaaguaaaagaggucaugaacuugagaagaguagggaaacacagaaggaauuacagggaggaaagacacagcacaaaugauguaaauacaguccucacacuugaauuucucaaaaaaaaaaaaaagcauaaaauguuuccuaggggaauaguaauaagaaucuugcuccaguacuuuaucucugccaguagaaacauaugccacuagaagacugagugggugguuucaagaagaaagaucuuacugaugaguuguuaucugucucuuccuuuacagggcugcguaacaacacccaacucaccauccuugcauucucggucccuaacacugggucccucccucucccugggcaacaucucuggagugucuaugaagucagacaugaagaagcgcagagccccuccuccuccaagucccaagcugcugggucaagacaagguaucagaaaagguagggcuuucacacuucucacaaccaaaucgucuuuacacugacccaguuaacucuacugcggguccuuggaaaugcugaauucuuuacucuugaguaaagaauuuaacacaauguguucagagugaacaucugagcuuuauuuagaaguaaaagugagacaccacucugcuccaguuacuaagcuaggaaacuauuuuggggucuuugguucuuaaggacucaaugcuuguagauuaacauuuguuuuauuuuagcacugaaauuuugggggugucagagagaucacuuaugagaaauuacauaaacaaagguacuuggaggaagcuaaggcuugugaaggaagcaaaguaucucaucuaaaugcugcacacuacucagauucacagaaaauggacacgugugcauauuaaguuguuuuaaauaugauaugggguucaugucauaggaccuguauuuaagaagcuuuccuuuugucuuuggagcaguacaaagccuucuaaggcauuauaucacuagacauggccccauagaucacauccugagcagugagccaccuaaccuaugguuucuaccucuccucuuuccuucagcuaccugcugacacccagaagcauuaacuugaaaugucuaguccucucuucucaggacuagggaaccauaugacacuauaaacuuuucguauccugacauuucugguauagcuaacugcacuccgaaaauauuaaacagaaaguuccaggaaaaaaaaauauacauuuaaucuccacacuccucuaaauagcaugaugaaauccauagucauacucuguccuucuagaacaugagccaucccuuugccgaguauaucuaucuuguauuacuaucuguuuagugguugauaagugacugucugaauuaugacugguucucaugauguuguaguacugugaucacuuauuugucuuaauuguagccuaaaagcuaaaaauagucacucaagcaguugauaauuugccaaagagaaccuuucauuaaguggaaaggugaaauguuauugaaaguauagaugucuauggaaacacagaguaucggagagaggggggcagggggauuugagcaccuaaaaaauguguuuguagagaugguagcuaucugucuaaucaccucucuuuuccaagcucugaacaaaauacugagaugaaaucaugaaguuuuauuuuucuaagcacauccucaacuggaugacguguugagaguaccucugggggcucaugcuuuugacuguuccaagcucugcaucaucacccauaugcuugagagugagggcugccuuucucuucuuugcuuuaucugacccugcaucccagauuccagggcagaaggcauacccugaacacuggcaucacaugaagcaugcugaguauccuuuuauucuuugauggauuucacauucucuuucuugccuggugccuuggcaacucuggcucugucugugugucauaacucugaagaacgaacauggacacucuuuaggugugaaucauuuuuccauuagucaaaagauggcuuuuccuggcaacauuguuaaauauacuagaaacuauguccauuccaccaaacuuugaggcuuugccaugggucuuuguuacagcugcagguuacugugaguggguccuaaugucuuccuugacaucugauuuagucauuuuuucacugcugucacaaaauacuugcaaaugucaaucuauuugcaagggauuauuuugguuacacuuugaggauacaguccaauauggcagggaaaccauagcaucaggggcaggaacaucugucacaugucauccagagaacagggagcgggaagccacugcucaguucuccuuuuaccuuuuauucauaccucaguucaugaaugguaccauccacacuuagcacaugucuucucucaguuaaaccuugcuagaaacaacaucguagacauaagcagaagugcguuacuagggucuuucuaaagcaggucaaauuugccaugcaaauuaaccaucgcaauaucuuuacuuaucugucugucugucugucugccugccugccugccugucucucuggcagccuaccagucugucuaccuguccuguagaugucuuuauuuuuccagaggacuucuuaaccuuguauaucagaaaccauaucuaacccccauaggcucuuuauucaugucaguagaaauuuauaucaaaauccuauaauacaacacauuuuagaagauguucugguuuuuuguuuuuuuguuuuuuuuuuuuuuuuuuuuuuggcucagacacucauuucuuuugagauuucugugauaauacagcaauauucugauaaagagaaauuuagucccagaggcacaucaguuugucccacgcuugguagaacaauggagacgcuaugugaagcuguuuccuguggccacaguucaucucuuuaaucaguuuacauuguguacuuuuucauaacacccagauguauugauaacauuagccauuuccagccacccccaagaugccucuuuccuuuugguugggauagauauuuuuuagugaugaaaaauauguguucuggcagcaggguuauguaaaagcuuuucuucaauaagaaaucuuaaugugguggagcauagaugguacaucagcauuucaaaauugucuucuauaccaagauguuaugcuuuguuuuucugaauuuaauuuaguuacucauacuggauagucugcuggagcagaaaaacauauaguaacuggagaauugggaacucuaaauggaaaauaaacaguacauucuccccugcagaaugagcagagccccucugcagcuauaaaagcuuccacugaaaucuguuuuauuuggcacagaaugaguugagaaauugguugcuggaaaccaugucccuuuuaaaguaugugaguaaaguacagauugcauuuaagccuugccuaugaacauccuucuuucuaaaaugaaauauauuuuguuauuuaccaauuucugggaaaggaaccccaaaaaauguguuguccugguuguugggaaggacaucaguuccuuuuuaugaauuuccuuccaucuaaagauaaguuguuuguuugaaaaccuaauuuauauguagcugcuacuaaaaccaaaaucccgaguaagaagaaaauguuuaguuucgggacaugguuaguuuaugagaauacuuagguuuucauguuuacaugauccuuuuucuuaucaacuagguggcaaaauucaaaauuaacugucagugccuuaaagauagaauaauuuucccauguuccauuuaugugaaauguaaaaauguauauuagguauauauuuuaccuaauuaaauacucaugauuugaucaucaguauuuauuuuuaaagguaauuuuuaagaagauuuccuagaaauguuggaacugggaaauaagcaaugccacuuuuauaaaaaucucucugcagagcauuuagggggauuacugggcagaaggguauggucucuuuaggcagaggauagugccuuucuucagaguccauugcucuggccaugcaucuugaccuuaggcuauuauggugaacuuucagguagaggugggcagagaauggaagggugucacgguagggcucuaugaucuagccaccuuuuaugccuaccaaacuauaugucauuuuguucaugguauaaagaaaauguuuuaaauguauucugaauuauuugaaauguuucauucuaauggucggcaccacagacuuccaacugacaaggauucuuaacaguaucuugggcuuuuugccuuaggguuucaaaauaauuagcaauguugacuaugaaaacaaaaugguaaagacuuguuacgaucagguauuagcaucauccaaaguaggguuuucugugaauguguuccuuauuuggucaaaaauacugguagaacacucuccucaauagcagaaaugccauucauuuuucucaugcuuugguuaaguaugcacauggauacauaaaaucucguagcauaugaacagacagaaugaucauagauguuagaaccuuaacugaaaacaccacugcuucuuugauuuagugguuagaauauuccugaaaauccuaaaacugcugaggguacuuccaaagcaauacuuuauugaaacuugaaaugccuaauuuaccauuagacuucaagggugauccuuuuuguuguuuguuuccuuguuugagacagggucucauagccuagguuggccuccagcucacucaauauguuuggccagucacggauagccuugaacucuugauccugcugucucuaccuccugaguucugauugcuggcauaucucccaccacacucagcuccagggcuuuaugcauacuaagcaagaauucuauauccucagcccuuuaaagacuacugcuuuuuuuuuuuaaggaagcagaauuuuacuauacguagaugacuauuuaagggagaguuguacuauaauaauguauuccuucuaauauucaaagaaagaauaaaaggaggauagaaucauuagccuuuuugaguuagaacucagaaaagugggcagaguuaacagaaaaguuaacuaccaccaccauggcuacuucugauagcauggcauacugcuuucucugucauugacacugcccuacagaaaggucaccugggcugagaugggcucugcaagucaugguacuguggaggcccuguaaauuuggccaacaaugcaagaguaccacagguacugugaggugguuauugcugacuacuucguugaaucuagaauaaccagagaggugaacuuugguuccaccuguggaggcauaucuaaauugaauuaauugaagugugaagacccuuccacuccaguggacaccauuuccuagcugccauccugucuauauaauggaggcuagggcaacagacacuguguucaucccuguacuggcuaguuuugugucaacuugacacagcuggaguuaucacagagaaaggggcuucaguugaggaaaugccuccaugagauccaacuguaaggcauuuucucaaugaucaaggguuucaggccccuugugggugggaccaucucugggcugguagucuugguucuauaagagagcagacugagcaagccgggggaagcaagccaguaaggaacaucccuccauggccucugcaucaacuccugcuuccugaccugcuuaaguuccaguccugacuuccuuuggugaugaacagcagugugcaagaguaagcugaauaaacccuuuccuccccagcuuucuucuuggucaugauguuugugcaggaauagaaacccugacuaagacaaucccucucugcuccugauugugggaugugaacagcugugugaagcucccacugccuuggcauuucugaaaugcauuaugucuacccuugcgcagaacaaccuuucuccugugcugcugcucucaggugucuugucacagcaacaggagcagaagucaagguaaccaccuucucuugccagccucuguucccuuccuugauuucuuuuagcccugaacguguagucuuacaaaacaaagucuguauccuucuucacuaguaucuccgguauauagcuuuuagcauaccacauaagaaguuugaagaaacacagaccccaaaaucccaagucgauuguuguagaaagcagagauagacgaauguuuaguacuuucuccuggcuguugggcaguaaaguucccuucauucaacuggccccaggucucacaaacauauuaauagugauuuaauaacaagcuuuugugguguuccaaagacccuuauggccacuauccuauguagccuagugguuguucuaucuguaaacaauguacaguuauugucuucauuuuaccaaugagggcaauaugcuuagaaagaacaaaugaggucauaggguaguuggcaugccagucagugauaccuuguagacuaucuggugucuuucuuacauauagccauuggagguaacgcuaguugggucacagagauguguaacuguccuuugaguggaaaacaugcuggagugcuucugaucuaucugcacccuuugccaguucuuacauugcuaagggggaaggacaauguacauuguacugaugcgauaaauagacuucacaugaccuuggcuggcaggagaugcagaggguucagggauguuugaaauggagcuuacucaccacugacaaggaaggccuguuugcuaugugagggucaaacucaagagaugaggaaguucauaagugcugaagggagaucgcucuccacauuucacaucacucaugagcccuuaagaaacagcuucuuccugcugucagugcaaucagcuuccucagcagcucacucugugugucugagagauacaauuacuaccccaacacuuggcagaaauaggauaaaaaucauuuuaccuccauaugcauccuuugucaaaaaccuaacaucaaugggcaugaugcuggacuuuugagagaguuauguuaaauaaauuauugcaacuaucuuuggcuuacuaguuucaaagauauauaagcuuaagaauucugaagcucauauuaaacucauauuauuuuuaaaauuauuuuuauuggaauauuuaaauguauacauauaaugaaaacuaacaaaagaucaaaggcauuaaagaaaugaaacuaaguguuuggauguguacaaaaacaccuuucgaagcauauuuagaagcauaacauucuaaaccuauuacuguauguauagccaaaaacaugagaaauauaucuaacaauguagcuuaaaaguucugugguucugagcugcugauuuuauuuacuuauugacuccacacaguuuccaacucuguuuauguacucauacagaaugcuaugaaacgucacaaaccuugacaggaauggagaauaaaaauaaguaauucuuugggccuagccauacuaucacugaguucauauucuacaaagaagugucacuaaguuguaaauguuccacauauuaagugugccugacuuuuaguaaaugagccaaacuagcacaaaaguaauuaucuagacuugugacagauuuuuguacagacagccuugugauggcuccauuuacaucuauaauaugaaaauauaacacaacauuuauggcaaccuggaacagcuuuguaaaaaguguugggucaguggaagugcagagaugucucuaguguuugggaggcucccaucgauguucucuggcgauggagaaagugcgggcagacagcauuguguucagcugcaugguggaagacgggcgcuuuuccaacacaaacaucccuaagaaccugggcggcucccuuccacugcagagccugggaaaacaggccacagaggaaguuccuugguggaaacagcagagcggccauacugagggugcgcgguggaaggaaacggcagcuuauuuuagcuacuggacaucuaccuuuuguuuauggacccuuuccucucugacacgugcuguuaaagaaacaaauguggcuuugaaagagauuagauucuuaccuauuuuuagccauucuuaaagcauggcauuuuagcgaggcucucagcuaaaucaaagcaaaaugugcaauguccauuucccagcgggaaacagcuucauggucagcggaaaagggaagcggugcuucguguuccggcacacuguuccaggguuccuguucaccucauucuuucucacuuugucguugguuuugcucauccagcacuccaacaaagaaauaugugaaauuggcgcuucguuauuacucuuaccuucacaucuugccucuuuagugauucuucuuuuuuuuuuuuuaaauuauguguacauguguggaggaugagguuguauauaugaguucagauuccuauaggguccaaaagaugccaucagguccccugaaacuggaaguacagguagaugcuccaugggcuuuuggaauugaacuccaguccucugcaagaauuagacuuguuuguaaucacugagcaucucuccauuucccuugcuucuuuacaucuacauauuauccugauuuuuuucagcuaucuugauaaucauuauuaggaaaagugaguguaagaacacaaaucuggauuuaaaacuugcaguaugaaacacccuacuuccuuucuuggaggcaugaucuguuucagaagcugauccuaagcacugaguuacccgguuuuuacuuuuuaaucuuaaacuuacguucuggaggggaggcccuugguccucugaaggcuugaugccccgguguagaggaauaaugcuagggcagugaggcaagagugaguagaugggugggggcgcacccucacagaagcaggcuaaagggcgaugggauaggggguuugcugagaggaaccgggaaaggggauaacauuugaaauguaaaaaauaaaauaaaacauacucaucaacuauaugcaguauauauagugaauuguaguuuaaauauaggucuauucacaaaauucacaugcaugcugacaauccauauuuugauuuuaaugaagccuuuauaaaauauuugcauguguaaauucaguuaauggugaaaaagcuaauaucuuuauuuauaaaggaggaggcugugaaaauaaaaucuucuguucugaacucaguagucucugcucaggguuugaaguaguuaaaugaccuucauguuuucagacuuuugauuuaugcaccaaccaagcucauguaauuuuaaugucuguggcauguuuccuuuuuauaccuaacaaacugaagagggagccuagaaaacucaaaaagauauuugagaagaauauaccugacaaggaauuagcauuuagaauauuuagauaauuuacaauucagcaacaacagaguaacaauaaaacaauugcaauggaacugauagacuuguuucaaagaaaauauacagaggaacagcaaguucauggacagcuguucuguagcacuaacauuaggaacaggagaaucaguaaagccucagcaugaacucacacuuacugggaggacaaugauaaaaaaacagaaaggagagaacaaaaugccaaacauguagauaaauuggaacucuugugugcauuuagugaaaaugugaaauacccuagugacuuuggcagugcuucucaaccugugggaagugacaaccuuuucacaggagucauauauuagguaucaugcauaucagauauuuacaauucaugacaguagcaaaauuacagcugugaaguagcaaaaaaaccuaauuuuauggcugaggucacauaacugaaagggcagcagaauuaggaagguugagaaccacuguucuguggugaagugugucaauuacucaaaacaucaaaaacugugucuuaaaauuaucuuucuaguauuuaaccaagaaaaguacaaagcaaggauccaagaaaauauuuccauacucacuauacucacuguagacaacagauucagugacccauugguagaugaaugagcaaagacacuguaccuguauuguggauuuuuuuaguuuauaaugggaauaauucugauaccugacuggacauggaugaacauugaggacauuaugcuaauuuaaauagccaguaacuaagagacagauacuauguuauaucauuuauagaagaugcccagaaaguaaguggugacuguuguauauugggagagagaagggugggugagucuugcaaggugaaaagaguucugaguaguaacugcucugcuguucauguugaaaccauuaggauagugacuaugugauuuuauuucaguuaaagucaaugauuucaccacuuucuggauaagauauaaucuaaagaauaauucuuuuacuuaaacauaggaaauacacauuccagugaauaaacuuagguucauuuuugucuaccuuuccuuuucuuucuauauguuguuccauuugucagcaugccuuugauacauucuuggagaaauguaggcuuuaaaaggcuguuauuuuccuccuaguuuuuguacuuccagauuuagugcauucucucucucucucucucucucugucucucucucucucugucucucugucucucucucucucucugucucucucucucucucucucucucucucucuguguguguguauguguguguguguguguguguguguguguguguguugcauuguuuugccaaaaccuagugcaacaggaaacaugaaagcauguugugugucuuugcugagguggcugcaaugaauuagcaguagcagcagagacuguaaagauaucuugguacauaaaagucuaugcucugcagaugucaggaucugaacuuaaauuuccaguacccacauagaagcugagcacauggcauugauaucuguaaucacagcacuccuuuggaggacacagggguagagacaggagaauuuccaaaagcuagaggacaagcuaaccuggcuuguauaauagaaaaaccacagagagaccuugucuuaaacaagguggagugcuagcauuaacauguaagguuaucuuccaacaucuccacauauauugugauauuugcaaacccauauucauauacauaaauucacauacacacauuauauguacauguaucacauacauaugugcauguacuuacacauauacacacacagugacauguugaaaucaagucauaguucagaaguacucuucuuucucaucuauuuuuauaauauugggcagguuauucaaaaggacuuaauaaucgacacucuugacuuuuauuuccaugaaguaaaauagccugugcgcaugaagaagagcuuuugaagagcuaauguguuuauuaagacauguaagagugcuuaaguauuagaaaguauuuucacauauguaaaucaugacauaaagacuuuaugccaaggucuuacccuggagaccuccuaaacaauccuagacuuguggacccacuacagaccuacuacaguuugcuugaucugaauggaauguagaaauuaaagaaguaugguauuauccguaguauacuugcuaaaccaaguuaacaaaagggaauaaaaauguuaaauacaagagccacauuaaggcaaaugagggaggagcaagugaaggaggauaacugauaacucaguacuuguuccacccacacucaaaauuacacuguuagcagaugaaagcugucguuaaaagggagugauugucagaucagguuagaauacaucaugagggccaugguuugaauaagaagaugcaauuaaucaaaaaggaaacagagaaaucacauaaacaccaaaugauagacagcugucaaaguuuguggcuagcagagaaauaggcuuuaagagagaauggccaagggugagaguggacaaggcuuggguauacccacaguggccauggcugccucuggaaauuccacgcuucacagcucaagaacucacugaguuggucagaaugcaagcaggaaaacagcucucccagaaguuucuccuggguuuaaggcugacagauaaaauuguaaggaaagcuggcagccugccaaaugcuuauguuuaugaaguuggcugugggccacagcgaaucacauggucuauucucugccagcuuuagugaacuucugaugguugaaaggauucuguacucauuccuggauuauacaugcuuucuuaagcagaccccagaaaacuaagaagugucccuagaaauauguugacauuaagauagggaagcuuuuccagagaaucuuaaaauuaucucuuucccauguuccaaauaucauuagaaacaaaguagggaucagaggucagacuugggaggaucaggauuccauauaucuuaugggcauaagguaaaucucauucuauauuauauaaucagaaaggaaaaugguuuucaauuauugugauaaaacacucuaugcaagacgaccuaugaaggaaagcauuuaauuugagucaugugauuuuaggcguuagacucagagagaggaacagaggcauggaggcaggaacagcugagagcuuacagugauccacaaguagaaagcagagaaagagagagcccgggaaugaaguaucuuuugaaaguucaguauccaucccuggugacacacguccaacaagaucacacaucccaaucauuuccuaacaggucugccaaucugggacaaguauucaaauguaugagccuauggaggacauucucguccaagcaccacagugggccuuuguaaagagccauagcugcagugcaauuaugaggacaugaauuuuuucauguccagaagacacuauuucucugcaguccugccuaacaucuggcucuuucaguguuuuccaccucuucugcucuugacuagauguauguaguuuguuccugcagauaccugccacuguggcuuccccgccaugauggacuguacccugguaguaggacaguauugaacccugucucccuucaguugcuuuugccagagcaauuaucauagcagcuggaaacuuagaaauuaauuugaaugauuguuucccucagcaucuaucuuucuuuuuaauuggacauuuuuuuuauuuacauuucaaauguuauccccuuucccgguuuccucacucccagaaauccccuaucccauucuaccucccccugcuucuaugagggugcucccccauccacccaccuauuccugccuuuccacccuggcauuccccuacacugggacaucuaucgagccuucauaggaccaagggccuccccucccauugauguaugacaaggccauccucugcuacauauacagcuggagccauguguacuucuuuguugauggcuuagucccugagaguucugaggggucugguugguugauacuguucuuccuaugggguugcaaaccccuucaguucuuucucuaccuccucuguuggggaccuugcacucaguccaauaguugucuacgagcuucugccucuguauucuuaaggcucuacagggccucucaggacacagccauuucaggcuccuuucagccugcacuucuuggcauccauaauagcaucuaaauagcaucuaucuuagaugucuuuaggucguagugauucuuccuuguuguaaccuuauacuuacuauuugcccauguaaauguuaggugaguuacagaaggaaaggaaagaagguuaaaaaaaagaaggaaggaaggaaggagggaaggaauugguagugaaggaaagaagggaacagagaaaggaaggaggcagggaaggaagaggaaggaaauagaaaaaaauggaaggaagagaaagagacaaaggggggaaggagagagagacagagagacagagagacagagagagagagagagagggagagagagagagagagagagagagagagagagagagagagagagaagggaaagggaaaggggaaggggaagggaagggaagggaagggaagggaagggaagggaagggaagggaagggaagggaagggaagggaagggaaaggaagggaagagauuaaaaauacaaacccaaguacuggcuuauugauagaaaauaggcaagucagacuuauauuccaugcuugggcuuuuuuuucucaagucauuuaaaaaauaaauucucuuuuucuugucuuuuguuuguuuguuuguuuguuuguuuguuugagucaggguuucucuguguagcccuggcuguccuggaacucacucuguagaccaggcuggccucaaacucagaaacccgccugccucugucucccaaguuuggggaucaaaggcgugcaccaccacuggccagcaaaagaaaauucuaaauggacaaucuuaguguuagauuuuagguagcagagaggaggcaauaaagggggcaaagaaugggggacugaggcagauccuuaacaguuaugaaugcuauagguacagguugauguagaguuucaucucaucuaucucuauaacuuucagacaaagccgugucuucuaaguuguuuguaggaugaagagaucuuacauuucucagaaaugaaacuaugaguuaguguguaaccuauguuaugaacagaggacauagaacauguaagacuuauacuauaugaugggcuucacucuuuuuauagguaggggaaugaagcauggugaaugugugacccauauuauguaacuguauuccuguugucucugacauucauccacuaaguguguuuuuaccuugcuuauaucccuuuucaagauccaauugcccuuuucaggggucaggguuugcuaucauuuuaauuuauucucauaacauucuuuaaaguaugccccauguuuuucuuucuugaauuaccaaagacugugaugauagauucaguuucgaugucagcaugccuacacccaccuaugaagauauuuaaaaagaaaaaaacaaacaaacaaacaaacuuaguuucuuagaauccuugagauuuccagugugguuguacagguuuguacucccaccagcaagacaggaguguuuuugcuccacauccucaccagcauguguugucacuugaguauuugaucuuaacuauuguaguugguguaagguggaaucucagaguuguuuugauacauuucccugaugacuaaggaugcugaacauuucuuuaaaugcuucuuacccauucaagauuccucuguugagaauucuguuugucucuguacccuauuuuuuuccuuuuuuuuaaaauuagauauuuuccucguuuacauuuccaaugcuaucccaaaagucccccauacccacccccccaacccccuacccacccacucccacuuuuuggccccggcguuccccuguacuggggcauauaaaguuugcaaguccaaagggccucucuuuccagugauggcugacuaggccaucuuuugauacauaugcagcuagagacaagagccccgggguguacccuauuuuguuuguuguugucugacuucuugaguucuauauauauuuuggauauuggccuucugucagauguaggguuagugaauaucuuuucccaaucucuaggcuucuguuuagcccuauugacaguggccuuugccuuacagaagcuuuucaguuuguugaggucccauuugucauuuaucacuuguugaucuuagagauuaguguuauguucaggaaguugucuccugaaccaauagguucaaggcuauuccccacuuucuguucuauuauguuuaguguaucugguuuuacuuugauucauuuggacuugaguuuugugcagggugcuguauauggaucuauuugcauuugucugcaugcaggcaugcagucagaugagcaccaguuguugaagguacuuucuuuuuuccauuguaugguuuuuggcuuuuuuugucaaaaauccugugucuguagguguguggguuuauucuagggucuuugauucgauuccauugaucaaccuguuuaccaaugccccacaguuuggauuacuacuacucuauaguacaguuuuaaugucagggauggugauacuuccagaaguucuuuuauuggacaggauuauuuuagcaaccugggauuuuugcuuuuccauaugaaguugaaaauuguucuuuuaaggucucuaaggaauuguguuggaauuuuggugggaauugcauugacuauagauugcuuuuggcacauauguaguagaugugcagcuuggucuuucugugagcccccuaacaacuggagugacagcagucccgagucuguugccuaccaaccaagggagcacuccauugacaguguucacuuagacucuuuccagcuucucagaggaaccuacaaauaaagcacagucccaaaauuuucuacagagccuagaucucauaugaagaaacuguuuaccuccauugaauaguagcagguuauauaacuuuuuuauuuuaauuuccacagacuuugggaauagguagauaaugugugcuuuguucaguacuucuuacuucaggauaucguuuuaucaguuaaauuagaaaucaucccucauccauuuccuagaugggaacuucuggaauuuuauuugcaucugacaugcuuguucacacagauguuguuuguaguuacuucacgacagacuguccuuaggacaugcaacacacauacaugcaugcacacauauacauauguacauacacauacacacacacacacacacacacacacacacacacacacacacacacacacacauaccucaccuaccuaccucauaaaaaaaggaacccagugcagaccaauguaaugauugcaacaugguauaccaauggauuuucuuuguguuacuaacaggaguaugggugagggauuauuucaaggaauagggaugacucaaaagcaggugcaucauuagaguguccauuaaaauacauuugacagcuugugaaaguuacaguccuagaacuagcucucaguacugcuuguaggcagcucugcaaaucucuucucucugcaguucugcugcugagucuccucccugaguaguuguuuaaucuuuuauauucugcuggaaaguccccucuagaauccuucaaauuucuguucuuccagacacagaccuuuuguuuaccugcugagucucaugagccuccccuucucuuccggagggaauauuuuaauuugaaggaaauugcaauguauaacaacaaugucaagaauaaacuguaggcuuauucucugauaggaagaauaaacucucucaaguucauacuccacaaggaugaguacauugcagaauccucuacagugcaucacugacaacgagggcgcauacucuauuuuugcugugauucaccuggccaaacgagaugcuccugcauuaaagaucaggauguucauccugcuccaccacccccauggggggacaaaaaaacagaacacaagagcccugugguuugguuccuaccagucaauuuuaacugagagagguauucucugggccucacuguguggaccucacugagauggcucagcagaacaggguagugcugaggagagcccacuccagaaagccacagccuccauaaauauuauaaauaacauuauuguguccuuugacucaacauauuaagacuucaacguucacuuuauuuuuuuuccacuucugucuuuccuuucuucccugaaguacuacuugucugggaucuugcauaaccucugcauaugcucacccagaugugccgucuaugauccuagucuuugaacagccuucuagggacacagcagcccaguccuauagguuaggguggccccaauuuaagccccugugucagcuggcaccagcccugaaccauagcacuuuaccucuaaggucuccugagaccuuucuugcuacacuuguacggcuuuuugugugcuacuucagugugaaaguaaggaugaugccucggcaucccaccauggucuaggccacucagucacauacccaucccuuuucucuccaccuugugcugccaugauagaagcagaugcccagccucccuaagcuggauccuuguuugccuggcuaacccuucuccuaggagacugcuccuucccuguucuaguucuuuaucaucuucccccaaaccucuccucuugauccuuuccagcagcauagaacuguguucaucaguucacucggccaauauucccuaauguugugccaaguccuguauugggcauggaggaaacacagguaacucaagauagucuaagcccuuugagguuucuaaccauuacccugauucaucaggcccauaauccccaggaccauaaguccugcccuucuugaucuugucuuauucucaguguuuguuucaacauucacauauaguaagcauaaaguuauagauugaaugcauccguccaaaaaguagcauugcuuugguaugaacacucauucugacaguacuuugugaacauccugcacaggccaggaaguauuccagggcaguggguuggcuacagacuccucccuugugaagcacaaugggagccuguagauuagcugaaugcauacugcucuaccacugucucacuuggucaaacaagggcacugccaugugugaagagcagugcuacuuaaacccuugcucaaauccuccagcagcuuucuugacccuucugagccuuuuuuuuuuuccuuuuugucauaaugaaaaucacaaccacaucacuucuuagggucuauguaaugauuaaucacaguaguggcucauaggaaagucuaaagcacagaucuugccuugcuacauguuaggaguucaguaaacaguagcugggucuauuauucuuucuuugucaagguggauaauguggccuugcucuaucuuccagccccuccuuucuuaccuauaaaguacagggccugcaugucugguucagacacuguguuucuuucgugacauuuagcuggcuucccauuuauuucaugcacauauauagcauuuuuuucuaacagccucugcagccagggaccuuugugaaugcucauuaauaauucuuacauuagcucuguggggugagugcuaucaugaucccacuuaaaaugaggaaaccaagacacauaaaaguaggucacagcccaggcagacugguuccaaccuuguuugucuuuuagagcgauuuucucucuuuuuaaauacacuuuaauuaaaauauaaugaugucacuuuuuccuuacagcuuccuuccagucccuucagaguccccucccuccaaacucguuccaugucuuuccguucucacucucaaaugaaaggcucacucuuuuuaaauuauuacauguaauuauauaugaauaugcacaaauauauaaauacaaccuuuuuuucauuuuuauuagguauuuucuucauuuacauuuccaaugcuaucccaaaaguccccccauacccucccccccacucccccccaacuccuacuucuugacccuggcauuccccuguacugaggcauauaaaguuugcaagaccaaugggccuaucuuuccaaugauggccaacuaggccaucuucugauacauaugcaguuagagacacacgagcucugggagguacugguuaguucauauuguuuuuccaccuauaggguugcagaccccuuuagcuccuuggggacuuucucuagcuaaauacaaacuuuugagacuggugugugugacuacuuuguauuugauaacaaacuagggacucaucccugagaaagacuaauucuccucccuagcagucauuaguugcuuguaguucuugccuagagaaccuagagaaauaucuucccuucuaaguuagcaugucuauugauacugaacuuguucuguucuucuuuacauaacuguugcuaggagacuguuuugcagcagacuuuugccccucuucugugauguuucccuaacuguggaugcaguagcuguaguguagauguauccauuggggcuuauggacugggaaauggaaaaauggggugggagagcaagacucugacuuggggagggacaauacuaaaagagaaggagggaggagagacaaaaagcaccuagaugcugugugccugcgugcaugcaugugugugugugugugugugugugugucugugucugugugugucuguggguggucccauauuuaugguaaccaacagcuaucuaguuggacuuaggacccacucaacaggaacgaaauuaugucugguaauagaacccuaguuaacuuuccagagcuagugaggcuguggauuaagagaauccacuguugccauuuugcuagaccaguauaauuucuucucuaaauucuaacuuuuauccuuauaccuacagauaaauauagccaucacccgucaucaaagaagguucucuuuacaggaaauggaaaccaguacagaaaacagugggauaaaccuuauuuuccuauagaauaguuuuaucaauguguuuaugcucagguaaccaaaauagaggaaaauacuggccuuugagaacccuguguucccaggggaauccugacuuaaggcauggcagaucugaugcuguggugccuccggaugucccaguucccaccaggcuggcugcucuuggauauugaagagccaagauugagauuaagaaaucuguaccaucuuccccaagaggucucuguucucuguguuccuguacucucaucugguccucacaggcaccaggggagguaggcacuguuucuguccuaauuuuaaaagaggauuuuuuuguauacagcuuauucaauguuguuuggucaguauauacagaccucuaauccgggcagucuggcuuaccuucaugccaagcacucaucuccuaucaggcuuuccuuagcugcucuggcucaaauuauuuguggauauaaucuuaggaguagaagaauauuuaaaggacauuauauauaauagucaucuuguaagcauuugaacaaagugcucuucuauacacacaauaauaaugcuaauuauucauauucuauuauauaugugccauucucauucaaaccaccaggauaccuguguagagaugaaagcuacaaagucucacagaagacaacauauaugcuuuuaauuacuuugcauaaaguuucuauagcaugccaugcccuagcaaaguauaggggugggggggacucaaggugagaagcaugaagcuagaugucucauagugagaauucauauguauaaucuuuuaauuaacaucuacucuccugaaaugcuuucugaccuugaguuugauacuacauauaauugacacaaugagauaaagaaacuaaguaaccaaauaggcccaaggcagcccagugcucucuaaacugugauaucaaaugcacuuagacuauagacauuauuuccucguaauugugaaagcuagaaaaccugagcuacaagggcugcggagauagaaucugaugagggaccccuucuaguuuuaucugacaucugucuucuugcuauguccuuagcuggcacauuaucuagggaccauuuugggaucuggaacuuuauaaagggcucugauucaguccaacaccaugaccuaaucaccccuaaaguccccaucucacuccagucuaauaccaucacauuggagcuuagguuuucaauauaugagccaguaggaaagaugcaaaguauucaguguauagcaaggugcaguuccugguuccagagaggaaaggagcaugcuccacagacaauuagagccgcaguuuguguugugcauucuuaaagaguacccuaaagagauuuuuaagugucucuaagccagaaaauucaagcacaaacugguuuauauaguagccagucacauggaacauuaagaaaucuaguagcuuguagucacuugccacagcauuggaugacagauuuccauucaagcugcagcuacuuacccucaccccugagucauucaguccuggucaggaggccaacauaaagaacagccagagagauucuguuuugugcccuuuagagacagaauaacaacagugugcccacuacuuagcuguagaauaaaagucaaguuaucuucuauaagccucaguuucccuuucuauaaauuaaggagauaggcuggugagauggcucagcaggcaaaauacuuguggcccaagccugauuaccugaauuugugccgcagaacuuacuuaaacguauaaagaaaaacaacucuacuauaguuguccuuucaucuucacagguguuccaaggcacacacgugccucuacaugucuuauacccccuuauacacaaaaucguguuaaauauuuuuaaauuagaguaacuaucucuucagaaaggguccugaggugguucuaugagaaacacuugacaacuucaauaaaugucuaauagauguuuguggcugucauuguucauguuuucuugaacucuauaaaccuuucuacuaaaagucuuuaagcagguuaaaucucuaaaaaccucaggagaacuauuuugcccacugggacuuaucuuucuuauuggagagccuuagaccuugccaaacccuuugugaacacggugccuuaauuagcuuaguacaaguggccugugacuggauggcaccugcuguuccacaagugcuagcugaguggguaugauuggcucugcagaagcauuucagugguggcaugaggcagcuuuggcagagccucuggacuuuaaugcuucuccaaaucugaaauuaggagggagcagaaaccaucuuucaguaggugaaauugcuuuuccaaauuagguaugccugaguuguuuucuugccccccucuccuaauuaacucuagcuuauuguggaugugcagcagaauucuagaacaugccaccaugcagacaucacugggagcauagagaccuucuguuugccaguaugaauuauagggaaaaaaucuauaccccaaauauggcccucaagccacaguuaaggcaguaucuccagacuagaagacuguauaaacauuauagaauuaccuuuccuccacucucuuugaacauguugagguuggagagucuguguaucauuggaucucuuguauauagauucagucacagagcaaugacucagcagcuucuuccugauuagaagaagauaaaguaaauauaacagcaugaguaaaauaacagcaugagcaacgucucacuguguuggacgaagucguugagaagcaagacaugguucuucaucuauauccuccuaguacucuggaaguugaugccggaggacaacaauggauucacauauacggaguucuagccuaagcuacagagagacuccgaucucaaaagcuaagaaaagaauuuacauauuaggguauaguggcuagaaaauuauauagguaggcaaacccacaguguugaauaaucacaauuaaugaguggauuaucuuaagccuagcagaaguauucugguuaaaaggcuuucaauguuagcagcaacaacuucaguggaaaauagaauuacugccagaggccaaacaauuacccaagaauuccucaguaguugaguacaaggaaacugcagcuccagagugcuuggcucaccauaccaccaaugcuaugcagaccuagaaguuagaagugccuuagaauuuagaauaccauacuguaguugauauuucccaaaacauugcaagguuugcuguucaguuauuugaaaauaugcugguggccuuuuauaaacucaguaugaggcaaucaucuaauaaggguucuuuauguuauuaauguuauaaaacaaaagaacaaugucuaaucuucaucacucuuaaguaugcagccgugagacucaccagacccauagucuauuucaggcacccacaucaguugccucucuuucaagucccaggagauccaacacccucuucuggcuuccccaggcaccuucaugaacaugguguacauacaaacaagcagaugcauccacauaaaauuagaaaaaaagaauaagucuuuguaacuguguagaaauuugagguauauacacccuauacugaucucaaauuuuucuaccuuggaucagcaauccccuauaccccagcagccauuguucuacuuuuugugauuuagaguuuuagcuguuagaugucccguguaaauggauuuaugcauuauguuuuuaugacuggcacauuccauuuaaugugauuuuuccaaacguuuaucuauauuguaacaugcuuuauaguuucuuuguuccauaaggcugaaugcacuuuucauaauacauacaaucaacuucagaaauuuagguuguccaugaaucuuggcuauuuggagcagcuauuuguauaauggauauacacauauuuauuugaaaucuuacuuuaauucuauuuguacauuuuaaugcauguacaaaguuaaaggcacagcuuauaugcuaagucuauuuuaauuacuugaggagcucucagauauguuucauaauuauuguaucauuuuauauuaguauuccuguucuugagaauuuuauucauauauacaguggaacacugucauuuauuuucuuauuuccagccuccaacuccccauaaauucucccuuauauggccugcucccaauuucauguuuuguuuugcugauaaccugcuaagucccauuagugcggaccauauguucaugggcauggggccauccgcuggagcaugggaaaccaaccagcggccauacauuuaaagaaaaaaauagagaagaagaauucuuccuccucccacagcugucaacugccaaguacaucucagagaggagugagaccuagagaguacuccacuaucaguucccaaauguuagucuggcugaugaugucaucaugggcagaacuugugaaccaggccauggcuggugugagcuccuggguaugauagacuuguugagucagaaguuggcauuuccuagcacugcuccccaucuuucaguucuuauguuccuucugccccuucuuccuggauuuucccuaugccuugguggugauucggagaaggaguagguugagaaauacacuacauucagagcugagcacucagucaucucuccuuaguccuuugacuaaguccuaagaccauugcaggaaaaaagcuucucugaccaagguuuagggagagagcagcccaagucuauaaguauaaacauaaauauuuccaugacaauuugacaacauggccauuuagcaaaauaacaguagcaguuuuugugcuagggccugugacuucuccagcuguggacuuuuucuuaucagaauuacagacccaggcauugucucuucugggacaggccucaaauccaauaagaaugugguucauuagccaauaacagucacaccacgaucugcgccaguggacacaucuugucugguaggucaguauuggcuaagaccauugauaccuccauucccccugcaaucugcauggcaccuuccagugcuaugaaagcacguauauuuugagaucaguuugagauugauuuuucacuuucuuuagccacaguguguggugucuucagcaauagaaugugugugugugugugugugugugugugugugugugugugugugcaugcaccuuuauugucuuggagaccucugggaucucacugaccaguaacuccuagguagguacuccaugccuugcacugauuuuuauuaacuaaucuaaauccguugugagagauauuauccaccugggcaggguaauuccaucugugcuccccaccccuuuucaguuauauuuugaaaucagcuuacuagugauuuuacauaaagcauuuuuuuuccuguaucuguaauuuugguuaaccuacuauuuucuccucuuccccaaaccccaucccucccccucccuucuugauuauuuuauucccaguuuuacacuuuguuuuugaucacaugaauuucacuauccuuccaauuauccauuuucauuggauuguaagguuguaggcuuacaaggcuucccuggugcuacccuccccugucccacuucuauagucgcccauccauuucuucuucagccuuccaaucccauucuaacuacaauucccuauucuccuccccuuaacauauacaucuccucugaaaaagacacccuucuaguuguuuagugucaagauuucuauuguuuggauaaaaccaugaccaaaugacacuugggaggaaagggucaggaacuacagguugaaaacugcugguuuaaauauuuauuuauuuuuuaauaaauaacaauugugugucuuuauggguacagugugauucuugaaacaauuuagaaaaaguuaagcuaggcauaucuucuaccucagcccuuuggcuuuuucuuuuuguggaugaaaaguauuaaucaucuguucucuuaaguaauuugaaauucauacacauuacaguguuagaaaccaugguuaccaucaggcagcaugacaauuuguucuuucaguuuaucuaaaauaugguaucuuuugauuuaaguguccucuuucucucucccauaguauguauagucuguguucuuccucugacaggcacguagacugccuguguauuuuggcuuuugugaguaacacaagagagcaaauaucccuccagcucacauguguccauccucugcauaggugcccugagcgggaagggcuggaucauguguuccuauucgaugagccuucaugcucauuguuuucuuuauuuacauuucaaauguuguccccuuuccuaguuucgccucagaaaauccuguauccccucucccccucccccugcucccuaacccacccacuccugcuuccuagcccuggcauuccccuuuauggggcauagagccuucauaggaccaauugccucuccuccccuugaugaccgacuaggccauucucugcuacauaugcagcuaaaaccaugagucucaccaugugcuuucuuuguuuggaacucuagggguacuuguuaguucauauuguuguuccuccuacggggcugcaaaccccuucagcuccuuagguacuuucucuagcuccuucauggaggacccugugcuuuguucaauagaaggcugugcaugcucauuccuuccagugauaacaauauuucucuuuuccauauccuucccaaguuauuuuaucaucuuucaaaauaaucauuauuguaaucaguauggugguuuuaacuguuauuuccuugauaauuugaucauuugacuuguugagccauuuuaauauucuguugauauauaaaacaagaacugguuuuguuuguuuaggguagggguuuacacugcugaacacucagguuacagcuaugagucacuaugccugguuucuuuuggcucuguguucagacccuuuggccauuguuuaacugagauuaauguguaguuguuaguguuucuuauauaguuuauauuuugucccuguauuggauugagucuauaguuucaagcauuucucccaacucauuccugcauuucugaucucuuauucuucucucucucuuccucucucucucucucucucucucucucucucucucucucucucucucucucucucucucucucucucucccuguguguguguuuuucugucuuucucugcuauacaaauguccuuuaguuuggucugcucauauuuguuuccucuuguuuuuguaaccuuaaccaaggagagcaaaaaucaaaacauuggcaauaaaaucugaauaagacucaaguaaacaagaguauauucaugguuuagauauuaaaaguauuaguguuauuuauguguauaacgcccagagaacucugcagauucaauacaaucaaaacuucaauguuguuuuucacagagacagaagaaacaauccacaaagaacuacaaaaagagcccuaguaaacgaaaccccaugggguugggggagagagaaauaaacaguggaagacagcacacuccaugauuucaaaguacaguguaguauguuauaaaacuauuauaaucaaagcagcaacagagagauaacaucaaaauagacuagugaaugagaugggacagaaaggucagagauacacucacugguuuacagucaccugacuuucagcaaaggcaccaagugagcccagugaggaagaguuucuucacuaaauugcucucaagaaacuggacuuucaugugugguagaauaacauuggaccuuuaucucagcccaugcacaagcuuagcucaagguggauuuaaagaccucgaaguaauaccugaaauuaugaaacuguuugaacaaacuauacagagagcucugugaccuucgucugggcaguuauuguuuuagaucucuauuuuuagcagaugguuuugucaguggauucuuggcugccacuguguuuuuuccgcacaccuuccuacauaaccauccaccacuucugcucuacaaagggucuucugggaagaagcucucaucucauggucugcucaugugcagcauuuagcagucccuucuugauacucugcacugauucucucuagcuuugucuuuggaugauuaccuuacagggugucuuucaucugcuuuacuuugaguucauuucuguuggaauccuuugaucuaccugaaguuuuacauagugagauuuugauuguuauuucuccagauaagccacuaucuacccuuucccccucuuuuuuuuucugggaguuuugugaugcguacaucacucccugccaugucgucucauagagcacucaccuuccuucuuucuuagaaaguccucugccucaaucauuucuaguagcauaccuuuauguuugcagaaccuuuguucucugugauuagauuugcuggguaaacccuuaaggacuucccagcuuugcuguguucuacagacccagcauguccucucuucuuuggcuuuugucuuuguguucaucuuaaaguugcucacauaguguuccucauguugcuuacucguucaucugucugucuggccucuuauaagucaugaaacgcuaccaagaaaauugcuuuuaauauuuucaggccaccacucuccauuucuuuaggauuauuugucuagagauuuaacuugcugcuucucucacgacacaguuuucuggacuuuuauuuguuauuguaaacucuacauuuuaaaaagaaagcaaagcaaaacaaaacaaccagaacagaacaacaaaacucaugcauccucccagaccauagaguuuagcauuuuauggaugcaacaggguaguaaguccaucugcagaucuugggaacagcucaaacuuugccuguguuuguaucuucucuggccucaugugauuguucccagacagauauuuaugauuuucuuuuuuucaaguaguauauaauuuuuuccucccucugcuguuggucugugguacugcaggucucugacauuacaacuggucucccuuggucuggguaacuccccagguaucagaacuguucuacucugcacuaccagucaaaugugaccaaaaccacucaaucaugcaagccuauauagaaaucuaaagcaucccauucccuuaccacucuuguaaaccccccccccccaaauaaucuugagcugguacuuacuucugauugugccgugccuuccuucguggcaaugccaggucucugagcucuggaucaaccagcguuuaaauucuucuuucuucaauuccugccaucugcccacauccaaaagacaucagcucccuaggagcucuccugucacucuggaccgaucc

SEQ ID NO: 5888 - RNA, 3041 nt, Mus musculus
auuuuuuuuccuggucugaaaugagugucuuuauugcuuguaccguacaaauacgaggaguaaggaaaggccagcagggaugggcgaaaacucucagauaaacauacacacauacaaaguaaaaaacagaugaccccccauaaccaucccaaccaccccacccuacugccuuucugaaauccaccuauucuggggguguggugggagagcaaaaccaggagaacucauuuccaaaaacccagagcuauugaggagggagagacauggccagagcagcaggcacaucgccugcacucacugcaccccgugggaucaaacacucaggcuggggcugagccugagcccacucacacaagugcugcauacagcugugggcaccagcaucccaguagccugggaugcucacugcuaggucagggugcacacccgcacccacagcacugacacaacucuaacucaaacauucacuuuaaggcuccagaacaggggcccuggagaugaggcagacuccaccccauuguguaucagacaccuauccccaucucuguccccucagaccccagucaaguccaaggggcccaauacugucuucgugugagauguguaacagccaagguuggcuucccucugccccaggcagagaacggagccauccaaaggggccgagcgggaggcaaggcuggcuagaaggaagcccugguaaggcacugggcugugggcaggagggcugcccccgaacauuccuccugcuuuauugagaaucaagagaguagcuuuggaggaaggggaaggcagcuccugcuccuggaucccccuugaagauccauucuccauagaagcaaacccagaccccucagcuuccaaaggcuucugccugucccuggacauuacugcuuuugugccccaggugggguggcagcagauaagauugcccagaggacagcauggaaggcagcugaggugcugggagugaggggaacuucuagauguguccuccgcuggcgugccuccaaauccaugugaccccauggcucuccacuucacccucuuggaggcugguggugaggaaugaccucacucuccauccucccaacagccugucccugggcagguccccagcgcucaccugaaacagaggggagcccagaggagagggccgccaggaccacuaagucugagcaagaacugaagaagaaacuggauuugggaugaggggacagggaagggaacacaaaccaaaaggcaaaauaaaguuuuuuuuguuuuguuuuuuguuuuuuuuuuuaaagccacccaggcaguggaugacggccaugcuuguguccugugguggcagagggcugcucacucucggaugcuggcugaguaggagaacugggggaagugcguccgcugguccaguuccagcggauccaggcugucauaucggucugggggugugauugugauggacugggcggugaacuccucaucaaaguaccuuguguucacuucugaagugaccugagguuugaaggguggcaggagcuuuuucuguaccacguccugccaguugaugcugaggaagaaccuaugcuccaucaccuccuucgcaucacugggaccuccgccgagccucugcuuuggguccuucuucagcagcccagccagcagggacuuggccucuggcccgagugugcgcgggaagcggaucuccuccauaaggaugagcucaaagaggcgcucgugguccugguuguagaauggcaggcggccacacaucaucucauacaugaccacacacagcccccaccaguccacugcgcgcccauagucauuguccucuagcaccucaggcgccaaguacuccgggguaccacagaagguuuucaugguggcuccaucacugaugcccucuuugcacaagccaaagucagugaucuugauguggccaucuuuguccaacauaagguuuuccagcuugaugucacgguacaccacaucucucgagugcaaauacuccagagcugacacaaucucugcuccguaaaagcgcgcccgauccuccgugaagacucgcucccgagagagguggaaaaacagcucacccccguuggcauacuccaucacaaagcacaggcggucaugggucuggaaggcauacuugagggcuguaaggaaggggugccugguauucugcagaacccggcucucugugacugugugggcgacuucauccuucgcaaugaugaccuccuugcgcaggaucuucauggcauaauagcggccaguggccuucucucgaaccaaaaugaccuugccgaaggugcccuugccgaggaguuugagauaaucgaagucauucauggucacuuuggcccgugccuuguugacagcuaccuccaucaucucagauguggaagagucacugggggagccacacuuguaauccauggcguccucaccugggccccgcugcuucagacuguuggcgaccaucuggauagcccgcauucacucuucccucucaucuggagagucuacauggaagguccucucgaugacugugguccacugcaggcagcguaugacaaagguguugggucguggccucucagucuucaucagcuggcauucugcuacagagaaauuguugggggggggggguaaggucuggucaggggacucgggccucuccuuauacccaaugaaagauccaucacucuucagaaggaaguaccguggccuccaggucuugauguauucaccacguuuguggagccagccuucuuugaugacagauaccucauucaugguggcagcauucacacgcugucaccuagcuugagcgagcucagggcagcaggacaugcaggaggcuccucggauacaguaucacaguaucgucugucaccggccgccgcccagccucuccggccgggcucuacccccgcccaucgccacgcugagcucauucccgcuccuuauuuaugaacuggcagcagcaacagcggcagugcuggcaucugcgacgccuucucagagucaggcccaacagcucg

SEQ ID NO: 5889 - RNA, 2073 nt, Mus musculus
cucucuuuuuuuuuuuuuaagaaaagauauuuauuauuuacaccacugaaauagucccauaagaacaauguacaccuguucauuuaaaaggagcaauuccuuucaauacaagaacuguauaaagcaauacugucaacauaaaacaacagucacauacauauuugcaggcuuaagcauugcaaguaucagguauuuuuaaucuuauggcuagauguuugcugcaacgguguuagcaguuacaaugacacccgacuggaguaggcagagaugcuauccaugcuucugagagucgagucggugauggugccuucuuacuacugugguaagcugugcucaugacuaguuuuaggcagaagugcuucuacucggccuuguccugcuguguuauuucagucugcuuguccugucccugucauguagggcacagccuuaucaugcagauguccuucauucuuaaggagcacugacacaacacagcuucaggaucuuccgaguagacugcaggagagaaacucugacaaggaaggacaacucuugcgaguuuucagcauaacaaaccaggucauuacuuagaagcuggucugggguuuuuggugcugcuuuugguuuuaagggggaaagcacuagcuaguuugaagacagauuuggucucagacucaggcagcugauuauacaaggagacaaaagcagaaaagcauaagacaaaacucauuuccaaagucacaagauggcaaucguagauauauuuuucuccuuuuuucauuuuccuuuccuuuuuccauuuuuagaggguuugggaaacaccucaauaauuaaugccagagaacaauucuucaagaguaaauaacauagagggaagagaacuuuuuguuuguuuguuuguuuguuuagcacuuuguuuacaaagcauuggaagaccacagcuaggcaggcuggcaucugcuucaguguccagcgcagccgugguaaugccuagcaaagaaacagagguccacagaccucaggaucuucaacucugaguguaacugcuaacuacuguccuugcuucuuugauagacaccucucccaguacuugugauucagcuccaagaagucaucaagcuuagcgaucuccuugagguacugagugagcuucaccaguuccuugucuuuaucacgguuuagaugagcuuucaugaaaggccuuaucuucaguccauuuuguggauucauuagaaaauuucuuccuauaucaucaaacauaaugguguucuuuuugcuguagaauucagaaaacuuuccccaaaugacaccaagaggcuucacgucaaugagcccucuccggggcgugugcacagugaucauggccgcacuguccagcaugaagguaaucuuauaguuggcauuugugcucacgcccagcucuugcauuuuagcuucaauccacuucauauuuguugcagaccaaauaacaaugucauaaucuucauaugcagauguuagaaauucaugaagauaauggucucauuaacucuaccccagucucugcacaagaccuaugaucaaacaguguauagucaccauccagcaccaggagcuucuugcccucccggggaggguucagcaccuccaccuuguacuccuugacucugcgagagaccuucaggagguuuuccucccuauuuucuacuucaacuacuucaucuucaaugucaaaaucauugaugacaucaucauugucaggaggaggacauaagacaucuuccaagcucuccucucgaguucccaucaucaugauuuuaguauuugguuucaguuugagagcuccaagcuuaacaucauuuucugcagguuugccuuuaacuuugagcccuaguaacuucuggcgcucugggagcacucccguaagggucuugaggaacuguuuaagauccagcacaguaucaucuucugagagcguggucacugaguacuccugcccaccccauuucacuaugauggggagugccauucuucacgcauaugaagcaggacuuucugucggaacaaaacaccuggagcgcggcggaaccagcuacagcggacgaaaaaccu

SEQ ID NO: 5890 - RNA, 2073 nt, Mus musculus
agguuuuucguccgcuguagcugguuccgccgcgcuccagguguuuuguuccgacagaaaguccugcuucauaugcgugaagaauggcacuccccaucauagugaaauggggugggcaggaguacucagugaccacgcucucagaagaugauacugugcuggaucuuaaacaguuccucaagacccuuacgggagugcucccagagcgccagaaguuacuagggcucaaaguuaaaggcaaaccugcagaaaaugauguuaagcuuggagcucucaaacugaaaccaaauacuaaaaucaugaugaugggaacucgagaggagagcuuggaagaugucuuauguccuccuccugacaaugaugaugucaucaaugauuuugacauugaagaugaaguaguugaaguagaaaauagggaggaaaaccuccugaaggucucucgcagagucaaggaguacaagguggaggugcugaacccuccccgggagggcaagaagcuccuggugcuggauggugacuauacacuguuugaucauaggucuugugcagagacugggguagaguuaaugagaccauuaucuucaugaauuucuaacaucugcauaugaagauuaugacauuguuauuuggucugcaacaaauaugaaguggauugaagcuaaaaugcaagagcugggcgugagcacaaaugccaacuauaagauuaccuucaugcuggacagugcggccaugaucacugugcacacgccccggagagggcucauugacgugaagccucuuggugucauuuggggaaaguuuucugaauucuacagcaaaaagaacaccauuauguuugaugauauaggaagaaauuuucuaaugaauccacaaaauggacugaagauaaggccuuucaugaaagcucaucuaaaccgugauaaagacaaggaacuggugaagcucacucaguaccucaaggagaucgcuaagcuugaugacuucuuggagcugaaucacaaguacugggagaggugucuaucaaagaagcaaggacaguaguuagcaguuacacucagaguugaagauccugaggucuguggaccucuguuucuuugcuaggcauuaccacggcugcgcuggacacugaagcagaugccagccugccuagcuguggucuuccaaugcuuuguaaacaaagugcuaaacaaacaaacaaacaaacaaaaaguucucuucccucuauguuauuuacucuugaagaauuguucucuggcauuaauuauugagguguuucccaaacccucuaaaaauggaaaaaggaaaggaaaaugaaaaaaggagaaaaauauaucuacgauugccaucuugugacuuuggaaaugaguuuugucuuaugcuuuucugcuuuugucuccuuguauaaucagcugccugagucugagaccaaaucugucuucaaacuagcuagugcuuucccccuuaaaaccaaaagcagcaccaaaaaccccagaccagcuucuaaguaaugaccugguuuguuaugcugaaaacucgcaagaguuguccuuccuugucagaguuucucuccugcagucuacucggaagauccugaagcuguguugugucagugcuccuuaagaaugaaggacaucugcaugauaaggcugugcccuacaugacagggacaggacaagcagacugaaauaacacagcaggacaaggccgaguagaagcacuucugccuaaaacuagucaugagcacagcuuaccacaguaguaagaaggcaccaucaccgacucgacucucagaagcauggauagcaucucugccuacuccagucgggugucauuguaacugcuaacaccguugcagcaaacaucuagccauaagauuaaaaauaccugauacuugcaaugcuuaagccugcaaauauguaugugacuguuguuuuauguugacaguauugcuuuauacaguucuuguauugaaaggaauugcuccuuuuaaaugaacagguguacauuguucuuaugggacuauuucagugguguaaauaauaaauaucuuuucuuaaaaaaaaaaaaagagag

SEQ ID NO: 5891 - RNA, 4236 nt, Mus musculus
uauuuaaguacucagcauaaaguugaguuguugucaggguuaagauuguauuugccaguguguccucacugugucuuugcagggagccgcggggcugugagugcugcaaagcauacccuuuugcaguaguucccaaccuuccuaaugcaguuccugauucaguuccccauguugugguggcccccaaccaccaaauuauuuuguugauauuuuauaguuguaauuuuccuacuguuaggaauuguaauauaaauaucugauuuguguuucaaagguaccuuagcagccacuggggguaaaggaaggguacagagaggggaggcaccaugcugggaccagcauuccauuacaucucuggcagucuuagcucagcuuaacucuuccauaguuaaccagucucauauaccuccugggcaucuuucuacuaacugccuuucagcccaaucuuagauaaacuuuuucuaugucuugaccccacccuggcucuugggcaauucaugggaaaauauauggagcuaacguuuacugggcacaaacauuacauauacauacauauauauauauauauauauauauauauauauauauauauauauauauauauauaugaucuacaaagagcuccuaucauuauacccuauaaaauuacuuuuuuagcucauguugaaaaauaauaauaaucucuuaaaugcuaaauuugcugccagucccugcugccaugggcuuuauagauaaaaaccuuggcaaagcacaaaauuuuauuccagcuaaugauaacacaauguaggcauuuguuggacacuuuuuuuuuuuuuuugauuuagcaucccaccccauccccaaacuguagacauaaaaggacuuugacuacauaagcacugaagcacugggcuuugggcugggcuaccaugagacauauccagccaguacaguuucaaccugauuauucuuaagcccaugaacuuuucagaguaccuccaggauacuacaauaaacaucaaaguuuauuugagagccacuguaaaaggcuugauaaggggacuguuggcacucacuaguggcugcccaucugugguuuguucuuauugguccuuugguugcacuuguauaagacaaagcugguacgugaaaaucauguacccucacugccaaugaaaaguaccuggaucgcuuagaaaggccuccgcagccccuucagucucaagcagucaggaucccagaggggcaccccaaccuugauucuaguccucaucugcaucaccaucauccaggaaacaggccugcuacucgacucugugcacagcuggaguagaauaaaaccccugcuuagggacagacuaccugacucacagaaagcauaauuugcagucaccacuacuccuaugaguuguccacaaguguagccuuuccaaaaucuuccuuuuuuuuuuuuucucaauaaaaccuuuauccugaaaaugguaaauaucuaaaucugggccggggacaucuugcuaaaguccucagacacuguguguuaucuaagaaacaagccauaaaaacccaccacuucccaccuccccacacugaaugagcuguucccacuuaagacgcagcagauguuaaacuuuugcuuaaucucuacuuucuuuugauaagcuugugcuuguauuaaaacauaacgaucuguuuacauuuccuugcuugggggcuguaaaaccauaacugagcagaaaucccgcacucuuuuucccagccacaccuaucauuccagagacaaaaaucuugguacuguuaaagccacauguagacagaguuuguaaauguaaauguauuuuuguacuugucuuuaguauauuguccucuucauguaguacugaacuuuguaaaguauauuuuuuuaggaaacucgguauuuuuuuguuuuuguuuuuuaguuuuuuguuuuucuaaagaaaacugcuuuguaaaaacugcaauagaaugaaaauuugaaauugagaucuucgcugaaaaaugguucaacugaggugcgaggaaaagucucuuuucucuuaggugaaugucuagcauuauuacagagcuaagcuagaccguuacagacagaaaagaugaaaggcauaugagcuuaguacuguucugagaagaagcuguggacucuggggcaaugucagcuuacagaaugcugccugugcauaacuacuagaggaauuuaaaugagugucauucucugauuaucugcagucugaccuuguaaaugaaugcgguucaaugacacaacacuuugguuuacauaugcuaauacaauaguaacaucaauuguuuucuuuuuauaguuacaaugucggucguucucuuacuaguguguccuagaaaugucuggaaaguuacaauaauauuuauguuuguuuggguuacuuaauauauuccugaaaccuaccgcaugcaaacauggucacucuagaggagccuucuucagucauacgugcaccauaaaaucaccuagguugguuucacaacucuugaaauacagccauacacaagaaacaaucaaauaugaguuaccaugggguaaaauuugugaauuuuuacuuuuuuuauuagcuauuuacucaauuuacauuucaaauguuguccccuuuccugguuucccuucagaaacucccuaucccuccccuuccccuugcucaccaaguccugaguuccuucucauggauagaaucauacaugauuuuuaaacccuguuuaggauuaaaaaaauacaaacucagggauuagcccuagacucauaggugacucuguagauguagauggcaucugggccuagagaacccuaagccugcuugucagaaucguucuggggagugggguugucagguuuccauggcagcuaccugggcauuuaaagggucuagcccgugguugagaagcuagaaaagugaacacagacauccccaucaucaguuuuguauuaccuaagcaagcucuauuaagaaugaguggcgggggccucucuucccagugauggccagggaaugccagggccaagaagcgggaguggguggguaggggagcagggcggggggagaauauagggaacuuucaggauagcauuugaaauuugaaauguauauaaagaaaauaucuaauaaaaaaaagaaugaguggcaggaaaguaaacguuuuuuugcugcuuacacauccaacuucacuggcaauccaccaaccugugccaacccaugaaccuccgacucccagaaggaaaaccucgaccuauuauuuugacugcagcagacagauugcuaaauacuuauguggguuuuguaagaauaaaacuccaagaagaggaaccuugcauuaagaaaaacacacacauacacacacauaugcacacauaccuccaccugcacacacagguacacaggcucaugcaugcacacacuugcauacauacacgcacacaugcacucauaccugcaccugcacacccagguacacagacucucucucacacacacacacacuacacacuauacugagauaaaacacugaagcaguaauccagaguuuuccauacgcauagugaucuuccugucuuaccugaauuaccagcaaaauuguugucauuaccucacagcagcagaaaaauauaggaaaagauuugaguuuaugcaucuuacaugaacuuuuuauuuggaaaauauaaugccaaugcuguacucucuugauuuggauacaaaguguuguuacuguauaauacgaaggcaucgaaaugaugacaccccaggauauaaugacuguuucuagaugugaugacaugacuaaccacagacagcaguaaucuuguguuaguuucacucaugcaauagcuuuacagcuucuuauaugguacauuuuaacuuuguaaagucaugcaguuaugaaagcaauauuuguacaaaugcaaagcaagaucucucuuacauacuguugauaagaacauguugauuguacauuaaguauuaaaaauuggauuauguucuuccuugcuugcuacuccuaagaacuuaaugauuuuugcauucuuuguuaacagugcagugugcuuucuguuauuauucauaucugacuauagauacuuucuugacuuuuucuuguuuucaaauuuauuuugacuuaacuugcugauuuuguggugcuguguggaccaaugagcuguauuccccaccccaacugaaaacauuuuuaaaaaauuaauaaaccuuauuuucagagaag

SEQ ID NO: 5892 - RNA, 418 nt, Mus musculus
agaaauacaggcuuucuuuucuccauuccucugccaucgugcgcgcuauucuugauucagcuucucgccaugucuucucacaagacuuuccgaaucaagcgauuccuggccaagaaacaaaagcaaaaucgcccuauuccucaguggauccggaugaaaacugguaacaaaaucaggacaacucuaagagaaaacacuggaggagaacgaagcugggucuguaaggauucucacaauggcaagacugaggauuuauacugaauugucaucaaucaauccuaccagauggauuucaacauuuaaaccuggagacuuuuugugucuuaaauuaggguguuuguccgguaauaaaauauagaaccuuuucaaaaaaaaaaaaaaagaaagaaaaaaggaagaaagaaagaaagaaagaaag

SEQ ID NO: 5893 - RNA, 1340 nt, Mus musculus
gucccucacggaaacacuucagugugaacccaguaggccugagaccagcccagagcgcucucuccggucagcuagagcuccacuuacgcggaacgcugcccgccugccacuccaaaacagccacauagcgugguguucgugauuucuuucccgagugagcuucugaccucaacuuguggacggugagugggugggaagaugggugauggucuggcaaacacauucacuggaagcaaaucuuagggaggcaguaacacgcguggguuaagggagacuacuuuuggcuaccuuugagaaauugcucucucuaaacaucuacuucucuaucucucuguguguguuucuaugugugugcaugugugcgcgcagggaacccggacagaauuauuuuuguuucuuuuuacucuuuuuuuuuuaauauuuguuuugcugaccuguuuggcgaacaccgcuauaucuucauugaaugacucugacgagcagacguccccgcccgccacccccggcucgcgggggguacaaguagcuaauucacauuucucaaaaaucagugcuaagagagggaagagggggugucugcaagaaaauacaacagucacaaacaacacaaugauuaguccagagucaccgaaaaaaaaggcgcccaagagaaacaacccgaguagcucgaggccgagagacccuugggugaucugaucagcuuuugcccuuuuucucacccuccgcccaggugacggcucaccucccccuuacuccugggucucugaacucagaggcccagagcccuggaccgugucuguggaaugguucagcauaucuggccgaagaaauuggcaacauuugcuacgaauaaaacccaagcgguuccagcagccauuuugaauuaaguuucgcaccgcgacaaacccucgucccuccgccgcacaggcaagaccgggugcccggggaaggcgcaggggacacggggugggagaggaccagccucucuaccuuccucggaggcucggcccaaaaucccaggcuaaggggaucuugguggcaggggcgcagcaaacuugaggaaagggccucuguggauauagaacggacugucacagggcugcaccuacggacccuggccgcacagcccuccaguagcaagaggucuuucccgguuccccggcagugcccucccuucgcagacgcuccccauaaucccccaaggaaaguuccuucaaaugauucuacauucaagccuuccaucucgccuggagugguaaagcgacuggcaucuaaaaggccuagaugucgcucgucucagcccauuuaaaaaaaaaaaaaaaaaaaagacuuuuaaugcu

SEQ ID NO: 5894 - RNA, 1340 nt, Mus musculus
agcauuaaaagucuuuuuuuuuuuuuuuuuuuuaaaugggcugagacgagcgacaucuaggccuuuuagaugccagucgcuuuaccacuccaggcgagauggaaggcuugaauguagaaucauuugaaggaacuuuccuugggggauuauggggagcgucugcgaagggagggcacugccggggaaccgggaaagaccucuugcuacuggagggcugugcggccaggguccguaggugcagcccugugacaguccguucuauauccacagaggcccuuuccucaaguuugcugcgccccugccaccaagauccccuuagccugggauuuugggccgagccuccgaggaagguagagaggcugguccucucccaccccguguccccugcgccuuccccgggcacccggucuugccugugcggcggagggacgaggguuugucgcggugcgaaacuuaauucaaaauggcugcuggaaccgcuuggguuuuauucguagcaaauguugccaauuucuucggccagauaugcugaaccauuccacagacacgguccagggcucugggccucugaguucagagacccaggaguaagggggaggugagccgucaccugggcggagggugagaaaaagggcaaaagcugaucagaucacccaagggucucucggccucgagcuacucggguuguuucucuugggcgccuuuuuuuucggugacucuggacuaaucauuguguuguuugugacuguuguauuuucuugcagacacccccucuucccucucuuagcacugauuuuugagaaaugugaauuagcuacuuguaccccccgcgagccggggguggcgggcggggacgucugcucgucagagucauucaaugaagauauagcgguguucgccaaacaggucagcaaaacaaauauuaaaaaaaaaagaguaaaaagaaacaaaaauaauucuguccggguucccugcgcgcacacaugcacacacauagaaacacacacagagagauagagaaguagauguuuagagagagcaauuucucaaagguagccaaaaguagucucccuuaacccacgcguguuacugccucccuaagauuugcuuccagugaauguguuugccagaccaucacccaucuucccacccacucaccguccacaaguugaggucagaagcucacucgggaaagaaaucacgaacaccacgcuauguggcuguuuuggaguggcaggcgggcagcguuccgcguaaguggagcucuagcugaccggagagagcgcucugggcuggucucaggccuacuggguucacacugaaguguuuccgugagggac

SEQ ID NO: 5895 - RNA, 1379 nt, Mus musculus
auauaguccacacugguaauggaauuaccaagugcuggaagagaacuggcuggugcagacgcagccagcaguugcaaacauuuaccuuugaaagcaacuggaugaggcugauugcccaugcuuagcaucgguauuacaccgaauaaaggggcagguuuugugcgaaucuccaggcaaaagggugguaguggggaaugauuauucaaaaauaaauauuuuaacauuucauugagucgucuaaugaauaagaaaaucgucgaaggcuuccugcagcucagagagaauucuagcggugcggaaaaacacuaggagaaaagaagaagaaacugaagggugccugcugagcaguuacucauuugugacguacuuuucugugccuuuauugaaaaaugaaaaauaaauaccaucuuuccuugucuuaaaaauagcuucagacuacgguuaugcuugcugaaaaucacauugucuaaacaacuucugcaugguaggguccguuugaaaacgggaggaaaagucuacaaucuugcaggcuccccuccuuccagguccgaaaggauaauuucucucacaggcgcuuccuuggccacuuccgggaauauggggugggggcagucaccguaucccuccgccugugcggguacgugucgccaagccucaguggccugccugcacuccuggagugagcauucccugggaucgguggggugcccgaggccacgggauuugcaagcacaggggauaggagucugugcacacugggcuggguucaggggaguucugaguccuuuggggagaggacgaguggccagaaaagguggaaaagaucccuuugcagguagcugccugucggguccccggccacucuggacagccauucugugggggacuugagggggggacugagggagcagaucccgucuagaggcucuggguagcccgcccggugcaaagcucuuggggacacagggacaccgcgcgcgacucuggcaauagcuuccacugcucgaggcugagugucauaaggugccuuucuucccagcuagacugaaggauuccugagcucucggccuggggucugauucuagaagcuucuggccuuuguucacggacaguuuuuccuucgaggggcauucaggcggucaauagguccuguaggucaugugcucggugaucagagagccucggaacauggagggacccuugugcacgcucggagggaggagcugaacugaguuagggcuucagguucucagaagagccgcguggagauucgcgcguguccucacuucagcuuccggccgccgcgaguggacgcggagggaccuaagggaccggggagucgagucgcacagcgccgcgugcagcgagcggagcgggcg

SEQ ID NO: 5896 - RNA, 50652 nt, Mus musculus
cgggcggggacuuccgguuugggcggagcggcgggccgagggcggggccguguggaggaggaagcaggccaggccgggcggcggcucaccaggacgaaccauggacagccagggcaggaaggugguggugugcgacaacggcacugggguaaggcccggcggggcggccgcgugugugugcggggugcgcgcgggccccucggcugcgcggcugggcuucgggggcgcgggcaggcgcgcgggcgggcgagcucucggggggcgccggccggcccggagccgguggcccggagcuaggcuacccgcgcugcacccgaaggcggcggaaccuguccccgcgcgcucgcaagcauccgccggcgugccgagagaugggucuagacggugagaggcccugucccucgguggcgaggaggucuccauuuccgaggcucgccuguguucguccauacaagaccuagcggccuuccucuuccuguguagcgaaagaugccgaaugcgaggcaggaaacggguuccgcagagaaaagaggaagugcugucaggccccgggccgcggcuggagucugccccgggagagcgugugggcuguccuugucgucugugguuuugagagagggggauggucagcagcuccugcuucaccucuugcuuugcaugccgcccuauuauagaccuaggaccucucaaguaaauucuagugggaaguuggaucauuucugguuccuccucugcuucauuuuuuuuuucuguuaaguacaggauagacacguuagucuugaagaugcuaaaaaugucaaaauaagccuaaaguucugauucagaaaacucguugcaacugguuucuuucuauccccaguuaaaaggguggagcaucaaaguuccaguuuugaagaugcaacuguuucugacuccuuuagcgauuugcaacauuuugugacuuuucuccucucugccacagagacgacacacaaauuaaaauagauuuuacuugaauuacaccuuugaagccagauuguugaaaggggaaggagcugguauucacugccauuauagugcccuugguugaauuuguuacaaacuuugacaauuauuguacuagcuucauuuaagcuaaaucugggcuagaauaggauagguaacaauacaaagggacauccauaccacugcugugguaacagcccuaagauucaguaacuuaaagguuuuuaagcaaccccauuuaugugcucauuagagauauuuauauuugcagacuucaugaagggauacauaaaaugcaucucauuuuuugagauaaaggauaaagcagugagggaaaugguacaauuuuauaaagcuucuaaauuaucaggaaaaagguuuuuaaagcaaagccuguauuguuacacuauauuuaagcuaaauuauaaaugcuaaacuuuucagaaauucuuauaaaaguacuuauuaaaaaaaaaaaguaucuuacuaccaaagagacgucucagcaguuaggagcacugguuguucuugcugagaacccaaguuugaugccuaacaucuguguggcagcucacagcuauucuguaauucuaguucaaguguauucagugcucuuuucuggccucuguggguacuaggcauacaugugauacauauacaaacacucaaguaaacagacauaacacuuaaaguaacagugucuuaaaaguguuuuaaaaagggcugaagugauggcauacaucuuuuaugccaacacuugggaggcagaaaccggcaaauccccauggcuacauagggagacuccauccauuuuuauuuuuuuuuuuuuaaaucuguuucuuaggauaaaaagaucagcuacuauggcauaagugaaaggagaugauuuuaaaaaaaguuuuaugccaggugugguggcgcgccccuuuaauuccagcacuugggaggcagaggcaggcggauuucugaguucgaggccagccugaucuacaaagugaguuccaggacagccaaggauacacagagaaaaaaguuuuauaucuauuuuuguaauuauuuauaaacuuuauucacuuuuuuuguagauauguuugacugugaaugaaauagucggauccucauauacaucagcuaguucugauuuaaaucguaacgcaguuaggaauauugugaugucuuuuaagaaaacuugacgacuaauagcuacuuagauuuuggguuguuucuuaacuauuuauucuucuuuguucaucuuaguuuuacuuagguaccugaaguuauaaugaugccuuuacaauuaaauauuagagaagacauuaagacuugauuuuuuaaaacaguaauagaaaagggguuggggagauggcucaguggauaagcaccugacugaaucuccaggacccacguggaguggagcuggcacuguaacaccagugcuuccaccacaaggugggagacagagaaaggagaaccccaggaaguuuuugggcaagcuagagcuguaugcagcaguggacagcaaaggacaggugaaagaugaggaccagcacuugaaguuguccucugauuuccagaugugcaccauagcauacagucucccccacucugacauaugaauauacuuaccaucuagucacacacucaugggggcuggaguggagcucaguuaguagagugcuugccugaugcuugaggaacuggaggguccauccccagcacuguacuaucaaauguacguacuuguaauuucaugggagguagauacagaagcaucuuaaauccuuaauuaaauggugguuucauuuaccuuuuguauacuuuagauuuuaaaaugugagcuauuuaagaagguagauugguuuguuuuuuaugaugcuaaggauuauauccaaggauuuggaagauaaacguucuuucugagguguacccccagcccugaaaaguuaaaauuaaagaaaaaagguaaagauuuguuauauuuuuauauguauagguguuuugccugcauauauguauguauaccacaugcgugccugguggcccaagggagguuaauccucugguacugaacuuagagaugauuuugagguaccacguggguacugggacuggaugcuggauccuuugcaaaagcaaaugcucuuaaccacaucucuucagccccaagaaauuaagguuuuaaauguucuuuugaugaccuagaugcuugauccacucucuuuuccuauuauccauaacuagacucuugucucaguagcccagagaaggaaaccugcuuuuuagaauagggcuuugaaagugggcauuuagguaaaaagucugcauaccucuuuuauuuauuuguuuguuuguuuguuuguuuauuuauuuauuuauuguuuuuugagacaggguuucucuguauagccagggcuauccuggaacucacucuguagaccaggcuggccuugaacucagaaauccuccugccucugcuucccaagugcugggacuaaaggcaugagccaccacugcccaguccaucuggauaccucuuaacugaauuuugauuccuuucaaauugaguccagauucuugguguuaacauacagaauuaccagacuucaacagugacuucauugaccagauuucccaagugacuaccauguugaugacgcgaugcuuaauaaaguuuaaugauuguccauagacauuuauaaugcuaaaauucacauuugugguuguuuuaucaugcuucuacuaacauauguguuaaauuuaggaguauuuuaaguaaaaacaaaacaacuugaguuucaccauguggaagacuuuggucuaauagaacaaccauuggccucaaauaagaacggucacuaugaaguugaaauacaagcaccaccaauuauuaagggaaagaauacaaagcaaggaagcucaaaugggaguuuaaaaaucucagcaaggaaguggagagauagccuagcaguuaagagcacugucccacuguccccuaucccaucaacugcaugggggcucacaaccauuugaugcucucucugacaggaagauguacaugcagauagaguacucaugcauaaaauaaauaaaucuuuaaaaaaauuuuuuuuccgagacaggguuucucuguauaucccuggcuguccuggaacucacuuuguagaccaggcuggccucaaacucagaaaucugccugccucugccucccgagugcuggauuaaaagcaugcaccaccaccgcccggcuaaaauucuauauauguauauaucagucugguagagccugccugucaugccagugcuugggguggagaggcagaagcaucaggaauuuaaucucucuagucugggcggugugacuccuugucucaaaagacaagaaaauccugcuuggugcuacuuccagcauaugggaucaccacaaauucaaggguagccuggucuacagagugacauucugucuccagagguucagugaucauugcacacaagguaguagaaagaaugguagagcccaaggcagugguuagagccucgaggaaacagugcugcuggucgcacaggaacucaacagugacaacguguacaagaccgugcaaaccuaagccagagcaaguuccggcauggaggggaguuaggcaagaaguuccaccccaggcaaggagcuauggggaauuuagcugcugggaguggagggagagauacggacaucuucccuaccaauauagccccugauaagucagcuucccauauucccacggagcacugcauacucaagaaguuuuggacaaacuagccuggauggaaaagacaguugagugggaagggacgggguggggugguggaucuggggaagaguuggggcaggaaggugaaugugaucaaaacaugcgaaauucucaaaaaacuaauaaaauauuuuaaaaaugaaaguuuuugagucuuauuuaaggaaaauguugcauugauauugaauauagacaggucguuuguuccuuuuugucuuaaggaacauuauaccucuuacuguuugaugacucaguaggaaguagagagccugcucaaaccacagugcuacaaggaagaagcuauauaugguaaaaucuguuucuugaacacugccuguuacacucagugagggagcucagucaccagccuuaagaugauugacgugcaggacggauuucagugauuacaaugauaccacagaguagccuagaaaagaauaucuucuuuguauuuuguuaugacuuaacacuuuuuugaguuuuuuugaaggaauagcuugucaauuaauuuuacauuauugaauuugguuauuuuaauauuauuggaucuuaaugcauucagauuuguaauagugugagauagcuugguuuauacuguucugguggaaugucugauuccuuagagaaauguuggcauuggauucuaaggcagcaucugcuucuaccaagcugcugcuuaggcggaguagaagucaauagguguuuugauguuggcuuuugaaacaagggucuggagucugggcuagcauccaauuugccacauagccaaggauaaccuugaacucugaaagggucagagggaagaagagaaggaaaaagccauccuugaacuucugauccuccagccuccaccucuugugugccaucauguuugguuuauagguguuggagagcaaaccccaggcuuagugcauaguagaugagugcucugcucucugagcuacauuuccagccccaggaguaguuuauuagaaucuuccuuuuccuacuuagagucacuuucauugaaaagucuaauucccccguccgguuuugguuuugguuuugguaaagcagugauagugguuuauaauuguucauuccugugguuucagggaucgcaauuuuugucuucugagguacuuggaaaacauuuuuuuuuuccacuuaaaauaugcucaagaauguuaaaggcccuugagcugaucagcagguuaaggugcuugucaccaauccugacaacuugaguuugauuacugagacccauggaguggagggggacaaugugcuagagagcucaagugugugugccugcaaacacgguuucuaaaaauguacauuaaauucaaaauauguauauuuaaaaauuauguuuaugggugacuccugcaugccuuguguaguggaggccagaagagggcauuagaucuccuagaacuagaguuaccaacagguaugagcugccaugugugugcuggggauugaaccuggguccucuggaaaagcagccagugcucuuaacuccagccaauuaagaguuuuaagggggcuggcgagauggcucagugguuaagagcgucgacugcucuuccgaaggucccgaguucaaaucccagcaaccacaugguggcucacaaccauccguaaugaaaucugaugcccucuucuggagugucugaagacagcuacaguguacuuacauauaauaaauaaauaaaucuuaaaaagaaaaaaagaguuuuaagauaggaacuacccaucugcacaguuguagucaaaagacauuggugugacccuuugcuguuguguaaaugacagaccuaucaaccuuagcugucuccuucccucacuucgauuacccuuagcaaaaccccucucuccuauuuuuuuuuuuuuuuuugagacaggguuucucuuuguagcccuggcuguccuggaacucacucuguagaccaggcuggccucaaacucagaaauccgccugccucugccucccaagugcugggauuaaaggcguuugucaccacugcccaguacccucucucuucuuaaacuucugauuucucauguaacaaacuuauucauuuacauuuguuacacagaaaauguuuguuauaaacuguagaguagucuuucauucauucucuuccuggguuuugguuuccuuuuggaagugcuguuauuccaacccacuguccuguguaugguaagcaagcacuguaccacugagcuaaaacauuucuaauuuuuuuuuugagaucaguuauauccacauaagugaacauuuuauccugauaaauggguacuuuugacuugccuaaugucuauaucuguucuuuuauuuuauuuuuuaauuuacuucagacauaccaaaauagggcauuauaucucauuacaaugaugguugugagccaccaugugguugcugggaauugaacucagaaccucuggaagaggaaccagugcucuuaacugcugagccaugccuccagccucugacuuucuguauuuaaauaauauuuuagcuuuauauauucagaauguauauggaaauuaugacaggcuggugauggcagauuuuguaauaagauaugucuaugguagagauaugaugggaauauuuccucuuauuuuuguauuauuucagcucauuaucaacuaagcuggguuuugacaugagaaacagaaauguuauaauuuaggagaagggugagaaauuuuauauauuuguuuuggguuuugauagccugaguuggccuugaaccugcaaucuuucugcccuggacuccuccagagugggagaacuaguccugagcugccccacccagcaaggugcuauuccuuucuucugugguaauuguuuuccuaagucuuuuuagaucacaaucaauuauucaagaagacauugugggacuaugaacugaguucuguuaaacauuccuuugggguugugucuauacucuugguuucucuucugaaacacugucaacugaacaaguaggguaucugacuacauauacccuaagaccauacugacuugggcuuuaggagggagcccaagaaagauuauauugcacuuuuauuuaagacaaaaaucucacugugcaugaaauuuugguuggcuuggcaguuguguguagcucaagcugguccuuuuaagugcugggauuauaaacauguuccaucauaucaaccuauauaauaugcuuuuagaaauguguagcuuuaucugaaaaugccccagcuuugguagcgagacagugaacuaacuaggauuaagcuuugugaguuuggaacaaagcauuucaaaaauuugaguuucaggcauuuuuuucauaauuacuuuuauauacaauuuuaacauuuuugaaguucuguucaaaaagacagaauucuggauagcagaauguucuagagagggaauuuauaauuaaaagugauucaucaugauuuccaaaagggcugauguagagacagugaagauguugguauuuuggcaggauugauuuaagcucacauuacauagguuuguggaggucagaggacaacaugcaagacuugguucucuccuuccaccuuguggaauuaaaagaacugaggcacucaggcagacuauuagcaagugcccucacccucugagccaucuuacugacuaggacauuaauaauacccacauuugaggaagagaaccuuuauauucugcuggugggaauguaaaccuguugacuuacugcugaaauugaugagauuccucagaagacugcaaguacauaacagcugaagagagagauuuauugguaaaguacauuuccgacaauccugaggacgugaguuccaucccuagaaccuauggaaccaugauagcuugugauuguaaucucaguccugcagagggagagacagggcauccccuggccagccaguccaguccagucuagucgguaagucacagccgaugaccuaucuuaaaggaggucugagggugacaccagaaguuacccuguagugucugcauguaugcacaugggcacuugcaaacacuuguuuucaaaagauaaaaaauagaaguaaacaaucaaaugacacaguuauauugcccugugucaaauuacuccuguacuguuucuaauagccaacagaugaauugacaaaauauucugcauagucauaguagaauuucagccauaaaaaaaugaaaugucauuuucaggaagauaggugcagcuagagaugauauuaagugaaaaggucagacuaaagacagacgccaugcuuucguuuguggaucauaaguuuuuuauagauguacagaaucacuuuuuuacauuucaugaaagaagugaaacucugagccaacagaaggcauuagcagaaggaagggaacggggaggcuauggaaggaggcugguuaaaguacacaguauacuuacaugaauacacaucgaacaucaguguaauauuuucuguuucuguuuaguuucuuugguuugcuugagucaaaagucucaugauauagcacagguugcccuuggacuuguaaacaauccucuucccucagcuuuccagguuaaacuguauggcaccaacuuggcuuucugucccuuugcauuauucccaauguguguaucuccaguacuguucuucacuuuaguucuucuaaaaguguaugguaccuggugccacagaacaguagauguuuccuauagagaauugauucauuccauuccccugugcacccacgcacaugugugcuuguaguuguucauaagguagcauaauaucuguauauuacuucaguaauuaccuaacucaauacuguuguaguuauuuaugauuuugagacaggaucucauguaguccaggcuggccucaaaguuccguauguuaaguuugggcggcuaaggcuggccuugaacuauuuauucuaccaaccaccuccagagugcuagaauuaugggaauauaccaucauucgcaguccuaauacaauguaaaugucauaugaauaguuauuuuguaguguuuagggaauaacgguaaggugaaagguauuuucagauaugauuuaaauauuuuuuacuccacuuauuugugaauggauagccaugcacaugcuacaguuuauauguguuguguccggccagcagaccacaaccauauguagaggacaaaggacaauuuuguggaaauugauucucugcuuccagggugugagucuuuuaagauugaacucagcuucucagguugggcaguguauuagucaggguucucuagagucacagaacuuauggauagucucuauauaguaaaggaauuuauugaugacuuacagucugcaguccaauucccaacaaugguucaguaguagcugugaauggaaguccaaggaucuagcaguugcucagucucacacggcaagcaggugagggagcaagagcgagacucccuucuuccaauguccuuauauggucuccagcagaagguguagcucagauuaaagguauguuccaccacaccuuuaaucccaaaugaucuugaacucaggucucccugucuuaaccuucuggaauccauagccacuaugucucaagaucuccauaccaagauccagaucagaaacuuuuaucucucagccucuagauaagggucacuggugagccuuccaauucuggauuggcguucauuccaaauauagucaaguugacagccaggaauagccacuacaggcagcaaaugccuuuaccuccuaagacaucauauuggcccauguuuagucgagcccauggauaggaaacucaccagcucuauuuguauuuuaaaauuaucauaaucucaugcuuguaaauuaacaauucuuuuuaauacuaccaauaguuauuuaauaugcuccucuuauaugucaaacucugauguaggcauuuucauuaaacacaaaaaucauaauuuaacaugcaguggacaaagacuuuauuuuauuaauguuguggagacuuugacaggguuuucuuuguugauacaguaucuuccuguguauuagcuauuuucugaucauuggaucaguuucucauugaaguaacuuagaagagcaagggcaugaaccacucagcuuagcucccugcuugaacaacuuuccuucugggaauacuucaccaugaaggaagcaguuacccugaaacuaaaccugaacucugugcuggcuaguuuuaugucaacuugacacaagcuuagaagacgaagagcuuauuuuggcuuauuugagagaagggaaccucaauugagaaaaugagucuguaagaugagguuguagguaaggcuguaggguauuuucuuaauuagugauugaugguggaggcuccaguccaguccuaggauggcaccacccacaaugaugguccuggguucuauaagaaagcagguggaggagcaagcugugaggagcaagccaguaagcagcacacuccauggccucuguaucagcucaugccuuaaggaauccaguccuguuugaguuucugcccugacuuccuuaagugauaaacuaugauguagaagaguaagccgaauaaacccuuuucucccaaaguugcuuuguuuaugauguuccaucucagcaauagaaacccuaacuaacauaagcucugaaaguacuugguaccuaggagaacuuaaagagaugauacuaggaauagaaugggugacuacuucggauggugugauagcauagugauguuuucugauacuguugguuuuuuuuuuuuuuuuuuuuuuuuuuuuucugagacacgauuucucuguguaguccuggcuguccuggaacucacuucuaacaccuacuaaaagccaggguaagcaaggcauucugggaggcgauccagcaggcacaaauguaucagcuuuggccuccccaaaauucuaauggaugggauggaaagacgaugguccugacugagauagggaugaaggcaaaagcucauccauucucuggaagcuuccugggcacugcuggguaaggcacuggcaucauggcaagagaagaaaugaucucaauaggaguccuguagggggcccuugccuccuuccuccagaacuaucaaaaucucaaguguucugacaguccuccaggcuggccucgaacucagaaauccgccugccucugccucccaagugcugggaucaaaggcaugcgccaccacucccggcuuugauacuguuuuuaaauaacuguaguaaaugcuuggauacuaaccugcuuuuucuguuuccuuccaguuugugaaguguggauaugcaggcucuaauuuuccagaacacaucuucccagcuuugguuggaagaccuauuaucagaucaaccaccaaagugggaaacauugaaaucaagguaaucuuuuauucauuguuaaauguccgugaggauguuugaggugaucuuugaacuaaguaauguaaaguacaaggucaagaaaagcaaagggagggucagaaccucucauaauuuuaauguaaacaaaggcaaaaaagaucccuaagguuaauuuuuaucuucuucguuuauguauagcaugguauaccauuauuauauggaguauaaaauguaaguuuuuaaaauuagguacaaaauugauacauauuagugccguaaagucuucuugcauaguuuaauuugaaaaaacaaaaaacaaaaaacacaaacgagccuggcagucuuauguuuugcaguuguuagugucuuagugccucugagacuugaggcuuuauucuccguguugucauaggcuggcccuccuccucuuucuauagagugagacaggaaaacacagaggucuagacuggcucuucucacccuuacaguucauuuuucauaauaugcuggaggaagccauucuuuauuuggucuuacacuauaggucuuaccauauggaagacaagggcaaauugucauuagccaaaguacuuuacaugagagacucaacacauuuuucucccacagaacuagaauucaagcagaaaucacguuauuuucuaagaaauagaguaauugagagaucaccaauugacuuuaaauucugaauguggccaggguucaaguuacaaaacauacuuuuagaguuuagggacuuuuuaaaaaugggauuuuuuuuuccauuuguuuuguggguaguuaacauuguugguccuguugggacagucuuuggcaagacuuaguaggguguacaucuuugagacauuugaggggcugagaaaggugauagcugguguuaauugcuguuaauugcugauguaggcuucuguguucuaggucucuaguagggaguuagagaaugaguuacaugauggauaaaaauuaacauggaaacugagguucuguguuuguuuuuaaaaaccuaaaagugaauucugcccuuugguagguuucaaaaacuuaagugguucguucaguguaagauaguuaagaaaaggccuuaagggaaauuuugcuggauucuuuuuucucuuuucauaaauuuuuauucugauugaauuuuaucuuuucuuuucuuggagacaaggucucacuauguagucuaggcuggccugaacucagagagcugccucugccuccaaguguaggauuaaaggcauguaucaggacaucugucacauucugucuuggaagaacuucagcuugaaacuuagcuaguagugugaugcagggaacugagugacagcaguaccuuucauuuuguaauuuaguagcuggcuuuaaacauuuuuauggaugauaacauuuuugagguucagagaaauauaaccauuauuuauauauuucccagcaugagagaaacaacacauuucuucacaccugcuuucuugguuuuuaauuuaaggccaagugauagaaaugagcaguuuucuugggagacuuuucccagggacuacccaguggccuugcugauacagugcuucagucuguguuuuguuacuuuagaucuuuucacuuugcucuuuuaagccuuucaaguuaaauggcuuuccuuucacaugaauacuaggguuuagauaaacacuccugaacuaacucuuacagaccuaggccuuugcuguuaccauguauuuuccuuaauugaaguuauuaaauucaauaaugaacuacguuugacauuuuggaauuccugugcauagaaaauugacuuauauuuguaugucuguuagcuaaaauaugauaguagacuaaaaacuauggaaauuuaaaucauuuauguaguuaauuuucaguuagaaguaauuacuguccauguucauuuggcccugauaauuaacuccauaaguuauagugguacugcaucugaccucagccuaauuugucucuguugcuuguguguuuaaacauuucagugaggauuuuauguaggccuuuucugacucuugcuucuaccuucucuuucuucaccuuucuugaccuguugaaguagaauaacaaaaagaugguaagugagguuacacacaugcucucuguuuguuuuccacuuugcuuggugggacaguaguuguugguuugugucccuuuaguauggggagggggaggaaaauccuuauuuuuguuugagugcuuuaauuucuagcccuuuuuauuucuucaauuugguagcaacuaauaaagucuuauacuuuccugauugcauacaaugaaccaaacaagaacuaauuacuaacauaguuuugaauuguuuuccuuauuuuuuuuuguagaugaauguuauaauuaaaauggaauguggugugcauaauacagaaaugaaguagcuaugugauagagacagaaaauggggguuauuuguuauauuuggagacucaguuuauugauugauguuauauauugccuaucauacugagggcuauauuuguagucaguacaaaaucauauauguauuugguaagcugaguaaaaauuuaaugugcaaaugaaacguaaaugaaaaaaaaaaauaacaacagaaaaccgguucccaugucauccuuacugaugaauagauuugauauuaucugagaauuaaaaaaaaaaacaaaaaacaaaaaaaacccaaaacauaccaaucaggcuuucauacaaauaaagggcacacacacagauacuauuguguggacccuccccuuuuaaaaacaaacaaacaaacaaacaaacaaacuagaggcuugcugggccugucucagacauuaauguguuauugcauuuuucugugguaguguuuaaaauucuuacuuuuuuuucugcauaaagagcaugcauuuaucuuagauacuaaagaguuuuuuagaaaagguguaguuguagagaauaguauggucauaauuuuaaaguuuuuuuuaaaaucagaaauagauauagaaauagaaaugucucauugguauuauaaauauauuuguuccuucaguauaaaaauaaauuucucaauauucuggguggagagaaagaacgucuuuugagacaaccucacucuauaaccuguacucuugccugcuuuuuccugguuucauaguuuccuuguaggaauggaauugugguuuagagcuuuaauuuuuuuuuucugucuuuuaguucagagugacauuguucaaaaucauuuuuggcaaacauaaucuaacuguauaaauggcuuaaaagcagugacucggucacugaguuuucaaguagugggugagguuuaguccugaccuccaguggugggaaacagugaagacucaagaguucucugagugaacauguccugcuugguucugacgagaggagggacauuugaaagcugaaagauucuagggaagaguuuagauguucuagguuuuguuugauugguugguuggucuuuuguuuuuguuuuuucugcagacagguuuuuauauagcuuaggcuggcgucagucuucucguggaaccuaggauagagauaguguugagcuucugauuuuccugccucgaucaagagugcugggauuacaagcuugugccaacucuuggcuguuuaguguuuugaucuguggucucccuauguaacccaggcugagcuugaacucucaggcagucuucauuuuccuacccuaggccuugugugccugcuacaccauaccuguuagucauugccuuuucuuuuguuuuugguuuuugacaaaauuccauguaucucaagccggccuucuacuuuugauccucuugccucuaccucccagucuaccucuguaagaguacagaccgugugccaucacgcucgccugauuuuaggucaugccaagguggaacccagggcuuuccugcaugcuaagcaagcacuauaccaaaugugcaacaccacuggccuguuggagaguuuaaagcaaugguucucaaccuuccuaacaccaugacccuuuaauacacuuccacauuuuuagugauucccaacuauaaaauuauuuuacuacuucauagcuguaauuuuuauacuguuaugaaucauaauguaaauaucugauaaguaaaauaucugauauguggauuaucccccccccaaggggucuugacccacagguugagaaccauggguuuaaaauuaauuuuagcaacagauuuucauaaagucccuugaaguuauacucuucauuuuuuuuaaagguuuacuuauuaauguaaguacacuauagcugucuucagacacuccagaagagggcgucagaucuuguuacggaugguugugagccaucaugugguuucugggauuugaacucaggaacuucagaagagcaaucagugcucuuaaccgcugagcaaucucuccaguccccacucuuccauuuuuuaaauguccuuuuuguuuagagggaacuaaggguacucagcgucaggugucccuuacaguuaauauuucguaauaugugugguccuaggagaagauucacgaggcuuuaauuuugauuuguuauaaaauaagcaucuauaacccuuuucuuacaaagaauuaaaaacuaagcauucuauugacauuggaucauacuuaaucgaaauugauugaaauaauggugauuacuaaucaauuaucuaagucaauugucuuguauaauacaaugagaaauauuaucauaggagcaaauaaaaaauugguaugaaaguauacuuguuaauagccaaaguagcauauagauuucuucccuauuuuauauuaaauguucagcacauacauuuauguuaaacagguuuuacagaccccuccauauaccucucaccuagauuccaguauuaauauuuauuauucuaagccacaccuuuaaucccacuuuaauccuaacacuugggaggcagaggcaggcagaucucuguguguuugaggcuagccuggucuacauggagaguuccaggacagccagggcuaccguagauggacccugucucaaaaauauuuaucauucuggguaauuacauaccuagucuuccaucaaaaugccuugguuuuauuuguuuugcuguguuauaaguuacagauaguaguaaacuuccccaugcaugccuguacccagaguccacaguauagaacuuuccagcuuugucuuuccagucugaacggcugagagucaagaaacuugaguguuggcuugggggaauugacuuuauaaggaauugguugcaacagaaggcuguagugaacucugcuuuuuuuucuuuugccauuaguguauuuuccaaaaaucugucuucaauaggcucugcauccuggcuuucaaggcuaaaauuacuuuucugaaacauuucuaguucagauuuuuucuuuuucccagugcuacagauugaacccagggccuuacacaugcuaagcaagcacuccuaccacuagagauauauccccacccuuaaaguucauauuuguuugaaguuuuguuuacaucuucucauguuggcuuugucauuuuuuccuuuauuuccccauaauuugaacuuguuuuuauacaccaaauaguagcuauuucugguacuaauuucuaauuggauucaucaacagaggucuauuucuaaaauguuuaaauauuagaauauugcuugccuuguuaugcauacaaaguuuuuuuuuuauuuaaaugugggucacuuuaaauaugcucucauuggagacagauugugaguauugggcuucaugaaagauagcauugauuuucaauauuauacuucaagauuaaaaauguugcccaugagauaacucuaaaagagcuguuuuaauucauacacauauagacuuuugugaaguuuguuaauuggguguauauguauguguaugaugcauuguuauagaggaaugaagaaucaugguuuuugcaucuacauuucuauaaaucauuuugauaggaaagaacugugcuugugugcauugagcauuucucaaguuucccccugaugugcuauuucacaugucacaggacuuaauuuuuugaacauuugagcaaaagaaacagaugaaaccucauacaaacccuucaaaauaugaaaauauggguuuuauuugugcuaaugcucuucuuuuggaaacauguauuaaagguaaggucaauuuauugauuuaaacacauaguauauaaaauauugauuuaacucuguaagcuggucuugaaagaaaagauuuuuaacuuuuaaguaaaaaaacuugaucugcaaguuccagaaaguuuaaaauugaaucauuccugaguuuucugagcugcaggaauaucauuuucuaaaacuucuuuauguaaaguuuuaaagcuuugauaucucaucuuguaggaccuuaugguuggugaugaggcaagugagcugcguuccauguuggaagugaacuaccccauggagaauggcaucgugcggaauugggaugacaugaagcaccugugggacuacacauuuggaccagagaaacucaauauagacaccagaaacugcaagauuuuacuuacagaaccucccaugaauccaaccaaaaacagagagaagauuguagagguaaguuuugauuggcuagcauaauauccauguguaucucugaaagaauguuaaaucgguuuuuuuucuucuugcugcuucugcugcaaaggauaaguaaaacaacuguuuugcccuagaucccgauuauuuugcauguacucaucugaaaucugaagaccauguuagcgaugcacaugaaacugaauuuuggagcauuguagauuuuggaguuuuggaguaagggaacucaacugguaaauguaaaugggcaaauauuacaaaaucuaaaagcagaagucucucucuggcccccagcauuuuggauaagggacagugaacauguaugugcuaguagaugagacugcucuucucucccuaaguuaggugauugaguuaaguaguuuauuagaaagcaguugaucuaguggaaaaauagugaaguuaggagagugagaaguuguggugauaagccuuucauugugacagugcuguuuaauaaagacaagcuaaggaagcugcuggguagcagggaaagggcaucccaaggcagagagaagagcuagcuuggcaucuguauacuugagagcaggcaagcggcugcuauggcuggagggccuaggaaggggauggcugaagaaacaagcuagaguaaguaguaguaccuugcugguuucuguaggagcuggccuggggcagugcgggcaggagggggcugcuguagcuaagguuuagaguuugccgugaguaugccacagagagacagcagaagagacaccaacuuagagacuuugacaguauguacaugaaagaucaugauggguaggaucaggagugguaguagaaaugugagaaauaccaaauuguuaguguacuuugaaggagguaggccuaaaggauuuucuuaugguuuaaauacagggggcacuuggagaaaguuuccauuugaguaauuagaaggaaugaggaaaagcugagaauagcagaaugggauuuaaggcagugaucaggaagaguuuauuuuagauauguucaaguuugagguccuuauuaaacaucugcauagaagugacaauacguguauguauguguguguguguguguguguguguguguguguguguguguguguguguacacguguguauaaacaaagaguucaggaaaauagaguggaauucaagauaaaagcuuaaaagucuuuggaaucuagaggguacuuuucacaaagcagugaggagaaagugguaagaaggcaggaccuguaaaagagaucgaaagcuauugagguaagggcaggcaggagagcugcagucuucauuuaauaacagacuuuggaggacuugauauaugccuacacagcagcagcaacuuccuuauuaaauagaugcuggaauagaauguuaauugaugaagauguauuccaaaguuguaagacugaaguucuguauaguuaucauugcaaucaguuauugauaucuagauauucagugauugcccuaccagucaaagagugcuuaagugggugaacaaaacacaucauccaagguuuacucaauugauuuggaugcagagaaugagcacaggugugaccagagagagcccaagaaaaugcugccucccuccaguguaguucauugugaaggggguuacaaucuggacucaaauagaggcagugggcugggcagcugagccaccucugcaucugacaaguuaguauuuuaauguuugucuucaccucauuuuuccagccauccauucagccguccggccagccagccagcccacugcuagggaaucacacccagaguuucauucaagcuagaaagagcucuucuacugaauuacauacauccccaguccuguuucuuuuauuacuuguuuuuaauugccagggguuggggagggggagcuagagccaguuuugaccuugcuugggggaaauaagcagauguuuuuuucuuuuucuuuuucuuuucuucauuuauuugguguguguuuauguguaggugcaugugcacacuuggguauccauggauggacaauuuguggggagguuuuucccucuaccauguggguucuggagauugaacuuuagcugcugagccauuucucuaguccuaagauaugucuuuuuauuucuuuaaucugauuucuuuuuacauuaaugcuuuugucuguguguauaugugagagugcacaggcacaaugagcaccaccuugugugucugcaggugaaaggacaccugugagaaucagcuuucucuuucccguguggguccuaagcgccuguacuggcugaguaaucuugcuggucccaggcagguguguguuuguuugcagugucaguuuacuacauuuuuuuuuaaagauuuauuuauuuauuauauguaaguacacuguagcugucuucagacacuccagaagagggcgucagaucuuguuacagaugguugugagccaccaugugguugcugggauuugaacuucagaccuucggaagagcagucgggugcucuuacccacugagccaucucaccagcccccaguuuacuacauuuugugugaugcuuucuuucauacugguuagccacugacuauaauauauucagaagucuuuguuuuguagcacuuacaagacucaacucagauguuuauaugugcuugcaugcagacauauuaguauccagaacucugcccuaauaacugagguagagguaggcuuuauaagggcaagaagaacugguuagaauggaugcucaggguccuuugguggcaccuaaaucaacugaucuguauuucgagcaugaaggaaauaaauaaauguguauagaguuuucucuauaaaccaccucccucuuuuccuucucuuuccauuuucagguaauguuugaaacuuaccaguuuucugguguguauguagccauccaggcaguucugacuuuguaugcucaagguaaguaaaguaagcuuaacuguuaggaaaauuaauucagcaaauacuauaugccacagaaauuuuuuuuucuuuuuuuuuuuuuaauuuuuauuuauuauuauauguaaguacacuguagcugucuucagacacaccagaagagggagucagaucuuguuacggaugguugugagccaccaugugguugcugggauuugaacucuggaccuucagaagagcagucgggugcucuuacccacugagccaucucaccagcccccgccacagaaauuuaauuugucaccaaaguccauuacuagggagcuggagaguugacucagugguuaagugaguucuugugaaggccucagguuccucuguguggauccauggaggcucacagcccucugucugugacucugguuccagagguuccaguggccuuuucugcccuccaggggcacuuaaugcaccugguacacagacacacauucaguuguuguuaucccugguuguuagguagaugauggggauccacacccaggucuucaugcuuguguagcaagcacuguaccuccugagccucuugcccagcccacagcuacaaucuuugucauuugucacaacagugccauuacaugcacuucauuaaauaagaaccuaggcugaaagugacaucagguuuuuaaaaaauaguguauuuuuuucuuuuaaacuauuucaacauuuuauacaccaagagagacuacagaugccucaucaauuaagagcacuggcuuuucuuccagacgacccagguuuaauucccagcaccuugaaguggcucacaacuguaauuucaguucugauguccuuuucuggccuccuugggcacuugcaggcauguaguacauagacacacauguaggcaacaccuccauacacaaaauaagaauaaauuaaaguaaaaccuuuauugaaaauaaacagaauuuguccucagaauuggcuugauuuuguuuguuuguuugcuugcuugcuugcuuaaaaauuuuuaaagaauuagugugcuggguagcuuuaugucaucuugagggaaccucaguuaagaaaauggugacccaccccuuuaaucucagaauuugggaggcagaggcagguggaucuuugagaucaaggccagccuggucuacagagagaguucuaggauagccagggcuccaaagagaaauccugucuggaaaaaaauaauaaugcuucuauaagauggggcuagaggcaaagccuauagggaauuuuuuuaauuagugauugauugggguuaggguagcagcucacuguguguggugccaacccugggcuggggguccuggguucucuaagaaaagcugaagcuggguggcgcucgccuucagucccagcacucugcgcagauguugguggaucucuugaguuugaggcuagccuggucuacagagugaguucuaaaacagccacgacuauacagaauaagaaggagagaggguugggggagcaagucaguaaacagcauucuuucauggccucuggauggguuccugccuccagguuccugccaugaguuccugcccuuacuuucuuugaugaugagcagugagccaaguugucuuuggucaugguguucuaucacagcaacaguaaccaagacaccacacacaaaucuuacuggucauccagcagcugggagggaggcaaaggcauauagauggcugugaguuccaggugaagcuuaucuguacagugaguuguagaccagcuagugcucccuagugaaacccuauaucuauauagaaagcaaaagcacauguacuagucaacugcacaguaaguuggggaggaaacauuuuggaacacauuccuaaugagucaguuuuaaugagagaaacuguucucauucucucucucucucucucucucucucucucucucucucucucucucucucauucaguuuuugaaauaguuauaucauuucccccuucccuuuccuccucuaacacuucuuguguauucuguuuuguuucucagauccauggcuucuucucuuucccccucccuccaucccucccuccuucuuuuccuuccucccucccuuucuccuuucuuuccucccucccuuguuuuucaaaacaacauuucucuguguagcccuggcuuauccuggaacucacucuauagaucaaccuggccuauagaguucugcuuccuaagugcugggaucagaggcaugugccaccacugccccacgauuuucuuuguuguuguucuuuuuucuuuguuguuguuguuguuguguguguuccuuaauauauaaauacagcuugcucagucuguauuuguuacuuguauacauguuuuuauuugguauuguauaaccaguugguguguucuuugggaaggaccauuucaguggugcaucauuccuuaguuuccuguaauucuuugucuagaauugaagccucauacauuuuccccuuuccacauuacuaugucucuuggugucauccuugucccggucauguuuaggcaucugcagccguauugaugacacuucaugggucugcauggguucuuuugauaauguuauuagcaacugcccucacuguccuuuguuuuauguauuuguguauauucgcauguuugugccagugucugcagaggucaaagagagcuuuggaucuucuggagcuggaaaauauaggcaguugugagucaccugauguggguauuagaaaccagacuuuggguucuuugcaagaguaucaagugcugucaacuacuggaccauuucuccagccucuaguuuauuuguaugugugcucaugugagcggacaucugcauccauauguaggauagaggacaacuugaaggaauagauuucuuuucuuaugcuacauagauccagguggcaugcaucuuuauguggugagcccaucuugccagucucucucccugucuauuuagcacaaaacauuucccacaugggaagagcucuuuggauuuugauggucuuaauucaccaaaacauagcugagaauuuauaggguuuucaauauguucaaaggaaucuuuggcauuugaaguauaaagguaccucaagaaaguucuuaacuggaaagauucaggaacauaauuuugauuuagcauaucaaagagucuuccugaaggaggaguuaccugaauucucaguguggggcacauacugguaaggauuguauucuuuuguuucaagugguucuuuuguaacuuuaagagaucaauuuuauuuugagcuccauaauucuacauguagguuaguaaaaaugcacacuuuauuuacuuuuuugagacaagagucucccuguauacccuuggcuaucugaacucacuguguaaaccaggcuagucuuaaacuccuagcugcuauccugccucagccucaugagggugugcaucaacacgccuggaugaacuguuccugccuuugguuuuguuuuguuuuguugguuuuugguuuuugguuuuuugguuuuuggagacaggguuucucuguauagcucuggcuguccuggagcucacuuuguagaccaggcuggccuugaacucagaaaucugccugccucugccucccgagagcugggauuaaaggcgugcaccaccaugcccggcucugucuuuguuuuaaauuauaguauuaaauauagguauuuauuuagaaggcacucaaggacauuuuuaaaaaaauguuuacuugguuuuguguguaugugugugcacgcgggcaaacauaccaugucaacauucacaagucugcaaaggucagaagaggugucagauccucuggaacuggaguuagagauuauugaaaacugccaugugguucuggggaacagaugcauguaguuccucuguagugcucuuaacaggaaauuaauuuuuggguuuucuuuuuggaugggaguuguuguuguuugaaacacgguccagggucucacuauaaaacccuggcuauccagaaacuugcuguauaaaccaggcuggcuugaacucacagacauccaccugcuuuugccuccugaguccuggaacauuaugugccaccauuucugguggaaauuaauuuuuaaagcuauauuuaguuacuaacuauaauaugucuuauauucuauuugauauagaaaauguuucuaaaugagauagacacaguuucuuugcucuuaaggugauaauagucuagcuguaauuuuucuuuuuuuuuuuuuuuuuuuuaaagauuuauuuauuauuauauguaaguacacuguagcugucuucagacacaccagaagagggagucagaucuuguuacagaugguugugagccaccaugugguugcugggauuugaacucuggaccuucggaagagcagucgggugcucuuacccacugagccaucucaccagcccccuagcuguaauuuuucauuugaaggggaaaaaaucacauguucugucaagagagggaaaaauguuugucuagauaaguccacaucuggauaauuuuacuacuugaaauuuguauauuuguguaugagcacaugcauauaugugccauagcauuucauguggauagguggacaacaggaggagucaguucucugugccauggcagauucagagcucaaacucagguccucagguugggcaggaagcacuuacaccccugaaccacaccauaagcuucauuuucccuucuucccuucuuccacccauucuucauuuuaaaauagaacuugcagagggauuuacuggcugauuucccagaggguuugaguuaaauuccuagcauuuauguggugacacacagccuuauguaacucuaguuucaggaucugauguccacucauguccuacacaggcacuaggcacacaacuagugaacaugcaaacaaaagauccaugcacauaaaacuaaaguuaaagaauuuaauaacuuguauaaauacuuuuauaaucaucaauuuugggaaguuuaaaaggucuaagcuugaaccuguaaugagagauccauguugggaaaggaugaguuauuuuauauaugucaguguuuuguuugcauguauguaugugcucuguguacaugccugguguacagaagccagcaccagaucuguaacuagaguuacugacaguugugaguuacacuguagauguugggacccuauguggguccuacaagagcaguaaauauggagccaucucucuagcuacccuaaaguaauuuuuaggaaaacugauguuaauauguuuuccuaguaacauuuauaaauuaaucucugacaagugaggagauagccuaucuuaauuacuuauauuuugcugcugcugcuucuuuugguggggggcaggggguucaagaugguuuuucuguguaaaccuggcuguccuggaauucaaucuguagaucugcuggccucaaacucagagacccaccugucucugucucucaaaugcuaggauuaagaugugcgccgccaccaccaggcuguauuuggacauuuuuauguaacuauuaacaccuuaacuuugagaagcaguagcccaguaaaauuaaugaaauaacuacaagccaugcuuuuuucuaacuuguggcuaauguuuucagagaaaaagaagagagauaucuuuaugguuaagagcacuugcuguucuugcaaaggacuugauuucaguucccagcuccuaggucagacagcuuacgagcauauacaacucuagcuccaggagacugggugggugcucuuuucuggucuccauaggcacuguacucaugugcacacacaugcucacagaaauacaugauaaagagaaauuuuaacaacaaccaccguuguuaccauuccaaccuguagaaauuuuuuuuugaauaagaagugaccugguguuuuaggaagggguuucuaucugcauggucuaguuuggguggauagaagagauuaauuggaauugggaaaucucagagguuugaauggucucugacacaggaaagaguaggaauuuaaaagacacaacccagugacaaaaggguauggcacuagaaaugaugacuaaagacuccuguuucucuuuuuuccaauaggaagucuucagggcuggagagauaggacaguggcuauaugcuagccucuaaagcuugaggcccuuaguugagaucaccagcacccacauaaaagccacaaccauaccggccuguaauccuaguacuggagaggucaagauugaguccuuguuggccaggcagucugucuugauugguggcuucagguucaguaaaaaaaagugagugcuggagaauuagcuuagugguuaaacucacaagaacaugauaucagacaccagcacccauguaaagccacguauccuucuaaccacagcucugauagaugugaagucaggaggauugcuggggcuugcuggcuuccaaagagagagauacaagaggauaccuaucugaugcguccagguacauagacauacagaaauaaacaagcaaauaaauccuucaaaacauaguaagguggcgagcacuugaggaagacagacagugccaacccucaguccccugcagguaccgaggacacacaacugaccagacaguaucuucuuuggaagaucaggauugaaaaauaguaguguuaugaggcauuaaucuguggggggugaacagauuguuucaauuuaaaauagggauguuuaugaauuuauguuugucaaagauaaauaugcaaacuuauuuaagaaaaugagaguaagcauauuuauggugauaugucauaccauaggcaaauuuauauaauaagaaaaugaaagggagagagaugagaaaguaauaaaauauauauuauaguuuuaaaaugugaguuaaaacagacuugccaaauggcucaccagguaaagaaguuuaauucucugguuucuacauaaggguggaaggagagaucugacucuacaaaauuguccucugcuugcuacaugugugcugaguucuuacugugaguucuuagaaguucuguuuuucccauuuuuuuugaaauaauguuucauguagcccuggcuggccuucaacuccccauauaacucaggaagacuuaaaacuacuauuuuuuuuuuagucaggguuucacuguguguagccauggcuguccuggaccuugcuguguagaccacgguaguccugcuugccucugucuccaaaaugcuggauuagaggugugugccaaccugaccuaaaacuugucauuuuugucuuccaagugcugggauuacaggcucuuuccacuaugccagcuagaaagggcguuuccccuuagaauugacucuuggcuuuuuucaaccuuuuucuuuucuuuucuuuuuuuuuuuuuuuuuaauguuagccaugauggcccacaccuuuaauuacagcacucaggaggcaaaacuagggauacacagagaaacccuuuuucaaaaccaaaacaucaauaauaaugaugaugauagggcuggcgagauggcucaggggguaagagcacugacugcucuuccgaagguccugaguucaaaucccagcaaucacaugguagcucacaaccauccauaaugagaucugaugcccucuucuggugugucugaagacagcuacaguguacuuauuuauaauaauaaauaaaucuuuggaccugagcggggccaaccagagcaaagcagagguacuaaucaauucccaacaaccacaugaaggcucacaaccaucuaucuauacaguuaaaguguacucaaaaacauaaaauaaauaaaucuuuaaaaugauguugauauauuaguaguggaagucuuuuaaugacauuauuauuauuauuacuuauuacugcuguagguuggagaugacucagugcuuaagagcacuugcuauucuuccugagauccugaguucaauuccuaguuacccauguuggguggcucacaauugccuguaaccgcaugcccuuuugugacuauggcagcuguacauacacacaaguacacacacgcacgcacacacacacaagaaaacuauauauauuuaaaauaacuauauuacaguuguuaacaguagcaguauuuguggguggggagugauacuaaugccacguguacauuuagaggucagggcaacccuguggguugguucucuccucccacuguaacaugaguuccagagcuagcucacuucaccaggcuugcuguacagaguaugccccacacugcacaccugugauuccagucuguagccccauggcucaggcugcugaggcaguaugauuacgauuucuuggcuaggcugagacugccuuaaguaacaacaaaaaauaaaucuuuucaguggcaaacaggaacuacggcagcuugucucauugucacuguuguugcuuauaggguuuuggcuggggaucccuccuaggccuuacauaggauaggcucacacauuaccucgccggccaucacaggcuuuuguuguuguugaugguauuuuucuuuuucuuuuucuuucuuuuuuuuuuaaauaaacaacauuucuuuuuuauuagauauuuucuuuauauacauuucaaaugcuaucccaaagguucccuauacccucccuccgcccugcuccccuacccacccacucccacuucuuggcccugacauuccccuguacuggggcauauaaaguuugcaagaccaagggcccucucuucccaguaauggccgacuaggccaucuucugcuacauaugcagcuagagacacaagcucuggggguacugguuaguucauauaguuguucuaccuauaggguugcagaccccuucagcuccuugggugcuuucucuggcuucuccauugggggcccuguguuccaucuuacagaugacugugagcauccacuucuguguuuuucuuuuguuuugagauggugccugacucuagcucuggcugucuaggaacucuagucauccuuuaaauagaagagugagggguggaguuuuucucugcuagaggccuuguuuuggguuuuuuuugagauagguaacguagaguuucugguucuucaaucacaagccuucugaaagcugguuucugguaugagcaccagcgcugaccaggugaucuuagcagauucacuuacugucuuguaacuggguuaauagucacuuuucccaguuguuuccuguaaauguaauuuuuauucuccuguaguaguuacugucgcugaggcuuaccgcccucugcugaccuaggccugguccuggaagcuuucagccucagagacuuacugcuggguaagcucgcccucagccucagagacuuacugcuggguaagcucgcccucagccucagagacuuacugcuggguaagcucgcccuuuauaguucuuucugagcucugccuggcagguucugcguggccucauacuaacuuuggcagucaguucuagucuucaggcuucuucucauucucuggcucgcucugucuuuccugugucugccuuguucucucugcaaccugucucucuauaacuagacaagucaaauuaccucccucuugugagaguugggcauacccuauucugccaaauuuuucucuaauucgucauguuguuacuuaguuaggcaucacuuucaaacacaggagcuuucuucuacaaacuaacuuuaccuuuauuguuagauuaaagguauguguuaagggcccuuaacaccagggcaagaugaguuuggguaaugccacuuagcaccaagucugaaaccugaguuccauccuuggccacacuuggcggcaggagagaaccagccccugcacuugccccauguugucuucugacuucacacgcaccauauggcaugcauguuccccucccuuccccuccacgccacauguaagucaaauacaaagaaagaaagucuucagggagcaaaugcugccugccaucugugauuagaaauuaagugcugaaguugagccuaggggcacacaccguuagucccagugcucagaggcagaggaagaggcagaggcagaagcaggaagaucucugugaauaugaggccagucuggucuauauagcaaguuccaggauagccaggaauacauaaaaagaccugucuugagaaaaacaaaacgagaagaaaugggggcuggagagaaggcucagcaguuaggagcauugaaugcucuuccagaggaccugcguucaauucccagcaccuacauggcagcccacaacugucuguaacuccaguucaguuccaggguauccguggcacaggacaugccucuagugcacaccuauaugcauggaagcaaaauacccauacucauaaaauaaaauaaaucuuuaagaaaacaaggaaaggaaaugcuggcucuaagccucacuagccaccuuuuuguggguggcaucucuacuacauuugaaacguucucgcuuugauuuucugaauuaacucagaaccuucugguucuugugcagguuuacugacugguguaguaguggacucuggagauggcgucacucacauuugcccaguauaugaaggcuuuucucucccucaccuuacaaggaggcuggauauugcugggagggauauuaccagguaucuuaucaagguaagugagaggaaaauauaauaaaagguagucuuuuuuuuuuuuuuuuuuuuuuuuaaguuuguuuauugacuuauacaaagacagaggcuagagagcuggcucggugaucaggcgcacauacugccuugcagagaaacaucuugguucccaucuuggcccgcucaccauugccuguaacucugguucccaugaagucuaaugccuucuucuggaccucucaggcacauauccacacaaagacacacaauacacauaauuuaaaaugauaaaauaacuuagaaaacucacuauacaagaguuguagccucaccccaggauagcauuauuggcuuugcuauugguucccgggauugaguuuagguugucgggcauagacagcaagugccuuugaccuuccgagccauuuuauccucuaggagauuaacuuuuguucaguggaacucguucucauagauuauuaauuuacugccauucuuuuuauaccagcugcugcuguugcgaggauaugccuucaaccauucugcugauuuugagacaguucgcaugauuaaggaaaaacuuuguuauguggguuacaauauugagcaggagcagaagcuggccuuagagaccacaguguuaguugagucauauacaguaaguauccuauguaaaauacauuauggguguaaaggggcaucuguguuuauuagugucaccucgacuccagagucuugguuuguuuggucacacacacacacacacacacacacacacacacacacauugcugaauaucauaccuagggucuuaugugugcccagcagauuaggccuuaacauggguauuaguuauuguaauauguuuacauaugauuucucaggauuuccugcuauguuuaguuucugugauuaguuauuagggauuccauauauugcaaauuaaggcaagaauuaaauuagaauauaauuaaaaauggaggucauauuugagauucgagcaucuugagaguaucgcucaacauguuuuguacagugucauuucucuggggcugcuuaggaguuaugaaaauagagcacaguuauaacugucacacacuguggagacaauggaugcugcuuuguugucugacuuguaagcucuuugaugugaaaaugucgugugccugugucucagccugucggaccauccugagagucucgcuauauauguacuacacaguccuccugccucggccuccugaaugcugggauugcauggaccucaaauuuuuguagugugucauggagcuaaucaucuaagaaauguauuuuaggaaguauucaugcuuugauuuuuuuuuuucccucagacagagucucauuguagcccaggcuggguuagaacccaggcuaguuucagauuuauuuuaaaauccauuauguugcacacauuugugaucccugggcuuaagaacacuuguuuuuuuuuuuuguuuuuuuuguuuuuuuguuuuuguuuuuugagacaggguuucucuguacagcccuggcuauccuggcacucauucugcagaccaggcuggccucaaacucagaaauccgccuggcucugccucccaaaugcugggauuaaaggcgugugccaccaccgccggcuuaagaacacuugugcugggcaugguagcacaugcuguaauaaaaacacucagaauacugaggcaagagugccauauaaguagugagaccaaccucaugaggccuccaaaaccaaccaaaauagcuugacauggugauuuccaugaagucuaggcuagccaaggguacauaguaagacccagucucaaaagucaaaaaaaagggaagaaaauauugucagagacuaguugugguagaacaugccuuuaauuccaguacuuagaggcagaggcaggaggauuccuaagcuugagucuauauaguaagucccaagcaggccaagaauaaagagacccccugucucaaccccugcccuccaaaaaaaaaaaaaaaaagccaaaaaacaaaaagaugccacuuuaagggcacaauaaaaauguauuuuauaaugucucuuaaccuccagguuuguucugguggcuuacgaucccaauuuucaaucuuguuuugaaggaaauggcauaaagcaaaccaugagagaacuaacaguguaagacuugauugauuuguguuggacacugguuaugacaggagagucauugaauuagcucaagcucagccuggacuaauagccaggccaucuuaaccccgcuuuccccuuuccaacacccccacaaaaacaaaaccugagacaugguggugcccaccuguaacuucaguaaauuugauauggggcugaaacguuacugaguuugaggcccaccuguguauauaggucagccucagacucugaaugacugccaggcacagugugcccaccuguaaucucagcacuugggagccaggcacaggagaaucucucucuguaagccugaggcagacaaaccagccauacagaccagaguucagcagguaagggauuucugcguaagucauguuaaaguguuggacugucuaaaucuuacuggcuuaaguuaagguuauaguuaccacuuagauaaaguuauuuaagaugcaguagcauaaaaaauuuucuaaaucaguguuccuuaaauuuuuguuuuguuuugagauaaugucucaauagguaacagcccaagccggccuugaauccaugauccucuugccucaagagcauuggcauugcagguuaugcaucaugcccagcugcggcugugguugguuggcuuggcugguugguugguuuuuuuuuuuuuuuuuuuuuuuuaaagauuuauuuauuuauuacauguaaguacauuguagcugucuucagacacuccagaagagggagucagaucucauuacagaugguugugagccaccaugugguugcugggauuugaacuucggaccuucggaagagcagucgggugcucuuacccacugagccaucucaccagcccgguugguugguuuuuaagaaagaaaaugugugugugcacauguguaaaucaaaggauagcuuuugggggucaguuuuugcucucugccuuguugagaugcugccucuucuugaguacauugcuagcuacuaagaaaaacgaucaauagaguauguaugaugcuagcauuaucauuugaguuauuuuguuucaccuaagaauacuuuaggaagucuuacugcuuuuacauaauuuugauugcaggccagauguauuuaaaacacucauugugcagagaaugcagagaaguugugguuuugcugacaccugguuauuucuuucuagcuuccagauggacguaucauuaagguuggaggagaacgauuugaagcaccagaggcuuuauuucagccucauuugaucaaugucgaggggguugguguugcugaacugcuuuuuaacacaauccaggcagccgacauugauaccagguacaguagacagcauuuccaagucauuuauaagacacggauaggccacagagauggcucagcaguuaagagcauuugcuguuugucuagaggaccugaguuccauuccuagcacccauaucagacagcucacaucucugagccugugacucagcagcacuggccucuugugggagccugcauuuaugcacacagcauugccgugcagaugcacaacacaucuagacaugguuuaaaacaauaagaacaaaaugguuuuaguuuuguuuuugguuuguuugaguuuuaaggcaggguuucucuguauauagcccuggcugcccuggcuugcucuguagaccaggcuggccucaaacucagaggucugucugucucucccucucugccucucugcuucucugccaaaugcugggauuaaagguguaugauauuuucuccuuaacuuguaucuccuuuuuggauagagguauaaucugauguuuuguaaaaccaaggauauguuuuguagagcauggugugguuaaaugggaggaauccccacugagguagcagccaguauagaauaggguuuauuugggugcaugggaugggggguugagaagggaguagaggcagaggaaaaaggaaaggagagagagaaagagaagagaagaggcuggccaggaacaugggggagggggugucagagagagaagggaagccaaacagucccuuuuguagcaagccagaccuaccuggcuguugcuagguaacuguucggcagagacuagaaagaaugcuaacaaauucaguuagaguacaugaaacacuggguuugauuuacagcacugcacguguuuuaauucuauuucaguuagcuagcuagcuaguuaguuaucugguguguauguuuugauggugaugguggguuccauggcacacuuguggaaagucaggaguuggcuuuauuuccuuccuccauuuggauuccagggaucaaccugaagucaucaggauuggcaggagguaucuuuccccacugaaccaucucaccagaucuuuaaauguagcuaguuaauuuuuucuuuuuuuaaacagggucucacuguguaguccuaagaauaggcuggccuugaauucagagauccuccugccucugcuggaguuaaaggcaugugccaccaagcccagcuuaaguuuuuuuuuuuuuuuuuuuuuuaauugacaaaaguucuguuuaugagccgggcaugguggcacacgccuuuaaucccagcacucgggaggcagaggcagguggauuucugaguuccgaggccagccuggucuacaaagugagcuccaggacagccagggcuauacagagaaacccugucuccaaaaaaccaaaaaaacaaaaaaaaacaaaaaaaguucuguuuaugauauauaacaugaugucuugaauuuuaauugaguauacauuacuguacauacaacuuuuuugaugagcacucuuaaaaucccagugcuuuucagauauauuuuagaaacagaaucuguguuuggugauaggccuccuaucuaacugaauuuguauagcuuuugauuagcagcuccucuguugagucaccagcucguuguccuugguaaccaucuuacucuccucugcuacuggauucagcaucagauuccauguaaauagggccaugcaguauuugccuuucucugccuggcuucaucuaacauaauuucuuccaugucugucuucauugcuacaaauuacaagguuucuuuuuuuaagggagaauuacauucuauuguguauuccaauuucuuuuuuauucuuuuuuuuuuuuuuuuuuuuuugguuuuucgagacaggguuucucuguauagcccuggcugucuuggaacucacuuuguagaccaggcuggccucgaacucagaaauccaccugccucugccucccaagugcugggauuaaaggcgugcgccaccacgcccggcucuuuuuuauucuuugagauauguauuuagugguggauugcugaauuguuuguuaguuccgucuuuaguuuuggggaacguuucuauucuguuaucuguaauggugaucauaguuuaugucugggcuucuuaaacuuuucacuuaugauacccccuauguuaggguuuccuagaguaacaaaacuuacagaauaaaauguguuuuuguguguguguguguguguguguguguguguguguauucucucucucucucucucucacacacacacacacaagauuuauuagagugacuuauaaacuguggucuagcuaaucuaacaauaacugucuuccaguucaagaauccaguucaugagguuggauaucuuggcuggucuucaguauaagcuggaaucucaaagacuugguucuaaugccagugaaaggcuuguuagugaggggagagcaauucggcaaggagggaagccuucuucuuccgugcuuuuauauaggcuuccagcagacaggguguagcccacacuaaagguggaucuucccaucuaaaagaucgggauuggaaauaggucuuccaauuucaaauuaagaagaucccucauagauguacuccacuguuuuuggguuuuaguuaguuccagauguagucaaguugacaaccaagaauagcuaucacguucacccuuugaaggaaggagucuacuucacuacaaagccuaggacggccugaaacucacuauguagacuaggcuggccuuggacucaaacucuuaagagauccaccugccuuugucuuccaagugcugagauuaaagucacauaccacuaugugacaguauaugugcuaugauaugugcuaugaccccuuuuuggcugagaaauuuuuacauaauucuuaguauguagguauauaagaguuauauaggcaaauauuuacugauaauuaaucuugaaguauauguguauauauauauauacacacacauacauacauacacacacacauauaauuuaucuugcaucaaaaaugaaaacaaauuccauacuaaugaaaugaauggguuuauuugguuuuacauaaagaauuaagucuugagccgggcaugguggcccacgccuuuaaucccugcacucgggaggcagaggcagguggauuucuaaguucgaggccagccuggucuacagagugagcuccaguacagccagggcucuacagagaaacccugucucaaaaaaacaaaaaggagaauuaagucuugggguuagagagaugacucagugguuaagaguguuugcugcucuugcagaggacccagauuugauuccuauacccacaugguggcucaccacaaucuguaacuccaguaccagaguaucuggaacacucuucugaccucaucaggcaccaggcacacaugaaguacacauacaauaaugcagaaaaaaccacauuaaauaaaaauaaaucuuuuuuuaaauaauuaaaucuuaaacuggguauggugguccacacuuguuuaagaccagccauagcuauauaguccauccuggacugcaugguggcaaaugucuuuaaucuuagcacuugggggacagaucugcauuugagaccagcacagccuacauagcaaguuucaggccaacuaaggcuacauaguaagauccugucucaaaaacacaacagagaugaggcuauaucucaggcagaaacuuggcuagcuugugugagccacuagcuucagaccucaguacuguaaaaaacaacagaacaaaauggcacaaauauguuuaaggccauuucagaaauuauuggagauucugggcuaaucucgagucagaauucacuuaacaauuuuuguuuuaaaugaaacucaaaaguuagaaauucaaauauuaguuuuuauuuuagacaggguuucucuguguagccuuggcuguccugaaacucacuauggaggccaggcuugccuugaacauagucuaccugccucugucucccaagugcugguuaaaaauauacuaauguagaccaauaaugucuuuguuuacuguaauguuuuuguaaggaugggaagcuguacguacaguagccguuuucuaacaugccauagucuugggugagcucaggugcugcauggcauggcuacauggacacugcacacacaguagaugugcucagagggcagccagugaacaccgcagacuuauugcauguuugcuuuugacuguuuugccuguugcaccuuagagaaccuuuucuguuaccaugucauucacagcccccacauucaguuaugugacgcagcucaguuuagagcuguggcuuguaguuguuauccguuguacagugauagcucauuggugauaggugauguugagcuguuuucccuccuuccaugucaugaugcaucuuauugcugucauguuacaguccuaaucuagcagaggcuugagcuucugaucuuccucccucuacuucauaguccccuggcuucuguggugcugggauggagcccaggguuucaugcuaggccagugcucuucugagccucauccaaauuaaacaaaacaaaccaaaaaaccaccuaccguucucauaucuaaaacuguaauuauccacugugucuuccuagaucugaauuuuacaagcacauugugcuuucuggagguucuaccauguauccuggccugccaucgagguuggaacgagagcuuaaacagcuuuacuuagaacgaguucugaaaggagauguggaaaaacuuucaguaaguaucuauaucagcuguuaccuuuguuuuacaacccuguaaaguagcuuguggaucuugacaaccaccagagggagcaagaagucuuacagcagauuuuggugcaguuagccucuugaagccuugcagggcucacuggaaauugucuuggggguagugcuucuaccuacuagguuacacucuggugagaaaacacaggugacugaguccaguguccuugguagucuguagcauucuuuuuuuuaaaaaaagauuuauuuauuucauguuuaugaguacacuguagcugucuucagacacaucacagaagagagccuuggguuccauuacagaagauugugagccaccaugugguuacugggaauugaacucaggaccucuggaagagcagucagugcucuuaaccacugagccaucucuccagccuggacugguaugcagugugcaaguguuugggaagagccugcuuuugcuguggagagaagggagaggaaauguccuggcuugcuuguuuucucucucccucucccccucucccucucucccucucccucucccucucccucuccccuccucucuuuucuuccuuucuuuucuggaaacagucuuccuauguagucuugccuaccuuggaacuuacuauguugaccauauaggccuugaaggagcuuaccucugugucccaggugauaggauuguagauucuauaccuauauguuuucugggcauaggguaugcuagagugcuugccuaggcccugcguacaaacccuagaacugcaaaacugagaaggaaagggagaucaguguauaaaagucacauuuucaguaggguuuaccaaaagagcagucagugcucuuaauauauauaauuauaauauuauaauauauaauucauauauauccuauacaccaucacagcuaucuugguuuuuaauuuugugaauauguaaccagccuuuacucuuagcuuguuagaauucugguuuuagguuacuuuucuauuuguuguaugucuuaucuccucagucauguuuguguucucagaaauucucacagcucuuaaaauggacuuuauuggucguugucaccauggacuagaauauaauugcugguaguucuuuggcaugcccugucuucucagcucuagacugugugaggcauucugugcgguagcccuagcuguaacuaccucagugacacugacucaagcucgccugccucuaggaugaaagguggauaccaccaaucccagccucagccaagaaucaugcuuuuuauucucuggauuugcucuuugcuuuagaugauaauauuccacuuuucagaguauucuguguagagacaccaauguuacagugcuuucuaauagcucacucacaguucucauuucauugagcuauuuagggaauuuaaaauccaucucuggugaucauucuuuuuuuuuuuuauaauuuuacuuuuucuuucuuuuuuuuuuuuuuuuaauuauuuauuuauuuauuuauuuauuuaauguaaguacacuguagcugucuucagacgcaccagaagagggcaucagaucucauugcgggugguugugagccaccaugugguugcugggauuugaacuucggaccuucggaagagcagucgggugcucuuacccacugagccaucucaccagcccucuggugaucauucuuuacccuguagacuuuuuugaggggcguaugcucuguagcacuaucuuuugguaaacccuacugaaaauaugacuuuuacacacugaucucccuuuccuugucaauuuugcaguucuaggguugggacgcagggccuaagcaagcacucuagcauacccuaugcccagaaaacauuucuugaaacuccaucccugugccaaaacugauuuaggccaugcugugaguuuaaguuguuuaccaguaguaauaauaaauggugugggaaaaagaaaggaagacuacaagguagaaaaagguuguuguuggugacaagucgguaugcucccucacuccugauugauuagacaggucuugggucagauaccugucuaaucagauaauauuauccugauugauuagacaggucuugggccagaugccugugucaaguuagggauugagcauuucuagucaggaauagugcaaaagcaugaguuggcagaaaugucccaguguggcuggaacagaguaagcaagagaggguagaaaaugagguaagaaaacuagcgggcagacaggucaguuaggcuucuaugauguagucagacuuuuaccccuuaaaagaaucuguaagcccaguguguuggaggaggagccaagaaagaaagccaggaaguuaugagaggaagaacuggcagagguugaacauggaguagggugaaacaaacgguccucuaagagagugaauggagagugggaaaauauccuagacggccagacagcgugaaggacccgggcaaaguuggugacacauuauagcaaaauaauauagagcuucuguacugugugcugagcugcuugaaagcagguucagaccugauuaccugaguggaugaauguaaggagagaaaaaaagucaacaagggugauguaaaaaaaaaaaauggaggggagaggucuggagaacuggcucagugguuaagagcaccugcugcucuuguagaaaagccggguucaggucacaaccauccguagcucaaguuccaggcaacccagugcccucuugugacugccuugagcaccaggcguauacacgguacacauaaauacaugcagccaaaacucagacacauagcuaacuaacuaccuaacucucuuuucuuuuuucuuuuuuuauuagauauuuucuucauuuacauuucaaaugcuaucccgaaagucuccuauacucuccccccgcccugcuccccuacccacccacuccuccuucuugucccugccauuccccuguacugggacauaaaaaucuuugcaagaccaagggccucuccucccaaugauggccgauuaggccaaccucugcuacauauacagcuagagacaugagcucuggggguacugguuaguucauauuguuguuccuccuauaggguugcagaccccuucagcuccuugggugcuuucucuagcuccuccuuguguuccauccaauagaugacugugagcauccacuucuguauuugcuaggcacuggcauagccucauaugagacagcuguaacaggguccugacagcaaaaucuugcuggcauaugcaauagugucuuccuuuggugguuguauaugggauggauccccggguggggcagucucuggaugguccuuccuuccgucucagcuccgaacuuugucucuguaacucccuccucucucucuuuucuuaauggaggugcuggguggcaguggccaaacuuugucucuguaccucccuccccucucuguuuucuuaauggaggugcuggguggugguggcacaugcauuccuuuaaucccagaacuugagagacagagcacauagaucucuuaguuugaggccagccugguccagugaguugcaggacagccagggcuacacagagaaaaccaaaaaaaaaaaaaaauggcaagcucugcacgugcuugcacacgcgcgcgcacgcacacacacacacacacacagaggccaugcuuacagauaauacauaauaacaaauacaagagaaagagagcaugcauauuaugcaucuguuagucaggaguggguaugggaaggagcagcuguagaugucuggggaaggauagaugaugaaggaggggagguggguagagagaagaagcuguagagcagcuguggagguuuaggagaagaagaggauagaaguugcaguucagaaagaaagcugcucuaggaccuccuggugaaaagggaagugugaaaggggaguagccacugagagcacuacuggggaagaagucuuuccugagaacagcaguggcuccagagcaaaagcagcaucauaacauuguugauuggaugcaguuugaaugggccaaggcaaaaguauaugaauacaaaggucagcucuaagacuaaucuuuuaauauuacauuuaaguuugcuuagccaagcaguugagauacuuuucaagcacuuaauaaaaagauguuuuaucuuuagguuauuucuccuaaauuuugcaaucaaaguuucucucaaucuuaguuuccauaguuagcauuugaaaacaccacagccaaaucccuuuuuaauauuuauuuuauuuuuaugugugugugccuggguauacauguguguaggaguacauggaggccagaagagauaucauagccuguggaacugggguuacaggccauugugaguggccaggaguugcugggaauugaacucaguucccuagcaaauguucucuuaacaaccgaagaaucucuacucccucagagccaagucauuuuaaagaguaagcuuaaaauuaacauuuucaauugauauuuuaaauaauccugccagagguaaaauacaaaaaauuaguuccuuuuuuucuuaaauuuaaauuuucucaaauuucuuaaauuuuaguuuuaagaaaauagagauaaaagcaauugccuuuauguaguccagaugacccuaaacacucauucaaacacucguauuuuuuuuuaaagaucuauuuauuauaugaguacuguagcuguuuuuagacauaccaguagagggcaucagauccuauuacagauguuugugagccaccaugugguugcuggaaauugaacucaggacuuuuggaagaucagucagugcucuaaacugcugagccaucucuccagcccacucagacauuuuuuaaaggcaugccaaucuuuuguuuguuuguuuguuuuuuguuuuguuuugagacaggguuucucuguauagcccuggcuguccuggagcucacuuuguagaccaggcuggccucgaacucagaaauccgccugccucugccucucgagugcugggauuaaaggcgugcgccaccacgcccagccugccaaucauuauuaucaguacacaaugaguuaauaauaaaugaaaaacagaaguggcaagaguuuucucuuccaggggcuccagagagagcuugguuuuugcccuauagucuuacaaaucaucccacguuuauuaaagacuaggaagcugcaacuuccugaugguaccaaguaauaaagacaauauguggguuugucuggcuaauguugaaugguauaguuacagcacaaagauucucuaaggguuggguacccuguacaucaguccuacccaacauccccacuccauacuccuuugucugcccuuaccuuccuagccucuugguuuggcucuccccucucccuuugccucccuuugcucaggaucauguccgcuuuggacucucccagguaucccuggcucuggcuccucaugucuacaguaaaccucauccaccauaccuaagaguagucauguacuuccuuuuuuauuucuuuuuuaacucaucuggugcugaaacccaggaccaauuauauccuuuccuuuauuucuuuuuuucacuuaucuguaacucugauaauauauagaccucauauugaaaauggaccacagcagcuggguggguguaguaguucgguucacuccuucaaucucagcacucaugugguagaguuagguggaucucucugaguucaaggccaaccuggucuacauaaugaauuccaggagagcagagcuauaaagugagcuucuguugcaaaaacaaacgggggggggggggggcaguggguggacuuuaguaaucuggcuuacuuguuuugaguacguuucuguuugaauuuaagaccauagaacuugaguuuuguguauaagaaaggaacuggaggucuggguggagcucaguuguaagccacgugaauagaugugaauucaggguuaccauugcuacgauaaacacaugaccaaagcacuuggggaggaaagaguauuugguuaacaugcccugaaucagucuauugagggaaacuguuaauccuaccaggugagaguauggcuaccaccacaauuuugagccauauuugaaacaagcuuaauuaaauacuggccaggaugauggacucuagccagggccauuccuggguugccagaaaauggcaaugaaucacaguuugcagaggcuuacaaggcaagcccauaaagccaaguauuucucaccagguccaaucagacaagcauauuguaucuuguaugcaacauaccucauauauauuauauauaugaaugauguaauuccugccugugugccuucugccuacauccaacuaggggcagacauacaucuuguuguauuuguugccuguguaucucccccucugcaugccaucaagcacaucaaugcaguuaagucaaacaaacuugguuaggcaguaagaacaggggcuucuuauccuacuuauacaguaaccuccagcauuucagaaaguaucucuccucaggcaaguggcuuacaggugaggagcacuuuuguuuuauggcucucuuaggcacaguaauuaaaacuuaaaaccuaacuuuagcucucauaaagccaaggcaggcauucaaaugggucagauacauggagcugauacagaugcuguggaggacuguugcuuaccgguuugcucauaaugcuuuguuuguuuguuuuuguuuuuuuauagaacacaggaccaguagccaggggugcccccacacacauacuagacugccccccgcuugcuugugccccagcccuaucagucauuaauuagaaacugguccccaggcuucccugcagccagguuacggaggcguuuucucaccccaccuccaauaaccuuagcuugugucaaguugacauaaaaccuaaccaagacauuugccaauuccagauccagaaaaaucaucucaguuuuauuguguugcacuaagcuagagucaaguugguauuaggucuugaagaacacugcucaggaacuacagaaaaccuugcucugguucuugggugauuaacacagugauugguugugcagcuuuucaaaucuagauaacagguaugaaguaagauucuugucuccugaucaugagcuuaagaggaaauacugaauguuucugugucugagggguaccuuugguggguucgugccaaggugagcuccugggaaauaacaccaugcaacagacccgguguaaagaagacagaaaacugaggaccugggaagggauagacuauauauagcaggcagguggacuuguagacaggcugacagauggaagcagagccaugagggcagggagaggagauggggaagggggcacccacagaguagauagagggaugcugagaacaaagagagcuggguuggcagacaaguccucuuauacacagcucacaccugucucagguuauggcuugagcaguugcugguugccaguggaaucaccuguugacauccuguagagauugcagacuguggagagauucaacaauacauaugcgaagucuuucugaaacagagcauuauacgaauaugaucucauugcucuuucuucuuuagaaauuuaagauccgaauugaagacccaccccgcaggaagcacaugguguucuuggguggcgcaguccuagcagacaucaugaaagacaaagacaacuuuuggaugaccagacaagaguaccaagaaaaggguguccgugugcuggagaaacuugguguaacuguucgauaaaauagcaggcuuguccccaucacgccucuaaugcuuuuucuuuuucccuuuuuaaaaaaauuuuucuuuauugccaaucuuugaagucauucaacccaggacugaaagaggcucucugucccuuuugacagaaaggucaaguuuuucucugucuuggggaagcauugcuaaauucuuguuaauauggguaaaucugguuguuuaaggcuaccaaaucuuugcagacauuaccagggcaagggguugcugcugcucuguuucuuucuuuguaggcauuuagaacugcuuguaggcuuccaauuuuugcuuucuugcucuaaugcugcuagcuuuaguuuuagcacaguaggugguaugucuuuauuagcauaagaaaaacuuucacaggagcuuuuacauaugcugggugggggugguaaggggugggugggcagcccgagcgggagggccuuuccucuguaguguuagcuuucagcaggucacugcugcuacuuuugaaguccccugaagugucuccuaguaacaucuuagggaaauauuaagcucacaacuaagguguuugggcuagaguuuuaugugauggaacaaaugggugaccuuucuguuguggcuuuugaggucuucugcucuggguacaaaagaugcaugaaccucauuuacaauacucugacuugguaguuuucuucuuuccgucugccuggaacuguucccauaugacaggaaaaaagcaagcccaguguuuuauuaccaucugucagcugggaguauauuuccuauacucuaucagugaaaaaguaacauuuuaaaggaaaugcuuuuucuaggucaaauuacagauagaaaauugcucaagggccagcauuuucuaaugcuguuguuuuuccuggaagcacuaaggaaaugaaccaaccaaguuccacucuugaaaguuguacuuuuauguuccugaucagugcuucucgacaagagcuacuguacagagaaguaauucauggcuguggguuaauuauaauuguuguaguaacauucacauugggacuuggugccaguuguuuuguuuuguuuuuucaugagacuugggacuaaaauuuuagcaacaacaaccacaauagaaaauuuaccaguagucaaccaugucuguacaguuauggaggcuacuucccagcccucuuugguucuugcaggaagaguguuugcaggccuguccuguugguauuguuugucagcucagaaagaaucaggugguacccaagugcggggucuuccuaacguugaaaaaugaaacgagaagcuguaucacagaaaauacaaaaugaugauucugagagaaauauuuuccuucauuucaaauguucuuuacuaaugaugaauuugaaagaauggcuuuuuuccuuuuuucuuuuuuuuuucuuuuuuuuuuuuuuggaugcuuaaaaucagaauuuuuaauggauuuuuuaagauaacuuuaauuaguuuauaugaaaucagcagcaaaaggaaguuugucuuaauaaugcagcuucugugauguuaaguauuuuugccuguuuuaccucaauuugaacaaauaggagaagucugugugcaugcuggacaugcucaguacacacgacagcccgccggugcagugcggugucagcugcucgguguugggugcgugacucagucacaguggaaucccuaagcguuccuaaaucauguugucaaauucuccagucucgggaguucugggcccauuaccugcugugcauaggacugguaccaaggacuauugaguguagacaaacgaucaacucuuggcuuugaccauggcuuuaaacaaaggggugaaaacaagaaagaauaggauggaaucuggaauaaaacagugaaagagcauuguucuuuguaccuugaauguagaauuuguuuuuauuucauaauucugcuagcaaacaugacuguuaaaaugauguauuuauauauguaauaauuuagaaauuccauuuuauaguuuccuauccuaaggugaaauaaugaauuuaguaauuugggaguucggacauacuguauucuauuggaggugccagguuugaguccuucaaaaauaaaaaaaauuuaaaaaaucuguuuuuuaaaagaucugauuuuuagcucuuugaaacccaucgucacuuagauuuccaaugcuaauuaaaauucuuuuauuuuuaaauuaaaaucaccaaugccuugagggucuucuuagaaaauaugguauuggauauuaacuuucauaguucugagcacuauuaguaucuaucugacaaguauugggaagaucaauggaaagcuaaauauucuaaauuuaacacaaauauacuucuuuuuaauuaagaaaauaaauaagauuuuucaacauaauuu

SEQ ID NO: 5897 - RNA, 1198 nt, Mus musculus
uggggguuguguguauaaaggguauaaauggcugcagauauggucggguagauaaaguacuuguaaaugugaggaccagaauucacccaugaaaaugcuguguagcuguggggacccaccugcaauccauggaaggcagaggcacuggguuacaggagcucuguauucaccgagagaucuugccucaguaagguggaguguaauccaggaagacuuuagccuuaggucucuauauacacauacuguacauacacacaaaaagaaaaugugucugucucucucucucugugugugugugugugugagagagagagagagagagagagagagagagagagagagagagagagagagaaugagaauauuccaugaauugguguuauaaaaauuuaaaugcaaaauugugugucuagcccauugcauuucaacuugaugggcuguguuuuuuuuucucccaaguacucuuaagucuuuuccuuucauguuuuuuuuuuuuuuuuuuuuuuuuuuuuuuuaaagauuuauuuauuuauuacauguaaguacacuguagcugucuucagacacuccagaagagggcgucagaucagaucuuguuacagaugguugugagccaccaugugguugcugggauuugaacuucagaccuucggaagagcagucgggugcucuuacccacugagccaucucaccagcccuuccuuucauguuuuauuguuuagucaugauggccaggucuucacugauuuuuauguuugaaagagggucucucacuauauagcccuaguuguccuggaacuugcuguauagauaaggacagucuugaacccacagaguuccaccccugcuuuugccuccucagugcagggacuauaggcacuaaacaccauauuuggccagaggacaacuuuuuauaguuucuuccuucuaucauggguucuagggauugacuucugguugucagguuugcauagcuuuugcuggccuaucuugcuugcuuuuccccauuaaaaaauauuuuuauuaagugaaguguauaugaaugcaugugcccaaagaaaccagaggcacugggugccuuugaaacuagaguuacaagcauugguaaaccacuuaguauggguccugggaauugaacucagguucucuagaagaccaauauauccucuuaaccauuaagccaucucuccaugccccu

SEQ ID NO: 5898 - RNA, 25040 nt, Mus musculus
uggcugcaggagauagaucgcuacgccagugaaaaugucaacaaguuguugguagggaacaaaugugaccugaccacaaagaaaguaguagacuacacaacagcaaagguauguaugagguuugacuuugacacugaauuuaauuauggggacugccucacccuguaaaagccagugagcuuagucccccauucccauuucagaagacuaagucagaaggauuuuccauuguucacugugccuuauuauucucucaggaauuugcagauucccuuggaauuccauuuuuggaaaccagugcuaagaacgcaacgaauguagaacagucuuucaugacgauggcagcugagauuaaaaagcgaauggguccuggagcuacagcugguggugccgagaaguccaauguuaaaauccagagcacuccagucaagcagucagguggaggcugcugcuaaaaucugccuccguccuuuucucacagcaaugaauucgcaaucugaacccaagugaaaaaacaaaauugccugaauuguacuguauguagcugcacuacaacagauucuuaccguuuccacaaggucagagauuguaaauggucaauacugacuuuuuuuuuuauucccuugacucaagaccgcuaacuucauuuucagaacuguuuuaaaccuuugugugcugguuuauaaaauaauguguguaauccuuguugcuuuccugauaccagaucguuucccgugguugguuagaauauauuuuguuuugauguuuauauuggcauguuuagauguuggguuuagucuucugaagaugaaguucagccauuuuguaucacacagcacaaccagugucugucaguuuccacgcauaaaguuuagugagacguuauauguaagaucugauuugcuaguucuuccugguagaguuauaaauggaaagauuacacuaucugauuaauaguuucuucauacucugcauauaauuuguggcugcagaauauuguaauuuguugcacacuauguaacaaaacugaagauauguuuaauaaauauuguacuuauuggaaguaauaucaaacuguauggugauaaguauuguuuuaauuccuaugauuaaagggaaauagagcuuugcauucuacucagcagccacgugugugcagcaagggcacuguagaccuaucuuaauagcacagcauccaggguuugcuuucuaguaauaggucugaugagugaccuagagaagcuuuugugcuguguagagacuucaccaccuucauugguucaaggaacucaaacucuagugcuucaucuccagcccaggccaccugaaguggcuucaccagcaacccuuuuuucccucaucugugguagagauggagagcagcccaugcuuccucccaggcagugaucugguaauagugcugguguuucuucaugcucagucugauggcgcacacaccuuuuucuuucuuuuuucuuuuuggcuauuggagauaggguuucucuguguaucccuggcuguccuggaacucucucuguagaccaggcuggccucgaacucagggauccaccuagcucugucucugagugcugagacugaaggugugcgccgccacgccuggcuuuuuuccccuuucuuuuuugagacagggucuuacuauguagcccuggcuagccuggaacuuaaguauguacaacaggcugccucccccucccccauucaccugccuuuuccucaaaagugcugggauuaaaugaugucccagacugcaccuauuuuuugagacaaugucucauauagcucaagaggccucaaauucacuuguaaccaaggaugcccuugaacuccugauccuccugccuccacuuccaggugucaacuuuauucuuuccaauuguaugaaucauguugguggagaguuuaagcauuagaauagaaagcaggaaaugugauugcccuaauuguagaaauucuaucuccccccccccccaaauuaaaugaaaacaugaacgcuagaugggaaugaugggagaaauaauauauuuauuucggugaaauuuugcaugugugaaaguuuguuaacuaggaucuucgaaauccuagacuuugcuuuugucuuacugugggaaacaaagucucuugcagacacuagcauuuuaaggugacaaaggucagagauuguuuccuuugguuuaaggagcagccaagcauucuucaauugggggcuaggguaggguauggcuguugauaacacauuuuaucauggggucuuuaaugauaaaauauuaaacuaaaaauaagccagaaauuacagguuuauuuuucacuaaacagacaauugaaauacaugguacaaaaauaagugguaagauuauuguaaauugaaaaauggacagaauaaauauucaauuuaauuuuccaucuaugagaauuucacaauaaaaucauaguuuacuuuguauuauagaugcgcuuguugggucuauucauccuuauauauaaaaagguaacuggaaacuccucaagucaccaggaauugggucaauaucuuuuauuuuuuuguagcuguugguuuuuugucaauauaaagggagaaagaguucauaaacuguuuucuaucauaacuaaaugauacaacaccaauauaggaugaaauggugccaagcacuuuaauuuuacacagcaaaaguuguucaaacugucagcuuauucuguuagcagaaaacauuacaugaauuuauuuuuaauauaaacauauuuacagacuaaaauucuagugcucuuuccccacuggcagcaagauuagggcuuaccagacuauuucagcaugcuucacuauuugguuucauguaugugcugauaauugcuguuuuagagugggaaauaacccauuuuucaaguauaaauauuucaagacucuugggggcucuaauauguucacauaauagaaaacugucccuugauauauuuuaaaaaugacugccauagagaaacgugcauaaugaaaagcacucucucaguuggccacggcuccccuaagguccagugcucuuucggacaguucccucaggcucauauuuggccacaucuuguaccacgaugucauuuuaaguuucaaagcuguuugaauuaucuuguuuugugcuagagcuucacuguagaccuguaacaacccugucucaagaugcuacuuuacugugaacucugaacuuuaagggaccauuuauaaauucuaaaaaggcuauuugagucuagccuggccacauuuacagaugcaaaugguagugacauccaaggcugagacauuuuagcucaaacauaacacacaccagaagauaaaacaacaguuguauugauauuccuaaauggcauucacagccaaggucagaguuacacccuuuaguuacaaaaagucuaucuucuuguuacaaagaggaugagcagaagcauagagcauguucgggccaguauuguguugggaaaccaugcucacugucaguugaaucaauuguaauuauacagcaaaagaagaggagugccccauuuugcauucaguuggagcagcuggcuagcucuaugagucuccugacuuucaugcuugacaaauggcuuuaauaccugagggcuccuuuaacauauuggugggaaggcaguuuaaauccacaugagagguaagaugugcuuuugaccaauucuagguuuuauaggauauuuuacauuuaacuuaaauuauuugcuagaaaaguuuuguuuuagccucuugaaagcacuuuauguaccauguacaguauaagaaauaaguuuaacuuagagauggcagaauaaaacuaaugugagcuggugcaugacuuuaaucccaacacuuggggaggcacaggaucucucuugaguuugaggccagccuagucuacagagggagucccgguacagccaggguucuguuacacagagaaaccuugucucaaaaacccaaaaacaaaccaguaacaacaaaacucuuaauauggaucaugcccauaagcauuaugguaaaucaugcuguguagcaucaggcauguaaaaauacuguauuuuaugcauacuuacugaagaaucuuuuuuuccuucuucuucuucuucuucuuuauaaagcccuggcagccuggacucuaauaaacaagccagacuguccucaaacucacagagcuacuuuuaaguacuaggauuaaagucauguacaugcuuaucuaaauagcuauuuuuuuuuuaaaccugaaaagcccaccuuugauacuuuguggaauuugugguagccaacauacaaacacuuugcuuggaaagcuguaacugaugcuuugaacauauggaccuaugauagguccauagaauucuuuucuuccugacaaggcacaacuuccuguucacucccaaacuacaaagacuccccgcuuuucaucaccaauggcugcuuuaauuuacguacgcacagaccauguggcugucucuacccggcccaguccucugacuagucuuccaaggggaagagaacuguggccugagauccccagagguuagcacaagcaugcaguucagaagcauggcaggccagcuccugagcauucuugacaugguugaaguggagacugaccacuauagguggcaacuccuaggacucuguagagguucucccgacuuacuaagggugagcauuucacucuacaguuuuggccacuaacauuuucucucuuagaucccaucccccuguaugccugagaauccuaaguacguagaaccuuucuccagcagcuuucuguaaauggccucaacacauuuuaucugcugguuuuuaaacacgagacccacaagucuuaauauuuuaucaacuaauuauaaagccacauaauuauuguagagaagcaccauagaaacggccuuaauuuuggagggauucauaguaaaugagggcagugacucaggauccuucagaggcgagaaaggcaucuuaacguguguucaaguugauuuccuccccuuccuuaacuuccauggcucuuacaaggaguucuugaguuuucuuuccagcugccaucucgccaaugacuccaccucugccugaaugagaggagagcaagguuacagccugcugcagaggcagcagugugcuaccacauguacucacaccacucacaucacugaugcaaaugcagggccccuuuacuacuacuauuuuuuuaaagauggucuguugaguagcuuaggcuggcuucuaggaacucucaugcuucagccucuaggugagauuacaggucugcaucaccauccucccgcugcuggagucucugcucuugacauauuuccagcauuugcucacugagauuuauuugauaaacauuuuguaagaggaaaaaaaucaguacaaccugugauucugcccaggauagguaccagauaacccugcuuuuuucuugggcuucuuccuaucucauugccaguuugacuuucuaaaaguuguauuuaacaaguaguauugauuguuaagucuguaagaugugucaucccccagucuuugggggaauggugugguauggaagaucugcaaagguccuuuguagcauagcgaucuggcaaguaacuggguuuuuguagacguuuguguugucagagaugcuuggagacaggugcugagugaguugagcaagagagccuguaggacagggacagucuugaacgcagccccacacuggagagaguagcacuguaaggauuacugcugcugucugcugugugguguagcaguagagguagagaacaccguaugggaaugugggauaugcagcucagcaagcacauguuaacaagacacuggaaagagugaaagacccaccuuccuggccaggguagugacuccuucagucuuccuucaauacuacauuuguuucaaugaguauuaccccagccaaguauauaagaaguaauuauuuacugggacagccuugugcccuuguuagcacagugguuggacaguaaguccucuucuuggguuucucuacuuacuguguuaaagcccuucauguggguguucugcugcuguuggccuguugucagggaugagggugcagccagccaacauguccaaagaggcuaagauagagucauaaagaugaucugcacggcucuccagcucaccagacugcuuugcaauccucucaaggacauccuuuaaaacuaauggucaaauuauaaaaagguauagcauuuugcucacauaggucuguaaguuucacagugacuccucccuacccuagcagggucucauguagcucaggcugaccucuaaccuuucuacuugaacaugaccuugaacuuuuuuuuuaaaaaaagauuuauuuauuauauguaaguacacuauaguugucuucagacacaccagaggagggcaucagaucucguuacagaugguugugagccaccauguggaugcugggauuugaacucaggaccucuggaagagcagacagugcccuuacccacugaaccauuucuccagccccgaccuugaacuuuugauacagguauauaccacagcaugcacacuacaguaguuuaugaaguucugggaacuggagccaaaguuuuauguaaguuaggcaaaacauucuagaaacugagccacacucccaguucauuuaaucuucucccuuuaaauagugauguuccaaagguuccagagcuuauguaauguauuggggaaguuuguggacuuugggggguaagaaggaucaaugaccaaaacuggaggaacgauuagagaauagacuaugcaugucuaaagagggaggcgcuaggauuagaguacucaaaaaggcuggcuguuuucuuuuguuaaauacaaaagcugcuugcuuccugugcuuuaucagcuggguuaaaugcucccgagcuuccugccugagagcaacaucugccagcagaggauaagaaaggggaagucuuuguucugcucacaauguggacucgauggggcaggaagggaaggaacuggcuggguguguugaggucagccccuuagaaagccauagugaggcaaaagugcuggccuaacaauuucuuggagcugguggcagaggaauguugucaggguggcugagccaagcucuguucagucuuuccgugugucaguggaauucuggggcuuuuuauuugaaacuuuaaacaggucagggaagaaaggcuagaaaggguacagguuucuuuuucuuaggauuuauuauguaguguucugccugcauuaugcccgcagaccagaagaggcaccagaucucacuguagaugguugugagccaccaugugguagcugagaacugaacucaggaccccuggaagggcagacaauguucuuaaccucuugagccaucucuccagcccuuuuccuguuuuuggugugugugcgcuuuaauuuuacacauacauauggggggcuucauuugguguaauucccacgagucccagucacaugacucauaagcaguugagaguguagaacaaaaugucagccuaaagcugggcgugguggcgcacgccuuuaaucccagcacucgagaggcagagguaggcggauuucugaguucgaggccagccuggucuacaaagugaguuccaggacagccagggcuauacagagaaacccugucucgaaaauccaaaaaaaaaaaaaaaaaaaaaaaaaaaaaaaaugucagccuauauuucuguaacuaggucaaacuuccuuuggcagggugcugacauagggcccucuuggugguagguaggggcaagccuuagucacuccugcaguuagacuuggagccaaguaagaaagcagacucggaagaagcaggaugguauggcgugugugcugacaggaugcuucugggaagaggaaguagaaaguguuaaggguaacuugaaacuugaacagaacagcuaagcguuccaguuacuccaggcugagggcugggaggguagcaguccgaaggucuggguucauaucugagauucaaagaaaaccaaaagccucuucuaagaggccaggcugaccccuaagucucuucucagaguaggacaaaguggcucuuguuagcuuacuuaaggcagccuuccauuacacauggccucugugaagaggccuauaaugagcucuuucugcucagacccuguuucuucagacccuggacagcagcugcagguuucucaagccccaugcuaagcuuguuugguaaacaccaguguagucagaagcaauaaagcuugcuauaucaaauuucugccuuaauauaaaacuugaggcuggugugauggcuuagcaaguuaaggcuugcaaccugaauucaaucuuuaaaauauguauaaggguagaaaagaacuaacuaccugaccaccuccacacagaugggauggcacagacacagacagacagacagacacacacacacacacacacacaacuacauaacauucauauacaaaacaauaaaaacauaaccauuaaggcuuagccacaaaagcaacaccuaaaaauccuauguaagagaacacaggaagaauuucaaaacaggccuucagagaagcaggggagacaaagggcucauuaguucacacuggugcagacccguucgugguugcucuccaucaaaaccuccccauguauucacuucccaggguacaacuggcacugccuggaaagguuccaggggucugagggcuucugugcugcaaaacaucuugcaaugcacagaaauaccccuaaaacaaagagcuacccaguucuauauggcagcaguaccaacccugagaaaccuuguucuguaauuuuuccaguaggcaccugccaucaccucucacaagguucaucauggauguguaugacauuuaguucccauguaaauccucccccuggaacugaggcauaauauaacuggauucuuccagcaccuaccugucuacacaacauuaguaacuacuaaucagucaauuuauggauacauaugggcaucaguucuuggcaauaagcaguuaaaaauacucuugaaguucucauauuuugcucaauuuggaacuuauccugcaaauagguuugagucuggcuuguaugugacuguuacccugaccccuaccaguucaguucucuacuaccaccaccaccugccccaaacagacagcccuggcuguccuggaacuuacuuuguagaccaggcuagccuugaauucagaucuaacugcuugucuccugagugcugggaucaaaagcaugcauuacugugcccaacuccuguuuaauucucaaaauccauucauccacccacccacccaucuauccauuugugaaauuuauauaauguauucugaucaguuccccacucauuccccuaauaaaucaaauucuuuaaccaguguguuccugaaaacaaacuuaacuuuuuuuuuuuuuuuuugacauaggaguccaggcugaucuguaacccgacugcuaggcagcagcaauaauugucuauagccaaugugaugccuuuuuuuuuuuuuuccuuuggagagaaacccuuaccuaaaguagagaacauagagcagagaaaccugccaguuaaacaugagcuaaauaggaaauuugagggcuuacauugauuaccccagccacagcuaaggacugcuagaucaaauucuagauucuugggccugauuuugagagaacuagcucuuaaaaguagaccucuuauuucuacaccugugccaagcacacacaccugaaugcacacaucacacuuaacgcagaacgucaccagagacugauaaaagacugcauuucuuggggucuggcaagauggcucagagaugugcuugcucugcagccuucacagaccuugauacauggaagccauauaaaaaaagcugaaggaagggguuggagaaauggcuccaagguuaaaagcacuggcaguucuuccagagguccugaguuuaauucccagcaaccacacguggcgguucauaaucaccuguaaugagaucuggugcccucuucgggccugcugacauacuugcaggcagaaugcuaaaccuuagggggggauaaaaaggugacucagcaagauggcaggcaguggggaagaagccaggggcugcaugcuuaugccucacaaacaagauggaagaagccucacacacuacauuaaaaaauuauuuuuuaaaaagaauauguuucuuguaggcuuggugccugauuuguaaacuuacuuuaugcccauaacucuaccagcauagguuagggacagugauggaagggagccagcagguguucuuuauagaauucucuuagguggugugcaucuuuucuugcaauagaaaaggaaagcuuuggcuaaguuugagacuugaagcacgaggcuagagaugcagcucagugguagcauguaucuugcaugcucacagccauggauuugaucccuugguaguagauucaagcaaacaaaggcaaaaaacaaacaaacaacaaccaaaaaaacucaaaaaccccacucaagacuggagagaugguuaaguacacuuagugcucuuggagaauacccaacuuugguuccuaacaucuaccuggagacucacaauuacccuuuaacuauaguugcagggcauccaacaccuucuucugaucucacauguuccugcaugcaugugguauacauacacacucaggugcacacacauacacauuugaaaacaaagcacuucaaacaaauacagaaagacgugcauggugcuagaggugucucagugauuaguuuaacaguucuuccagaggaccugaauucauugcauuguacugcuaacaucccacuguagcucuaggggauuugauguccuggccuccaaggggaccuguacuuaugcacauaccuuuacagagauacagcuauacuuaaaaauaaaaucuuuacgggggcuggggguggggcacugggcaugguggcauagccucuaaucaaagaaagcacuugggagacagaggcaaguggaucucugugaguucaaggcuagcuuggugaguuccaagauagcuagggcuauuauauagugagacucugucucaaaacaaacaaaagacauuacagggccaguacaguaugucuuguagguguugcugccaagucuaaugacuugacuuugacuucuggaacccacauaauacacaggaauucaaauaaacacacacaauaaggcuaccaggagcuaggagacucugucucacacaaucagauugcagccaugguggcucaagccuguaaucccaggacucaaggcagaggcaggaauccuuagagucaaggccggugaguucuuggcuacccaagcaauaagaaacuaaaaaacuacuaguguuaauagucaucugauuaaaagacggaucaaugacauagauacuucagaagcggguauuagaaaaggcuaacaaaucuaugaaaaauacucaguauuauuaauaaugcggaaaagacuagugauucauaaucuucaguuaaaauggugguggugauggugucauagauaaguaaauuuuguguauuugaacauaauaaaacaaacaaaagcugcucuugguuacccaccugggguguuauccaacaggcacugaagaagaaucucucccuucuccaagacgcucucugucagggacugauguucgucuacaucuuucuuaaauugcuuaagacauuaggaaaacaaaaguuuuaauacuauugccuguagaaaucaucuaagaugaacacuguaccacuggguuacauuagaccgaacauggaagacaggugacaugcauucaagaaucccucaguggucuagucuauugucagcuucuuugagccuauaggauacauucauuguuuuugcuuuguuuuuugaggcaaggucuugauuuggcucgggcuggucuucuagaggcucuucaauuucccuagugguagaaguauaaaccugcacggucaagccuagcucaauacaagauuuuccccggaagaggcuguccugaacagguggucccacuuuguauccuacuugaugguggugguggucagacgaaugggguugacaagauaaaccacacccuuaaaaugaacaggguagguaagaacuagagcagcaguuugccacugcacugaccaugcagagcuggaaccucucuaugccccucuguucaccuccaugcaacaccuucguucgcaucagaguagcuauuuucugaagagcucaucccaagcaaguuccuccucccagcuacaaggccuugaugauucuuauuuucuuuuaagauagggucucacugugcagugcaggcuauccuugaacucacuguguagaccgggcugaccacaaacucauagagcuaugcuugccuguuugcucagugcugagauuaaaggcaagggccaccacugucagcuauggcaauuuuuuccaaaucuuucuuuagccacuaagaacuggauaggauugaacccaugacaugggacagacaccacugguuaguauuuugaaaguguucauuuuauucuuggauuuguuuuccugucuuacucuccugugcuuagcaguuuagaugcugccuugucccugcugcauuaagaugaaugaaguuccaggcuaggagaggagaguccgagugccagcuaaaaugugagcacacguaagugcgagcacucagagucgugcagcauucugagaaaguguccacagaguacucucacugacucagcuguguacacagaggccuaagcuggaccgauaugcaggagugacuccuggcccauauccuagccaccuacaaugcaagucaagucaagacucagaggguguuaugagggcuaaaguggagacuguucuaagucuaucugacuugcucagcuaggccaggaaaagcuacugagguaagucacauagagcaauuccucucccugggacuucccggguggacacuccacgcacacaggcacagugugcuuaaauugagagaacuucagacucagccuugcucgaguuucucucuaucucuacacucuaucuaaugcauuccuaccaggguggaacagcuggcuagcccaggcuagauuuuaguugauuccaagacagaaaacaaaggccuuccucuccagaugagguguggugcccaugaugcugagucagagccugguaguaaaucuuacccucuccugcuuggagaaguguuagguuuuacagaucuguguuccucucuuccuauccagacuagcagcaggucugggccauaaacacuacccaccaauaugugaucaaagucagccaagguuaacugagguagcaguuacugacuuacccuccaauucaaaauaccuuuuucuuuuuuuuuuuuuuuuuuuuuuuuuuuguuuuuugagacaggguuucucuguauagcccuggcuguccuggaacucacuuuguagaccaggcuggcaucgaacucagaaauccaccugccucugccucccgagugcugggauucaaaauacuuuuaaucuaguaucaaguuaacuaaaauucacaggugugaaauaacagaccguaguaacaaaaaggcagaaauaaaacccaaagucucacaucaccuugucugugccuggaucccaguaguuucagcucaaccccauaaacaccaacacaguccaaaagaacuugcggugaggcuggcacguucugugucugcacugccuggugugguggccacugcauagcuguggugcucacccuaacuaauugucauacuugauuagugucuguaaaucaaagcccaggauucuagcccugagggaucugccagaaucccaugcaaacuccucuaaagcauucuggcuccaauguauguaauuauccucuuaccucacuuaguacauuuuauaguguucaacacugagaauuugaaaaggacaucuuaauucgauuuaucagauaaaauagucaacugagcuacaagacuccaguuacuugagauuuuauuuuguaaaagugacuuaacucccauccccguggauaaacaagccaggacuacauauuacccuguaaagcugcagagaagacuugagaccuguaaggcugguccuggguggagcacugaggucagcaacaucugugacauuauacaaccagcagaucagcucuuccagccgacagcaaaaugucuguggagacaagaacaauuggugggcuggacugagcucagugaugaagucugccuacuucaggcauguucagggcucaguacaacaagagaagucuacauggcacaucugacugagcugcuauuuaacuuguccgaaggcuaaaauuaccagcauuuuggcauacaaauuuucuagaguuuucuuucagauggucauuugucuccaccucuaucccaagacuccagguuuuccucugccaggauaaugaaugccauaacuggcugugccucagccagaugugauaucagaacuaggcucagaaugcagagcccugaaggugagaguggaacuaaggaacaagggccguuaccgaccacuaaacuuucucugcagaaaagcagaugcaggaugagugaguaaacuaguaaaacuguggaucagccucuaccaaagcacacggaacacugcugcugcguuaccugauuucucugccauuuucuugcaaucacuaaaggagaacgauaccucuaauuuggggucauauauguugagggugccgagacaugcuguuggugggcuggggaaacaucacuccuuccagaagauucuccgugaacauuuuuaccugcacacacugcacuagagaagcuuucuccugcucaucugucguccugggaagugucucuccagcuacuagcucggagaacagccgccuguccgucauggcuuuugaggcgggcugaguuuucagugguuuugaagagaccccgagggucugguuacucaucagacuacuuuugccucuagaguccuggggcuggauagaaugccugaagcagggguucuggcccacaggcccuugaaaggaaguuccagaaggaugcuuccuguggcuggaguccaaugugggggaggcuggcuugucacugucugagacuuguagugaacuguguuccucagcagccccaguguguagguucacaaaggagggccuggcaccugaguaggacaccaaacuagagaccugagucagccuggugggcagagcaagguacuccucaucacuucccaccuccucuucugauggccauccaggcgucacacaggccgggcagcuaacaugcugccugccucucuucugucugggaaaggguggcucuuucuccuucgucuucagcuggggagagcccauucggagguccucaccuauagggaggcaguccuccgcugugccccucagggcugccucucuguucucccaagaagcaucuucagugccuggggcucuagggguugaugcaagcugguuccaggaugacaagcuugugccacccuguuucuggaauauucccaagggccagcgcuuaagacaugacucucuggcuccagaaaauggcagaguaggcacuucugcugaugagcaauugugggagacauuagugggugacuuuagaguacuugcuggggagacagacaaacuguccagaucuacaccugaguccugcagaacaggcucagucaggacaugacuuucagguugcuuugggagcugaggcccaggccucaguggguaaguguagucaagcagaucuucauacucuuuauuugggucccagagugcggaguggcgguuaggggaaggaggcagagaauuuggcagcgcacaggcccaguauucugccugaaaggagaggugucucuuacccaggccuguagcaucacugccagaggucagaggcugugcugaccccuggagcggaggcccugcccccaccacagagugggcugccugggguacagucaacucgggagaggagacauuggcaaaagaggcccucugagguccugccuucucuuggugauccugaagacugcugcccaccgaggaggcagagaugcuucugcuagaaagcugaggagcaccugggcucaccguggacuuccacuguggcgggagagggagaccugaggugugugguugcuggcugaggcccaacaccugagauggaucaagcguagccuggaagucuucacugucagccuccuguccugagcaaacaguuauaguuccaaagacuugaagagcuggaaguagguccugggaggcaggaagccugucuuccuccaucugcaauaacaagggggaaagggcacuguguugaaaccaagcagacuucuuguuucuaagaacaguuuucuucacaagacuggggggggggggggaauagggaagauuaucaaugaaaacgaaguuggucuaaggauccuacgguuaaaccgacugcuugguauacuaagaaaaggaagacgagcagagcguucaggggauuucagggugcccgcugcuagugcuuaguaccgagacucauccuauuucggaaaucuccuguaaugaagcccuaaccaccuuuuccuaaguuacuuagucacuuugugagaggagaacucaaagacaguucugccaccucuuugacuaugggucguggcaagugaaagaucucuccaucaccacuaaccguggggguagggugggugugcccucuucaguucaugccucaguauacucuggcaaaaggagucccucuucacucuggaccuucaucuuuagugaguaacucaccacagaaggagacaggguaacuaacaugaggccuuaggaccagacugaccugauguuaaugcacuguuucuaccgccuuccguaagguacuauucuucucacaggacggggcuccaaagacagagccaagggccacaaugcucagaucaaagcuguuccugcgcugagguaggcugaauauaaucgguugccagagccaggaggagcagucucucccacuacaagggcuuaaaagauccagagccuugcacuggccuuagaacaugggggauucccuggcccacauggcucacuagagagggcgcugccuuguccuccagucauggagagcagagacagcugcgcacgaaaggagcgucagguucugaccaguccaagaggauuuggucugggaacccacagcccucuaccaagucuucccaggguccccuagaagcuuucagaucacuaaaucagaaccaggaaggggguggggggguucccuuguaacgagaccccugauccacaguagguuccuggugaacuugucacuguccuuaagagguccucagugacucuuugggaagguucagcucuccaagagaaccuguauaacagcccauaccuggaucccacagcucccaccuuacaguggccaggacagagguuaacagucaaggaaaggacacccccaccucagcucccaccauacuuacuuggcugcccauagaguguaaaaccucuccagugcccacacuggcagaaggaagcgggccucugaggggaggcuuagaccuaucugcuacugguucuuugcuggcaguauggacccgugacaagaaaacucccgagaugcagccagggucagcuucagcccuccacaguggcccccccucaacacccagauguaggggcugaucugguucaagcccugagggcagcagcuucccagaguuccaccugccacaggaugggaccuuuguguugacagacacuucugccucagccucaucuucacucagggccauugagccuccucuaucagguuuccuuugaagccuucaggaaccuacaaaaccagagaaggaaaaagaaaaacagauuuucagccgggcgugguggcgcacgccuuuaaucccagcacucaggaggcagaggcagguggauuucugaguucgaggccagccuggucuacaaagugaguuccaggacagccagggcuacacagagaaacagucucgaaaaaccaaaaaaaaaaaaaaauguuaaaaaaaaaaaaagagaaacagauuuucuugaugugugcaucaaaaucuugauuuuaagugaaaacacacuuuucuggccaaaggaauagugaccauuuccauggccacguaccaaggucugacucguccucagccccagacgcuuucaaagggaaugcccaaguaugacucuguccucuguaguugugguauugucucccaagagucaggacagguguaaccaagcaaaagacuugggcagccugugcugcaaaaaaaaaaaaaaaaaaaaaaggcagcagaagaaaaaaauguauaagccagcugaucugggaggaagaccacaccccaaggccaucuuccuugccuggaagcugaagggacaggaagcacacaaagaagguaagugcaggcuaaugggugugacuaacacccugacccuggcuggccugagaugcuuuugagugcagcucuacaggugcaguucaggaaaaggcuugggccccgugugugucgucaccucuuuaccucaaccucauuaagauguccagcuggucuuugccaggcacagcccccauagugguucucuucagccaauggcuuguugguuagcauccugagucugggucuguccuuucuaccccagaggauagcaaguucagguagccuaggaccucacugggcucaggaggaugcuucgaacuauuuuuggugggaggagacaaccagacuauagacuggauggggcuucccauucucugaccaaugaccagaaacagaucagcgccccuucucaggcugcuguggugugugccguagaaagccgggugauaauggggugaguucaugugagaaagcagagcagcccaggcagacuggugagggaggagcuacagaacaggagcuccacacaacagagggaaagcaggcuggccucaacaggccagccagugcuccuccugccacuggggggccgacaggaggagaucuagccugaagggcaugcacguggguacaaggcaacagugcgcacggagugugugcagucaccugcacugggacuaaccucaaaacuaaaaccuggacaggaacagccucauuuuccucagagacuagaagcugacaaggcagguagaaguggccuccucaggcucauccuguuuggcuuucacacuaggaaaugcaacucagguagaauaugaaauuccugcucccccuuaacugggcacguguggcucaggccauucugacaggacuucagagaaaagcaugcauuuuaaaugcagccagcucacucuuguaagcgucagacccuucagggcuaauucgaccccaccuguuuucuguuaggaacagugccuaaccuuucacauaacaagccaaguauuucccacugaacagucccacaaacacaggcaagcaguauuaguuuuugugugacuccuaucacuugauacauacacaaacacaaguuucuuuccacaccuauacuuuaaaagugcugaacagggcaagacauaguauuccaaaccuugucucuccccaccucaaaagaagcccccccccccaggaaauaccccaaaacagcacuagggauugaaccuagaaucucagagcucgucuggagaucuaagggcaguauagcuccugguauauccuugauuagugaccaguccucuguuaaggaaaguuauucccuucaacuguauugauuuccccacaggcuuuauagcaagcaggaaaaaagaaaacaaaaacaaaaaaaaccaaaaaagccaagaagggugagguuagaaugaaaccggaucacucaguuuuauuauaacuggcacuggacuaggacuucuagagucugccccacaucauuuuacuuuagguauauuuaagcacagcacaauuuuggaaacaaaguuuccugguaacaauuaacuucagccccugaaugcagcacagcuuaaggaaggcucacacugaagcucuuuacaaaguccauauggcuucagcaguaagcuggguucuuguugccucagaaacagugcccaggauaaggguuuagggagaaugacugagguaaagauaauggcugugggugucgggacuggccuggcucuaagauaacugagaagucacuuaggcuguuguaaugcacaagugauaucacgcauaagaaugggcuuuacggcugaaagcaaugcucaagauuuagggggaagggucuggaagacagcaagggaucaccaggcucugaaacuccaucacuccuggcauucuaggcagagcugcuacacacaccucacuccacugaagagguaagcugugugcuucacuguccugccuucuccaguguguaucugugugcacaggcccucuacacccagccaggauggacacacaggggagugaagaagacaggggugucugccuccccagccagaugcacugaauccacucuggcugucaacggggagacacaugaagcuggaccccucucacaccucacaucuacagucgucugcgugcuaaggagccaagucuaggacccagcucuugaugaaccaaacaaggaucaguaagagcacaaguccaaaggcacccagagccaaagagggugggcgaggaccgggagagggagcggcgaguucugaugagagauuuucauggagccacauccucaccuuguggcuccuuaacaaacugcacggacuacuugugugugugguguguucuuacugauccuuguuugguucaucaagagccggguucuggacuugacuccuuagcacgcacacgauucgggaagggaggagaaucuggcugcaugaaaagacauguaauaaaaauguguuucuuuuuaaaugagcauucgcacccauaacacauaaguaaauguaauaaaaguuuuucuuuuuagaaaggccugaaacuuggggauuuccacugaaauaguacuucuaaagauagaauauaugugguuacucucccaguucagagaaucgaauuguuuacaaucugauuaugaaucugccuacuaaaucacagucuauccugcacugucgucuugccgcucuguaaaagugacuaugaugcugcgguuuacuuuggcucacaguucaagaaugcagucugccaccacggggaaauccuggaaggggacccauggcugcuggugacacugcaugugcaguaucgcaugaagugaugccugcuugagagacagugcucacauucuuccucaucauccauucuggggccccagccacagguagggugguacccaccucaauuaaccaagucuaacaauccguauagauacaccagaaaacuguuuccuacaugauuccauauccugucgggcugacaauaauaaccauaacuccauacccaaacacacuuaaccacugucaagucauggccuuccuucuuuugucccccacccacuaauagguucauugcaagauaacuaauggaaaacacguucaguccaacauaaaaaagaaaacucacacuuuaacagauccaauacugauuaaacauguaacugcagggggcuagagagacggcucugaggugaagagcacugacuacucuaccagaggacccagguuugauucccagcaucuacaucguggcucacaaccaccugaaaugccaguuuuagggaucugauuaucuauucuggccuccucaggcaucagacucgcaugugguacauacauagauauacauacagccaaaacacucauauacauauaaaaaaagcauagccaccacuaagucucuucugaaacucaauaaaucucugauguguaagcuccuauacaauaaaaaaccaaaguuacauacuugcagcaucgaguguuuaggauauacacucccauccccacagggaagaaugcagugauagcaaagaguacgaucaaagcaagaccaagcgcaggagagcaaacaccaacucuugcagcuccacaggagcuggcauuugggacccauaaugcaacacuuuggguuccaaagggcuuggguagcccugccuuuccagaugcuuguaccaccucucuugaguaggccccaguccacacaugcagcuuuccuuuacagauguaccauguuuagucauugccagcauaaaaaguaaacgcugcacccugcuccucuuuaugagaaagagcacagaacugcuacucaagggacuacuuauccucuagcaucuuccagggagcaccacaaacucacccucaaaccucucagguaguucucagagccugcaaaggcuacuugacccaucagcuaucaccauguucagcacuguguauauguuaacagcaggggacaccugaccuuuccugguaucuguugagucacccucaagcaagcucaucccagcugccugccuucuucccacacauuccuguuuagagcaaaugggagaggacuggcaaguuggggagggggggcacuuucacuucugucuaacucauucaaauagaugcaugauucaccaaggagcaaaucucugaacaacaaaaaauucccgugugauucuuuaaguagcaacucccuuggaaacaaaugcaugcaucccaacugucaacauuucuguucugacaagugcugucuguguacccauggccacugacagccaccuguacuggcagggaugccccuuucaguuuggggccucaacaaugaaacgucacaggacucacagguagcgagaaaugccauaaauacccagcagcagaucaugucuaguaagcaagaaagaggaagggagcgagugggaagauggagcccagcagggcuuggagcuucaaggcuucuggagugucacaguggaggucacgcuaggcaggacggcaacagugaaguccguaaugacaaaagagaagacagacuugagcuggcucugaggcuagcuucaagcaggguggauaucaggaaaacuguggucacagauugaagaaaggagacacguucucacaaacugcccucuccccaccacaugcaguaugcugccucugaccuccacacaaaauaacuguuucacaugauggggauuccugaggagagcuauagugagggacagauacaagcgacacacacugcauacacauaugaaaacuuccucuuuagaauuagcuuugagguuuuauuuuuguguacauguauguuguaccuacagaagucagaagagggguggguccccugggacugaaguuguagaggccagguugguguugggaacugagccuggguccucuagaacggcagccagugcacauaacugcuaagcgagcucuccagccccuauaugaaauguucaaaaaauuaaaauuuuuaagaaauuucaacuuuguggucauguggguggauaguggugguguagugguacugcccugacagaggggugggcagugguggcccaaggccugguacauauuuucagagccucuuccugccacaacaggguaaggacuuuaaaagcauaaaucuaagaauacucucuggggucagagcagcaaucacaaaagguuugagggauggccucaagacagaaagacagacaccagaagaagcaagaguuauacagauauuugguagugguaccuggguggguggguggguggggcaucuuaagacaggucucuguguuuauauagcucagucucagagauccaccugccucucucucccgagugcucugguaggucuaaguauuucuucuuaucuuagguauuuuauaaaccuuggaauuggcacuauuacucuuccuagccauguuuuuuuguccugucgugcuggggccuaaauuccacuuuauagaugagagaacuaaggcacacgugaauuuauccugaauuaguaguaugaaagggacuaaagucugaauugauucagagagcccagcugcuuccuuaaccuguaaaaauaauccaacaacuuaaaggcuuuuaaaaguuccgguucccucaacguugggcuucacuuguucuuguuuucuuuugguuuccuucccuuacagaccuuucauccuguuagggggcggggaaaccacuucauugccaacccaggcccauaugggcugcccagagaaggguauguuuuucaguuguggggguagggaaaaaguuuuuaaaagcuucugugaugaugugaagcuggguucccuuacacccacuguuccuaagugauccagaauuuaacccaguccgcuggagagaacuaggugaguaguggcuuguauuugaaccaagcccaaagcaaaaagugucgcaagcuguauaccagacuaccucuuuccuugucucggaccccaucaauucccaguaaggucuacucugcucgggcacugggaguuuuuagcuuuuauuauuauuuuuuuaauuuuuaauugaauaaaacaugguaauuauaaaauuacuaaguuuggggcaugugcucccgggcugcugagacuggcuaacaggugacagaugacaaggguagaucuuagagauaaaaagugcgccgcuuugcuuuccuccuccggaugcguucacugggccauggaagcagcagccguccagacgcgagcggcuguggcugugacccgccgguucuccgcgaccaaggucgacgcgcgcacagcugcauggggcugccagaggugcggccccacgcgcucugcaggccgcgcuggcccuccacagccugccccuccgcucgccuccacccggcacgguccgcaagauggaggcgaacgcgcgaggcgcccccaucgcggccagccuuugugcccuccaggccgcgggccucccccagggucccccacgcggagccccgggcacgaggggaaugccccgacucgagucuuggcgccgcgacacucgagccggccacagccuuuuuaccucacuccacaccgccgcacgucccgagcgacccgcguagcugggccagggucccaggcggcgacgacggggccucccgcgggcgcccgcacuccuggggagggagggccaggcgcccgccacg

SEQ ID NO: 5899 - RNA, 3291 nt, Mus musculus
uuuaggcucucugcuccucccuguuccagagacagccgcaucuucuugugcagugccagccucgucccguagacaaaauggugaaggucggugugaacggauuuggccguauugggcgccuggucaccagggcugccauuugcaguggcaaaguggagauuguugccaucaacgaccccuucauugaccucaacuacauggucuacauguuccaguaugacuccacucacggcaaauucaacggcacagucaaggccgagaaugggaagcuugucaucaacgggaagcccaucaccaucuuccaggagcgagaccccacuaacaucaaauggggugaggccggugcugaguaugucguggagucuacuggugucuucaccaccauggagaaggccggggcccacuugaaggguggagccaaaagggucaucaucuccgccccuucugccgaugcccccauguuugugaugggugugaaccacgagaaauaugacaacucacucaagauugucagcaaugcauccugcaccaccaacugcuuagccccccuggccaaggucauccaugacaacuuuggcaucguggaagggcucaugaccacaguccaugccaucacugccacccagaagacuguggauggccccucuggaaagcuguggcgugauggccguggggcugcccagaacaucaucccugcauccacuggugcugccaaggcugugggcaaggucaucccagagcugaacgggaagcucacuggcauggccuuccguguuccuacccccaauguguccgucguggaucugacgugccgccuggagaaaccugccaaguaugaugacaucaagaagguggugaagcaggcaucugagggcccacugaagggcaucuugggcuacacugaggaccagguugucuccugcgacuucaacagcaacucccacucuuccaccuucgaugccggggcuggcauugcucucaaugacaacuuugucaagcucauuuccugguaugacaaugaauacggcuacagcaacagggugguggaccucauggccuacauggccuccaaggaguaagaaacccuggaccacccaccccagcaaggacacugagcaagagaggcccuaucccaacucggcccccaacacugagcaucucccucacaauuuccaucccagacccccauaauaacaggaggggccuagggagcccucccuacucucuugaauaccaucaauaaaguucgcugcacccaaaaaaaaaaaaaaaaaaaaaaagaagccuuuaaagcacuagagcugggcagaugucgccccucuaagcuauuuugccuacuucccuaucaaugaccccgagauauaacuugccacguucugccuaggcugcucuuacuugaacuggcuagccuuuauggccauguuuucaugauuuaccuauccccuggugucuccucucuccaccuucuuuccucccucucaugguccugccucagaccccaagcccaggaacugaaaccucaccugccucucuucugcccagcuauaggcugucugcaucuuuauugaccaaucagggauaacuugaggggcaagguuacauaguaucacguugauguacugugaggaucuucuaguccccuaggcaacaagggccaguauuuagcauuacaauacauagcaacaaaccaaaucucuacauagaggcaggggagauucugaguucaaggccugcuugggccacaaaggaagaauuugucaagcacuagcaugcagucaacagcauggcuaguggaaguagaggagagaaaggacauuucaacaugagucauggggcuuaacaacagaucagacuagagaaaacuuaaacaugaagguucacagaggcagaucauaaugauagcaguaacaggcuggaggagacaaucacaaaucugauucggaauaugcugagcugagaugcugcagaaugucuggguggagcuguaaagcaggcaauuggaaacccacuucuggaacaugacuucagucuuuugcauaaaagcagcagcuuaggaaaaaggaggcagagcuaccuggaaaugaggaacaugggucuguaggaaucauccauccuugcacagagagguaaaccauguucugggaaacaagauaaaaauauguauagguccucaucuaaugaacacaccucccucccaccaauaagcuccuauuucaacaagcuguacaugacagcuaaauggcuucauguaaggaacucuuugcugucucaacaauuggacguuuuacaccucgacaggacauauugauuugcacagguuucuguuaugguauacuucaaaauuacuuuacuucacauugucuuccucuuuaacucagcuacaccuaacuagggcuuucuuggaggucuggggagguaguucuuuucaaaagcagaauagggaaaaauaaauaaauaaauaaauaaauaacacaauaaacgacugccaagguuucccuuuuuaucugcuguggcccgggaagauaguaaauaaauggcauuuuuaaaaaauccauugaaccaucuuucagacuggccaaacacuugacugaacuguuggcgugccaagucuggagacccggaagggggugguuaaaaucccgcuuguguuucagcuuaaguuacauggcagacacgccaccgaaagugguggcguuagagcucuguuucucugggagaguuuuacgucuucagccugcacacaccaggcuucuccccagaguccaauggacucgccccagagggcgcuagugcacgcaguggcucacccuuggcacugugcauagugccacccggacucgcuggucaccuaaggguaaagcucugcuagagucuuguacgugcacgcaaugagacuuucccccauccacccacuccuuugucucuguaccaggaaagccuacagagcccuuagaagaaaggauuucccgcaggauggagguugggucguuccggacucccuagcggagggcgggcaccaaccuccgagggcuccccuccuccaccagcugaggagaagaacugccgaggcguuccagacgcuccccucccucucuccccgaggccuggacaguaggacugaaagcugccaggagacaggauuggccgauggccucacgccccgucgggagagcccagccugccugucucucacucucuuugcugugccucccggagggugggagaagggcgggaccugggaaacgucagggagguggggaacggauauucaggguucuaauuggucguaac

SEQ ID NO: 5900 - RNA, 1922 nt, Mus musculus
ucuaagccgaggccaggaccugugggucaaguuccagaaggcagugagcuggccacuggaaugugagugugggugggggugggguggggaguaaggaaguggccaccggcuuccacugagucacagaaacucaagugaggaagguucccaagguccacccagguguagcagggagagcaagggcuggaaggaggcaggcauuuacccagcagauccugggaggccaagcaggcagucgcuacaaauacugcccugugaaagcccccaggagaugggagaugcaggaggcccugugugugugugugugugugugugugguaggaggugugggggucuuugugugugagugugugguaggucugugugguguggguguguauguaugugguaugugugaauguauggugaguguggugggagugugugugauauggguguauuauguguauguuuguaguguguguguguguguguguguguguguguguguguguguguaauucagaaagauccagagcccuugccguugucuaguuugaacuucagcaguuguugggugucauguaucuguauugaucuugagaaguuaaaguugaggucuguccuauguagcuuuagcugucagucugacacagcuuagucaucggagaagggaguaccaaggcagggauugcccagaccuagaucagauuaaccuguggacauguaugugggggauugucuugguuguuagcugauguagagagcccaguucauugugggugauaccauucccggagcagugguccuugggcuguauaagaaagcagccaggcacagauaggaccuauaagccagcuagcaaguuugguuccugguuucaaauuccuucuaugauuucccuaaguggcggacuguuguccguguucaguuguguuuguaaaagaaauacagaaugucuuucccagagcaaaggucugaaacugagcaaaugugcaaauguaauaaagauagacaauaagacacucuggggguuaggagaaggaggaccacagcagaguggagggauguguguuguggauggccuggugcuguugugagccaaucaccuaaugaauaaaggagucagccacugggugaguaggcgggacuuccggguuagaggaagagaggaagcaggagagaguuaggaccuuuuggauggggauagugugaggacaagauguagcuacgagugucucccaguuucaauggcggauccauuaggauuuccccccaaggauuuagauuuaauaagcuuacaagauuagguuuuaguuguugugcccagugauugaguuaccauuguuucugaacuaaguuuguguugcauuuuccuucacacaauggcuugucuggguucaagagagaaagguacgguggcaaagaauggguuugcaagauguguaccauaaaggaaguggggguuuugaagcaaggggcuggugugguagcaccaguggucccagugggaacccagugagcuggguggagagauuuuggagcacugagucaaagucuccacgagauaaaaacaggccauugccugccaaugcauggccggcacaagcacuggaaugaaccgguucuauuuauuauuuccugcaacagauguggacgaaacaaacaucacaggaagccagcaggacaacaugcccauuaucugccugucaucugcaugugaggugcccauaccauugcagaaaggagcagaguguggugaggauaauggccuggugcagagguacaucccuaaggcaggcugacccaacauccaagaaccuuugucugcuuuucacuguuacaguagcuauuuuaacugcuguacaguagguggguagcuaaaccuggcuaguuggugcauagacugugacccuaaaucugguaacagcuauacaggguac

SEQ ID NO: 5901 - RNA, 661 nt, Mus musculus
gaugggugcauucaaauauauccaggagcuauggaggagcuauggaggaagaagcaguccaacaugaugagcuuucuucugaggguccacugcuggcaauaccgccaacucucugcacugcacagggcuccccgccccacccagccugacaaagcucgaagacuagggcacaaggcuaagcaaggcuaugucauuuacaggauuugugucugcugugguggucacaaacgcccgguuccuaagggugcaauuuacggcaagccuguccaccauggaauuaaacagcugaaauuugcccaaagccuucagucuguugcugaggagagagcugggcgccauuguggggcuuugagaguccugaauuccuacuggguuggugaagauuacacauacaguuuuuuugagauuauccucauugauccauuccauaaaucuaucagaagaaauccugacacccaguggaucaccaaaccaguccacaagaacagagagaugcauuggcugacaucuucuggcugaaagagccauggccuuggaaagggccacacguuccaccacacuguuggugguucccgccgugcagccuggagaaagcgcaauauucuccagaaacaacaagaaagaagcaacacucaaaauguuaauaucaaaccaaaauaau

SEQ ID NO: 5902 - RNA, 7968 nt, Mus musculus
ucauaguuuauauuuuauuaaaacagaacuuaggcauccacaacauaagcucauugggucucuggagccucugagacauuuuucuagccuuuaucaauaugggaagcacacguacacauggucuuauaguaugugagauaaagggaccacuauuaagcacauggucuaugauaaauacauuguaucuagagccaaaugcagcauguaauaacccagaagcuaucuuguagaaaauuccuuuauuauagugcaaauaacuuuuagcagugacauaauguaacaacacauuuaacaacaguuuacaccacgcaguaaauaagaaaguguuucuuugaaaauaugucaucauaggaacauuaucuuuacauuaaugcuggaaaaugccaaagcuguuuucucaaggcaguagggcuugauccuuuuuuggauauuuuucucuuaaugcacauggauuugccauuuaaugcgucaucaacucuaagagugaucucuuagggaguuguagagaaguuggcaagauuugaaacugggcuucaaaauuuaaaaaaauaaucauuuuaagacaauucugggauugcccaggaaguagaagucaucuguuaacaugguagauagacacauuuccuccaccuuugcugcagauugucuaaagccugcuuauugccccagagccugauuguuaucccuugguuuugguuauugcaagacuagggcccuggguggacagaacuccuguguaugcagugcuuuccccaugaagcuugaaauugcacuuuccauccugaauuccccacauuugaccucucaggcugaggagacugugaacuuguccuaguuucuagcuagccauuuggacagugaguugggcuguggccccuauugauuaacuaguccaaaaucaacucaaugcaccacuuagacggcucccaggaggcugaucugggauuuaauacugcuuuucauuaccaagcagccuacgggauuggcugcuucugaguuagcugacagguagagaaaagccacuuccaaucuuuuauacucccguaccccaagcuucugcugaguuacacaugcuugcccacucagaagaucccucgggggggugggggggggugcuuacugcaugaaucgaauccaaaucucauaaauguuuuucaggguguguucuaagucucuugacagacacuccucuaaaguggcuuuucaacccaugagaaauugcucacaggcuuuaaaaaaaacaaaaaacaaaauaaaaaccuggagcuacaaaacagcucuccuggcugccugagaagccaugagaacagaaaguuuuuuaagacgcagcaggucuugguggacaaggcuuugaauauaacaccauggaacugugcuaaacaguuucaaaguugagaagaauccaaauauaucaucuauaaagauuccuuauuugaguuugcuuuguuuaucuuagacuuugguucugaaacacugucuacauucuugacacaugaagaugacauggucacuucagugccucugcauguuguguaaaaaaccuuagaagcgaaggacaaagaggugcccuaauaagacacauacacuguacaaacaaaaccgaaauuauauauaaauacaccccacccaggaucccuuucuucucccacuaccugcccaaagcaaugccaaaggcccuucucucuaggaccaacgcaggguaugaaacaccgagcaucucuaaccuugcagauacguuagucaccugcagccuacuggugguucugcaagugcaggaagcaguuucccuggaagcauggucacuguuggcugagauccugggacuuaaucuuucagaugaccuagcuggaucccaccguauccaccagggaggcagcacugucuacucagaagcuccaaaggcauugcuuagggauacugggcagggucucagaagacaaaguauacaaugagcuaacagccuagguugauauaaauuacuucucaguaaguaauuuggggcaacuugcuucugcuuaacacugcauucuggaaccauuuucauagcauacuauuaaaaacugauauauaguuauuuaaaaagcugucuaugcaaucaccucuuauaugcuuuccauuaauuuaauaacaacuuaaugagcuauuauguaaaucuaaggaauaguuagccuuaaggaagccaauacugugcuaauucacaggaaggagaaaaagcaaugcaaacaaaaguucccaucaucgacaagaacuuuagagcuuuaucgaaguguugcaaaaauguccccaaaagcacuuauagcaauuuaugucaagaagccaaaguugagggguaaggggaauauguucaaauucuuuaagguaaaaauucacuuauuuuaugcuuguuauacauaaauuucccccuuagaccuaaguucauaauuuguagacauugcucauucucugauacauuaauacauauacuaaauauaaauaaauuaaucgagaaugcuuaaaaauccaaguuaacaugaugcugugccaaaaacaaaacaaaacaaaacccaagaaaacauaagaaccaaaccuugcacaaucuacauucuauguaaauacccugacuaaaaugucgguugugcuacgcaauuccacgucagugcagauuugauguaccgcuguuguuuuuaaggucuuuagcacuuuuguuucuaaauaucaccuugcuuugaaaugaugaguaauugcuaucaaaucacaaaucaucacaaauccauuuuaguuuagucugaauaaaaaccagauaaauguauuacuuuguucuggguauaauggcucagugucuuucuugcgaguuuucuucuucugggcaaaccacagaugagguugucacucuggacuuaaacugcacagaaagagacagugaagucugucuuuguuuuuguuuucuuuuuaagucuccagaucugguuaggacacuucuuucagacauguaguuguggcaccugaucgaucauauuugaaauagaagugcuuuaaacaucagccaaguuuggugaucuggagguccccauugaucuuuauggugucaauugcagauaauguuugaauacggugauaaaaaucaaaaaguugguguccauccacaaacacucugaaacgugggugcucgcaaagaaucuccaccuagaagaaacaaaaauaauaacaaugcauaauuuuggaugaauccugcuggaguaagggggaaaccaacaacauaaccacacuucauuguggagaagauaagcaaggcccaccguagaucucaaacaucacaaauugcugaaugcuagcuagggugcagacugcuggguucccauucccccagcucucaauucaggaaguccagagcucgaucuaaaaaucugcacccuccccagugcuaaggcuggagcagggaacccacugagagaaucaccacuccauaccagugaaagauuuggaacagacaauuccucccauauuccagguagaggugugaaggagcaccaaucucuucacaugacacuugaugccaaacaagccauccuaccugcaggggggccucuccugaugcauggcugguagcccuuagcagcaucuaauaauagucuagacaaucaugguaaauaaacacuaagggagauuacacaguaauaagcauuggaccaagaauguguaauuaacaaggcuuuguuaaaacaaacaaacacugacuccacaugguaaaccuuuucccucucuuucuccauaauucaccacagagguuuguugggauuuuguuuguuugcuuguuuguugagacagggcuucuucauauagcucugacuguccuggaacucacucuguagaccaggcuggccucaauuucacagagaucuguccgccucugccucccaagugcugggaccaaggguaugagccaccaccuccuggccaccacagagcuuaugaauuggcugugcuaugaugcuuguagaaaagcauugacaguuaucauuaagggaugccauaugugguaucagucacauuuaauucauauuacugcuuaaauuauaccaucaaaaaguucuauuucacuccauuuguguaaacuuuauuuagagacaagguuucucuguguagcccugguagucgucaaacuuacucuguagaccagacaggccuugaacucacagagauccaccugccccugccuccuaagugcuggaauugaaggcgugagccaccacccagcuuauuucacuacauuuuuuuguugcugggaagcaauguaacccuucuagucaguagcucacaaucaugaaccaggcauaaggauuuaccgucugagauagcucuguugaggaaauacucgacugguaaguaagaggacccaaguauaauucucuauuuucccacaagaauggcagguucugaaugcaccuguaauaccagcaguagagugguggggaucugggcucacucgccagcccaguuuagccuaaucagugcgauccaggcuagugagggaggcagauggugguguuccuaaggauggcaccugaauugccuuccaguuugcaagcucacacacacacacacacacacacacacacacacacggcuuaccauguaagaacguggcauagcaagaggagcccgcaagggguuaccauucuaaaggaggagcuaagguaauggggaaacguccuagauuccggucguaaggggaacaaucucauuuccuuuacugauguaaaaaaguuauggauuuuuguuuuguucuagacucuaaggaaagagaaacagucacgguucuugagaagacccacgugaagugcaagguaucaagagcaguucuguuuacucuggucuauacguagcacagagcuuuuaaccgaggugccguuacugacguaugguacgauucaugcagacagcagccucaucuccaggccugacccguacacaagucuguucuuauauuacugacuugcaccucuuauuuguccugcagaggaagguagugagugcuacugcugccugaugggguggcaaacuggguuguuuccugccuguuagagacugggagccaaggagcucuacccaagcccuagggaagaaaccugucagccacacagcuuaugaccaugaaacagacacgcuuaauuaacccacacgggaaaauaguuauacaaauauggacucauuagcaaagugaacaagagaaaaugaaaugauaaccacuaaauuguuuuaaacccauaacuaauaagguuuugagguauuuaggccaagaaacaugaaaauucuggauacuuacuaauaucuagugaucaaucagauacuuggggguagguuauuuaugugccucacacuauauugggaauuacacagaaaauuauuacuacauuaauaccccagcuugaccugauggcauaggccuguaaucuaaaauacucuguaaacugagccaggaggauuacaaauucaaggccagccggggaauuuagagaguuccuguuucaaaacagaaaucaaaacgaggauugggaguguagcuaaguuguagaaaccuuaacuaaugugcacaagguucagucccuagcaccaccccagaaguuaacaauaauuaauaccuccgcacuggcuaaguagaauuacaguuaaguacuuagcaauuagguaugcauauaugcauccauuaacuaaacauauggucugaagagaaucaagagcuacuaaggcaagcauuaacaucuaucagcaaacagacuucuuuuguuguuuuuuauucuuuucucucggccucgagacaaguuccgggcaacaaauuucuuggacaugaagaaauucuuaaagagcucuuggcacacaguagauacagaguaaguaggggcccugccaacacugcaucaggcacucaagguaccuacccugaacggcuggucugggaugaauggaaaguaagggauugccgacugcuccucgccucuuucuccugagauacaagaguuucugagcagcugccggucugugaacacagcuuugaguucaauugccacaucggcaggaggaucuucagagucuccacaggucaagcugauggcaaagcuaaaaagaaaacagugucacuuagccaggagucagauguaacauuuuaacuugacccaguuccuccuccaguggguucaucggcuuuuaaugggcugcuacuguuuacacaguuuaaacacagacacuaaggauuacacucaaaccaauagauuuuguuaccuaaaguaggcucuggugaaaacuccaguggaacugaaaauaauuacaacugaagacuucaaaugccucaggccacccuugcauuaauccaucucagaguucucaaaaacagccacagaacuugacaagggaaacaucuuguaaguuugguucuuauuuauucuaacagguuugguuacgacuaccguguuucaaaaccauaaaaaaagaagucuuuuggccuucucaagggucaaagauuaacuguaggccuauuuuuaucaucacugauauaaauagcuaucugcagagaugauggcuaggauugauacacauucuuuucaugggaacaugguacuuucuuggcacuccuaacuagugacacugugcaaguaggguaaggggaggaggcagccgcgggacucagcaauggcagggcucugcccuuaccuuucgggguugagaucuacgaugcccaucacuaauaccuucuugccuggucucaugccaccuuuaaugugcccacaaaauggaacuaucugcaaaggaagaggggagagacaggauguuuaugggcuguuagagacgagccaaacccucagcccugagaaucagacccauuagaaagcaaggaaaugcaccagaggggaaaaggauaaaggcagagacacggagcacauugauuuaccagucgugggaaguacacgucggcuugaacuggagaacccaaggaguuguuuaagugcccaucaucaaguuucuaaaaauagaagcacacagauuggcuuuccacagacccuuguuuauuagggagugaauggaaggaugaggaaucaacacaaaucuguagugauccagcagcccuccacagacacacauacauaugaugccucuuuauagcccauuaaauaaccgcgaaacaaaacccggccuuuccauccggucuaagccucugaugauccccaggcucuugagaccggaucaaauucaaggucgcggcccacccgggaagcaaagcccguguaggugggcggcaggccccucuccaagcacaaacgcucccggagucucugcccccuggccuguccucggggacguggcuggagugcagcggcagcgcucggcuucucuccggagcccccggcgcgggaccguuuccaaagggguaaaucccggacgccgggaccgcggccccacacuaacccacgugcacgcacacgcgcccagcgcgcaccuggccggcgcccuccugccccgcgcccggggccccccgagcucgcaccccgcggcggcugacagguaccgcgcuucccgcggcaccgcggguccguaguccuugccccggcccucugagcuacccgccucgcgggaggccgcugcacucaccaccacggcgucgcugucggccaccgaccccgccauguuccugcagcgagcgccggggacgcggcggcgggcgcggguccgagccgggcgcgcgcacacacgggcgcgcgugcacgccccaggcuggcgcggccgcaggcccgggagggggaagggaggcgggcggcgcggagaucgcggcggcgaggggaugacgguggcgagggccgcagugcguuggccugggguggcauuuaaaggcggcagggcucggcucgggaaccgagaaccgggaacagggcggggacggggcccgggagccgcggcuugcuaagcgugcccugcccuacggccauuggaccacggcug

SEQ ID NO: 5903 - RNA, 8136 nt, Mus musculus
cugacaagccacucauuaauuugcuuuuauuuucgggaaauaauguagauaaagaggaagaggagacggacugccuuacaucucaacaaguaauuugugaucuucacaucggacaaaucaaauuuacaaauuacuuucccaccuacugaaccaagcggccaaaaccaaaaccgauagguacacagguacucuccgcagauuucggagaaggaagguucacuaaaaacucacagaacagacaggguguuugagagagagagagagagagagagagagagagagagagagagagagagaaacauuggaccuggaacucgggcuugguuuucuuuccacaaugcuguaauuucaccuuguuuguuugucuguuuguuucuaagcggaagcuuugauacugugcuuagacuggcgaagggucagucgugcgcccugaccagccuagccccgaccccuguauccugacuuagcuguuuccuucacuuccgauccucuagcgcccagcuuccuggaaccaagcggguuucuuuaauaaauacacaaagggaggugugaagagggcaggacagcuuuguaauaacugaaaaauaagaaccaccaucguuugaggaagagaggaacgggaacaaaggggaaauaauuuuuuugcuucuguuauauauauaugugugugugugcguguguauauauauauauauauaugugauguauauauuuuaaaguucuguuucuuggacgcuaaaacaagagagaugcucaguucaaccaacagcaacuaaaaacuuuaaguggucccuggaacggaccugacuauguacagcauucccgcugaggcggaagcuugaaucaguccagcgcaggguaggaaaggaggcuggggcacacuccugccgcgagccuggcccaacgcucaccacuggugagacagaaaugcuggaagcucgggccugcggguggggagcuagaucaagggcagcugaaggggcgacagucugcuaggagaaacaguggaggguuugauuaggaguguguauguauggacacacuccaaacgguugauauacgccaguuagugacuucaguguccagaaagaauaaauaaaacgguugagcucaaaacagagggucagagcgaagagccccagaaggcuccaggugcauaaaagcuguccagaaagacuugaaggggugacgcacgagcugagagcgagagcguacugcuauuccgggaagaaacggagggccaagugggagcaccgggccccaccuccaagggggagaagggcugcauccuccacccccaaccaaguggcacacagaugggagcggcagugcaggcaaugaauaucuuuugggggacugaaaauuaaguuuuggaaaagccaaggcaaaggcggguggugcagcagcagcaacaggauggggaccauggaggguauagguaguugcguuucuucuccacuuccuuucccuccugggcucacaagaccuggaaccgccacgaggcuugguccuuauaguccagacagucgggagaguugaaauugaguuuccaggcagaggaagcagcggcggcggcgggcuccuuguaauccaagcaaucggcagaauugaaggcgagcccagagccuccauaaccuugguggugguggugguggugauggugguggugguggccugaagauuggcucaguggguggugcgcaugagggugauggugaugauggccagccauggaggagggugccauggggcuaagcuggugcggguggugaugagagugcaugggcgcuagguaggagcugcagucuacaccgccaaaguaagaagaggagggcgcgggguaucccugaccauagcuuccgcccuggccauaggacauaggguaggaggcugcggcaguggccgcaccugcggcuaccgagcgcugcaugcacgaggcguugcucggagcggccaguggcucuggcaccgauacggaugucggcgcugagcccggcgagauggaggccgggcuccagauggacgaagcaguaggcgugcucagagaggacgcugcugccacuggguucccacccaggcccgcggccgcagcagccgcgggguuggcggaggcacuggacgcugagcuagacgaagaagcagagcuagauacggcgggcggcgugaacuggccgcugcucucugaacccgagcucucgcguacuggagacgacuucuucuugaccggccggguuuucguuccauucccgcucugcugcugcuggcggcacuuggcgcggcgguucuugaaccaaaccuacagugagcagggugaaggagaggggaucagggggcuggcuaguggagcuacuccuccgccccucggacucauaccccgcccaggaucucgggaagcucucaaucccagccucuaccccucccaguccccggcccugccagacccuguccccucccccgcacgugcuagguccccagcucuggcucccucccccauccuucugcgcaaaccccuaguaagccuccucugcuggagggaugcgcaccuccccaagcccagcgcaacucugcccgagggcggaacauuugugucuguccagccagaaguucagccaucucuaagcuguugcgguuggcugcuuccccgcagccccguuuuacuuuggaggcccuguuuuccuugaacagagcucaggaaacagcagagagauacagaacaucgaaguguaggucagccaccaagccuggggcccgagggguuucaccgagucggcuccuggagacuggaguuggucagggcgaauauuugggugggaacagaagcaaagcuagaggcuggacggaaacagcacuccaguauuggggcuuuucgagaaggaaaaggugagauuuccuugggccuuuuggcuccaggugggauaccaaauggaauggcaagucauaaacucgcauuccuaggagaaaguccgggcacagugcauugcauucccagacccuucucgagccuucgggaaagaaguuuaaacgaaagaccguaaagaaagaauuaaacuaagucagaacucgauuuuucugaacguuucaucucagaaauagaaaagcaagcaucuggauuuugcacucgacguccauucggcugcagaaaacucccuaaccagacagaaacugccggcggaacgcauucccaggcagagagcacuaggcuguggccaaguuccaucuugcacuuuuagaauccccgggacgaauggcaagggugugaaagaaaggccucagagcuaaggccucaguucuguaguagccaaagaagcagacccuuaucgaacuuucagagaaaguuacauccggggaacauggcuggccucccccaaaccaaaaacaaaacgacuuucaauauugaaagcgcccaggcgauaaggaauagauacugggcucuaagccauuccuuuuaauguuaccccuuuuaucagacuuacgcccagcgcuagggggaguuggagaggggcugugcagucagugagagggccccaacaucagacagccuaggccagaucuuuccagaccgguuccugcgucccuacccuaccccuagagccccaggagcgcgcaccuggacucuggacucuggcagguugaucuugagugccaccuccucgcgcaugaagaugucuggguagcgagucuuugcgaacagcgccucgagcacguccagcugugagcgcgugaagguggugcgcucccgucgcugcuuccgcgggguggcugaggggacaugcgagagcgccuggagucagcgguggaccacaaggacuggugcuagaggccacaaguaagucuucugguagguucagaacccccgccauagaaagaaagggccgagcuccgagcaaacgaaaacuccccuggccacagguggaacaaaguguacuuauucuacuaaaggccccagucuagaaccuuagggccuucacccucuguaccucucaugcgguuaaaaacaaagccacccuuuccuucucaucucccuaaacccacacgcucccuaacugagaggcaguuaauagagcagagguggacagaaacaggaccaggggucacuuuuuccaagagaauaaacucauguuaaauaaguaggaucuagaaaagaaacccagggcucagcuggagucccccaucaugccagaagaguugggacaaaucacuggucuugagguuucucuauggagaaaaaaaaaaaacccuacuucucagggaagcuagacauaagaaaaauuuggcuauguuagggccuagugaguguccagauuccucaugaaauguuggaccagggaaagguuuuauuuuuuauauuuuuaaaaaaagcaacugagggaaauaaauccgggggcagggggagggauaaaccugcccucccuagcaagugggacacaagaggagccagguugcaggcaccacaagcucaaaaguuguaggcugcacuuucuacagagcaaggcaacaggcggcgagcuaaucaccuuccugggucuguuuagggacugugugggcucaaacuguagaggauggaaucccccaauauuuacagagguuugaggguaggggcagagggccacugcucaccaggguagcccacggaggggugcaggagguccauggcagggccagcuaggcccagcccguucaugccguauggggguuguuugagguaagacaucaugcuaacagccggguggaggugccccgacggauccagggggccugaggccaggagcaguucagggcucccacugcgaaguccuucaagcuguugcuucugggggccuggccuagggagacagcagacacauggaaaccuucacccgcagucaguuuggcuuucagcuccucuaauccuugaauggggagggggcgcgugcuaggaacugcacagcaggcaauccgagaaacgucuucuccuuuagcucggcagcuacacagcuucucaggaaaguaaacuuuucccacaucguuccuuccucuuuuagggcuugacaagggccaaagacacuccucgagugucaacaggaaggaaaaguuaaagcgugaucaggcugaggaggugagagccgggaccgcggagggugcaaaaucccaagugaagucaauuuuuuuuuuaguguggcggaagcaauuugcucaagcaaauguucauuuggcgccgggagggcaggccgcacagagauaccggguuauuucguuuaguuugaaauauuuuugaaagagggacaaaauggcaaguaauacagaggcccaaggugaauacaccuugggucgccaaggcucacuggccacaucauuucuucaaagaucuccagcgcugccuccuaccccagagccugcaaucaccuuucuaguugaccucucugggccccuagcacuaagagauagcugaacaggaaucccaccgcaccuccaggguagaugcggcccaggccaggcuaaggcggcaagaagacgccaaaggcaccacaguagaaguggcaguuucaggaugccgcccaaggucagggguaccuccgaggcggucaccccucuuccuuugcucgcacaggcgggccuucuuucuaccaagucugcuaagcacaccgagucccaccagaauuugauggccaacccagcgccccaaacauucuagggauuuuggaaggccuagcgugccaggucgcgucgcaucggccguccuauaugaacccgauggagagcaaggaacuaggccucagguuguaaagcucacgcacagccgaccgggagggcgaggcucggcgcagacacucugagcccacgcagcucugcuccagcaaaagaagggguucugggaguaugacugggaccggcggggggcuugaagcuacaucccaggacccaaggguaggagauuccggggagaaagggagguaaaacuaaagcagcucccccaucccaacuccuuuccccgccucagcccugggggacccucagccuagacuaaggggguggggggaggucagcgagcacauaaggcggaaaggaaggauucaaagagcuugggccgaagggccacaggccugcagccuccgcggcuaagcccggcugcggugugaguuuucgaguacuuucgucuaacuuagcagcccaguuccgcagcuucggaggaggcgggggagggggcggccggcucccgagcggccugggguccccagggcagccaaggggcgcccggccucucacuccaaccccgcccaccugccccggacagagguagcgggggucgauuagaggacggggagacgagaggggccaccaucgucccgggguggcgcgcggcccggcgacucccuccuuaccugcccuccgcagucgcggcuuuucaccaucuaccucucgccuucaccgagacucgccggcagccaaccugcaaaacggaggcgcacagguauuaccccggagacggcgggacccuaggcuuuccucuucccucaacuucccucuucccgucuccugcauuuuuucuaggagcucugugcguguaccuccagguuucacuuuauugcucaaacacuuuguugcaaagucccacaugcuuuuccucucaagaccuggccucgcccgggacccgggggguggggugggugaguaggggguguucgagggacagaguuaggagguggcuugcgcuggcagcugcacucucucggagcaagccggaggcgguagggacuggagaaauccugcauagucacuuggcaaacuaaauaaaucaagcaauuuaccuugucggaguggcuugucuugcucgguuguuuaggugauuggaaauguagccugaugaagauugaucaccuuucuacugcccuccccggguaugugaacgcgaggcgagugcguaacggggcucggccuccaauagggggccuagagcggacugagugacagggagcugggcaauggcgagcccggguuaccuccgcgcgcccccgcccucccucgcccccaccuccucccuccccgcgcgccggccccgccccggucgcgcgcuaacucugggucuagguuggcaaauuccgcucagaacgaguugaggagggcgaaggcugcgccggaguugcuggcacagagggggccccgggucccaaggcucgcccgagggcccccgcccuccccuugcccgggccgcgcuccggaggaguggcgucaagcugcuggauaaccgguuccugcucgcgcgcgcgcgccgccaggcucugccgcacugugggagccaggcuucccaggccgaggacucggggcgugcuggccccuggcacuccuugaugcucccuggggccccagcaacuccuccuccgcucccccacaaccagcggucgccgccggcgcgggcugcugagcggagccgggagugggggugcagcucucggcgcgcagggcgcccugcggcgacccgggacucuugcgcccagaaagagcaccggcaggggaggcgccgccaauucccagcugcacagcguuuccaggggcucccaggcagucucaccaaagguguucgcaaguccuaaaagcuucuucggaaccguuggaacucaaaucuccuuacauucucucucucucucucucucucucucucucucucucucucucucucucucucucucucauggauuugauagaaaacuuucuuuuucacaaucugucagucuuuccagaucuccaccuacaacgaacagucugguggaaaauguggcuacacaccccgaucccucucacuucauuuucuacaccuuacuggaggagccuccucgaaacaauuuccccggauuguucuuacuggcagaccccaguuuccagccgaauaaacuugcugagaucgucuucuuguguguacuuuucaaagcgagagggaagaguauuuucggcccaaccccgaacaaggcaauauuuuuacauggcaucuccuacugaauacuagggaccacacuuacacucuuuccuaguucuuuuuccucaucuucugccguucucaccccaacaggcgggcgaaaaguuugaaccacaguaugugcgugggugaguucggcagccgccgagagcaagguagagcggagcaccgcgaugcccaggccgcgc

SEQ ID NO: 5904 - RNA, 20661 nt, Mus musculus
gcacgaacuacagcauuaagaggcauguacuggcuuccagcuggggcucuugccaagguaggacgugaacaauguacaguucuguuccuuugucucucuggaucauaaaggacagcauagagccaagucugguggcccaggccugugaucccugacacaggaagauggucaacucaagcacagccugagccucaaaacaaaaaguaagaaaugugggagggucuggucugauucccaguaucacaaaaagauaaaauagaggcagaggcagguggauuucugaguucaaggacagccuggucuacaaagugaguugcaggacagccagggcuauacagagaaacccugucucgagaaacaaacaaacaaacaaacaaacaaacgaaaaaaagaaaagauaaaacagaaugaaugaaugaaauaacaaagugaagauagcauuacaccaguggguugcuggugggggaaaucacugcuacauugaucuaaaaaagaguugggcuauugcccugaaacccaucuuguuuggcuuccuguccuacuuaaugcuuuggaauauuuuuuuugaagagccucucuuaaaguaugauuuaaggcuuaccacgggaugaguugacuuuuuaaaauugaaguauaauuuuuggacaguaagauguauuugcucuaaguguccuguguaaucaccacacaaucugguuuuaaaagucaucaccucagacugacccucugucccuuguggcugguccccaauccuaggcucaucucuggucucaggcaaugggccaucuuucugucucuguggauuugccuauucuguaacaccauuuucauacagagcuggcuggccuugaaaucacaaugccccugccucugcuuccugauaccgggugugugccaccaagccuggcuagguuugcaucuuaacagguuaugauaaguggaaucaagugacacucaguccucuguguacagcgucuuucagccaguguggucuaugcauucuguaugagaucuguuccuuuugguuuguggauaauaaucuacucacauacauugcauuuccaugcacuguugaccauggguucugggcuguagcuauuauguacaaagcauguauauucguguaggugguuuuacauacauguauuuaguuaucucaguugaauccuuguuguggacuggaucuaaugcuauuuguguuaauucaguuucccaaaucacaugggaaccuguacgucugucuguaagacucugaggguccuugcccacaguuggcuguaauugguaaauaaaguugccaguggccaguggcuggacagggagacagaggggggaaccuuagauuuucccggcaagggaaccauggggaagcaggaaagucaugccuaagagcugcaggagacgaaguguacagccauguaagcaucuggguagugacccagcuccuggcugcuuagggcauauuaaaaaugaggcugugugugugugugugugugugugucuuucauucgugaaucuaaaacauuugggcagugucuuagucaggguuucuauuccugcacaaacaucaugaccaagaagcaaauuggggaggaaaggguuuauucagcuuacacuuccauacugcuguucaucaccaaggaagucaggacuggaacucaagcaggucagaaagcaggagaugaugcagaggccauggagggauguuacuuacuggcuugcuuccccuggcuugcucagccugcucucuuauagaaccaagacuaccagcccagagauggucccacccacaaggggccuuucccccuugaucacuaauugagaaaaugccuuacaguuggaucucauggaggcauuuccucaacugaagcuccuuucucggugauaacuccaggugugucaaguugacacaaaacuagccaguacaggcagguaucgaggagugcgcugugcgagcacccgcaguggaguuuagaucgaaugaaccuucuaauggcuucaaucccuggcagcuacuccugggaacacagugccgagugauccgguuauguaugcucaguuuuaaaagaaauugccaagcuacuuuccagguuggguaugccauagagucccuccaacagugugugcggacugggcuucuccaagucaucaaaaaagcaaaauaaacaaacaacaacaaacaaacaagaaacugcuugccccugucacuuugacuguagcugcccagcaggugugaaaucuguucuucguugcuguuguuuguuuguuuguugcaugucuacgggcuagucuuuuugauguguuccuugucuucucugcuacccuaucuaagaauuugccagcaauauuuuaaagcucaggagauggcagauaaaacucccuggggauggaaaugggguuugucuuguucauuagccacuuaauucuaagaacucacuacugagugggaagcaacacauuaccucagugcugcugcuuuuuuaaaaaagcuacaaacucaauaccucaaaacagcacacauuuauucuuuuaaaguucuugacaccagaguuuggaauuucauuggguccaaaucagucaggggagacucugggcacuguagagggaaucuguucucuccugacucucuccuucucuccucagguccuccugcaagauggcuugccuucuguucuguagugaaauaaauauuccuuuaccucacuuccccuuuggugauauaccugauuacauguagaaucuaccuaaauaaucgaggguaacacacucuagguuucuuuugccauuuaaagaaacuuccugggauuaggccgugaauaucucugggguauuucagcugacuaccccagagauaggucagcaaucugucugcaugaggaggccucugagguuuagguuuggaguugguugguucggacaacgguuccuguugaggggucuucuggaggcucagguagguccuagaggcaugcugauuugggcuccauagcccuuacggcuccucucacucuuuuuccuagaaacaagaggagcggacagcacuugggcagccaccgggugguggaggggccucugauggugcccaacauccuggcccuagucuucuaccacccacgcuuacuacacagcaaccccuuucccauccccaucuccuuacccuuacccuuacacuugccgccccuugggagucggccacgcugcaaucucucagguggccagcaggggucagcauccccgcgcagagggucucgaggcugcgauggguggagcagggcucggugguguccuccugccaccucugguacagguccugaguacagccaaugugucuccacugcuuacccgcucucuucucuucgcuuuccaccuacgagaaggcggcucccucggggucagcuuggaggaagcuagccuccacagaagagccgggaaggaggaccagaggcaccggaagcccagaggccuuccugagagcaggaagcuguuagauuuagaaugaauuuucucccaagugucucagauuguuggccaaaguuacucugauucuaacgucccgugguuccucguccagcugguggguuuggguggagccugguggaaugcuugggccagugccucgggucugcaguaagagagccuggcaaagccaggcauuaaaaccucagcccaauuacguucuuuuccacuuguguccuuccuaauuaaaggaggcccucuugaugccagcauggaaugcugcagacaaggagaaacuaaauucuggucucgaacucaacagccugucuuuaaagcagauucauuauucacgaugaauaaaaaguagcuauaaacacuuguguauggugguauggauauacauuuccguaguugggaaugucauguguuuuucuugcuuguagaauuucugauugaaaaucuuuaagauaguuggaaaacaacacagguaucguggacugagugguuguuuuguaucaggcagaauaugugucugaaaggggcgggagggucuuccgguccacccugacuuugggaagcugcagcauacuagcucuguagggcauucggugcugcagcaaagacagcccugagagagacccuugguggauggcccuuuacuguaugccugaaaucugcaucagcuuggucuaggaggcuugucucuuuggaauuucuuuguggugacauggucaaaucaaagacaugcagagccaggccccgucuuagcuguccuggguugcaucuaacugagucccccauuucccugaccauguuuccugacuaccucagucuauggaauguugacuuuguucuucagcucauuuucuucaccuuuacaagagauguuuguaacagaguaaagcggggcuaacuaacacuuucuaguaccucaaacaauugccacacugccagauauacuuguuucacaggaucaucugcaaugcuaaauuuccuuuuuaugucauccguggaagcuccuaaccaaagggggauggagaauacucacgagucugagugauguugcaugucauuguguggucucacuauaagcacuucugagggcuaagcuuucucagguccugaugaaauagcucucuaagacaaacaaagcaacaaaacaacucauagagccaaaauacuaacaaucagcaacaacaggcucgauauuguuaagguaaguuacugaaugcugacauucacaacagaacauagacaaguaucuguaauuaaccaggucaaaaaaaaaaaaaaaaaaaaaaaaccuguuuacuuucgccucaggaaagacuuuauuuauuuauuuauuuguuuguuuauuuguuuauuuauuuaugugcaccaggcuaggaauagcauuuacugcccuggaauguucucauucaauucucaugacacacgcguguagaaaugauugguguauacauauuauacgugaugagcagaugagcuucuucccccccccccccccccccccgagacaggguuucucuguguagcccuagcuguccuggaacucacuuuguagaccaggcuggccucgaacucagaaaccugccugccucugccucccgagugcugggauuaaaggcauggccaccacugccugguucagaugagcuuuuguuuucuuugcuugcuauaauugagaugagcuauugauagggaguccacgcacagccaccagugaggguggcugcugaguuuuggucucucagucauccagcuucuugguucuuucugucgcaguguuuccacauuuuguccaaauguuugagagucauccaucaccuuuauccacuaacccucucucuuucuauaauacuaaagaguucaccauuauguuuccuuuccuggaggauccugggcuucucaccugaacaggggacggcacuguaucuucuuuuauuuuuauucaccuugcuucuaaaacguugcuuggaguccaucagaugguccagugacagguacuguggaccugaagguugccauuccacagugcuauccugaggucaaguccuguuagugugggcugcugcugauccacuucaggaccaaugguucuaaguagcaccauuagcaucaaagccugaggcccuaugacuucucccuaguagaaaagccugucacgcggguguagaauagaucucuccugcacuccuguucuucuauguaucaaggucccucauuagcacucucuuuggugagauauacgaaucccucuagggacucuuucuuaagucacacuuccuuaaugacuaccaacugugcgcacaauuauugugguauugucuaucuuucuggaaaaauuuucuccccugaucaccaaauaauagucucauuauauuugcuauauaauagaagauucucacucaauuugaagauuagggaaaaaguggaaucaguaagaauuccuaacugcaguaagaauuguuacuacuuaugcuucaucuuuggugugccuuuagaaaucauccaauaccaaucugugaauaauuuaauauugcuggaaaauaauauugugguguguuguuuacagaauaauuaauggccucuaccagucagcaauguagaauauuggugguuuauauaaagcaguaagucaauuuuuagaccuuuuggacuggauauauugucucauauaugucuuauaguucuacuuuuaauuuaauggguacuuguuagguaucaggcacuuagaacaaaggcaagagauuuugcccuuguauuugccuugcagaaaauauuuauuaaaguggcuaacaagguaguggaggcagaagacaccuuugggagauaaaagccccacacaguggguuccagugagauucagagucaagguuaaggagugugauuucccagaguggagcugggcucuguggugucuaucucucuccuucaugaguuccuaucaggacucuugcuguuggacuaaacgggauuugggagaacaccaaguauuuugaggguacaagcucaaaggagcauguuugguuugguugggaggugagaugaacaggccagggcccagguggugaagauccagguaaguagacauuaaacacaagcagauagcacaguucacugggguucccauguccaguguugguuguuuugguucccugaggcugaagucuucuuugcauaccugugacuggccaaugggaguaggcaaccuugccucucuuaucccacacaaacagguaaggguucacugaaaaaaaaaaaauggucacuuccccucuacuagaucaaggaacuuguccucaucaaggaaaucugugaaagaccccagagguaaccaaauccacugcugguuaaaguguguccccaagcagagggacaacccauagucaucuggggcauuuguuagcuaagacacacaugacccucauuccagaacuccggaacccacucucuggcguggaccugauccaccauuacacugccucucaggaguauucaaacugcaagcuugaaaccagacuuuugcuccauguuucauccaggaggucugggaccugcuggguagaacugauacuguuuguaauggcugagcuggaguggcaggacaggacgacuccuggugcagcauuacccaggccucaagauguuuccucugacuguggacaccuggaguucucacucuggccaucuggcccugaagaggucagcucaggaacuuuggaaaauuccaccagaccccucccuuccuagaagagaaaggucauagagcacagaggcaccccuccucucuggaagggagaggcuaauuacauuccucagaccccaggggguagguggugguggggacuaaccaucagccaccuccgggugugggaggcccagagcacguagacaaauuccacaggacagacugaccauuggccaccuacagacaagggaaguccuuaccaccccauucccuaaagaccaaucagguuaaaagucauacuguucugccaaucacauugugccuaauggcugcugcacagaaaacuauauaaaaacucaccaaaugggcuguucucucacucuccuuuaugugcagggcaauaccagcaugcuggaacaauaaaauuuuucuugcuuuugcaucgauucucugcucaaaguuguucacaucuuccugcccugacucguucuuuuucccucuauguaacugaaaaagaggaauuugcccuuggagucuuaggucaccaacugggaccuucuuuugcaccuguaguauacuugucaaagaaacuagaucuaaccaucuaggaaugggcacguuguaucuguaccuuagcagccacugaacuccuuauucgagagucaaaaaaacuaaccuuugggucgccuauaacuguauucucauaacuugucacagcuccuaacauauaaaggcuuacagacucuaccucccuccaggguucuuucucuucagguagcucuaauagaagacaccacacucacuuuccaaucauaucugccucuuaauauuuucaaucuuccucgaccaaauacugaccacucccgaucucacuccugcacugaaacuucagaggaacuauuaccucauccuucacacauaaaggagggcacauugcuucaggccaucuacaccugguauacagauggcagcuccuuuuuacaugaaggggccagaagagcuggcuaugccauaguaucagacaccgaggugguggaagcacaggcccuuccuguucauacuaccaaucaacaggcugaacuaauagacuuuacccgagccuuucaacuggcacagagacaaucccuuaacaucuacacagauuccaaauaugcuuucaauauccuccugucccacacugcuaucuggaaggaacauggguuacuugccacaaaaggaggaucaguaacuaaugcaaaccaauuauggccaugcuaaaggccucccaucuccccacagcuuuugggauuguccauugcagaucccaccagauggauaacucuauugucuccaagggaaacaacugagcugaugaggcagcuagagcugcggcccuuagggaccuagacuugucucuuccuccccaggacauccuucuucauacacaucaacccuaacaggacagugcucuguuaaguuccagaagaugucgagaccaccggucuuguccccuaucccaguuuaaaagugaucuucaggaaaugacuaaaacugugcuuacuauccaggaagagucugauucuuuggcagcugugguguuucaaaaccgucgggggcuagauguccugacagcuaaagaagguagucuuugccuguuucuccaagaagaaugcuguuucuacgucaaccaaucugggauagugagaaauaaaauccaggagcuacagucagacauaaagaacuucagagacugugagaccuccaguucugggacuuaggaaaauccuauuuggaaguggauacucccuuucauaacaccuuuccuagucaucuuccugguguuauuugaucucugccucauuaaucuuguuucuacauuccuucaauggcaaauacaaaaaauuucuaacugaacuauuaaucagcuccuguuacaggauuagcagccgcugcccaaagaagagccccuguccauagauuaucacguggauccugauggugaaagccagcuaugcccugaaauugacuaugccccuagacagcaggaagcaguuuaagagaugcggcauucucguucccuuuucaccauuggcuuuccccucccuuuuccuucccuucucuuuauaacaagaagggagguauguuggcaccaggacauuccaaaccuaugaguuaacagugcaaccugcgaccugcagaccuguugccaagccaacgaccaccauaucccagaacccacuuggcuuaccucccacccuuacuugugugacgucauuuuccauauaacuaaagagaacaccccuuccucacucucuucucuccccuuccucuauguuuaccacucccuugucucucccucucaauaaaaccucuucacauggaacugccuuggccuagugugcugcuugauggcccacuauucuaacacagagaagagagagagggguggggggaaggggagggaaagagacuggcuaaaagggacccuggucuggcucaguuuuaucccuguggcaggcacaaugccaccucauaaccacuugguaaauaccuucugaauuacauccagguguggcuuuagagaugccaguaaugaagggaagcccuggagcagaaagggccuccaggcugugcuuucugccaaugaacuccagcccaguucucccaaucaauccugcuuugcacugcagggucugauaacaauccuuacugcccgggaagguugucaaagccucuuugccugaaaccucucuaacuuccuacugcugaugugguccccccaagggucccugaagacaaauccacuccugauucacaguuuggguguggccagcccucccuguauccucccuccugaaauugccggcuggaagauaggggaaaaaaagucauucuuuugguuuugccuguccucuggacacaggaucucuacaguccgcccagccacuaggcacccuacuggcaguguaacaacaucaggcucuugagggagaugagcugcagcugcagcuaggaugccuguguggaaagugucugcuagacacagaacacaaauaguuccugcauuucuaaaaggcccaacugccgcgcuuggcauuagugaagggcaagaugcugaggaaaagggacagcucuaggaccaguuugggugugugagaaguuaaacuuccaccgcaggaagcaggaagcaaacguagcaggugggauagcaagcugguggaggaggggcugccacaggcgggugacacagacaaagcaggaaacuccgagggaucucccauggaagcugagcaucuugagggcagaugugcuuaccgcuagucccagccggugggauaaaaggucauuugguaaccuuccugcgacguuaucuucugggaagauaaacaaauucacugugaacugcccaaggaaggauugaguacaagaggggacagacggcaaggcuuaaaugcaaauucacugcaggacaagagucccagcuggaucuuccugauacaccuggagucacuggcuccaggcuucacuacugagcacagaauggagccauuggagacugguggaaagcuggcagguucucaccccuuuggcuguuggacuuugccuggccgucccaucaguucucugaggaagcaggacagggagagguaaagccaucagaaugugacugucuauuuuggugggcgauguagguugcucacuacuguacuuucacuuggggcccaugagaguuuccagaaaauauucccaggccuugcuguaaauuagucaccuggagguucuuuuguuuuuaaaagguauugauguuuucaccaauaccucaacugcauuuuaacagguucuaugugagacccaggcauagcuagguuaaggcuauuacacacacacacacacacacacacacacacacacacacacacacacagagagagacagagacagagagacagagcgccggguuucucuguguagcucucucuguccugggcuugcucuguagaccaggcuggccucaaaaucagggauuccucuacuucugccuccugaguauugagacuaaagaugugugcuaccacacccagcucagguaucauuuuuuaaaacauuauuuuacuuuuagucugccugccugucugucugagggcuuugaauaggauuugggguauuugggaggugaacucaggacuauugucugucuagagggagauggggauuccaaauggggaaugaacuccaggaggaggaagucggagaaugagcccuuuuguugguggugggaaaugccucuaccuucccugagaaguuguccacaaagaccaggagguaucuaaauguguuugacuguggacaugugcauaaaguugaacaucuagucaguucuagggagagagcuuuuagccuagugaguaggagaaggggggcuucaauaacuggaguugggggucugacacuugacugauuuuacaagagauagcaaaagcccuuaaaaacgcaaauccucaagggugggcugcagaugggccuuaacaaagugagacaaggccuagcuguuagaaugaaaaaagcuggugcaacuaggacagcaugugaguuguauguaaggcugaccuguggugcaugagacagaucugggcauccaagggccacaucucuagcuaccucuuuggcucaguuauuucucuuugaaaugguggaacugucaguguggugggaccugugguggacaguuccuauaguuguuggaagauggaagguuuuuuuuuuuuuuuuuuuuuuuuuuuuuuuuuuuuuuuagcaaggccaugauuuggucugaguugguuauuguuccuccuuuuguuauaaguaguacauguucuuuccagauggcagugugugauaggaggauguggaaggcauauuuggagucuguguggacauuuagggauuguccuugugcaaaucugaaggcaugggugagagcuauuaguucagacugcuaauuaguggugugggccgggagggccuauuucucaaccacuuugguaucuggcacuauggcaucaccugcuuuccaggcccccugguguagaaaggaacuguuaucuguguacuagggauagauggccugagguaaugugcccuccuguaugugugaggggugggacagugguuccucuaagguuuuuugaauucagaaacgagaagcucagcagcugcugaagcguguaugcagggugucuaucccugggugacaagguuuaacuuuuuggacagguaugccacaggugcaaaggaaguucccagcugguagccuauaucucucucuuucugcuacauagucagagaagggaccaguuaggucugagagguguagggcaggggccugaaggauuguugugggaaauaauaaaaaagaacagcaaguucccacauuacacccagcuacucucugcccuggcaggcaauggcuggccuguucuuaucuuguggauacucucucacucagagcuccaaaaucucuccacccauugaacuaaguucccacuggcaaguugcuaccacaccagcaccaugccucaaagcccucacagcuuuugugguacacaucuggcaaacccacacuuugaugcuguacuuuucucucuugaacccaguugaacugcccagugaaggaaaacgccacacaaauuuaguugagaaacaaugguaacucaauugcugggugcaacaacuagaauccuaaucuuguaagccauauuaaaucuaaaucccccaguggcaaauucugguggauucgccauauaagccaggagacacuagucgcuacaucuugcccucucgcuauccccguccaaaagaucccuaacucuuuccugcuuccucucuuccuccaucuaacccagaagucccgccuacucucccagugauugauuccuuuauucauuaggggaugguucacaagaagucaccugagugcgugacucauucccuguuccagacaccccaccccccaaagcacaauuaacauuaaaauacaacagcaccuaggccauccacgauaaaggagggccaguuggagcuuaugaaagggcuugguaaugggugugggaaggguucaugugaggggccaagugcugccucauauaggggacagacaaagacagguaagaggagauccagggacauaagaagcuaguuauuccuaggaaugauaaaauuuccucauugguagaugggccugacagggauuggauuagauguuuucuauccaaauaauggcugugugggucaugauaaugguugguuccaaauaggcuacuugagggguagaaaguuggaucuuaaaauggugagacucuauagccccagcuggauaagaaauuuagaaaagucaauuuggcuaauuuugagggauggacugcagagaagaaugccaucuauuuauuguauaaguuaaauuuagggaaggacaaagagaacagaucagaggccagggucuggccaaauagguaugggcuaucucaaaacuccugggguaggacaguccaggugaguuggguagagguguguguguguguggggggggggggaacauuagggccagucuagguacaagcaaauauauuuugugacugagugucaaagaaaauagagaagaaagcccucgagguccaggccugaggaauggaagggccuugaggggaaaggaauguauaaggguuagccaugaaaggauagguaaaugggacaacugcagaauugaugauccagagaucuugugugggccugcguaccagaggcuucccauggagaucucuggccuggcugagugugaggguucugcaaagggaaucaagugugagcagggagggcaaguaguuucugucacuucugcugcugcaguuggcuccaccucugucuccuccaugccaucucaguuacuccacgccacccugcacugaguugggucgggcaggguugaggagaggccgacuagccagugaggagugcagcggagcuucaggggcauuuagguagaacagaucucuucccaagugucacagcucuugggacagaagcuuuuggaggacagaguaguucucgcacaccuuuaaucugguaucuuuaauucuuauauacaguuuuguggugggucaggguuugacggcaggugcuucucauuggucuggccugagagcuuuggggaaaccuuauuugcaugugggagggcuuggugcugcuccuacaugacugauggccagauaccucugugugugugggggggggggggggcgggguugugggaggcuguagcugugacaggagccaggggcccaagggguguggccaaacaucugcagucccucguaggcagaagccaccuacuaggucaccaggcuucaaggccugugcucaacuggggaccaggcuaucugugcauaacucaccacuacacaaucuugaaccaggcaauagguuccacgugcuuuguaacugcauacauaggaguguuaaagauguagagugaaguaguuuuuucuucagaggucagagaugauauucucaggucccuugaggcucuggagcaagaguagauacugagcuugguaaaccagguaggguccuguaauuggaugaugacagggaaagguguuugacaacagagggcuuggggguaucccagacuuaccuggcaggcuggcaggaaaugauguguuggagccaguagguuggguggcuaggaaggaggagaggucuugcugauaagcuuggggucaggcaaauagggggaggagugaaggaacuagagguucccacuguggcuggaagccuccuuccuaauaaggggauggaacagguuggcacuaccaggaagaaaugggugagaggaacaccucugaaaauacaauugagugguggggucugguggggcugguaaggcugccccuuaccccuauaauagggaaacaaggagggguggguuccuccaaacuccaucaagacccaguaaauggucccaauguccaggagaaaagagcugggucacccugauaccauacugacuacucagagcuccuuguuggagaugacagugguugggccaaggaagcccaaguccauucaguuguccauggcuaggcccaagagguugacuggagagugaucugggucugauauuuccaugucaugagggacucaggugagagggcagucuacagcccaguaucccucucaauagcacuuugaacaugauauggccacuauggccugugggucuggguccagugauccuucugaucacaucuaaagcagggacccaguggccuucuauccuuaggagacagggagccuggauaguugccaaaguugguugaauggccuuagcuagcacuugguauuucuguuuauggacuuuuucaucuuucccaugguauaccuuaaaguucagacuucugcuuguggaguuagggucccuuucuccaacuagggucccuaaugucagagaaacugggaaaaaauaagucauaaggaguuguuuaccuucuagguuuucagggucuagauugguauacuguaagagggccuuugcaagguguuuuaggaauugagacagguuuuuaugguuguccuagaugacaucuuggaguuucuaauacuuuacugguuucagggcagccuuauagagacuagccaggaggcaaguuauaaacugaugucuagguagaauaugcccugagguacuguaaucucacuggggauccuggucuggaugccucagcccuggauggggguacuguguuaguuugguggauuucauuugcaugcauucuucaggaaguagguuuuuuaguuagaaucauauauguccuggaaggugacacuguagaauuuaguaauauacuggaaugcuucaauaaauguagaggaguuaaagauauaagagcccaggguuuuuuuguuuuuguuuuuuguuuuguuuuuuuguuuguuuguuuuuguuuuuguuuuucaguuugagggaguucauuuaaaggaauggagagauguaccuugaccaggcuguccacccugucaacauccuggaaaaggaaaagaagccagguuaggcuagguggggagagauaaaggggaugucccacuguggagcaggaguaaguaaugggguauugaagacugcuguuggggugaggaugggugccagaaugggaagguuagagcaacuuauuaacuuaaugcuggaaagggaaaagaggacaccaaaggagauguaggaggagaaggagcuguggguugaggcugguaaaggagacuuauuagcaggaucaagagucguggaagugcccucuuguugagaccucauagcuggaaggagcugaguaggagaacaggaaaaacagaaggaaggcuuggagcaaaaauaagagaaagcuuggacauagagaacuucucuccauucccgugaucacugacaauagcuguagaggucucugauaauaucaggauguagggugcacugggaggucauuuugauugauuucuuaagguauauugagaucagauuugacugcaaagguagauagguuuagaggaccuuaagucagguacuagauguagaagucagagguucuccaaaaggcaucccaaaggacgaccagagguacaggugaugauguaguucccauaggagagguagaaggggagguccaaggccugaagucugaggcaucaucucaaggacuuugguagacugagugaagaaaacacaaguaggaacaggaguugaaagcucauaguucugagggccagggacuuaccaaugaauccagaaggugaaaaccaugcucuaaaaacaaagccccauccaagggaaauagucaggggugggaguuggugaguagcaucaaccauagccuuaaaggcuguuguugggggugggcuucugccuccaagaguaccagaggggugccagacacuuaacagccauuuccacagauucagggaagcaugcaugccaaccaaagggaaaacuuaccaauugcuaguguuggauaaggugcccagcauuuaagcuagaaaaugagucuguugcagguggacuggggacaagagauagggucccagugugacuuacauaggguauuugguuucagacaccagacaagcggcuggggauccuggucuggaugccucagcccuggauggggguacuguguuaguuugguggauuucauuuacaugcauucuucaggaaguauuuuacauauuuuacauaucaaagcagaccuggauuccagguucucccaguauccuucagucccuauuauauagcccugaacccuggacuuuauggcccaggggcuggcugcccuucccccagaggcucuuugcuauauaaccuagacauuuuuuccuccuccuccuccuccuuccuccuccucucuuuuccuucucucuucaugcaugcuuucucuuucucuuccccucuuuccucuccccucucuccuuccccaugaugaauucccuggccuccuuccuuggggacagugaacuugccugcugcuuccaaauaaaccuguauuuauauauguuucaaucugccuugaauugguucaguuuaacaggagggaaauaacuuaucagagggaacagguagggaccaggauauccuucugaguggacuaauguuaggauuuauuggcagaagcaccuuggcggaugugcugcaaagagaucacuuuaugcuauagaacucaagugauagguuuuuugagaaguggggagguauacaaauacugccucugagcaagaagaguggaaggaaaaagagugggaagcuugagugcuggcuuuuauaaagcauuauaucucaugugcaucgggagaauauacuugacuccuggcagcaguggaaauguguugcauuuuagugguugucacuaggcuaccaaaggugagcuuagggguggaguuuuucaauaugagcacugugugagggcaacauggcagggccucagagaugagcgucuguggacaggggucaacagaugggucagggugaugugcaggcauugcuuaaaccaaguguuagcauuucuucuaugcuccgcccaacaguuaucuaacaacagcagguaucuggcucucaugcuauaaaaaggacuguuugcccugcccccccucucccccuuucccucucuguccuccccaccccauguucccuguuccuaguaggucucuucucaucuuucucucuuucucuuucugucccucucuguccccuuucuuucccauacucccuucucaccuuucuucucaugcccccaaauaaacuucauuuuauacuauggcugguacuggggagggggugugugccccagcauacauggacccuuuaaggcacccccuccugcuguaucauuacaaaacauaucaccaaaccuuucuuuugagucagagaaggaaagcugauuaugaagccagauauucuugccucaguaccccaguauuggucuagaggcccgguugagaagguuagggguugguuaguucuuuaguauuaacaccaaaccagagcugacugagccuggggcuccuguggcuaugcaaaugaguaggagguuggagauuccuccccugaggagaguuucuuucgacuucauccuggcauucuuccauauggcccuaaagaagcaaacucccuagcucuugaagaggccaaggcugggagcagggcugagugaacagagaacgcucugugugugcucugacuuugggagggugagcaggcagggaaugccagcaugucuugggauucccagucagagcuucaaucuuguuggugguggugagggcuggguucacaucuucauuugacauuuagcuuguaaucaggagacaguaccauuugucauuuaaaaaaaguguguguguggggggggggggguggugcuuccaguaguauuacaaaugagcccugguuugggcuauugcuguuuuggucccauccauguuuaaacuacacuucuagauagaacuggauauguauggggguggggugggggugguaguggagauggaguuauuugugggugggguggggguguugucaguguugucagagaggauugugugagcaucacagacaaauucugaaaugaaaaacuggagaauggaacccugguccucagcugcggcgcaaagaaacuugggagccuguacuccugagugauggaggaccagugccugcuaagcgacuguaagaggacaaagaaaugaagccaacagucccguaaggcccagcauggcaggcaguggucccauuuaccgccugccauuagcuuuccaaaggaccaagcugaacaacaccuuucuccuacuaggaaacgcacaguaccuuuuguuuuauuguagguauacuugucauuuuuauuuugccuacaguuaugcucuguaggcaucuuaguuuaaaagaauuccuaucaccggcuaguccucaguuuugucuuuuaugugcaguuucaagcugcacagacucauuaagacucucucucucucucucucucucucucuauauauauauauauauauauauauguauauauauaugauaaagggagaauugccugugagaggggaaacauauaaugaugguucuagcaugggaucuuuucuccuugccuucagaacucuuccuaggagaaucugauggaaagaaaacaaaaccuuuaaaggugacaguuagucugccagucaucaggugauaggaggccaauagcagcagagagccuguaaugaaguaggaagacagagaggucaaagauggcauauuccuggcccuggaggaguaaaguuuguaaggaaaauccagguggcuuuuccuugcuuacuuuuuuugauuuuaccauguuuuugguucugguuuugcuuuuccuuuuuucgagacauagucucauuauguagcuccgguugaccuugaacacaauauguagaccagguugaccucaaauucaaacucacagauaucucucugccuuucucuccaagugcugggauuaaagacauggucugguguugaagagucagcucaggaacuuuggaaaauuccaccagacccuuccccuccuggaagagaacaccucuagaaaggagaggcuaauuaacauuccucagaccacagagggugugugugugggggggggggggaaaccugaccaucagccaccuucggguaugggaggcccagagcauguagacaaauucuguaaccuccuuccagccuagccagacuggcuuagaccauccgccacugaguuggagccaccugcugugcugcuucucauccaucuccuuugauaugccacuaccugccugaggcuuaaccgguucuccaagaucuuccggaguuagcugcgaacugugauccuacuaaacugagaguuccuacuaaaaggcugaucugacaacuucaaaggaacuuugcgugacggggaaugggccuccccucuucuuuauaaagcauguucgcugacauuaaaguugaaccugaucag

SEQ ID NO: 5905 - RNA, 1082 nt, Mus musculus
ucaaaacagcacacauuuauucuuuuaaaguucuugacaccagaguuuggaauuucauuggguccaaaucagucaggggagacucugggcacuguagagggaaucuguucucuccugacucucuccuucucuccucagguccuccugcaagauggcuugccuucuguucuguagugaaauaaauauuccuuuaccucacuuccccuuuggugauauaccugauuacauguagaaucuaccuaaauaaucgaggguaacacacucuagguuucuuuugccauuuaaagaaacuuccugggauuaggccgugaauaucucugggguauuucagcugacuaccccagagauaggucagcaaucugucugcaugaggaggccucugagguuuagguuuggaguugguugguucggacaacgguuccuguugaggggucuucuggaggcucagguagguccuagaggcaugcugauuugggcuccauagcccuuacggcuccucucacucuuuuuccuagaaacaagaggagcggacagcacuugggcagccaccgggugguggaggggccucugauggugcccaacauccuggcccuagucuucuaccacccacgcuuacuacacagcaaccccuuucccauccccaucuccuuacccuuacccuuacacuugccgccccuugggagucggccacgcugcaaucucucagguggccagcaggggucagcauccccgcgcagagggucucgaggcugcgauggguggagcagggcucggugguguccuccugccaccucugguacagguccugaguacagccaaugugucuccacugcuuacccgcucucuucucuucgcuuuccaccuacgagaaggcggcucccucggggucagcuuggaggaagcuagccuccacagaagagccgggaaggaggaccagaggcaccggaagcccagaggccuuccugagagcaggaagcuguuagauuuagaaugaauuuucucccaagugucucagauuguuggccaaaguuacucugauucuaacgucccgugguuccucguccagcugguggguuugggug

SEQ ID NO: 5906 - RNA, 2335 nt, Mus musculus
cuuuggggacccgaagauaacagugccagcggaugggggugaaaagcggcagccagcggcucacaaacaccugaucugccccugcggcacccuagaccagcgcagugcgcgggcggggcagaacaccgcccgcgacgcucccccgccgcccaggcccgcaccucgugcgcgggguacagcgcggcucagggugucgcugcccucucccugugggugcaggaagagcggaggucgagcaggugagaaggucaggaaggagguggaggccgggagacuggggagaaggugaggaggcuguaaaggaggggagaaggaccaggaggugaggaagccggacaggagaacggagaccggugaggauauccgggaggugaggaggccagggaaaugaugugcggaggccaggaaagugagacugggagcggugaggggaacccgauggaacguaugcgcagacaacgcaggagccacagaagagcggcgagagcgcggggcgcccacaccggccggaacuagcgcggcggggcggggaugcagggccggugcccacccacccggcccuaccuugucuagggacaccuccagcucggcggggcggggcggaagaccgcggccgcauccacgucccagccgcucuugcggcucagccccgcgaccgccgccgcucucgcuccaugcgcaaugcgcggacgggcggcccggcggggucugggcggcuccggcucgccucagcuccagcacuuguugccgcggcggccgcugagccuuacucucggccccggcuccuggcaccgccgcccccugccgcgucccuucggucccgcccccgcccgauucuccaaucacacgccgcgccaccgcgcgcgucaccgccgggaaggccgcgcucccgccccguggcccaaguuugggaaaggccgaacucgaacccucccgccaguuggcgcccaggucccgcugggacugcgcccccgggcccuucccgagcucuccgccccucguagcacugagaaaaccuaaggcuucacuggagcgcgcgguguccaaagauuacagucucccccgcuccgccaggaaguagccucccccagaaaaacagcugagacuugagucccaaacccugcugagauccagggucuaguguaaacucuucagcuaccagggcguggcgcuuggugagaauuugccagccagcacuggcauguagcuaagucuagacggcuccgaguggcuugugagcgggauccacgaggggaggugagaagagggaaacccaagugcaccugaccuuugcucucagcguacauaguagcggcagccaccuagauagaugcccaaggccugaggguggugccuaucuggccucuucggaccuucagguuaugaagccaucaaagacacgaugaggucuccacgugguuccacucgggucucaggaagucaagaaugcaagaugcgggaggcgcugggugcggaguucgcucggcgacuucagaaguugggcuuagcaagacaucugaacgcugaacccccgugaugccgcuggacugagcaccaaccacacccaagcauggaucacgcgggacccggaacggucccccacccccaacccagcgccuccccaggcuccccagagcgcuacgugccaaggugaggcccaggaaaaagccggggagaccggauggagaaguugcucuaguuuguagagcugggugggccggccgagucggcacgcccucaacaccgaaccuagagccugguccccacaaccugggacgcgcuuggaagcugcuuccucuccccuccauucuuauugcuaaggccuucggucgacccucuggagauaaucacacugagaaguuaacacucuacaccuguuugcuuuuuuuuuuuuuuuuuuuuuuuuucagaaggcugucagauggaguuagucaaagggaugccauugacuuucgagcgcuggagauugaauuucagccagcucgaccaagaccacgaagucuuacuuacagccgcagaaagaaguaagugcgaguuguuuggguugagcgcagagccacguguguacggucauccacaagaaggaauucugagucagugguucuggaaauguuaagauugacaaucugcagaccgaucuguucuuauguuugucacuacguucccaaacaacaacaacaacuuggauuuuuauauguucacauaaacuguuaaccacugucacucugaacaagaaaggaagagaaauuguaugcuuuucuugacucugaggaauuuuuucccacgauuauauuuauaauucagaaagccaauaaaagaagcaaauuagaaguua

SEQ ID NO: 5907 - RNA, 2146 nt, Mus musculus
acuuauuuauuuauuuccaagauaggauuuccucauguagccggguuguucuggaacucauucucuagaccaggcuguccuugagcuuagaaaucugucuaccucuggcuccugagugcuaggauuaaaguguguaccaccucugccuaguuaguggcccagauuuuauuacccuguauaucaauuuuaagguuagcuuuuauccuauuuguaacuucaauguucagggguuuguggguaaaguauagcuguauauagugacaccugcuuguaauuccagucccuagaaggcagaagcaugaggaauuugaauucuaugucagcaugggcuaacaaagcaaaagugcaucucaaaaaaguacuacaccaauacuaaaaaaaagccuuuauauuuucaauuaauuuccauauuuaaauuauguuucaggcauagaacaacccuagaaauaccagguuaccaagacuuaguuuaaaacaacuuaaaaauauuucuuagauagugggucuuuuucaaaucaagguucauugauggcauuucaaaaaaccugggauguacugggagaaaaaaaaaaagauuguuaagagggcugacaaagguuagccugaaggugaugucugcugagucaauaaucauugauaggaagacucuaaguggggagaggaugggagaaggaugaagggaaaacagcuacacaacucacaaagcucauaggaaauaacaggaauagguuggagugaaacuuuauagcgccgugcaaaaacagcaugaaguuagaagcaguucuagugcacagaaaaagugugacacaccuugacaagacaucguagaagauuaauaccggggcccucauuaacaugugcucaaguuuugguuuggggucaugcacaugaccuuucagacuuuguugucauaucccuguggaaguaucuuagaaacagaaauuagugaagguaaaaacuaacacuaaguuguccuguaaaaauuguuuaaaaaauuacucuuuuuuuuuuugccuuaauguauguauguauguauguauguauguauguaugugugugugugugcuaggaguguggacggugaccgcagaagucugaagagggauucgaaugcccuggaacaggauauagaugguuaugagcaccaugugggugcugggaauugaaucuggauccuccgcaagaguuucaagugcucuuauugcugagccaucuuucugagcuucuaguucuuuuuuuuuuuuuuuuuuuuuuuuaagauuuauuuauuuauuauauauguaaguacacuguagcugucuucagacgcaccagaagagggcaucagaucucauuacgggugguugugagccaccaugugguugcugggauuugaacuucggaccuucgaaagagcagucgggugcucuuacccacugagccaucucaccagcccgagcuucuaguucuuaaugcaauaccaaacuuaaguugggugucccuuucacuuguuuuccacuccuggcuccauuucuuuuggcacugggcaaaugggguuauaaaagucgcucaggcugccuucgaacucggagcaacccuccugccugcauuuaggaaguacugucguaaaccaucacgccaggcuucguuccucacgguacuagcucucgcugucucucucugaugaaaaagccuaauagagcguuuccgaugaagaaugaauggguagacacacacguuguaagaccucgugcguaaaaacgaggugucacgguuucucaaccgcgccauuucuaguccugucaagguguuucacugcugaggauccaugagccucacagaaccgcacggcugagauaaacagggauucagguuaagacgcgcccugggcuguuccauucucccgaagccagguggggagcgagccgcggcguugccagcaucugcugacccgcggccgucuccacccucaaaguacccgaaggacaggcaaacuucaccgcuuccccucgggggugcgggagaucaggaggcgccgcgccgcggcaggggacggggcgggccauccgucgcggcuccggccgagucucccggagcgcggagcccguaggggcgggagaggccgcguacccgcgacccgcccgcagccuccgccaucuuccacuca

SEQ ID NO: 5908 - RNA, 57145 nt, Mus musculus
ugccuccguccccucccccccgccggucgggaucagucagcgcgauccuaagcgggggaggggggggcggcggccgaacgaugugcgagaacugcgcagaccugguggagguguuaaaugaaaguaagucgccggguaggggacccgucggggugcacgguuugggggucccugggcugugcucucccgccuugccugccuucccggccugcgggcugcggcgaccgggccggcccggcguacgggccugugugcccgggaaggugcgugguggcggcggccgucgcggcgccucgggcccaggccgccggguuaccugggcgcccgagaggccgcggcgcagccccggccggguccggcuugggcggucucggaaaguuuccucauuacaggugucaauuaaugaaggcacuaaugagcccuuccgccccuuucccccuucgaggaagguguggggagguggggucggaggacuaggcuuugcucugcaguccgagccucagggccgcccucuuugauuuccagcgugcuggggaggccucgcuuaccugcuaauuuucguuaaaguccgugggagaaggguggugauuuuuccaucccuugaggguguguggguguauucaauccaucugccagcccuuaaauagcagaaauugaacugcaauagugaugauuggaaccgucuuaccuuaauuaaaaauaaaggugauaguauuucuuuaguaccauucgucguuuaaguaguaaagucuauuauaaggagaucucuaccaacgacaaccaccccgaguuagucauggucugucucugaaaaugagaggccuuacuccuuauucuuuauuauuguauuacauauuuuauuuuuggccuugcaagauugcauuucugcuuaagaaacagggaauauugcacgucagccacuugugggcccagaggugguuuagaugaaaagauaauuuacacaaacuugauuugugacaaauauucauuugagguauuggaauuuauauucagugugauauuuugacagauuucgaaacuacuuauuccuuuuaauucauucauuuaaaaagucuauuuguagauuguaauucccuuuugguugcuuaauuuuuacuuuauuaugugcuugaguuucacuuuaauggcuaaaagguuuauaauuuauuuucagcuauguauuuaguuccugacagauuaaaguagguguuuuguauauauucaaacuacauuuucccauaucugugucauccuacauuuuccuaguauuuuauaagguuauuccuauuuugacauaaauuucauucuugguagaagugauaugguaaacauaguuccuuaguacuuauuucaguaaaacauuuuguaucuuagaaauacauugaugauugugacucucuguucuccaacuugaaaguacuuaauuguuuaguauacuuuaggaaaaauaguuugggagaagugauuuaaagauucuguagguaugugugugucuguuuacagauauauuccugugagugcagcugcccaaguaagcaucagguccccuggagcuggaguugcagcagaugugagcugccccagaugugagcugccccauguaggugcugagaacugaacccagguccucuggaagagcagcaagugcucuuaacuacacugagccaucucuccagcccccuuagggugugauuuaaaacauuuuaagccuaacuaggaauguuguaaacauaguaucuaaagaaaauuuacuugagaagagaugaccuuugcaugguauagauagauacucuuuuuaagggcuggugacaucucucaggggaguggguuuacuccaggguccccacauucucacacacaugcauguaaguuaguaauaaaaagguguuaugauugucuugaaauugugucagucaguguuucccaaagguacuuacuuauaugcuuaguguuuucuuuaaggcucauuggaaaaucagccuucaaucaucucaggagauauauauauuuuuaaaccaccguaguugucuuaaaugcuuucauauguagugagauguuguuucaaaacuguauuuucacugcgguccccccccccccccccccgccaccccaaguaugauacugaguucuugaggacaggacagauucuacuucacugugguaauuaauguuugccagugugcaagauggauggagcuucaggaugaacauggugguugaacugggacuaaaacucguugaauuagccuggccugcuaguacaggcuuguuuguaaucccagcuacucaggaagcugaggcagggcuaccacaaggucaaggaucuuucugggcuacaagaugaguuugucucaaaauaaaaaguaagagugcuuggcauacagcucagugguaguguuugccuagugugggugaagccagcacuucagcccccaggaaugcccccccccaacaaaaacaacaaagaaaaucagggauuuuuuuuuuuaaauuuuagauuuuuaaauuuaauuuuauauguauaaguguaccagaugcaugcccgugugcccucagagucagaaggagcaucagaucccuuagaguucuagaaaaucagcuuuaaaauugaaguguguuauaugucuucuuguaauuucauuugcuaauuauguauuggcuaucuuuuucuuccccguugcuugugcaaagaugacuauucaaccaggauucaaaguucagaaaucaauuccucaaaccauuugcguuuuuuuuuuuuuuuuccuguuuguuuuuugagacagggucuuucucucucugccccugacuccagggacucacuguguagaccagacuggcucaguucauagagauacaccugccucugucucuugagugcugcucuuaaagguguguaguggcaauuuauuuauuauuaaggggcucaaaugcaaauuuauuaaggaaaagagaacuugagauuggaagagguaggguagcucacagcuugagggcaucagagguuuagacagacucuucugaccuuaaggguaugugaacauaguacacagacguacacaauuagugguaaaaacagcaaaauuggcagagagcagaacauuguggccauacaugucuguguuuggaaggcugaggugagauccugaguuugaggucagauaggucacagugaaaccuugucuuaaaaccaggcaaacaaaucugucagaaugcaauauaucuaacaagaaaaaaagaugaguaauaguuucuaaacaguuuacauugucaucagcguuuagcuauaguauuaauguuaucaguuguaccuguaguucuguagagguucccacgcuguaaauucucacaauggacacauucauuauauagcuaugcccugaauugaccuacaggugaaaggcauauuaaagucuagaaccaggcuagggauccuaaaauaaggacuaaacuauuggguaucuaccaccaucuguuuuuugacagcuuaagggaacuccuuccugguuuucuugccucaggcucucaagaguuggcccuacuuuucaugaacuacuguggcuuuuauagguggagaaggcuaguuuguggggaugacaguaucuugcucuuuaggcugaccuggaacuuguaauauuccacacccggcuugauuauggacuuuuuaaacuugucaaaucuuaaauuaaaacuuccugggggcugggcagugguggugaacgccuuuaaucccagcacuuggaaggcagaggcaggcagauuucugaguuugaggccagccuggucugcagagugaguuucuggccagccagggcuauacagagaaacccuguuccuugaugccggagaggugguuaagagcacugacuuuuauuaaaaucuuuuuuuuauuaaagauuuauuuuauauaugugaguacacuguugcagucuucagacacaccagaagagggugucagaucccauuacagaugguugugauucaccaugugguugcugggaauugaacucaggaccucuggaagagcagucaguucucuuaaccacugagccaucucuccagcuccccauaaaauaaaucuuuaaaaacaaaacaaaacaaacagggcuggugagauggcucaguggguaagagcacccgacugcucuuccgaagguccaaaguucaaaucccagcaaccacaugguggcucacaaccacccguaaugagaucugaugcccucuucuggagugucugaagacagcuacaguguacuuacauauaauaaauaaauaauaaguaaauaaaaaacaaaacaaaacaaacaaaaaaccuuccuuaaccaacuaauauuugaaacacuggcaaacagauaaaauuauucacaauuuccagccagauacuguguuuugguguuuugaccuuaggucucauucuguagccaucccaggcuauugucaaacaguucugcuacagccucccaagggauagguuacagucaugagcuaccaugaucagcuguaaucccaauagcaaaugaugaagcacuauaaaauauaguguauauuaauauaggaaaguaucaacauugucuguguaaugaacacugauuacugccuuuuuuauugguguuuuggaaacagauucucauauagcucuggcuguccuggaacucgcuuuguagacuagacugggcacacucacagagauccacuugcccaugccuaccuggugcugggauuaaagaugugugccaucacaccacauauuaacauauuuuuguguauauguuuuaaaaaugaugguacuggagagacuagagggauggcuuaguuguuaggaauguuuguugcuauugcagagaaccuggauuugauuuccagcaccuacauggaggcucacaaacaucuuuagcucuaguuacaggggaucugauguccucuuuggacuucuggaggcaccaggaacacauguggaauauaucccugcuugcagacuucauacauuaaaaugcucauacauuaaaaaggaaaccuuaaaaaagaaucccacaucauacaugcauaagacucacaugcgcaugcguguguuuuguguuccugaacaccagaagagggcaucguaucccaaaggaucacaguugcagacaggugugggcugucuauaguaugugggugcugggguugaacucaggaucuccagaagaacagacagugcucuucaugguugagccaucucucaagcucccaaagaugaccugucugucuaccuaccuaccuaaccuacuuaccuauuuauuuugagaccugguucucaguguagccuuggcuauucuggaacugguucuguagaucaagcuagccuuagaucuggcugucuccaucucccgagugcugggguuaaagguguuugcccucaccuuaguuuaaaaaaaaaaaaaaaaaaaaaaaaaagguuuuuaaagcaauauuauuggggcccaguaagauugcucagccagaaaaguauuugcugcaugccugucaucugagucugauuuguggaacaagcucuugcagauugucugcugacuuugacacaguugccacacaggucaaauccauguaaaaaacgcaacaacaacaacaacaacaacaaaaacaaccaaagaaaaaccaacaacagaauggucggaagagacggcucggugguuaagaaugauugauugcugcucucagggaacuggaguuuaauccccagcaucuccuuugugcagcucacagacauaauugcaguucuaggggauucagugcacacacaugcacaugaauaucuaucuacauaguuuuaaaagacguaguauugagacugugacuguagcucaguugguagacugcaagccugacacaugugaagcccugaguuuggucccuaguaccacauaauuugggcuuuauaaugaacuucuguagucccagcacuugguaguggaagcaggaaauugaaggcuacauggugaguugagaccagccuuggcuccaugagauccuguaauaauaauaauagcagcuagcccagcuuugcagagguaagaucugauauccccaguuuagaaaagcacauguagaacugauuggaagcuaccugagaucagcagaucucacacaaauguuugguaaaagcuuuucucacuuauccugguaacuugucucugaacuuuguaucugaauauugaacuagcuuugggcccccuggcagcuagcugcauaguuacagccacaaaagugcuguaggcaggggcuccucaggaaccacgagcagugugcacucuuagaaucccuauuucuuuacuuaaaaaaaaaaaggaaaucagaacuuuuauguugcauuuuuuuguuguuguuuuuuuguuuuuguuuuuguuuuuguuuuuccagacaggguuucucuguauagcccuggcuguccuggaacucacucuguagaccaggcuggccucaaacucagaaauccgccugccucugccucccgagugcugggauuaaaggcgugugccaccacugccuggcuugauuuauauuuuuaagauuuauuuauuuaugcaauguauaugaguaugccauuuucaugcacaccagaagagguugugggccaccauguggcuucugggaauugaacucaggaccucuggaagagcacuuaaccacagagccucucucuagcccauuuucuugauuuauaaaagcucauggccuucagggaaguuaugugaagguaguauauucagcauucucuggauguauuuguggaugccaaguacaugacccuaaaguguuaucaaacagaccuucugcagcacguggcuuaucuguugagcagugggacuuguggcagcauccccucaaugaugugagguccuaguguagguaggcauggguauaguugccuuugccaacaugauugcugggcugucuuuugggauauggguggccaugacugugaggcaaugucuucaaaaacugcucucuugguggacagugguggcacacacucuuucuuuuuuucuuuuucuuucuuuuuugguuucucgagacaggguuucucuguagcccuggcuguccuggaacucacuuuguagaccaggcuggccuugaacucagaaauccgccugccucugccucccgagugcugggguuaaaggugugugucaccacgcccggcuggaggcucacacucuuaaccccagcacucgggaggcagaagcaggaagaucucuugaguuugagaccagccuggccuauagagcaaguucugggacagccagucaagguuacacagagaaacccugucucaaaaaacaacaacaaaaguguaagaaaggagguugucaugguagcuugcuaaacucuuuuguguuugaucccaguaucccauaaagccaaucuuagugguuuucaccuguauuccuagcaccuggaggguggaugcaguaggaucguaagugcaaggucauccucagcuacguagggaauuugaggugagccauggcuacauaaagccuugucucugccaaauaagaaaaaggaauagucauuagauaugggacuacagacagagaagcuuauucugcuguuuuuucaagcugguaaaggacggugccauaguacauuguuuauagggcuugguucugggagaacaagaagagguggaggacaggacuaggaagagggugaucuuuuuguuuguuuuaaaauuaauuaauuaauuuuaugugagugcacugucacucucuucagacacaccagaagagggcaucggaucccauuuuaggugguugugagccaccaugugguugcugggaauuaaacucaggaccucuggaaaagcagucagugcuuuuaacugcugaaccaucucuccagcucuuuguguauguguguuuauuuauguuuguuagagaaaaacagagauuaacuuuuaucuagacuuuaccagaauucauuaucccuggcugaucucauucacagauaugcuccugcuucaguuuucuauugcuacaaugauagcaugcucugcuaacaaaauuuuauaugguuuaaaauagcuacagaugauauuuucuuuuaaaaauuuuauuuuuuauguauaauguauauauguagugccugaguguauauauauguguguguguguguguguguguguguguguguauguauguguauguguauauauauauauauauguauguguguguguguguguguguguguauauauguauauauauauauauauauauauauauauauauauauauauauauacuaaauguacagcagucagcaggagucaggguaggguuucagauccacugcaaauggaauugcaggcuguugugaguugccaugggauguuuggaagugacauggauccucuucaagagcagcaagugcucuuaccugcaauaaucucuucagcccccagauaauauuuucacaguuauacagacaauaguuuuuggaauuuucuaugaaaacuugauauauaaaguaugcugauuauuuuugugugcaaguaaauauaguuagggcuccuagaagauugguguuuuuguguguacaugacacagucugcauguggaggucaggguacaaccaguuuugagucuguucuccucuggguaccaggcauugaauuccaguugauaggcuuggugguaaucauuuuaaucauuuaauuaauuuuaaauuaaucuugcuggcuuaaagauugcucaauauguugccuuggcuaguuggaacuguauuuguagaccaggcuagccccaaacuuaauucucugccucccaaguauguuagcaugugugguuagguugcugaucuuuaaacuauaguucuagugcuaugaacgcuagucguaaaguuucauguauuucuaugugcuauuugaagaguuuuaaauuuuuauuuuaauuuuugaagccuuuauuuauuugaaucaaggucuccuguaacccaggcuagucucaaacuugauauguaccugaggaggaccuugaacuuccuugaagcuaguuaaagguuuauaguaaauuaaacaccuucacuguggaaagaaugguuucagcaguccuagguaaauacugaguuuuucucuuuggaaguaaauaaaaguuuauucauuuuucaaagaugauguauauguguauguuuauguuacucuguguuuuauauuauuuuuguuuuagagacugcuauuagcuaccuuaggcagcuucaaauuuccauggcagucucccugauucugugugcuggacuucauaggcaugaauugcuaggucugguuuuauuagcauuuguucagaaagagaaagcuaggaguggugaugguguagguagguuuguguaggugguguaggugguguagcugguacaggugguguagcugguacaggugauauaggugguguaggugguguagcuaguacaggugguguagcuggugcagguguaugagacaggguuucucuguguagccuggcugucuuggaacuuaacucuguagcuucaaacugaagauaucugccugcuucugccucccaaguacuggaauaaaagguguuuaacacuaccuccugcuuauauccuuaauuuauuaagcauuucaagaugugugguuaccuaaauuuaugauuacuguguugaaaaauuauauuuucagagcuggaaagauagcucagaaguagugagcauugguuuccuucagggguacugaguucaaauccuagcacacacacauggugauuuaaaaucaucuauaauggcauccaguugccucuuagagugugcagauaugugugagaacacgcacgcgugcacacacauacacacacacacgcauaucuauauuuuuuugauuaaaggcgcuacaugacucuuaauuauguuuauaagauacagauuaaggcuggauguugugccauaugcuugucaucccagcaauacaaaacuagggaaucugagagauugugaguucaaggcuagccuggacuacauaauaggacugcugacaaacaggaaaaaauaccagcaccuuuucuucaucuguuaccaauuagauuauaccuuuuauaaucucaauauaauuuucuauuauuuggucauacuauaaccuaaauagucccauggucuuucuuuucuuuuuaaaaaaauuaauguguauaugaauguuuaucugcaugccuggugucugcagaggucagaagacuugucugacccccugaaacuugagugacugacaauugugggccacuaugagagagcugggagucaaaaccuaggcccucugcaagagcuaacucuccagccuguccugucccuuacauuuaguuuauuauuuuauuuuauauuuauggacauuuuaccugcuugcaugucugcacuauguacaagcuuagauuguuguccacaaagaccagagaaggauauuaaauggaguuacaaaugguugugagccaccauaugugcgcuuagaauuaaaccuggaucuucuggaagagcaacccuuaaaagcagcuuuuagucacugggccaucuccauguugccguccacccuccaaugcccaaucccuuucaaaggucuugaacucaagauccucuugccucagccaauucagugaugggauuauuggccuauacuacucuauugugauggcaauaggaccuuuggaguuguagucaaaguaagacaaugggacacuucacugcuugguaaaguaguauauaauguggcuaacagaaugcuauuuuauucuaaugguauuuuguuucuauuuuccaugccauggugaguuuucuuaauagcaagauaaaucauauauuuagugaaauacuaacuucuaguuuggugaaaaguagagauuaucacuaaaccccaaaccugaaguuuucuaauuaguuagaauuuaaauuuugaguuuuaaaaaaguuaaaaaaaaauuaaaccuuuuuaaaaauuaaauuuacuauguguguguacuuaugcaugccauggagcauguguggaggacaggcaacuaccuugcuuacaacuaccuugguaguucucucccaccaugugaguucuaaagauugaagucaguucagggauugguggcaauaguuacuacuugauaagcaucuugccagcuccauuaaaaaaauucuuauuauuuguuuaugugcauguguguguauaaauuuauguucugaugcucuggaagccacaagagggcaucuaaucuccugauaaaguuggagguaaaggugguuaugaaaugccugaccuguauguugaaaaccaaauuuuauuccucuggaagagcagcaaguguccuuaaccacagagccaucucuccagcacucaucucccacguccagcuuuuaacuuuuuauaaaauauggcauguucagcuggugaaaaucuccacuauuauuuuaaaaucugaaauucucacgucagauacagaauacuugucuuguuacuggucugagagaauguuaaugauauucaaauuuaaaucuucuucuuucuuuucuuuucuuuuuuuuuuuuuuuuuuuuuuugguuuuuugagacaggguuucucuguguagcccuggcuguccuggaauucacucuguagaccaggcuggccucgaacucagaaauccgccugccucugccucccgagugcugggauuaaaggcgugugccaccacgcccggcuaucaauuuaaaucuuugagucuugggaguagugaagaauacugaguugguacuuaagugauugugaaacuuuugaaaauuuuuauuauuuuaagugaauggucauuuuugccugcauguaugagcacaacuuacguacagugucuguagggguugaaauaguacauuggaucacuauucacuggaauuagagacacuagugagcugucauguggguacugagaauugaacccuguuuuuugggagaagcagccagggcucucaaccucugagccaucucuguagcucauugguuuucaaccuguguuguugggugugugugugugugugucacauuucauauauccugcauagcagauauuuauauuacaauucacaacaguaguaaauuuacaguuacaaaguagcagugaaauaauugugugcuuggggaucaccacaacaugaggaacugaauuaaagugcuugcagcauuaggaagguugagaaccauugcuuuagcuccuuugauuuugaagguuuauuugaugauguuucuggaauaguaugaauuggcaaauauaguuuuagauugcuauucugcucucccauuuugggaacuuuaagagaacuuuguauugcacaaggaccugaagacugcucagcuggauaauguacuugauguuaaaucugauaauuugguuuugauuuuuggaacccacaugguagauggagagaagaaauuuccucagguuguuuugugacaacuuaaaacauacaccccuacacaaaauacauacaccuucccucacauagaaaaaaacccaccaccaaauaaacaaacacccccccccccuccuccagccccaccucccauaaaaacucagcugggcaugguagugcgugacaugucuuuaaucccagugcuaggaggcagagguaggaggaucuuauugcugucaguucauggccagccuggucuauaaaucagguuccaggauagccaggaccguuacacagagaaaccuggucuggaaaacaaaacccaacaacaaaauauauagcaaauugaaaauguaaaugaagaauguauugaauaaauauaaccugccaaaaaguguauuagcuauacacaguguuauugaccaacaugaguauggcuugcuaguuguugugguuuccugcccagcauuacaaaagauuaaaaucagagaaguauggaaugauaaagugaaaaaaugucaggcuaucuauauuuguauagcuuuuuaaacacuguaaugacauauggcucacaggagugaugaggaaugcuuuggccuagauaggccauucauauucaguaggagugggacuagaguuuaguuguuaaaguguuucauuuggguuggagagauggauggggcaguggaguagagaaccuaguauucuugcagaggaacuggguucaguuuccgcacccacgggaugguucacaagcaccugugacuccaguccuagggauccugcucacagugauacgcauguacucauacagggucacacaaaaacauaauuagaaaacccagugaauuauaaaaaugcuuuuguugaagcuaagccuuucuuuacuuuuuugaucagaucucacuauguagcccuggcuggccuagaauaaagaagagacccuaucuucaacgcccccgcacccucccaccccucucaaagaagaaaaccaaaacccaaaaaaugacagcaaaccaaaacaaguaaccuaaaccaaacaaaaaccaagaaaucagguugaggagcaagccacugcgcugaauuuaucuauggccugcuucauuuuuugccauuuuccucuagcgaugauagacuguuauccuuuaaggagaauaaauccuuuccucucuaaguuacuuuuggucauggucuauaucacagaaauaacuaauacagucaguaaucaaagauuuuauuucacuagugaaagcaaaagaaucaauugauguuugcauuuguguaucuaagcuuuauuuuuaaguaguauuggcuuuaauauuuguuuaacauuuuuuucauucuuuuacccuucucuuucaguaucagauauagaagguggugauggacuacagcucagaaaggaacauacucucaaaauauuugcuuauaucaauuccuggacucagagguaugcaguuguagggauuuuaaaaacuaacuugauggauucuauaaauugccauuacuuauugcuauuagauuuucuuucaggauguuucauuacauuuuuuuuuguauuaagugauaaguuuaucaauauucaauuaucuuuuuuuaaaucauggacuugacuuugacauugguuuuuaaaacaacauaaaaauugauuucuuuuacuuuucccucauucuuaauuuugagaaggaauuauuuugagagauagaagaauuugugugagacagaguuucucuuuguugcccuggcugucauggaacucacuguguagaucaagcugggauuagcgaugagaagcaccacuacucagcggauaagagaaguuuuacggaauagcuacuaaaagcuuauagcaaacuuaauguuuuuuuaaaaaaaaaaucuuuaguugugguaauaguuauuuugaaaucauuugauaguuucucaucuauuaugcacauuagaacaacuuuuauauaauauauaaguugagaauauacagauuuaaaacucaaguaucauaguuguuaauauagccacuuaagauguaaacuuacaucucuaugugguuuuuguuugguagugccacacgauguuuuuuuuuuuuuuuaagguucgauguauuuuacuuuuuaaaaauuuauuauuuauuauauguaaguacacuguagcuguauucagacacuccagaagagggagucagaucucauuacagaugguugugagccaccaugugauugcugggauuugaacuccggaccuucagaagagcagucaggugcucuuacccgcugagccaucucaccagccccacacgauguauuuuacaguguugauauacaagcccugcagcuucugggcuguaccacugagcuauaggugaaauuugaacuuaagguaugcugcauaaauguucuuacacucauguguaucuucagcucccacuaaauauuuuuucacuugugugcuugcccaauuugaacuaccauaaacauaaacauaaaauguuuaaaguggggcagagagaugguucaguggguaaagauuccugcuaccaagccugauaaccuaaguucaacccaggacauguacaguggaaggagagagcuggcuuccacaugugucauggcaccaguucaugcaugcacacgugugugagggcacacacaguauaucuguuuuucugagagaaggucuuauguagcccugccuguccuggaacucacucuguagauuagacuguccuugugcugggauuaaaggagugcuccaccacugcccugcuacagugauuugauuuuguuuuuuaaaaaaagauuuauuaauuaauuuuauguaugugaauauacugucacuuucuucagacacaccagaagagagcauuggguccauuacagaugguuuguuagccacuaugguuguugggaauuggacucaggaccucuggaagagcagucagugcucuuaaccacugagcaaucucuccagcccuugcugccccugucuucccucccucccucccucccucccucccucccucccucccucccucccucccucccuuucuccuuuccuuccuuucuuuuuuagauaaagucuuucuauauaacccuuggaacucacuauauaacccuaagauccgguuggccucaaacucaaaaagaccccacugccucugauccucugagugcugggauuaaaggggugugccaccacaccaagccucugacacauuauuucuuaaguagagauugucuuucaguuauccugguuuauacauuauaauggcaaauccuuacaacugauaacagcacuucuagugugugugaagacagcaacaguauacucacauaaaaaaagaaaaaaauagaaauuauauguuuauuagaugagaugguucagugguuaaaaguacuuaauacuuuugcagagaacuccagcuuguuucucugcauccacaugguagcucacaguucucuguaacucuacuuccugaggauucaaugccucuugaucugugaagguuucgguacacaugugguguauguacaugcacucacacacacacacaaaauaaaaaauaauaauuuguugacuuggacauggaagaacauucauuuaauccuaguuauaggagacauagauaggcaggucuaugugaguuccaaacugaccugguuccagucuagccagagcuacauggugagacccuucuuuuaaaaagaacaaagaaagaaaagaaaaagguuguugguggugaaagucuuuaauuccacccaguauuugaaaguagaggcagagagaugucugugauuucuaggccagccuggucuacagaguggguucugggccagccaauguggcacagggaaacccugucucaaaaaaaaaaaaaaaaaaaaaacuaaaagaaaaaagauaucauacuauuauauuuaaaguauuuuucuccagaauuuagcucauauaaaacaauuuuugagauucaagaugaaagccuuaguuggagucaauuuggcucaugcuuguaauccuagaaggcaggugcaggagguucccaaguuccuggccauucuuggcuacauaguuagaccuugucucaacaaacaaaauaugugcaaugaaaacuugaaacagaaaguugauaaggcuaauguacagauucagcagcaagguccuacuguuuuuuguuuguuuuguuuguuuuuguuuuccuucugucucccuucucuucuguugauuuauuuauuauuauuauuauuauuauuauuuuuaaagauaggucuguuguguagauagauagccuggcuguccuggaacucuaauuagaguccagagcaggccagccuuuagcucacagagaucugccugcuacugcuuccugaauuuugggauuaaaaucuuuugccaccacacccagccaguauuauuguuuuugaaagccuuccauauaagaacuccagaacauuuggaauuaauuucucaguagaauaucuguggaagcuguuaaugaucacauauaaaaugaacauaauuggcaaaaaauugcugagaacuggaaggccucaaccaagguuuaacuaaguagccuaguucuuuucagugcuacugagagucuaacgucugagcaucugcucugggcugaugcagcugaaccuuggugucuguuguuucagucaccacacucaacagguuuucuucuguugagaguaggcagccuauaggaaaggguuacuagcuucagauacucuggaaacauuuuucccgauguugaauacuguguuauaauaguucuuuaguuuuuuuucuucuaauuuuauguguaauuauguuuugcccguauguguguguguguguguauguauguuuguauguauauauauguaacauacguaugccuggugcccuaggaagugagacgagagcuuuggauccccuggaacugaaguuacugaugguuuugagccccuguguggguucugggagcugggccuggguccucuggaagcaaguggccuuaacugcuggaccaucuaucaccagccuugugaaguagaucuuuaaugcuuucaacaauagcaggauagggaaaaugauagaugcguguugucaaaugaaauucuagaauuuguccuaagaaauggacuugucuuaaugguucuucaugaguauuuauuacugaaacuuacugaagcuacauguuuugagcugucauugcauuuaaaaagcuuaucagcaugugcauauauaagaugugcauaaaugaguguacaaguuuuguauauuuucccuucuacuuuacagauggaacucagguuguuagucuugcauagcaagugcuuuuuucuuuuugguuuuucgagacaggguuucucuguguaguccuggcuguccuggaacucacucuguagaccaggcuggccucgaacucagaaaucugccugucucugccucucaagugcugggauuaaaggcaugcgccaccaccucccggugccuuuuuuuuuuuuauuagauauucucuucauuuacauuucaaaugcuacccccgaagcccccuauacccucccccugccuugcuccccaacccacccacucccacuuccuggcccuggcauuccccuugguauugcauaugaucuucgcaauaccaagggccacaagugcuuuuuuuuaacccacuaagccaucuuacuagcccucaauacauggguuuuaacauaaauuugaauucagaugugaagcauauuauuuuagcuggguaauaaguucauaaucaggcuggaaauaaaagauguagaauggagaaaaaggauuggcagaugguaggaaagguuugagugauacagagcaaugagucggaggaguccaagcaaauguuaaaagugauggaugcaggcguggggcacgcguuuauauuagcagaaccagcuaggucucuugaguuugaagccauuauggucaaugggguugaguucugggccaaccagaccuacacagugagacugucuuucucuaucucacaaugugauugaaagaaaaugcauaugguauuuuuaaguccuccucaauccaauuucuauuuucaacuuaauggcuuuaauauucuguuuucugaaauuguaauaugcaucuguugcuucauuugugaguuuuaacccugaucuuccuuuuaugauauauaggauuauacuuugucacaucuuuucaauaugguugcuaucaauucuuagcauacuugugaaaauaaaaaugcuguucaaagauuugccaaaauguuaggugguugcauuauuuguuuccuggggucucuacugacuuguuuuucauuugaguaauuuucuauaugugaaucacaaauucuuccuaaacucuuaaaaccuuuuuaguagugaucuguuuuuuuuuacuaucugccuaguaucaucugaauuuacccuugaauuucaguuuguauuguuugcugguaagcuagcuucccuucagugccuuuacuauuuuuuuuuacccguacuauucagaauuaugauuuugggugguuauugcuuuauuauuguauuuucuuagaaaagcuauauggaaaacaagauuuuuagaguuggcauaucuaaaguguuuauucuuuauguguacuuuaaucauacccuuauuugaacucgggauucugggugggaagucauuccuuucagaauugucagagcuaugcuucauuguauuucagggauccaguguugcuuuucugaagcuuagcuuguuuccuuuuagaaauacugucuguguagcuccauuuauccgcgaguugucuaaaacuugggauucuccuaacucagcuuucugaguguagaacucagaaaguguguuaugauauccaguacuuuuagcaguuuuauucuuuagcuuucucuaauacccuccuugaaagcuuuaggauuuuuuccccuauauuucaagaauugcaagugucauacauuuggaugaaccuuuccauucugaaaaugaauaucauaaaacaacuggcaacaaaagcuagagacuaaugucuaaugggaaugcacacugaacagccgauauaaaauccaguguggugguuuccauuucucuguguagcccuggcuguccuggaacuggcucuguagaucaggcuggccuugaacucaagauccaccugccucugucuccuaagugcugggauuaaagguguucaccacuaggccucacaagcuagaacuuuuauaugacccauuuauaucacucuuggaccucuaccugaaagacugcauccuauuacagauacuuaucuguguuuacugcugcuguuuucauaauagcaugggaauauaauaaacacagauguccaccauagaagacuggauaauggaaaugugguacauauacaguggaauuucauucauauguauggaaaaauagaauugugcuauuuuuaggaaguauauugaacuuggaaauauuuuaaguaagaugacccagacucaaagacacacacauaucuucucuuauguaaaucuuacaacuuuuuguauauacauaucuagguggaagggaaggcaaaugccaggaaacuagaaaggggcuuaugagaagggaaaauauuacuuccagcagaaaauuaccacauaagucucacuaagugauaucuaagcuauguuuaggaaccccuaaaagcugugguugauugaauuagcauaccacucaugaaaauucuuaaauuucugauuaugcucuguuagaacuaguguuagugugcuucugauauauucccucuuuugauuaguaauuuuauuuuuguacauuuacauauugaaguauuuuuauuacguuuucccuuauuuuuuaucuugccaccuuuuaucguacauuaguuuuuuaaaguuaaauuuaaaucuucccauaaguugaaauaaaaaugcuaaaacuccuugugaauuuuuauuucauuauuuccucauguccaucugucuuuuagaccugcuaguuuugauuggucauauguuuuucuuuuucuccccaguaucauaagucuuuauccuccuuuuugagagauugcuuuaguuucccuguuugaaacuuuuguuauauauuauagguugcuaaaauuuuaauuggcuuuaaaaugauaaacuauauauuuauuuuaaagacauaccaacagucuaugaauaguuaaagagcuuuuuauuuuuaaauggugcuuaggauggaacccauggccucacacaaagacuacugaccuaacauugagcucuaugcccaacuucaaagggcucaguuuuauaauccccacuuagguuuuuauaacauuuauucugucaguaaccuaauaucuguuagguucuuuauacauacauacucacauacauacauacauacauacauacauacauacauacauauccccacuugaaacagucuguggucaucuugggaaagaaccucaacuaacuuagaaauugcuuccaucagaucaugaagcauuuaaugauuauaugggagggcacagcccaugguaggugcaggggcccugaagugggaggaacaagccuaaagggguaaauuaguaagaugcauuccuccaugguauguaucuguuuagcuccugccucuggguuccugucaugguugaguuuuaugccuugacuucucucauugauagaguguagaucaggaagugaaagcuaaauaaaauccuucccccccccuuuuuuuuaaauuauagcaauauauaacaaacuaagacaaaaaguugguaccagaaaauuguuguagugacagacaugaucauguuguuugggaggauuguggaaguguuaggaacuuugggcuugaaaaguuauuagugcucaaaacuuaauggccuuuucugggggaacuuggaagauaguguugagaacagggcagaugaugaagaccugccuuguggaauuucauagggaagcaauuguggugauuuauuugaauuaauaaucugugguucuggucagcugcaacuaaagaauuugcucugaauggacggauaguacaguaccauugaaaugaaaccuuuauuuugcugagacuauugcuauuguuugcuggggcugaaaaagcagcaauaauuaagauacugguaucauugaggugaaaucuuguggagaguauuauuuccucauggucagcacaaaaacuguggcuuagaggagccaaggcuguaucucauuuuaggaguugaacuugauaaucucuaaguuguaaaugaauuauuuuuaauauaaauguguguagugaauccaguggccuuuucuuuacuuuaugcuaguccccaauaacuauacagagaaacuaaguguuauuuaaaacugcaccucaauggcugagcaguaaaagauguaccuuaaacgucuaugcuaaucuggcuacuuuccagcccaucaugauacuuguauauuauuauugaucuucagucuccuucauagcuccaguuccuccauccugccagcucaucugaaaugcaccccccccccacccccgguuggcgaauguuacacccuauucucucuauucugcuuagccauugggugaucaguauuuauugucaaggcagagaauaaaugauaauuguuuacccaaacuugagacaggagauucuuaguguaagcauuacagugcuguguccuugugaaacaagauaugaagccagagaaaucagcauuugaauaacuuaaggacaaacuucauacaguacacaaaacaauaugccuacaaagaaucuucuacauggugcuggcuuuggcuguaugaaaguuacauuuuuuuguuuuguuuuucugagacagggucucucacuguagcccugccuguuugugaauuccauauguagaccaggcuggccugcaauucacagagagcucuucuugauucugccccuuugagcguuggcucauuaaagcuacuuuacaagggaacgugguaagcaguggaggcuugacauaugaaaggcuguugguuaaguguagccucaguugcaguggcaaccccaggauugaagaggucaugaagagaagcugagacuuggcauugugguauaaauaggcuuggagucccugaagagagcucaauagaggccauuggugaaggugcagcuucagcugcaguggagaccccaguauaucgggaaugccaggaauauggacauuuauugauuaaugauugauuugggaggacccagaauucugugccagguagccuugaguuuuaucauaaagcaaacagagcaagccaugggaguaugcuaauuaagcugcauuuuuuuucauggcuucugcuucaguuccugcuucaggugucugccuugaguuccugccuugucuuuccuccggugaggaauuuuuagcccugggaguuacaagaugagauaaaaccuguucuugaguugguuuugggcacuguuuaucaauaguauccaauagaaaggaaacacaaacauuucuguguuuuauuuauuuaugagggguuuccccacuucuuuauuuuagagaguuuugcucuauauaucaggcuugccuugaauuuagagaugcaccaggugugcaccaccaagcuaugcugagucuuuucuuacuguuuuuguugucuuuggugacacaacuuuucuuuucuuuucuuuuuucuuuuuucuuuuauuuauuuauuuuuuugagacaggguuucucuguguagcccuggcuguccuggaacucacucuguagaccaggcuggccucgaauucagacauccgccugccucugccucccaagugcugggauuaaaggcaugcgccauuacgcccagcuacaguuuuuauuuauuauuuugagccuucucuuuccucuuacaaacacuuauucuuggcugucucucauggaagaggcaggugaguuggaucuucucugugggugguacaucuuaaaaucauuaucuguacuauauaauagguguaaauaaaauguaagcaggcuuuuuuuauuuuuuggccaaggguuugaccguguaacuugacuggccuagacuucaguuuguauaccaggcuggccuuaaaauaaucuuucuuaacacugauuauguccuuuagacuccuaauauuuucauaucuauauaucuccauccauccauccauccauccauccauccuuauucuuuggcuaugauaguuuagcuguugggcaagggaggcuaccugaucccuuucaucgaaccucuauucuguccuuuacuuaauccuaagcuggggcucuuuaguccugaaccuucccagugguuuucuuuguuguuguuuuuuuguuuguuuguuuuugugacagggucguuggugggucugaaacccacagaugcagcugccucugccuuccugguucuagauuuaaaggcauacacuaccauccaucguaauucccacuuuccuuuuauuuuuuauuuuauguguguggacgcuuugcccacauguaucucugcuucacaugcaugcagugccugcaggcgcuacaagaggagaguguuggaucccucuggaacuggaguuagagaucauugugacccaucauauggauggugggaacugaacccagguccucugaaagagcagcuaguauuuuuaaccacuaagcuguuuuuccagccccaguucccauuuucugacagcuaauuuuagaaguaaacuugucuuuccuauucuaaaccuuagccaagauuuuuuuuuuuuuuuucgagacaggguuucucuguauagcccuggcuguccuggaacucacucuguagaccaggcuggccuugaauucagaaauccaccugccucugccucccaagugcugggauuaaaggcgugcgccaccacugcccagcagccaagaucuuuuaagaacucagacucuagcuuuacuaagaaaacugccugaguaacaacuucucacuuuaaagauaauuuugcauuagcauuauaggaagaaucugaguuggaguggugguacaugccuguaauccuuacauuuuagaaucaaaggcaagaggauccuggccagccucaacuuaaaaggaagauccuaucaauguaaaaaugggcaggaauguggcucagcaguuaagagggcuuucccaguauauaugaaauccuggauuugucccaaguauuggaaaggagaaaaaaagagguaggagauaagagguaggcaggcugcucaucagaaaacacuacgaguaauuuuuguuuguuuuaagacuggggcuuggugucucacuuuaguccuggcucaacuggaauuacucuagccucaacucagagaucugccugucuuuuaaugcuagauuaaagacauuauauuuguuuuccucauacagauuguaauauggguuguggguugggguuagagagaagguucuucuaaaggacucaucugcaguuccuaacuugucugguggcucacaacugccugcagcugcagauccagcggauuugaugcacucuuguggccuucacagaaaggcacacuuacaaacacacacacacauggaugucuggguguuaugacacacaccuuuaaucuuaauauuuuuaugucagaggcagguggauaucugagcuugagguuauccuggucuacauagugaauucuaggucauccagagccacauagugacacucuuaucuugaaaaaaaaaugguaauaugguauuuuauagcuaaaagaaacuuuugaaguaaaagccccuuuguuuaaucaaugugacaaauuuuucuaaaaaugguauuuaauuaauuagaaucaguauuacaguggaauaaggauuuuggaauucuguguucggcuuaacauaagguuuuuguuuuuguuuuuuaagauuuauuuauuauaugaguacacuguagcuguuuuuagacacaccagaagagggcguaagauccuauuacaaaugguuguuaaccaccaugugguugcugggaauugaacucaggaccucuggaagagcagucagugcucuuaaccgcugagccauuucuccagcccuuaucauaagguuuuaaucaaggcauuagucaugauguaauuauguggaggccuacagggggguagaggaucuguuguuuggggaaaccucaguuguaggcagcuugaauguuacuaauuauaccauggucgcaguauuuuuaaugaccuaaucuuagauauuucaucuuuuaacuacuaucacaguuuacucaauggaaaugagucccuucuggucucaaggggaagaaaguuaggacuugcuuuuuaaaugaaugugugccaagcguuuuguggucauacuucuaaguuuaucaugccuauagaaaugagauuauuucccuuuuugguuguacaguguguuggugaucuauuuggacgauguagagaaauuuugcuaauacuucaaggaauaaguuauaaguaauggcugauuaucuguuaucaguguuuagauucuaauauaauuugaauuagguacuugugugugugugucguuuaguuauugauucacacaagauuuuuaauugccugaaauauuccaggcauugugcuauuaauugaacuugucuaagagaacuagauuuguauguaaugccuaccugacauuucccuuuuuuguuuguuuguuuguuuuguuuguuuuugguuuuuuacugacauucaagagagagcguuuuguguuucugaguauguuugguuuuucagauagggucagaauacccauccuaagcaggcuucaagaauucauuuaaaaauguagguagauaauaaauuuuguuagauaagaaaacaccuuguauuaaguaagcaguaguuuuauuaaugaaguuauuaauacuaauaauuuuacuacuacuacuguuguuugguuuuuugagacaggauuuuguauaacccugugccuguccuugaacucugcagugacccaucugccuuuugcuucuaaaugcugggauuaaaggcaugcaucaccauacccagucugugauucuauucuuaaaaaugaauacagagcugcccuagcaggaaggggaaaauugauguuuaagaaaaguauuuuaguauuugcuucuuuuguuacuuauugaaauguguauuguucccucucuaggaagcauuuauuuacugcauuuuauuuucucuuauaggcaaugucuaugcugcuucaaggaauauaagcauuuggagauuuuuaaccaaguaguaugugcacuuauuaauuuagucauugcccaaguucaagugcuccgggaccagcuuuguaaacauuguacuaccauuaacauagauuccacguggcaagaugagaguaaucaagcggaagaaccacugaguauagauagagaauguaaugaaggaaauacagaaagacaaaaaucaauagaaaaaaaaucaaacucuacaagaacuuguaaucugacugaggaggaaucuucaaagaguucugauccuuuuaguuuauggaauacagaugagaaggaaaaacuauuacuauguguagcaaaaauuuuucaaauucaauuucccuuauauacugcuuacaagcauaauacucauccuacuauagagguagguaaaaaauagguacaaugauucuugcauuaucaaguccuauuaaguuugcuaguucccuccuuaucugugaaugacucaaacuggcgauuuuuugauguaaaauuuucuuucuuacuacccugucugucugccauucccuucuuucuucuuucucuuugagacagggucucacuguauaguccuguaguguggccuugaauuuucuguguauccuagggcuggccuugaaguuuaauucacuugucucagccugagugcuugcuuuacagcugugcaaucauguuccaacuugauggaaaaacauuacuauuuauugccaaaauauauuuauaauugaacucagaagaacuuaaauuuaaguaauuuaaacauuuuuuuucuuugcucuauuuguuaugacuuuaaaaacaaaaaacaaaaaccaguggcugggcugggcauguauaguucagugauggcgugcuugccuagcauuugugugagguucuacguucaggucccaacaguuucagaggauccagguuauguuccagcacccaugcaguaaugcacagcuguagcuugaguucaagggcaccugacccugcuucugaugucuuugggcucuguacuggcuaguuuugugucaacuugacacagcuagaguuaucacagagaaaggagcuucaguuggggaaaugccuccaugagauccaacuauaaggcauuuucucaauuagugaucaaaggggaaaggccccuuguggguagugccaucucugggcugguagucuugguucuauaagagagcaggcugagcaagccaggggaagcaagccaguaaggaacgugccuccauggccucugcaucagcuccugcuuccugcccuacuugaguuccaguccugacuuccuuggugaugaacagcaguauggaagcguaagcugaauaacuuuccuccccaacuugcuucuuggucgugauguuugugcaggaauagaaaccuugacuaagacaggcucuuacaugcauguggugggaaaacauacucauccauuuauaaaauuaaaaaaaaaaguugugucaaaaaagaaccagaguuuuuaauuucuuuuuuuuuuuuuuuuuuuuuuuuuuugguuuucaagacaggguuucucuguauagcccuggcuguccuguagaccaggcuggccuggaacucagaaauucgccugccucugcccccacgccaugcccggccuuaauuucauucuuaggaacaugucagacuagaauuuuuaauuaauaagcagagcuuaacaaauuauauauauacauuuuaaguaguauuuuuuuauaagucaaauggcuuaauucuacuuguguuauuuuuaugagcauuuuagaaauuuaaagauuuaggauuugugaagauaauuguauuuauagaaagcaggaagugagacugugugguuauguauuugccucaguacaguaauuuauuaccugccauucucugaugaugggagugcuuaccaaguuuguggcucauuuaugcacugcauuuauuuuggguuuggauggguuaaaguuagacucucagcagucuggccguucagugcaugguuccuuguauuuucuuccauggcuacugcuccuaugcaggugggcaagcuuccucacauugugguuuuaggagugcuugagauagaugaagcuagauuucuaaggcaucuugugugccacugaaguggcauagaaugaguuuuauuacaaauuuggugauugauaaaauucauaagggcauucaacauucaaagggauggugaagaaaauuguacauuucaucucuagguggggaggaaaggcaaaguguuguaguuuucauuaucaucauaaacugagcucaggcucgccccagacuuguuguguaauagaagaugaccuugaguuccuucuccauucuggcugauggaauuauaagaauaaauuaccauaucugcuuauggguugcuggagaucaaauacaggguuuugugcuugcuaggcaaauaccuugucaacuaagcuauguucuuaguccuuguuuauaucuuggauaaucugcuucuuacaauacugagcugugaauuugccacaugcucucaucauccauccacucauccauuuauugacagaguuuuacuauauauuguuggcuggucuggaguguacuguguaggccaagcuggaaucagacucagagaucugccugcuuuugccuccugggugcuggaguuuauuguugucucucugucugccuccuugccucuugcuuugcuuugcucccuuccuccuuccccccuuccacccuucccccuucauucuuaccucuuccacccuucccccuuuucccccuuccccuucccccccacccuucccccucccccuuccccccuuccaccuuuccccuuccauucccguguuuugggacaggguuccuccauguaacccuagcaggcuguugcucucuguaccucucguaggucuugaacucaauagauauugccugccucugucucccuaaccuugagugcugggguuaaagauauucacuagcaccauccagcuuuauuguuuuuguuuucaaccuuacauguucuguaaccuucauuauguaucaacuuuaccugaaaaauaagcccuuuauuggaauauuuucaaaauguuuugagaaaacauagcccauuaaaugguuauuacuccuauuauaaauauugauaagaacauuuugaaguagauuguauuuuauucuagaauuuaguguguuguuucuguauagaaaccuuguaaagaauauaugauaagauacauaaaccuuuaaucuuuagggcccggagagaucguucaguaguuaagaguacuggcugcuuuuccagaggacucaaguuggcuucccagcaccuagcuguuccagggaccccaugcucgcuucuggccuaugaaggcacuguuugcacauggucacagaaucacauguaggcaaaacacccacagacaugaaaggaaaaucaaucuaacauuuuuaaaauuuaaucuuuagaauacaguauaaauuuuguuuucagccucauauugguauggacaaauacuagaaaugcuuucauuaaaaauguagauauaugaaguucauuuagaaaguauuuuauucaaucaauuaauuaguuauuuuguacaggaccuuauuuuguagcuacauggcuguccuggaacgugcauuguagacuuguugccuuggaagucacagagaucgccuaguuuugccuccauacccuacgaguuaauuguuuuucagugaaacuggaugagguagcuuaugccuuuaucccaguucucaggagauagaggcaggagaaucaaagucugaggcuaguguaggucaacucuaguuaagucuagagcagcuuaggcuucaggguaagacacagaccaaaaggaaauucuuuauaagagcacuauaaauaauauuaagucugguaguuugcucuuaaagucaguuuaagcagugauuuuuuuuuuccuuuuagaaauaauaaucugugaauguuaucgucagacacuuauacuuuguaguaaagcaucuuguuaguacuauuuuucaagauaauucuaugugguuacuuguuugaaaguaaagguuucauaaaauguuuuagguaaaauuacuuuauugacauuuuauuaaaauuauuaaaauuuuuauuuaaaaagguaacuguagaggaguuuuuguauuaaauuuuauauaggaauaugcuuuuaaacguucuauucuuauucauuguuaaaaauacccuaaaaugugugauuucuagccuagugaucauguaauuaacuguuaauugucaguugugugagaaaguauagaaucuuaguguaguuuacauguauuguagagucaggcuauauguauuuauaaacgugcugccgggaccagccuucuuucauuugaguuccuagaccaccuagcuuuaacuuuuauucuuguguaguuuuuuuuuccugauuaagccuuuuacuugaauuuuuauuuuuaagagaccaaacuuguugaaaucuuuuauaaggaaagguucaaaacucuaguuguuccuauuugauaccaugacuaguagacuggucagugcccuuauuaaauggagaaaucauuuacugggcuuacagacuuugaaagauuuuuuuuuccagauuucugcuguauacugcugugaaguccuagaaucagggcuuauaauauacaacacaguuucuugauacuuugagcuaauuauucacagcaaauguuuaauaggguggaaacuuaauauagucuuuguaccuccccuccuuccuucuuagcaucccucuuaaaguuguguaguauaugcacgcuuaucuauguauauacacauuugcacuuguacauaugaauggugggagcggcaguaauaggguuugaaccuaaggcuucaugugugauagaccagugcucucacugcaauuaccucucaguccucaguugugaacuauuuuuuugugucuuaauauguuauucacagcuggccuugaacuagugaggcucaaguggccugccuuguaugucaucaugcuuugauaaaaguuaaaaaucuuuaaaaauacuuagugacuggaaauggguaauauuguugggggcagaguauuguuaauaguaauucuuggaaauaguuacugcccuaguguucuucuuuuuuuuuuaauuuaaauuguuauaaaaauuguagaagcaaaaugcagugacaugugucuauuguuguuguugguuuuuuuuuuuuuuuuuuuuuuuuuuuccgagacaggguuucucuguauagccguggcuguucuggaacucacuuuguagaccauguuggccuggaacucagaaaucugccugccucugccucccaagugcugggauuaaaggcaugugccaccaccgcccggcugugucuauuguuauagcugccugauuauacucaacugggagggacaacauaauaugaccugauuuccccccaaaaaggauguguguguaugauauuucauuugcauguacauauaauauauaguacaugauauauuuugguaguuuauauauauauuauaacauuauauaugcaguguaugcauacuuagugucuggaggccaggauagggcacuggauucccuggaacuggaguuacagcuaguguuagguaccacauggguacuaggaaccaaaucuuggccaucacagcaggcucuucuuuuuauaauguuuuuuucaaaacaggguuucucuguaguccuuguugaccuggaacucggccuugaacucaaagauccuccugcuucugccucagugcuguuacacaccaucacuuggcaauagcaguuacuuuuauuuuaagugcauugguauuuugccugcauguaugucugugugaagaugucagaucuuugaguuacagucaguagugagcugccaugugguugcugggaauuaaacccugauccucuggaagaacaguuagugcucuuaacuguugaagcgccucuccaguuccaacagcaaguacucuuaagcugagcugucucuucagucccccaagccuuggggcuggauguugugcaccauaccuuuaaucucaguacuugggaagcaggggauugccugggcuacauagugaguucuaggacaucuaggacucuaacucaagcaaaagaaaauuuguagagcggagagagggagcaauacuuuuuguuuaguguauguauuuauguuauggugagacagacagugugcauguaucuugacaguuugaagucuugguucaucuucuaccuuuuuaaaggagaauuuuguguagcucaggcugucuuugaauucacuaugugacacagauaaccuugaacucaaguuucugguaucuuuuugcuaacugcuauuuugggggggugcccuuuuuuuuuaaaaaguugcuuuuugugaagagaggcuauuauuguaugccuuugguaguuuagaacuuaaaguaguucagcaaccuucaguuuagggcaacucuccuacccuugaagaucacugauauauuaggccaugagccuuauuaaauuuagagaaaaaauauauacacauacauagcaugcacauuguccugauuugauucuacuuuauaaccugggugugguguuucaugguccuaguuuuggggagauggcgguucaggaauuuaagguuacacuugauuguauagugagcucgaggccuucauggagacuguuucucaaaaaaacaaauuacccccucaaaacuggauaugauggcauauucugaggcuaucuaaagcugcagagugggaucuugucauaaaguaaguuuuuaaaaaguauugcaugcuauuauuuugucuaguguguguauauauguauguauguugccugcuguuauuuugucuaguauguguauguaugcaugugccuguguauguguuuucaagaguccccugagguuagaggagacuuuuaggacucaguuccuacuucuaccaugaggaguccgaagauugaacucaaguugucagucuuggcagcaagcaccuucugagaaaucauuuaagaucuuuaacuuguuuuuaguguugucccagaauuauagaacuacugugaauuuaaggacuccugacuuugagcacaccuuuaguucuggguaacuucauguucccuauggcucaguuacugagcaguauuugcuauuagagaauuacuucacucuaguuuuguuugguucuaaaaugugguauaauuuuauuugcuaaacauagagcuuacaguauaauccuacucugggcuugacucuguaccuacucacggggaaggagcaggcagagucauaagcaggacuaggaagacaguugcucuggucucuguggaacuaggccauaaggauccuguuguacauaaggguagaaaucuuuucagaguuucuguauuuguguucugcacuaguauuccagcaugguucuuagucagugacuugguacuuuaaugguaccacaggaguucugaaacucuggaaguuuuccuggaacccacagcuuuaaauaugcucagcaugugcucugucacugaacuacauccuuaacuauagacauuuuguggagaguaauuugaggcucugguauuagaaaguuaaaaacuauuagauuuaguauaccuguuuugcaaaauguuuuuacuuguuagguaaguuuaauucaauugcaguguucugagagugcugauuugccagucauuuucagauucauuuaacaauucaucuuuauguaaaacaaguaauggcaaagaaugaauacaugaguucucuugguauugcuuucagaugaguguauguauggcgcuacaaauuaaaaacagaauauauaaaauaaaaaccuuaaaagacuugaaccuuauauuuuuuucaugcuuccacagugacaaaacagggccuuuuaccuagucaguuuauauuguuacagucuuuccaaaaauaaauaaauauauguguguguguguguguguguaucuaucuccacaucuauuaucucagaucucaacccuuggcggaugagaguaggauuagaaguucagggucauccuuggcugcuuuggaaauucaaagccagccuaggcuaugugagacccugucucaaaucccacucuuaaucuccccuaaagugugaucaaccagacguuguacuguacacuugaaauccuaucuuuaggaauccaaagccaggaggauugaaauucuagccagccugugcuauccaauagcaugauccuuuuuuuuuuuuuuuuuuguuaaauuuauuugccuuuguauuuuaugugcacugggguuuugcuugcauguaugucuuugugagagugucagaucuuggaguuacagacaguugugagcugcuaugugggagcuagaauuugaaccugggucuucuggaaacacagucaaugcccuuagucacugagccaucucucucaugccgcaugguccuguuuuuaaguaauuuugaugaucagguccuaaucauaauuuuuguucuuagauauaauagagacacccccuaaaacccccuagacaggguuucucuguguagccuugccuauccuagaagucacucuguagaccaggcuggccuccaacucaaagaucuggcaccagauugcugguauuaaaggugugagccaccaccaccuggcugcuuucuuuucuagaacauacagaucuauuuaauuuuuuuucuuucuaaauauuuucaacaggucuuuuugguuauucugagacaggguuucuuuguguagcucuggcuguuuuggaacucccucuguauguagaccaggcuggccucacucagagauccaccugccucugccuccagaguucugggauugaaggcgugugcuaccaccucucagcuuugaacaguuucuaggucuaaccuauaugucguaugcaguuuagugaaacuuuuuaccacaucucaguuuuuagaguguuuucuuucugauacauucucugaaauuggguguuuaugcuaccauuuacuuaucugaucuaugaguauuaguugaauuuaguuuuguuacaagauucggugaaugugauuauacauaaaauuuccagcauuucucuugguacuucuucagacuaaaauauucaaaagaugaucuguaggucugaagcaguucacauuuuaaguauugauaaguacuguuuacccuuccauaaacauuugcuuauaugguccccagugagugugcuuugggcagcaaaucuuauauauggaacacacauucucuggagugcaucucaugagcgcucuagaguguaguuugaaaaucaccuaauuuguguuuuuaagaauuacucugacucuuuugaagugugcccccaagugguaaugauucaacccagggucuuauacugcuaagcaggcgcucuaccacuaaacccagcacagauucacccugauuuuaaaggaaagcuuauguuguuuaaguuguuuuuauuugagaaggaagccgggugugguuauacacaacuauaaugaagguggagacagcagacuuaugaauucaaggccauucugggcuucaacagugagacacuaucuccaaaaaaaaggaaaaaagagaaaaaaguuaggggugugguucaauuguagaauacuugucugacacuuugccagguacugugaaagaagcuuaggcagaaagaggaaaacaguguacaguguguucuacuggaaaggcuucuguagaaggcuuuaagaauccuucagaccugagauacuguaacuucaguaggggaaguugcuauugauggcuguaagauacacucuugagauuuuauaagaucacuuuuagaaaauuuuuguuuuuagaccaucauuuaauaauggucuaauacuuuuuuuuuuuuuaauuaggauauaucgacacaagaaaguaacauauuaggggcauucugugauaugaauguaaguauuuuuuuauauucuaagguuuaugaaauuuguuuuaucuuuugaguuuuuacaucugauaguaaaucaguguugcucauaaacugaaaaugauuacuuauaaauuuaaaaggauacaccuuuguuuuuuacaggauguagaaguacccuugcauuugcuucguuaugucugucuguuuugugggaaaaauggccuuucucucaugaaggauugcuuugaauaugggacuccugagacguuaccauuucuuauagcacaugcauuuauuacaguuguuucuaauguaaguauuguuuggaauuauucuuuaacuuuuuuagcauaaugucugcauuucaaugucaugaaauuuuuuuggccagaaauugcagguuuugauuuaauuuuugcauaauuuaaaaacuaaauauguaaagucuauuuuuaaaagguaauaaaauuauaaugugaauaaaauuagucaacuuuuaaauuuaaaauagguaaagguugcucuuaccucuuuuauauaaaaggcaaagguagguagcuuguguugaaauuaaccuuugucuaggauuuuguccugggaaaacuuuauuuauuuauuuauuuugguuuuugagucacuuuuuauacuuugcacauaaaccucaauugguugcauuuaaacuucacuuuaauuuggcuuaaucuuuaccauguugucuuuuauaaguggcgcagauauuucuuuaaaaauuuuuuuuauggucuggagauaugauucagagguuaagagcacuucuuguuuuuguagaggaucuggguucaauucccagcacccacaugguaguucacaacuauauacaacuucagauuuaggaggcacaugauauauauaggcauacaugcaagcaaaagacucauacacauaaauaaaaauuuuuaaaaauuacauuguguguguguguauguguaggagagagaaugagcuguuucuucagugccuacuucauauguguguguauauauacauauauuuggucacacacacauguauguauguauguuuuguugagacaggguuucuccuuguaguucuaacugaucuggaacuuacuaugccucccucaaacacagagauccuugccucugucuccaacuacugggguuagggcccuacacuauaaugccccccccacccuccauguguuuuucauggaagagcucuucuacucguauugaaaggacaugcacuugauaguggagugcugcagcuuugugaaggauagacacggauggugagggauaaagggcguauugcccuaacaagcagaccuggcagaugagcccuggaaguuaguggaguggcgcacggugcagagguuacugauacuguacugagcaugcaacugagauauauuugucucauauggauauugaaaugacuacaaaucauauaacuuaaucuguuuugaaaugaaggaugugaugguuucaguguaaagccaguucauuacucggauuuguagcugcugucuuccaaagagauaugggaaagcaugguuugaguauuaaaguugauuuuauacuauuguguguaaauuagauuaauugauggaauuaauuuuuauaacaaauuuauuaaaaaauuuauaauuuuuaaauaaauuuuauucacaauuuauaaauaaaauauguggcguuuuagaggcagccaaauguuaauuccuuuuguuuuaaauuaauuggaagacugugaaaugucuuacauuuuuauuauacauuguuuucuuuauauuuacuuauagauuaggauauggcuacauaucccugcugucaugcagcacauuauuccuuuuagaacguauguuaucagguaaguguucuaaauuucuuuaauuaaguaaauuuauaauaauacaauuaaacaauuuauaacaauuuuguugcuuuugaaaaacucuugcagauauauccucuagggaagauuucaguuuauaaauaaguauauaguaauuuuuauauguguaugaguuuauauuugauauuuauauuuuggaaaauuacuuaaucuuguuuuuuauaugugaguuuaggaagagcuaaacagaauuuuuaugguuuuacugaguucauucaguaaguaguuuuaaauauguuauagaacagcucauuuagaaaguaacucguuacaguauauaaggaaucacaaggaauaggauaaauauuaggaaagaaauaggaacaguaagaauaguggauugugugacuggggagauggcucagcagauaagagcauugacugcucuuccagagguucugaguucaauucccagugaccacaugguggcucacagccaucuguaauggaaucugauacccucuacuggugcguuugaauacagcuacaguguacucauauacauaaaauaaauaaaucuuuaaaaaaaaagaauaguguauuguaaguuuaaguacugggugaaauaaggcuugcaaaggugagucaguuugaaaagcuuuuguacaagugugagguaccugaggccauauaaagacccagguauggcagcaaaugcuuguagguggcaauuggagacugauacgcaggagcucacuucccacacucccuuacucagcuuauuugaugaaguuacaggcaaugagagaccucguuucaaacaaaaagugaaaaguguuggguucuguaagaaugauauugccaaccucuauaaauacacuuuuguacauaugaacacguaaguuaaauucugggaaugggaaaggucuuuuugagguggaagugaauuugaguuccaccuaagaagguaaccuaagauguguucuauagcuuagaaaugaacugugagaguucuaagaauuaauuuuuuuaaaauuaaaaaucaggaguucuuugcaauuuuuuccucauucacuuguaaaguuuugagugcuuacuguuuuucuugauacuguuugagguguuucagaauaucagaguaacaggauauuuuggaugugaugagugccauauaaguaaaguaauaugauagagaggaaauaugaaaacauaaaggaugugaaccacuuagucaugugguaucagggagauguucuaggacaaaaaacuguagggacaaagacuuagaaauagucugacaauggagaucuggaaguggaugcugugugccuguuguguaaggaagggagaguguuuaugauauaaaguuguagugcuuagcaagggcagguuauucagcuccuuguagguuacugucuguauuuggguuuacaaauggggcaggugagucauaauuuuuuuuaagauuuauuuauuauuuuauguguaugagcacacugucgcuuuuuuuuuucagacacaccagaagagggcaucggaucccccagaugguugugagccaccauguggaugcuggguauuuaacucaggacuuuuggaagagcagucugugcucuuaacuacugaaccaucucuccagcccgucauaaugguuuuuaaaaaacuaauuuggccuuuaauaaaauccucauuuuaaauucuauagagaauuuauuagaaacuaagggacuggcuuaaaaguucagugccauguuguagauagaaauuauauuaauuauacccagauuauugacagcuauauugaaaauagauauauuaaaugaaaauaaaaucacuaagacuagcaaugaugggacuauacagaaaaagguaccagugcuggggcuggagagagagcucaguaauuaagaacaguggcugcucuugcaaaggacuuggguucaauuucuagcacccacaugguguaauuccaguuucaaggguuccagugcauucuucugacauuuauuggcaccaagcaugggcauguuacauaugcauacaugcaggcaaaacacacauaaaacgaguaagucuaauuuaaaaaaaaauuaaaacaaagaagaaagaaaaaguaacauuauagaugacacaaguacucaccccuucucagauuuuucucuugcucuggauaucauuaacagugacacaaaagaccgagaaagcuugguauuccuuuugagucuuuaaugugauguuggcaaaaugaaagcaugagcuucuaguucagaagaaagucauuuaguugucggcaggaggauuggggauuugacuuagguaugcaggcuugaguucagauauaaguagaaacaaauuccuaguucucauugaucaaccagccauucaggaagcuggauuuaauuuccauagcugugugcaacuccagucccaggggaacugaugacacccucuucuggccuuuccaggcaccagacgugcaaauaguacucagacauacaagcaggcaaaccagauacauaagauaaaggcauauuuaaauaaauaaguaaauagauaaauaaguaaaagugauagagcaguugaagaagauaucccacauugaccucugcccuccauacacauguaugguuauauacacacgggcacauaauacauacauacucaugcacacauguaaaccucucccaaucccaucgucagcauaagagcaauauucaggaacuaguagaacaaaugaggucacuuaaagggaaaagaaagaaaauauagacgagucuaggguuaagcccuguaccaguugcuuuugcuauguaagcaaacagccucugccucauacuuaguguuuuaaaguaaaggguguuuacuaauucucauacuugguaagauaauucaacugauuuggacuggcuuugaaggaacuugauuguugaggauaaccuuguucugugguuagcagccuaguuaguguugggaaauaggauacauauucauguuugauaguugcuugaugucacuugguuagucagagauuguuuuuucaugaacuagucuaauuugugucuuuucuuuuaaugguggaagaguuuguaacaguagagggcaaguucaauagcucuaaaccuucucauaucaguccuguuuguugauacugccuuggcaaaagcacauucuuuggcaaaguccagauucaguaggguaaaagauagauaccuuuugaugggaguaguauuugagucacauuguaaacacuuguacauguagcagugagaggcauaugugacauuuuuccgauccuaagguguugaaagguuggauaacagagaguuaacaccuacagacgugagcgagguacugacaauuaaaaaaaaucauauguuuauuggguuuuagaagaaaaccaaaauccccagugcuuugaaugcaugccuuaacaauguuugcuaguguuuaggaaggaaaugugcugugucuuaugaagucagcuccuaaucacuaaauccagaacuguaaauacgacagauuuuagagagugacaaagcauuauggagcacccaaugauaaaugacuugguucuuugcaauugugaggucaagcuggaaucuaagcaaugacacaauuaagaguuuuuuuuaaacuauuaaguaaaauaguuuaaauugcagcucacuaaaugucuuaguggguggacguacuugaagccugaugcccugaguuccguccacugugagccauauaaguggcaguaagggccaacucccuacauugucuugugacccccacauccauaguguggcacaccccacauaccugcacacacaguaaguacauguaaagauuccaggagucucauaaaacggagguuuggagcaaaggaauguugguaaauuucuguugggauuuucagaagugucuggugaguuugugugcuuucuguuuuugaaucauuagguauuuaugcaagcucucugaucaggaguuacgacagagugcggcucguaauauggcugaccuaauguggaguacagugaaagagccauuggauacaacacugugcuuugauaaggaaagucuagaccuugcauuuaaauacuuuaugucaccaacucugaccaugagguuggcuggauugagucagauaacaguaagcaaugcuuccuuuguuuuugguaacucguuuguuugcuugcuaaacaaauguaauaaugauacuagagaaggacuuuauuauucuagguuuaaugcauggauuauuuuguauugccuucacaaauaaucucuguauuuuccuuauuuuaaaacugagacuagugagaacuaaaguaauggcacagugguugagagcauuuauuguccuugagaggaccugguuugauucuccucacccauauguaggcugacaacuccagucccauggcaucugaugccucuuuuaugguggugcauuuacauauauucaggcaaacacucauaaaauaaaaauaaaucuuuaaaacuaagagugaagcuuugauuuguacuuuagaucuauuugaucuaaaaaaaugagauccgagucucaucauuguuacacaguuuauuuugcuuauauuguuuauuuagccagugucuuaguauauugucaaagcuagucuugaauuccuacacacaggugcuaguuaucugaauaacucugugugugcaugugugcgugugugugugagugugugugugugugugugaguguguguguguauagggcagagguugauaucugugacuucaauugcuuucucucucuuucuuuuuuuuuuuuccauuuuuuauuagguauuuagcucauuuacauuuccaaugcuauaccaaaagucccccauacccacccacccccacuccccuacccacccacucccccuuuuuggcccuggcguuccccuguguuggggcauaaaaaguuugcaaguccaaugagccucacuuugcagugauggcugacuaggccaucuuuugauacauaugcagcuagagacaagagcuccgggauacugguuuucauuauguuguuccgccuauaggguugcagaucccuuuagcuccuguguacuuucucuagcuccuccauugggagcccugugauccauccauuagcugacugugagcauccacuucuguguuugcuaggccccggcauagucucacaagagacagcuacaucuggguccuuucgauaaaaucuugcuaguguaugcaauggugucucucuuucuuugaaacagauucucguaaugaaucugaagugcaugggcuuuaacuagcauaguuggccaguacauccugggcauucuccuuggucacucugcagcacugugauaaacaagugcuguuuuauauagcuuuuuaaaugcuggagaucuaaauuaagguccuuaugcuugcacuggcuuaaggcaagaacuacugugccauuucccuggauacauuuuucuuuaaaauuuuuuuuaaaagacuguguuauaugguagccagauccgucugaucucaccauguauccaaggcuggcuuugaacgccugauccuacugcuugaacaucuuggcugcugggauugcaggaguguacuaccacaucuggcuauuuuuaaauuauuauuauuguuuguaaaaaaaaaaucaugaauuugauccaaguuuuggcucuauagcccaggauggcuuuaaacauaggauuuccugcuucugccucuugaguacuugaaucacaggugugcaccuguuuaaugguuaauuuucaggcagaagccacaguucauugaguagcaggugcauuuaacuaaauuaucaaguacuacuuaaaguaggugaaucauaaaaaccuguguguuugaaucuuuaggguggggauaggugaagacaagcagcugacuccuuuagagugggugugcucucaguuuccucgcuccucgcuggcuuuacuucuuuccauugcucauguagcuuuuguaaugucagaacccagaaaagcuagcuagcuuaggugugggguuuguaaauacagaaagugcuucuggcauuucucucaguaaaucucaagccaguguggccuaggaagccuucucugagccugucccugaugacagaagguguucugacuagaucggaucaaccucuuuuucuuuacucagcuuuacuuucuugaauauguuuaaugaaauaaagcauaaauguuucuauuccaaauaauuuuaguauuuaacauaauaaagugguauacucauuguuuuaugucuucuguuuuauaauugcagucuuaucaguuguguuuuuauauauauaaccaguuuauuuuguuucaugccacuugcuaacaguuuuguuguuaaaaggacaauccuuaauuucuuuucuuuaaucuuagaaucagcuccauacuuucaaugaugugugcaauaacgaaucauugguaucagacacagaaacguaaguaggagcauuauuuaauacagaguuacacauuaaaaaaaagauaagacugugcccuuggcuguccuggaacuuacugugcagaccagguuggccucaggucucucuacuugugccuucuaaauacugagauuaaagcuuugugccaccaugccuuggcugaaguaugccaauuugucauuguuuuuauacaaauauaguugugacuuuauuugauuucaaguguuuauuggaaaucuuuaccuguggcuucaauuuguauggaacaauauguucaaacuuguugcuuuuuuuguuuuuuuuuuuuuaaacauauacuuaaguugcuagagagaugguuuagugguuaggagcaguugcuucuuuuucagaggucccaugucaguugucuggagccacuuguaacggcaagggaucucaugcgcuucucugaucucuaugagcagcaguguacaugugugcaugcacacacauacauaucccccagaugaauauauguuuaaaauucuuuaagggaaaaaaacauacacuggagcuggagagauggcucagugguuaagagcacuugcuuccagaguucugcguucaauucucaguacccuuuucggugcuuccagcuaccuguaaccaguugucuccagggagucaacacucuuuggacuuccacagacauacacacacauacacauauuaaccugacaagaagcucagauacaugaagcagagaugagugugguacuacaugccuguaauucuaacauucgguaguuagacaaaggaggauccuugauuucccaacaaaugugagaaaaaaggaguagggugcaagauauguuaaagccauaaugaaauauuacuuggccacuacauagcuauaauaaagaaauguaguaacacuucccuaaagcgaaacauaaauugaguauaauggccuucagucuuacuacucauuaucuaccaugaaauaugggaucacagguuuuagagacuggcacaugaacaaaacuagcaacuuaaaaguagaaaauaucuagauacuaaucaaaguuauguagagaaauaauagauaaacaauguaguggaaaaagaaugcaguauuaauacauacuauaagauaaacuuaauaaauggauaaacaguauaguauauugacaugauguaauacuauuagggaauaaaaaauacauacuaccacuuaaugagccugguaaauguauagaaaauuugacuuauugguucuagagagauuauucaacagcuaagagcucuuauguuuuucuagaggaccucaguuuaguuuaccaacccacauugggugguucacagccacuugugacugcaauaugaaagaaucuguugcccucucuagucuccucaggcacgaggcaggcauacaucauuuaucuacauagacagacccacauauccuugauuuaaaaaugguuugguuaauuuaauacuauucagcaauaaaagagaaugaaacucagugauagagguuuugcccacaugaacgagguacuauguuuaauucacaccacaaaaaaagcaaaaaggaaaggauuaugaauauaaaugauaauauagaagagccuggggaauaggcagaauaugguaugauaauaaauaaaacuaaaaacaagcaaacaaagaacuguagggcugggaagauggcucuguguguucaggacugggcccagugcuuagaaggcaaagauagggagggcauccuuggaacaaacuggauggcuagaauaacugaauuggugagcucuuggcucaauauauuagauagagggcgauuagauaagacacucagcauaaaccucuagucuccacacauguguucacccauauauauauauauauauauauauauccacauaacgccuaccuugcaguacagcacaguacaguugcagaugcucaaugaaagcuuuggauguagcaugcacagaggccauaguuucagagcuugagucugcuuguauuccucaaagugcaaugaaaauaauaauaucauguaauccuguuaaucugaaaugucuauaaacugauaaauuaugaaaagagacauagauaauaaggcugaaagugaaaguaaggauugauuuauuacaaaugggccaacaaauaggauuuuucugaagugauggaaauguuuuuuuaaauccauuaaaaacauuucauugaauacaggcgaauuuggagggguggggguaggggauagguuuuuggaggggaaaccaggaaagaggacaacauuugaaauguaaauaaaguaaauaucuaauuagaaagaaaacaggugaaugugguaguauaauauguauaucuuaagguuuuaaaggauacucaauuuagucuuuaacaguagucacacauuguauuuuuauuugaucuaauuuucucacacgguuuauacuauuucuuaccaguaaguacugucuuuaucuucuagucuuuaaaaguaaagauaaauguucauucuaaaaaugauucacuuuggcccaaaacaaauugguuuggguuugcuuuuauugagacaagagucacuguguagcucugcguaacccagaaaugauugcucuaggacaugagggccucaaauguaaggugaucuccugcuucuucuaaguguuagaguugauauuucauauauuauuaaauuauuaaaaauuaaccuuauggaucauaucuguaguagaucuacacagaaguaguuaaaauacauuggcacuguguugauuuuguuuuuucuuucuacuuuacaacuauaugugaaugacuuaccucuucaagaugaauucuucauuaguguuaggaaggagacaugcagguuguuauugggaacaauucuuuauguguucaucucuuagguaacacauacuuccuauuuugcuuauuaauucauuguagaauugguauugggaaaucuuuucuaaaugcuacagugcuacuguggaaauuaauucaugaacacaaaguucucauuucaggaguugguguuacguuaacuuuucaaaugugaauuguuuauaaauucaaggaauaugauguuacauuucaguguaguuaugauuuguaguauuguacuuuuuuuuuaaaauuuguacuauauggaaguuuuucuggugucuuuaugggaaaaggcuuuaaauaauauuuuuucaaucauuugguucuagguccauugcaaaagaacuugcagacuggcuuauuagcaacaauguaguagaacauauauuuggaccaaauuuacauauugagguuuguagacaauuguuucuuuuucuuaauuauauagagaggcuuuaaaaaguaacuauaccaaauuuuccucuuguagauuauuaaacagugccaagugauuuugaauuucuuggcagcagagggacgacugaguacucagcauauugacugcauuugggcugcagcacagguaacacuaacauuucuuauuuaauguuuuguuuguaaugcuucaaaugcuacuauuuuauaaaaggagaccaagauauggggaagauauggcaggaacucugagguuucaguugagucuguguguucuuauguuauugauagaauauaggauauuagaaucauuagaacugaaggcucaagccgcacagucguggcgcaugucuguaaucccagcacuugggaggcagaggcaggcagauuucugaguucgaggccagccuggucuacagaaugaguuccaaaccagccagggcuacacagagaagcccugucucggaaaaacaaaaaaaacaaaaaaaacaaaaaaauguauguuacauauggcuggagagauggcucagagguuaggaacacuugcuacugggggacugauguguugguucccaaaccuacacaucagcuaacucacaaauguuuguaagcuguguuucagagaaucugacaccuauucuggcuucugaaagcacucacacauagguggcaucuccuaaacagaaacacagacacacacacauacacacacauacacacacauacacacacacacccauaaaaaaacaaaagcagaacaaaaaccaaagacccaagagucauucccuuaguuucuacaugguauuggcccuaaaucccggugaauaccaaauggauuuggcacuuuccaugcaccuuagugucugagacagcuuuucuuauccuuagugcugucggacauauguacacauugcuugcucucucucucucucuggcucuguguguguguguguguguguguguguguauguaugcugggauuauaggcauaugcuaacagcuuaaaaccaagaaucuguuuagucagccugucucucuugucugucucugucugucuauucugucauuguauauuuuucaagagauuuauuuuuaauuuauauggaauauugucagaucuccuggaaccagaguuauaggcaguugugagcuucuguguuggugcugggugcugaaccuaggcacuccucaagaagaguaugugcuauuaaucagggagccaucucucuagccaguuaauacucuuuuuaagacugugaugugucauuauuuagguggaaaauaauuaaugaauucccauuuacggacauauuuucuccuagucauucuguuauaaauuagaauaagauaguaucugaugguuauuccugacuuguacaaaacuucuguauaggaccaauaccuacugaaguagaaguaauacacuaaaguagauagaugcuuuucuugggaguacuaauaggucagugccacuuuuuccuuacuuuuuguauugucauuaagcuucauuuuuauuuuuauuuuuuuugcaaauuugauggaugagaagacauuaguauuuuauuuugcauuuauuguauuaugaaugagguugauaguuuuuauuuucugugacuaucuguuuauauucuuugauguuuauuaguugccuuguuugauuauucuuuuuaaacauuuauuugagagagagggcucauauggcauggcacacacaugaagucaaaggacagcuugugcgaguugguucuuaccaccuacugagauuccacuuaguggaggaugucuuuacccacugaauccaucuuaguggcccacccuuugauuguguguguguguguguguguguguguguaugagugagucauauccaaacccagugucuccuguaucuguuucuuugggguuucuuaggucauaaauauuuuuugauuuugauugcuuuuauccuggaauauuuuucuucccacaucaauuaugacaauuuugcuagguauaguagccugaguuggugauuguggucauuuggaaccugaauuuguauuucugugccugucugaauuuuaagauuucuguuacugugauagggcugcauuuguaugugucuuguaacucuccauuuuuuaaaaaaauucuuuauauuuaguguuuugaguauaugauguggaguuuucauuuugucuuguuuguuucugguccuguguauuuucugcugcucuguaugucucuuguacaugaauggaccuuuucuaacaucuaauguuugggaauguuucauuuguuuauauugaaaauauuuucuaucuuuuauauucuuuuuuuaguuuaacuuccuuuuuuuuuaaaaaacuuuuuauuuauuuauuguauguuaaguacacuuuugcugucuucagacacuccagaagagggcgccagaucucguuacagaugguugugagccaccaugugguugcugggauuugaacuucggaccuucagaagagcagucgggugcucuuacccacugagccaucucaccagcccuuaacuuccuuuuuuaguuuaaucccagacauuacaguaccguuccuuccccuuuccuucuauguucuauauuaauagauuugguuuuuuuuuguauuuacuauucauaguuuuaaaagccuuuuuuuuuuuuuuuuuuuuuaacucaaauucagcucuuacuccagcuucucccuuaagccugauugccuguccucucucuuuguccauuuugacuaugaggcuuucuagugacuuuuguuuucauuagugaauuuuguuuuuagcaucauuuaguuucuuucucaauauuuguaucucuuuuauugaacuucauuuuuauauucuguauuggcuucuuuauuccauuucagugugugcuauuuugaaagcuauacagaaguuuaugcuuuuucauuucuuucauuuaucacuuauucuuuuaauucuuuggaauuuugucuaagcaaccauuauuuuaggcuauuggggaugggacugguagauuuuggagaaguguugugaucuugucuucuuugaacacacuguuuuuguuucucugaaauagauuuggaguuaauuauuccaguuaaugcaaacuuuaagccuaggcuaagagagagccaugcucaggcagaaaguuagauggaccugagaauagguuguggccugcucaagguggguugccucucagccuuugaauuuuauuuacuuuguuuuguuuucuguguguagauauuuugccucuauguaccauuugcaugccugcuucucauagaggccagaaaggacuguaggauccccuggaacuagaauuacagaagguugugagcuaccaugugguuggcaggagucaaacucucuggaagagcagcugguggucuuaaccacugagucauuccuccagcucauaauuuaaauuauuuugacuucuuuuguauaagcuuucaaccaauucauccccauuuggugguuauuaauguauccuuauuaauuucaggagaagggacucacuuugccuugguuuuuuuauguauuugcuuuguggagaaguuauuucggauuuuuugguuuucuuuuaauucugaaucugugguguauucauguguauauguguucauuuaccuguaguuauaugcagaaggauauucauguguauauguguucauuuaccuguaguuauaugcagaaggauauucauguguauauguguucauuuaccuauaguuauaugcagaaggauauucauguauauauguguucauuuaccuguaguuauaugcagaaggauauucauguauauauguguucauuuaccuguaguuauaugcagaaggauauucacaugaaggccugaaggcuguaugagguguauuuuuuucucacacucuaccugugaccuguccauccauccucccgcccucccuucuuccuuuuuugaugcaugguuuuuuaauuuaaucuagagcucacuuaaucagguauacuaaccuggccagcaaucccuggggguucucauaucuuuucgcugauuuuaggauuacugguguacucgcacuacuaugucuguuuuuuuauauggaugcuugggaucugaacucagguuuucaugcuuggguugucuaugugugcucuauugacuggauccuuugcaagagucauaaguguucuuaacccacugagccaucucuccagcccuggaauuuuuucuuguagcucauaccuaucucuaaacugccauaguguguuuugggaaguaccccaauaaaaguguauuuuuccauuucagcuauuguaauuuugaucuuuuuaacuuuuuguuauguaauuuuccuacuggugaucuuuguucaaacacuguauucuugaaggauuuauuuuuuaaucccuuuuguuugacuguuggggaggacauauguauggaggucagagaacaaauugcagaaaucaguucucuccuuacacuguguagguauugaggauugaacucagguucucaggcuuggucucuggaagggguguguguguguguguguguguguguguguguguguuuacuaaaagaggugaggauugaaaaagaaagacagacaaaaugaucacaugacuccacccacacugaggcugaagcagcuuucugccucuccagccugcuuuauaucauuccagguacaucuaaaaacauggucaguucuuagaucaaaaaguaaucaagugaaguagugaacaaggagaucacacaagaaaguaauaagccaaaggacuccacgagguaauaagcaaaguagcaagcaaagagaucacauaggcaguaacucagcaaagcaggaaacaaagccccauggucucuguuucugacauucuuaucugugugagcccagugacaaaugccagauucccaugucaccaaaagcucucaacagauagguauagcucuuaaaggcccccaugugugugaggaggaggaacagguuuaugauguagcccuggcuggccuggaacuugaucuguagaccaggcuggucuggaaaucacaaguucaucucccuuugccucucaaguguugggauuaagggugugugccacccaugugcuuuugaaagguuuuauaggggcuggagagauggcucagcaguuaagagcacugacugcucuuccaaagguccugaguucaaaucccagcaaccacaugguggcucacaaccaucuguaaugggaucugaugcccucuucuggugugucugaagacagcuacaguguacuuguauaaauauaauaaauaaaucuuuaaaaaaaaaaagaaaagaaagguuuuauaguagagguguugaaaagucuuuguccagaugcucuaaugaugguaagccuuuugaaagucgaauucuccucuccccuccccuccccuccccauuacauuuauuacaugguuaauauuacauuuuuguuguauauuuaagauuucuacuuuuuauuaaacagauuuuuuucuaucauuugguuuagucuugaauuauuuugauaagaauuucuaguauguucuuuagaaauuguugacuaucuguaauacucugauaaucagaauauaaucuaccugaaagcauuuuggaauauaaucuaccugaaagcauuuugcuuguuacauuuuuguugguguuguuuucucaaaucaguuuuuuaaacauuuuauguaauauuuuauguguaugcauguuuugccuaaauguaugucugugcacuacaugugugcaaugucuaccagaggccaaaagagggguuuggauucccaugggacuggagauacacugccauaugggugcugacaauuaaguucuggacucuggaggugcagccaggugcucuuagcugcugagccauuucuuuagccucuguucuugguuuuaauugucuauauuauagccauuauuuuuaguauuggguaccaaacccagguuuuauauauuuccccaaucucuucuagguuuuuuuuuuuuuguuguuguuguuguuauuguuuuguuuuuguuuuuguuuuuaauguuaaugccauugauauuaggaauucucaaaacuuagauauuauuuguuuuuuguuguuguuguuuuuuguuuuuguuuucuugacuaaaaguuaguuguaguuuguuugguuuauauaagucaguuaaauuuugcuuuuaauuaaaaaaaauaguacuauuuaugcuauccaguaauuauucuuuuuuccaauguaugaaaugcuuguugacuuuacaaccuggcuuuuuuaugucauuuaauuaguuuacuuugggcaauuuguuaaauguuugucuuuuuauuuuagcugaagcacuguagucgauauauucaugacuuauucccuucacucaucaagaaucuggauccugugccacuuagacauuuacuuaaucuggucucagcucuugaaccagguguucauacugaacagguaagacauugagaauauaccgguauguuuuguuuucugcacaaugaggauuuugcuuaguuguuaagauaacuucacuuuuaauuaauguacuguuuuaauaucauuuagauuuuuaaaaauauguuaaauuuuuuuauaugucugccccagagcuucuaaccguaaucucucucuuuuagacacuguacuuggcauccauguuaauuaaagcuuuguggaauaaugcacuugcagcuaaggcucagcugucuaaacagaguucuuuugcaucuuuauuaaacacuaauaugcccauuggaaacaagaaagguuagucaagcauauuguaccacaauaagauguaccacauuuugaauuuauuacuaaggugucaaguauuuucuacuaguacauuuuguacacuccuaucugaauauucaaaaugcuguaaauuaaaccccacaacucuguugaauaaagacuguugacuuguucuuacacauagaaaacccugcaucuuuacucauguaucuggucacugucuacuacaaauaauauguaaagucacuuuagcggguauuuggaagccugaaaguggaaguuugugaaagaaguguaugaaucaaaaaugaauuuuguguuuagacuucuaaaguucuagaauaaacacaauaucaggcacauuaaaaucacauguauuucagacaaaagauacuuaguauguacucagcagccaccuucccuuacaguggagugugggauaggaacccuguuuggaaugggaaggaugcucuguaucagaugguaauaaaguuucuggguacuguuuuuugcugaaucuuuaaacagugcauauauuuucagaaguuaguaaauuuuuucauguuuaauuuuucuuucuuuugggaaaggaacaaaauguuuuguuaaguaauuuucagauuagaacacaauucugucuuuuucuaacuuguugguugcauguauggguaauuucuaaagaguuuuuaaaacuauauacuuaaaccuagaguuuucuuuuggcauaugcuacuguucuagaacuuugugugcaggcacccacaauaggcaacaggcuuccuugucugugucuuacauaacccucugugcucucccagagaagcucagucacuuagaauguuucccuccuguuucuccuuuuccuucagaggaagaagagcuuagaagagcagcuccuucaccuuguaagucaagccuuagaaugcaugacagugugacuuuggaguucugguggucuuugagauuauucauuuuauguaguguauauauguuuuuccaguuuaugcuacagucacaauuacauuuugagaaaaagacagauuuuuaaacuauaaacuauucaucucaccuuuuucuuuuuaaaucucucuuguugaaguccuaagccugcuagacagcaaagaacuauaccagugagcuauagccccgugcuuccucuuaccaguuuuauuuaaaaucauuaguauuuagauuugaauguuuaucuuuuuuagaaauaacaauuuacagguuuuauuuuuggccgguuagcauaagguuugauaaauaauuaaaggaaccaaaguaugguauccuaucagauguaugcuaauuaaaaucagauacaaaaauguaaaaauuuauuuuuaggguccccagcagcgaguccucaaaguagugauaacagugacacacaucagaguggagccagugacauugaaauggaugagcagcuuauuaauagaaauaaacaugugcagcagcgacugucugacacugagguaaggaaguacucagagucucuuaauagacuuacagaauuugugccauguuuguuauuuuaacugagaauguaaauaucacucugacaucucuuuacauaggacuuuugauuuuuuucuuuuugaggguuauauucauuucgcaguguucaaagaaauauggcaggacuguuguuagcauuuuuaaaaaguaugguguggucaggugguggugcacgccuuuaaauccuagcacuugggaggcagaggcagguggauuucugaguuugggaccagccugauuuacagagugaguugcaggacagccagggauauacagagaaacccugucuugaaacaaaacaaaacaaaacaaaaaaaagguauguugugggcucaaaagauagagcaaagguaaaggcacuugccaccaagacugacaggccaaggaucccugugauccacaguagaagagagccagcuccuguacguuguccugugaguuucacauguaugccagagcaaaugugcauauagacacucguaauaaauaaaaucuaauuagccaguuuguuucuuuuuagcuggucugaauuuuuaaauauauuuguuuauaaauacaggaauccaugcaaggaaguucugaugaaacugccaacaguggugaagauggaagcaguggcccugguagcaguagugggcauagugauggaucuagcaaugaaguuaauucaagccaugcaagccagucugcugggagcccuggaagugaggugcaaucagaagacauugcagacaucgaggcccuuaaagaagaagaggaagaggaggaggaagaagaagaagaggaagaggaagaagaugaugaaga

SEQ ID NO: 5909 - RNA, 86997 nt, Mus musculus
ugauggacuuaauuggaaggaacuucucaaaauuaagagugcucauaaguuguuauaugcucuugagauuauugaagcacuaggaaaaccuaacagaagaauaagaagagagucaacgguaauuacagaucaguauuaucauuaaagacuuuacucucucagaauuccaaaucauccuacuauuucauucuagaauauuguuuucuccuuauaaccucccuuauuuauauuuuucccuuccucacagggaaguuacagugaucuuuauccagauucugaugauucaagugaagaucaaguggaaaacaguaaaaauuccuggacuugcaagguuugaugauaauuguuuuguaaaagauugaggaaaguacuuuuuagguucuauaaaucauuaucuugaggauuuuuuaaagauugaguuuaguuuaauguuuuugaguguuugcuuguauauauguagugcuuguggaggccaauuggaaggcucucuauauccccgugaacuggaguuacagaugaauauaacccuuucuguaggaaccugagccucggagggcggcagagaguuaguugcucaguggggaaugguagcgcgugugugugugugugugugugugugugugugugugugugugugugugugaaugacugaacauaauacaaggcagacaggaagauuucaaucggcuugagggaucguggcgacuucuagguaguggccucugaauagucagcagaugcuccaggaaaagggagauaggcgauagcagcugccuacucaaugcagucaguccuugugcuucacaugagcagcuucauggucuucugcuugaagagggugggggcuguucaagacugcacuuaacuaugagauagcaaggagucagcagcagugaagccuggaaguaccgaggugaugagcaccugucaccagagccuaaugcucuuagaccucugagucccauccagcaggagaaacucaaaaguaaggccaauguccaggccaugagggacaggguuguuguaaauggucuucaauggccagcaaacauauacaacgagggagguuguaccuauggucuaguugaagaaaccauugaugauguccauuuguacaaguguugguagcagaugccaguugugcugcugggacccaagaugagaaguucauuauuggggaagcuccaggugacaaccuauggugguucauuuccauggucagcuugguuggauuuagggucacccaggaaacguaguccuuagccugcaugugaggagguuuccagagaggcuuugaugagaaugaaaggcucaccacagauguguggcacagucccauagacugcuguccugaacugaguaaaaacguaguuucucucuacuuccugacuacaaaucuaaugugacuagccaccuccuguccccacugcugugccuuuuguaggagagggagaaugagcaugugagaguaugcuuagagacccguggcuguccucuagugucaaccauacacauccucugagacagggucucguugacuuggaucucaucaguuaagcuggcaggucagcaaacccuagguaaacuuucgucucagucuccucagugcuguggucauaagcucuuaccauugugugcuuagguggguuguaagaguugaauuuaguucugugcuuacaggguaagucuuuuacugagugaccuauguuugucuuuaauucugacuaauuuacucuuaaaguguaggugaaaaaauuacauuuuuaucauauaugauaguaauguuaagugagauuaaugcuuugcuucucuuaauuuugagccaaauuuuuuuuaguaccaguguccaucccaugcuacugucagcauuaucuccuuguccucuaauacacauugaaauugggacagcuuaguaucugagauuccuuugguaaaauuugaagucauauucauaaacuauaacaagacuuuuuaaaauaauuucugaaaauauuuuauauggaaauuccuuuuagcuagguaccuuuaauuaccuuuaaucccagcacuuaggaggcagaggcaaguggaucuuugaguucaagaccagacucgucuucggagugaguucuaggauagccagagcuacacagagaaacccugucucacugccccugcuaaauuaauuuuuuauuuauagacagugauuuuuuuuuaauaaaacacaagauuuuuaaaugcuuguuuacuaaaucaacaaaacaucauuauuauuccauauaacuuaauuuccuccucucucugcucuccaaauugcuuacaguuuguugcugcuggcgggcuucagcaguuacuagaaauuuuuaauucugcgauucuagagccuaaagagcaagaaucauggacugugguaagugaacucguuuaucuugauuaauuauaguuaccuuauuucagucacuucuguuucauuggcaacguaacucacuacauacuugguuuaguuaacuaagacauauaguagaaaggaaaaguuuugauaaguugauauagaaauuauauaacugaaugaagcaaaguggggcagguuacuuuugguuuaugaagaugacuuagaggcuaaaagcacuuaccauacaaaccugaugaacucaugcacgggacagaagaaagaacgaacuuccacagaguuaucuucugaucuuuacauaugaugguccaccccuguauucccuguguauauguacacacgugugugugugugugugugugugugauggaguuucuuuuguagcccuggcuguuaacaaacucacucuauaaacaaggcuugcauuaaacuuacagagguuacuugcuuuugccuccagagugcugggauuaaaggcaccacuacugcccugcuauauuaauuuuaacauacuugacauaagugcuaaaguuaauuauucaaaaauacuauaaguucaugaacaauuauuucucugguaguguuuauaugguuuuaaaauuauuuugcuuucuuuugagguauguuguuugucuuuuagucagggucucccugugucuccaggcuguaacuaacucuacucuccccaugcuggucucagauuuuuagucuuccugucuuggcuuccugagugcugacugagauuacacuugugcuaccaugccaaccauuacuugcuuuuuaaaggugguccaggcugggaguagaagcccacaccuuuacucgcaauacucaggaggcagaaccaggcagauuuuuuuaguucaaagccagcuuggucuacagaaaaaaguuccaggacaaccuacaccuacaucuacaaugaugaaacccuguaucuaaguuuuaaaaaaaagucaguuaaaagugauucauauacauauaugugcuaacuugauggauguagcacuagugauuaaauguaauauuuuacgagugacuuagaucuuagcaaaugaguaucuuuuguuuugacuaauccugcuuuuaagcaauaguacacaaaaaguauuucuaggccauacuaauuuguuugccauggcaucaagaaacggaggauaauaaacccuuuuguuuuaauaauaauuagaaguuucacuaguucuuuuugcaauauuucacauaaauauuuuucucucaaaaaaaaccccugaaaaaccaucuacuauguuacuuuuaugaaguuaaaguaacacugcuuuaauauuagguaaagaaaguugcuaguacaauauucacaacauucaaugauuuguguaauaauguagucaaucuuuugaauuaaauauaaaauagauuauuuuuauuugaaaguccacuggaguguuaacuuguuuguacuuggguuuuagaguugccuccaugcaacaguuuagcaucaguuaucagaugcuauguucuacuuuguacaguugauucuuucuuuccaccauuuuagguucuuguaacuacucacaaauuuagguugugagguuuucauggcaagugucuuuacccacugugccaccucgccugacccccucaguuugccuucucauuacuuacaugguuuuaaauguuuugcuuucuuuagguuuauguuguuugucuuuuagucagggucugucuauguuccuaugaaaagcugaacaucuuuuucugugguauuggucauugggagugugugugugugugugugugugugugugugugauuugugauuguacauauuuuuauacauuuucaaauaccuuuucaguuaggcuggaaggaacuuacuaguugaugaguauguguaauguuuccacuugugugucuuauauguuccugugaauuuggccaacuuggguguauacuuaggaauuuuaauugcuggguuuagaaauaacuguauuuaacuuuuuuuuuuugguguuuuuugguugugcuuuguuuuuugguuucucuguguaucccaggcuguccuguaacucacucuguagaccagacuggccucaaagucagagaucccccugccucuuccucccaagugcugggauuaaaggagugacccaccacugccuagcuguguucagccaagcaggucuaccauuuauauuccaaccaacuuuguguagccuaguuuccacacaaaggucauuuacuaccuuugagauuuuaaccagucuaggucucgugacauugaauguucucauguuuuuuugauuuauauuuuccugauagacaguaugauuaaagagcuuucuaugugcauauuggucauuuucuuaguuaggguuuuacuacugugaacagauaccaugcaguacuuaaguacuuuuacauuuuugucuuuguuucaaaauuuuuugauguugaagaauauauguuaauagucagugaguuuuuauuguugauaguguauguauuuuauaugacauaccaaaauuugcuuaucuacuuauggaccucugaagaagcuuuggauauuuauacauaaguuuuugggguacauauauuuuuggguaaauuccaggaaauuaaaucacuaaauaauaauguaagugaaaauuuaaauuuauucaaagcugccaaacuguuuuucagguagaccuauuguagaacauaaagggauuuccuuacucuacauccuuaguaguaguugcuuuugaucaaaaguuaaaauuugagacuuucaagaacuagcugauuguagaguguucacugguucauagaguguuugcuuaucuuguaugagucccauguguucaucuccacaucugcaagagcuuuuaagacuuugcuuuucuuuuuuucagcuauacauaugauggauguuuuuguuguguauauugauggguuuuauugcuuguuccuuuuagaccuggucuuguuuuguaguucaggaugaccuugaaguuccauuuugcugauucaacuuccuacguuuugcaaacuccaugccuggcuugacagaaucuuuuuagagacaagagauguaaaucuggacauagcugaggauguucuuaaacucuuguauuuaccucucuagugcagugacuguggugugcaccaccauaucuguuuuaugcuguauugggaauugaccucuggaauuugugcaugcuaaacaagcacuccacuaacugaacuauguacugaguccuaaacaauauuuucccucguuuauuuauucauuuuuuauuuagucuguguauauuaccuggucaugcuugugccuugacaugcccauggaaaucagaggauaacuuaagaguugcuuuuucuccuuuuccuuuguuguccuggggauugaauucaggucaucaggcuuggcagcaccaccuuuaugcacugggucuaucccagcagcacaacagugccuuuuaggagguguuuuuaauuucacuggaaauuguauuugguuugagaaauauauauugaagcucagaaugauuuuuccuccuauaauuuuucuuguaugugguagagguguguguauguguguguuacaugcaugugugucugcugguaggcucucuaaugcaucugauguggaggccagagguuaacuaacuucaggugacuguuguuguucaccuuaguuuuugauucccugcaucuugagcuuacuauuucaucguuaguuggaaaguaagccgucuggauccaacauccucuacaacugggcuccagcuggguuuacuauaucauguaauuauguauauaguugcucuauauucucaucaacuauauugaugagcauuugaaggaugcuuuauguagguguuagugaauccaaccucaguguuucuugucugcacaagaagcauucauucacccagccuucuuuacagcucucuguucuguuuuguaguucucuuugacauguauaguguuguuaauucauuuugaauuagcuuccguaugugaaaguuaagauugaauuaguuuauuuaguuauauagcaucuaauuuuacuaacaacauuuguugaaacuauuucucuuuuuuauuugaauuauauugaugagaauuuaaaguuuaguaacauggcauugcuauuacugagggaagggugcuuuuuuucugguagagagauauaaguaccacuuaccacuggaaucaggagaauaggaggccaaggauuauuguagugaaauuucugaaaaucuucucuuguauguaaagaaauuuuuugaauuguuauuaggacuuaaaauucauuguaaacuuuauucuuccacacuauuuauuuuacugaauaaguauuuaucuuaacuacuuuuguaauaaauguaagauuuucaguuaaaauguccuuuggaguacuugaaauucuauaguaugaaaauaucuagccuggucuauaugugaaguuuaggccauucagaucuacauagagagacugaguguucugaaaaaaaggaaaaaauuaauaguguagagcaauuaaauauacuaauuuauuuugcaguucauauuggugagugggacaauaagaacauuguuguugcuuugaaaugacuuuuuccuuaacuuggaacucacuguguaaaucaagcuggcuuugaacucaagagaucuaccuaccucugccuuccagguguauggauuaaagguguucgugaccaugccugguacccuguugguauuuguaauaaucuugaaaaauacauucuuugcagcauauuuuucccaaauuccuguuagcuucuauuaaaaacauuuuacaauaauuccaugggaaguaaauauguccuuucuaauuuauuauauacacgcccuuuaaaaaaauacaauuaagccaggcggugguggcacacgccuuuaaucccagcacuugggaggcagaggcagguggauuucugaguucgaggccaaccuagucuacaaagugaguuccaggacagccagggcuacacagagaagcccugucuugaaaaaacaaaacaacaacaaaaaaauaaaauuaaaguaauaauaauagcuuuugaaugcaaaacuuuccucuuggguccauggcaagaguuuagaaccugcaaugaaaaugguugcagaucagaaugaaaaggauaccuuaauuuuauuaauuagcaacuucagcugccugugaagagaagucuuuuggaguauuuuauguucuuuuuuauucuuuauucuuuguggggcagccugcuucugccuucugagugcuaagauuaaaggcaggcauuaccagcaccuggcaucacucuuuauucuuaugggaccgaaaguguauccaugcgguaugcucagcuaaaagcucaguuuacuuagaaaccaaaugaauccagagaucagggacaauuugccaauauuaugcuauuugcauuacaauuguuuagccccuagugcucuacauauaguuugccccucucaguuaagcauaggcauugaguuauaaguucuagauggagaggcaaaacuuuaaacuaugaugcugugaugugaccaccaggggaguaagugaaggaaccucuuggugguugaaagaauuccuaugaacaguuacuuuuaauauauucaaaaaucaucauuuuaagugaaaacuuucuuuguaauccauauuuaugaauuuuuuccugagaguuuaauuuuguaauggauugguuuauuauuuuauauuauacuuuuauuuguauuuauauuguaauuauaugaauaaucauaugacaacuguggaagauacucauaauucauaacaguagcagaauuacauuuaugaauaggccacacuuuggaggguuaagggguugcagcacugggaagguugagaaccacugcgcuagaagcugcugauguuuaucucuuccaugggucuuacaucugacuccacaagaguuauugcaucucugcucugacuuccucacacaguacgaguuaugaugucucucuaccugcacuauguuguucagaucuuguuuuuuauuagauguuuacuuuauuuacauuucaaauguuguccccuuuccugguuuccccuccauaaacccccuaucuccuccccuucccccugggucguuuucuuaaaauaaaguugcauaauguuaaaaacucauguagcacauugaugagaaucuacccauaauuuuuauuuuuugucugugaauuucagaguugaauaauggucacaccugucauguacaugaaguggagcugacguugucuucucauucacaguggcagcuggauugucuugcuugcuugcugaaauuaaucugccaguuugcaguagauccgucagauuuggauuuagcuuaucaugauguuuuugccuggucuggcauagccgaaagccauaggaaaagaaccuggccuggaaaaucaagaaaggcugcuggugaucaugccaagagucuucauauaccacgauuaacagagguaaaguuuggaaauuaacauuaaauuguucuaaugaauucugcuuaaauuuugagaaagcauaugauuuaguuuuuauaaaguuaagaguacacuaauugauuccuaugauacuuccuaccagccacagcaaugucauaauuugacguuguaaugaaguuuugguaauaguuuucaguucuucauuuaacaggaugcacaauguaccauuuuaauaugauaucuuaccuuacaguuacauguacaauuagaacuuuaugaugugcguucugaguguaucagaguccauucagaaauacauauuucaacagaggaaauguaguagacguugaguuucauauauguguugaaguguuaaaaauauaaaaugaaguccuaaaggaagccaggcaaaacuagucaucacuccuauagcugaauaaagaucauuguuggaauuuuaaggaguuagaagcuuuacuagagagaacuuguugaacuagauuuaguaaaaugggucuuuuugaaagcugaagaccugaacugcagaggugcucagaaguuaagaggacuuacuguuuccagaagaguuuaauuugguuuagugucccuaccggauagcucauaauucuaucuccaggaagaucuaguguucuacucugaccucuugaggccuaugaauaccugcauaccuguguguguauacacacacacauacacaccacacaaaacacaauuuaaaaggugaagccuuaucucuucuggucagaaaccccuggagcaauacucagaaacaaagaagaccacuaucuaguguaacagguuuuauuaggaacccagcugucaaaggaaggaucuugccuuuuagagauacaggaaaacaguauagaaaugaguacaucuuucagcauaaaccgagcucaugggccaggucuggugacacacaucuaggauccuagcacuccagaggcaaagacaggcaaaucucugaacguucaauccagccagaguuaaaucuugucuugagagugagagagagagacagaaaucgaucauuuugacuauguauucuuuguucagauaaucaaauguauacccgucaccaucucuaugaggggaaguagaaagagacuaagaugaguucuuauugaaaucucuuccucauucugucaccccuugagaggcacaccucaucugauaccugccacaaaacaugaacgagaaaugaauugguacagauaaaggaauuugguaaacguagauuucggaacuauugguauaacugggaaccuaaaguauguuucacuuuugcaauguuagagauuacauuugaaaauucauaucuccaaguauuguaaauuauuugcaucucuuaaauaugaaaaguucugugaauugaagaugcauuccaaaguguuaccuagugggaaauaguacuugguaguuucuucaauguuucuauuauguuuuuaccagaagaaaccucccacauuguaauauaaauauauaauuaaucaaaucgaugugauucuuuucacuaacuauugaaauaauuuccuuuuaaaaaauguuuacuuuuauguguauuaaguguuucgccagcauguauacaugugcaccugauaagugcuuggugaccaaggaggccggaaaaaggcauuggaucgcagucaugaguuuccaugugcuucuaggaaccaaaccuggggccucuucaaaaacaucaaguguucuuacugcugagccaucucucuaaauaauuuugauauuuauuagugauuuacuuuuuuauguuugaauacuaaauauguauaaguauugauguaaaauacauuuaggaaauuuuauggugauuuguuuuuaaaauauagcaacuacauggcuauuaaaaauaauuuagccaggcguggugguacacgccuuuaaucccagcacucggaggcagaggcaggcggauuucugaguucgaggccagccugaucuacagagugaguuccaggacagccagggcuauacagagaaacccugccucgaaaaacaaaaacaaaaaaaauuucuuuuuuagauuauacaaaugaacccuuuaucuagucagacauaccugccauuuauaauuuguacauacuuuguucauagauuuugcauuagguguuauacuguuaggaaacauaaauuucuauauuuauuaacuuauuuaccacacaguuguggcuuaguaugcacauaagaaauaaaacuuacuauugcaugauuuuagggggguuggguaaugaaaguacauuugguauuuugcucugcucaacauuuuuuuuucucuuccuugauguuuuuguuuuuaaagguguuucuugugcuuguccaaggaaccaguuugauucagcgacuuaugucuguugcuuauacguaugauaaucuggcuccuagguaugcauuuuuguguuuuuuauauauguauauucacuucuuaagcuucauuuugagcuggacaugcuggcacucaccuuuagucuuaguauuguggaggcagaggcagguggauucuucacuuuggggcuagagagaugacugaguaaaaaugcuuuuguaagcgugagaacuugaguucagcuaccaagcauccauauaaaugccagaugauaagguauguacuuguaacucuagagacgaugugugucagagauaggaucauccccugagcucaaccaggcuaaucaacuuggcaagacccagguuuaguaacagagagacccauucuuaaaauuaaagguaagguggacaauaauagaagauacuggcauccaccccugaccaugguugcauguauaucauauacauuaaaacaguaaacaaucacuuccuuuugaaaaagguuuuuauauaaaaguuacuuggauuuuauaauauauuucccuacuuuuucaccuagacuuaaaauaucuuguuaauauuugucaaacauauacaugaguauuucuguguauguuaauaaauucuauggaauuucaugaauguaaguuauagacauuaugacuauuuugauauuugucucuuaaaaucaaggauuuuuuuaaaaaggguuuuuuuuuguuuuuuuaguaacuagacuuuuuuuuuuuauggauguauauggauguauacuagugauggcuguuguuaucagcagagauuugaagagauuuuuagagucuccuaggguugaauuacaagugguuguaauguguguucuaggaagaguggaauuugaguccaacauucauuccuggaagcccacgguugccuauaacucuagguccaggcuauauaguaaccuauucugaccuccaugggcacaaguguacauauauguacacacacacacacacacacacacaaucuuuuuuuuuuuuuaaagauuuauuuauuuauuauauguaaguacauuguagcugucuucagacacaccagaagagggagucagaucucguuacagauaguugugagccaccaugugguugcugggauuugaacucuggaccuucggaagagcagucgggugcucuaacccacugagccaucucaccagcccucacacacacacaaucuuaaagauaaauucucaaacaguuuuuauauauucaauuaaugaucucuacuagauugucucaaguagacugauuuuuuuuuuuuuuuaauuagugcuaggccccagacaagcauuuuauaaguuagacccuaaagccccuguuaauuggguaaguucaugcugacgcuagagccaggucugagacagaauaucuggagcucugccugucccuguucuccacuggugggacuacagagaaaugcagccaugccuuagguuuuacucgggugcuugggauuugaacucggauagucaugcugcagagcagugaccauuagccacugagacaacuucauacuugugauccuuuaauacuuuuaauaauuuguucuucguucaguaucugugaugccauuaguugucauaauucuuccccuuuuuuuguaaauagagauacuuucccaaucuuuuuauaauauugauguuuuaauaguacagacccauuuuggcuuuuuuggguuuuuuucuuuugaaacaugaucuugccagaucugccuuccuucagccuugcaguucuccugccucagaaucuagaguguugagaauccaagcauguguccguuaggcccaacuugggccagaaaaccaaaaggguuguucuggaacauuuuucaguuuuguucuuacauuuuuaguaguaauaguacagaagugacauguuuuuuguaauacauucugaugaugucauuugcuauugaggauacuaauuuuaagaguuaaucuggcuucuuccuguuucuucugcucaaaacuuccuuuugaauacguugucagugugaagacauccugaaguuacaagccuacuguuucccauaaauccucaauugacuugagcuuuuaucaauaauuuuuucuugaguaaauguuaauauaaucucuucuaaauguugauuuuucuaauuauuagaauuucuuugacaucauugaauaacccauuguguaaggagauggaugcacuuuuuaauguuauucaucuaguuuaauauuaauuuggauucauggauuugaaauauuuauuuaaaaaucuuuuguuuuuguuuuuuggguuuuuuuggguuuuuuuuuuuuuuuuuuuuuuggagacaggguuucucuauauagcccuggcuguccuggaacucacucuguagaccaggcuggacucgaacucagaaauccgccugcuucugccucucaagugcugggauuaaaggcgugugccaccacacccaacugcuuucuuacuuuuuuuuaacaacccccuauacuauccuaucuucuaaaaacaaucuuguugcuuuuccaaguguuucacuuacuaguaguuuuaaaaauacgugacaaucagagucugacuauguaagucucugaagucuauuuggagugaaguuauuaaagaauauauaguaauuauuuuacuaccuugccaaauuuaauuaggagugaugccauuuucuuguuuuacagaguuuugaaagcucagucugaucauaggucuagacaugaagguaagagcucaacaaaguuuauuuuagguuuuuuuaaauauaauuuuuaaagaaaguguaaaaaccauuguuaaacacucuguauuuaauacugagcauugugucuuuauaacacaaagcauauuaugccuuuauuuucuuucagugucccauuauucaauguggcucuuggugagcugggcucauugcugcucuuuagucaagucuagucuugccgacagugaucauuuacaagauuggcuaaaacagcugacucuccuuauucccgagguaagagaaaaaggaaagguugguuagugcugcugcuucuacaagcuuuguauuacuagcauugcuaauuaaauaagaucaaauaaugguaaaggaauguucaugauucuauuaaucauuuucauuauuuaccauuuagauacagaaucugauaaacuaaaaaguguaaauauuauaaagucauauuugucucuuuuuaaguuuuguucuguucuggauauuccagguggccacaucuggauuauucacuuggaaucugugaagugacuuaaauacuuuuuaaguugccugugguucuaaaauguuuuuauguuguaaauaccauaauuaugaaaaaccuuuaauccuauuuauuugucuacguguauauuuuuauauuuguuucugcuuuauagccuuaagcauuucuuuucaaauaaaguaggcauauacugccaugcacuacugaauacuuuaaaugguuauauguuguuuacaguacauugcuagggcuggugauauaggucagcacuugcuugccuuacaugugccaggcucuauguuuagucuucagcaaaacaaaaugcuuugugaaagaagucagccauccucaccucagucauacucacuguguucucagcauguggagguauaggcaagaggauaaggacugccaagcuggcauuuggggccaccuuagccaacagaaagguuucauuucagacagacaagaaacuuccuaaagcuguuuguauuaauaucgcuccccuucccucuucuuucuucauugguuuuauccucuucacuuuuuucccuuucugugcacacacaagugcuccucuccuuucugcuuacaucucuuccacccuccgcugugcuggagcccaaacccaaggccuuauuuauacaugcggggaaccugcucuaaugcuccauuauauggguuguauucccaggauuuauccgccccuccccccaaggucuuauguagcccaguuugauaccaagauugauaaugcaauuuaggauaagcuuaauuuuuugagacagucuggccuccagccuacugaguagccgagcauaauacuucagugcuagaaucugauugauaaaaugcugugaauuaaaauuggggagcaaacucaaagcaaccucucagcugagcuguuuaucuagcauaugaauagccuuuuaauacucuaagcugucucuguuuucuccuuuagacugcaguucgccaugaaucuugcaauggucucuauaagcuaucucugucaggccuagauggaggagacucaauccaucgauccuuccuucuuuuggcugccucaacauuauugaaauuccuuccugaugcucaagcacucaaaccuccaaggguaagauuuuuaccuuguugcaaauuuguuaucgugacuguauccuuguuacuucauaaacuccugauucuccagucccaaccuaggagugcugagaaugucagugcacaccaugaugccucauaccguucucagggucagcauuacagccacuaacagcaucaaugugaugagauuuuagcuuugaauugucugucauguggauguaauuuuggagauaauguuugucccuacaaaguugaaaaauuauggagcacccuucuucacucauuuuauuuguuuuuuuuuuuuaaauuccuuuuguuuuaccuaguguccuagugugacacuuuuuaaaaagcuuuuauugcauaauaaauacaauaauuuuuaauaccuaauaaaagauucaugccgggugugguggcgcacaccuuuaauuccagcacucgggaggcagaggcaggcggauuucugaguucgaggccaggcugguuuacaaagugaguuccaggacagcuggggcuacacagagaaacccugucucaaaacaaaacaaacaaacaaacaaaaagauucauuaguauuuuaaaauaauuuacaaaaauauacacuguagaauuugcauauuuuccuaugauuauaucuuuuccaaauaauugaagauuguuuuucuuuucuuguuuuuguuuuguuucuuucucugagaccuugcuuuauucugucuccagaguaaauuuagacuaaaggugguauuuuguucuucuuuaucucgugauuguaugauuuuacagaauucaccaggaauucacucuuuuuuaguguuuguauauuauuuguuuagggauuuacuuucauaaagucugugcuugcuuaaacauguuaauauuuuuaaaagugauuuuacaagguaaaauuucucuuaauagauagaugauuaugaagaagaaccacuguuaaaaccuggauguaaagaauauuuuugguuauuaugcaaguuaguggacaacauacacauaaaggacgcuagucagguauguugaaagcaaaugucuucaguuguuacuguguagcagacacucaagccuugcacagacacacauggcuuuauuuguccuuucagcugagagcaccuucauugaucucuaaggagcagguucuguccuaacuugccuguuacaucauucccuuguguucucuccuaguuucuuucuuauuuuuacuuugacuuuaaaucuuucaauugaaauuauuuuaagcuaaacuaaaacauuuucuuuugaacaaauaagugcuuggauuaaagauuugcuccacaacauccagcuacaaauaaauguuuaaaaaaaauacauuuugaagauacacuugucacauagacuuuauauuuuccucuuuauauaaauuaguuaagcuggaaauguauguauguuaauucuaaagaggugagacuaacauaaggaggaucaauuuugauauuugggaaccauuuuccaaaauguaauguuuaguuuaucauuaaagcgugggucaaagauaaugacaauagaaaaaaaggaguggggguauugugauacuguguaccaguauacugugguacauaucacugcuccauguguaaauuguaccuugauagaugaagucaagggggaaacaaaaaacuaguaucuggucagguguuuacuguuccacuauaauuacuacuguggcugugauaaucuauuuuaaauuugucuccugugugcugagguuuagggcaugagccaccacugccuuuuuuaauggacuugaugcacuuuaaaguauaggcuuugggguuuguucauuuguuuguuuuuaauacuauguagaugaaaagauaaaucaaguuuaacuuaauuuguaaaauaacuuuuauuauauaugagauaauuuauauuuuucuaauuugugauacaucaaacauaaaaaucugcauuugaauuuuguauuuucuuuuugccuuaagacaacacuccuugauuuagaugcuuuggcaagacauuuggcugacuguauucgcagguaaaaaucuaaugcagaauuaccaauuaaauuauuaaacaaagagaaaagaauaucuuuauuuaucuuuugcuuguguucuuuucuaacaguagagaaauccuggaccaccuagauggcaguauagaagaugaugggcuuucggggcuccugagacuggcaacaaguguuauuaaacacaagccacccuucaaauucucaagagagggacagguaugcuuuaaaauauaugcaugagucauaguugaagcuucuuuuuacauuguauguguguucuguuuuguuuuacauuauauccaagccauguuugcuagaacuugaugaugaauucugaauaaauuaacagugaaaauaggaaacuuagaauauauguuuagaauguaaaaacaaauuuuaauuucuguuacucaggggaauguccacucugacauuuccuaugugaaaacauuuuuauauauguuuucucuugugcacuaaugucuucacguaguagagucaguuggugauggucauucugacuauaauggcuuuacccugccucuuacuuuuuuuaauauuuauuuauuuauuuauuuuauauaugugaguacacuguagcuauccucagacacccuugaagagcguaucggaucuuauuacagauggucgugaaccaccauuugguugcuguagaauugaagucagggaacugcugagccagcucuguagcucaugcuuucauauuuuuaaggccuccuugaaaugugucuugaauauuuauagcucuuaauaacuaugucauuggcacuuaucuccugcagugagguaauuacuucucauuuugagaacuuuuaucuugaaguuacuaauuguguuuuaaacaguaagcaaaagaguacaaugacuucuuuuguuguuguuguuuuuuguuuuucgagacaggguuucucuguguagcccuggcuguccuggaacucacuuuguagaccaggcuggccuggaacucagaaaucugcccgccucugccucccaagugcugggauuuaaggcaugcgccaccaccgccuggcuaugacuuguuuguuuauguguguguguuguguauguauuuguguaguauauacauaaaauguauauguaauauauguauguguguguaaagcauguacauauacauacacauuauacacuaaaguucauuuguucuaugauucuuauauuucaucuucucuauaacaaagcccacaaccccuuuauuuuauuuguuauucauuacuuuuacuacuuuuuauugauugauacaguauuuaagaaauaauacugaucaguuuuaucacuaaugucccaguuuauuuauuuuucaauuugugaguaguagacuuucagggacuugaagcaugugccaguacaucccacuuaauuuuaguuugcuguuguuguuucuguuucuguuuuuuuuuuuuuucuagaaacuacuacuauauguacuuuuuuuuaaaaguuaguuuucuuaaaauaacaguuauuaugcuguauguuauuuugucaaugcccuuuccuuuuugccaccaguaguauauucagugguaauaauuagauguauagauuuguguuuaaauuguuacauaaaauuuuauccaaaauuagauacauacuaaacuuuuuuuuauaacauuguacacaaauauuacaaaaggauacaaagcugccuaguacuggaaaacaaagaagguucuuguguaucuugauuaucuaccccaucccugccaagguauuuuguuuguuuuugaaacaagauuuugugaagcccaagcuugcccugaacuugauuuggaaccaaggcuggccuugauuuccugauccuccugccuuuaucuccagaguguugggaauauagauagucggguacauuuuaugugaguauuccugugaauauuuguggucauauuuaugccauggaauaugugagaugguuucaggacaacuuauggacaauaacuucuaccauguuguuuccagcaaugaaaagauuagacuuggcagcaaguaccuuuauucucuuaaguacucuguuaaggcaucuaauggagaauacaaaagaauguuguucacauaguguucagaagaguuauguuuugguacuucuuuguugcuuugaaacugucuugaaauaaccaagguuagcuuugaauacuguauaguuuauucuaugugcacaggaugauuuugaacuccugguccuccggcuucuaccuccugagugcuggcauuacaagcguguuauaccguauauuuuucaauuuauuuuguauuacacugugauuuauuaccaaaaacuauuuuuaauauugagccacaguagugaauaccuuuaaucccagcauucaggaguuagaggcacguggaucuaugugaguucaaggucaaucugcucuauauagugaguccuaagauagccagagcuauauagagagaccugucucaggaaaacaaaaacaaaacaaaaaaauucugucggccuuguguaaguucuuuuuugaagaauaaagguagauucagaauagaaaacaaaaauguucauuggcucaguguuuaugguaaaaugcuuugaucacggguuuuaaguauacuuuuucaaaaucacuauacaaauagagcuuauuuuccuuugaguuaugagauguuuggcaaagauaguucauuguuaguugguuuuuuuuuuuuuaagauuuauuuauuacuauaaauaaguacacuguagcuguuguuagacacaccagaagaaggcaucagaucucaugacaggugguugugagccaccaugugguugcugggacuugaacucaggaccuucggaagaucagucagugcucuuaaccaucugagccaucucuccagccccucauuguuaguuuuuuauggccaauuuguacuugcuguugaaacguuugguuaccagugcagcugaacauguuguuuuggaucuccgugacaguaaucucaguucugaauccuuaaauagauaaaaauaaaauuauaucaucuuugagucaucuguaugaaauaagacucaaaucauuuuguguauuuaguagccaaucuugucuucuuuugcaaaucuagaaaguaugauuuacaauauuuggaaguaguaaaauagaucuggagaaaacauccuagugguaaacauuuuaagauguuuugguuuuaguuuuuugaguccuguguguugcuuucccaguaccaccccuggugagugauuugucaggacucagaggacuuaacaguggacucacugcuaguuuucauuaugguggaauugaacguguuuaacuuugccaucguuguuacugcgacugagcauguguccugcauuuccaguugcugacauucaagauuccuaaaacauguuuagcauaaacuacaugcgguuugauacagugagccacuucugucauuuagggaaaguuugauauucauguagggaacugauugcaagucagguuuuucagacugcaacaaaaugccagucuuacuaaagagugaugcuauuugaaucuuaauauguauaguuuuucuucucaguccccuaugaaguacuguaccacaggguagauacaguaguaauguuugggauguguaagagauaacuagguaaaauguaagggagaauaauuagaaaagaacaagcgacccgaggucuccuuagcugaggagcugucagcaguucacaguaacuggggaggggauagauaggcuuugcccaugucuguaggaggagauucauuggauucaguggcuuauucagaaagaaaagagaaagcaauggugacaugauuuuaacaccaggauuugggagacagagacaggugaaucucugaguuugaggcuagccuaaucuauagaaugaguacagggacagccagggcuacacagagaaacccugccucagaaaaagcaagagagauugucuaggaggagagggaggucgggagggagggagagaaagaacaugagcuuggaaagggcacauguugcaagauaaauggacauuagauaggcaugguagagaaggacguaagguggauacagacauaguacauuguacaguuuuauguaguuuucagagaaugaaucaacagcuuuuuuguagaagaauugagugaaaagauaaccuggguaaacucaucuuugcguggucccaaccccugcucuugugugugccuuggcuucccuucaagcacaucaccuucuauuuguauuuaagccuaaauuaaaaugugcuagaugaauaucuucaacucugcuuuauaaccaaaauguaacauaauacacaaauugaauuuaggacaaaagucuguuauaaauuaggauuugaaaacugauuacauuaaaacaauuuagguccaucugagaguaaaccucauuucuuuagauuacaaaauuaagaagauagugggaaagagguuuaugucuuucauccuaacuggcauuugucacaguuuuaaguacuagcaagguucuuauuguuucugcucuuuugcacggcuggcacucagggugggugagguacuucuguucucguuguucaccacauggagaaacaucuguaggauuuggcaaauagggaaugacaaggccuuaauagaauaucaguaauuuacaaaugaaaauaauaacacugugcaaggauaaucuguaaggauagauaugaaauuugaaguggggagaaacuaaaagauggguccauucuguuccguuuucuucaagaaaaagaacuuuggugaugauuuaugauacugcuauauacuuaugauggauaucuuaguaaauuauaguuagcccauuauccaauuuguuuuuuguuauguuuggaauauaauugguaucauguuuagauaacauaccugcuuucuucuuaucuccuaggaauuuuuaagagauaucuucaaucuucuguuuuuguugcccagucuaaaggaccgacggcagccaaagugcaaaucacacucuugcagggcugcugcuuaugauuuguugguggagauggugaaagggucuguagagaacuacaggcucauacacaacuggguuauggcacagcacaugcaguguaagcgcucauccuuuucuugacucuuuauaaauugaaugcagcaaugaacacuuaaggacacugauuaaagaaucaccuuuucgcacacuugguuauacacauuguugauagaagagucagcauuugauuuuacuagaaaaauguaaaaagccuuuauguauuuucaauauuugugcuuucuuuguauaaaguagcauaauaccaaguaaaguaaugcuuugacuguuaaucugaauuuuauaauuagauuuaaaauguuuuuuuaauucuuaauauuuuaaauucuacacauacuaguuggcaaaucaauagagguaguaggugccaaucaaagcaagauauguuuaaguuuguuugggguaucuucucccucuuuuuaucagcagcccaugcaccuuacaagugggacuacuggccucaugaggauguccgugcagaaugccgguuuguuggccuuacuaaccuuggagcuacuuguuacuuggccucuacuauucagcagcuguacaugauaccagaggcaagacaggcugucuucacugcuaagguagaguuuccaaacugaaaaccaaagcuugaauaguuucauaaaucauaauuaauuugauauaauaauaauaauacauugcuuaauaucaagaauauaugggaaaagagauuuuuguuguccuggcuaacuauuuucauguauuuaauuuuauuuacacuuauucguaguuucauuauguaguuuuuggguuuuauaugcuuaguaugcauaguuaauauuguauuucaguaaaauggaauacagauuucuuuuuucacuucauuuauuuguuuguuuguuuacucacuuuacaucccaauugcagcccccccuucccugcucucccaguuguacccuuauaaauccuucccccuauuacucuugaccagaggacgccuuuguguaccaccccacaucuagucccagcaggacuaagcaucuccucucccacuaaggcccaaccaggcaguucaguuaggggaaguguguccaauagcaggcaacagagucagagaaagucuugguuucaauugaagaccaagcugaacaucuacaaaugugcaggggccuaggucuaaccucugcaugcucuuugguuugugguucagucucugugaacccccaugggcccauguuaguugguucucuaggucuucuugugguauaccugauaccacaggcucccucaguucuugccccucucuuccacaagauuucccaaguuccaccugauguuuggcugugguucugcauguuuccauccccugcuggaugaagccucucaggagagagagauuuauuuuaggcuccuuucugcaagaauagaagauuaucauuaauaaugucagggguuggcucucauguuuuuuaauuuuauuuuuuauuuauuuuuuucuaugguuuuagagcuuuauuguaguaaacagaaagagagacagagagacgaaagguagagaguagaggccggccauggccuuguggagagagggaagaagagggggggaaagaaggacgacgaaagugagaguaaaagcaagagcuuaagagagagaggagagacaagagagcuuuucuauuauuuauuuuuuuaagacaggguuuuucaguguaucccuggcagguccuggaacucaacuguagaccaggcugucuuuguacuggcauagacccaccuccucagugcuugcaccaccacugccggguuuguaguguuuuauaaacaugaaagaaacaaagaaucauguuuuuagugcccccuccccauaaugacuuggucauacauuuuggugcuuuuuuuuuguucauguuaaagaauacuuuaagccgggcaguguuggcgcacaccuuuaaucccagcacuugggaggcagaggcagguggguuucugaguucaaggccagccuggucuacagagugaguuccaggacagccccugaagacacuucuccaacaaguccaaucauccuaauccuuucucaaauagugacacucccuaagcauucaaacaugaacuuaugggggccauucucauuuaaggcacugcacaggcuaggugacaacuugggacuugucuuuuugugaggugaggaugacugacuggguagagcacuuugcuguggaagcuacgagauucugaauuucaccccuagcacccaucuaaaaaggcaaguacacagugccuguugugaucccagugucaggggcagcagauacaaggcaggcccgaaguuugcugaccaaccagucuagccaaggaauaggaggucccagugcgugacagugugucuaaaaauaagucgcucccgagguccacacuggagggugacuucuggaguucuugcauaugccugcagcacacccaaauuaauaaacuuaaaaaauagauaaaagcaauuagguuuaaguauagccggauucucuaaucauggauuguaguacuuugauguuuagauuguuuaaaaaagucacgaacaauuuucuuccuuaggauugaaguauauuauuccaggaaaaauuauaaugugaacuaauugauacuaaaauguaauuuauaauauuugaguuuacucuacaagggaauuuacauacuuaaagugcuuuuuauuuuuguuuaucaauaagguauguaaucuagaaagcaaggguuuuuuguuuuuuguuuuuuucugagacaggauuuuucuguauaacuuuugcuguccuggaacucacucuguagaccaggcuggccucaaacucagaaauccaccugccucugccucccaagugcugggauuaaaggcgugugccaccacugccuggcuuagaaagcaguuuuaagaaagaucucucuauagucaauuuuucaucauaauggcuaucacuguaaauuguaauagaaaaauacccugguuuuucuaagauguaagaaaaggguuaaaugugagguguuuccuuccagacagcuagaaggaugaaguauaguaauacagggauguccacacacuaccauuaguuuuucacuguuuccucgugucuuucaguauucagaagacaugaagcacaagacaacucuucuggaacuucagaaaauguuuacauauuuaaugguauguuugaaaaaugugcagaauaacuaauuagauuauuuuuuauuauagugaccguaaauauuuuacuggcucuguuaauuagacuuacugcuaucccucuucuuuguuauagacuuguagcaaucacagcugaguuacuuaucuucuguuaauuugcccuucauuucuaguauuuuuccuguuacuuguugucuuaauuaugucuucuauuacuacaaggaaaccaccauggccaaaaacaacuugaggaggaaaggguuuauuuggcuuacacuuccaugcaaaauguucuucaccacaggaagucaggacaagaacuccaaacagagcaagauccuggaagcaggaucugaugcagaggccgugaagggugcugcucacuggcuugcuccuuaugguuugcuccucagguuugcucagccugauuucuucuagaaccaaggacugccagucuagggauggcacuacccacaaugggcuggguuuucccucaucaaucacuaauuaagaaaugcccuacauacaugcauacagccagaucuuauggagaccuuuucucaaaguuuucucucaguugauuuuagcuuguguugaguugacagaaaaccagcacgcacacugguuuaacucuuuuaugcaaacuuucuaacuguugucucuuuauccccuuuaagucuuauuuccacauuggaaaaaguaagggaucuuuuuacaaaagcuagaucgggcuggagagaugacucagugguuaugagcacgacuacuguccuagagguccugaguccaauuccccacagccacaugguggcucacagccaucuguaaugggauccagugcccucugcuggugugucugaggacagcuacagucugaagaugagcuguaguguacccauauacacaagauaauaaaucuuuaaagaaagaaaaagaaaaaagaaaacuagcuggucuuccagaggaucuggguucuguuuccagcauccacauggcagcuuacaacccucuauaacuaggucuaauguccucuucuggccucuacaggcacugcauaugccuggugcacagacauacuugcagacaaaacuccauacaaagaaaauaaaaguaauuaaacuuguaaaaguaaaaaaagauuuuuuuuuuuaaauauugguaccucacuuaaaacugugugguugcuacuguguuuguagaguuuuucgaguuuugcuccugccacucacaucagucagucacaguugcuuguaaauacaggucuuucuucccuaguuaugcagauguguacgcauaugcgugugcacacacaaaguuugaaaaagaaaaucaauuuuaugcuaugucuuuucaguuauuuucuugagauuauaauuuaauuacauuucuccugucccuuuccuaccucuaaaccuuuuugaaugucccucuccauucucuuccaaacacguuucucugcccccccaccccccguuauugugaguguguguaucuaugcauauauauuccuaaauguaacuuguucaagacauauaauguaucuuguaucuauguuuucagagauaacaguuuagcacuguacaagcagauagucuuauucaugauagggaguauauuuaaaacauugaauguuuuuuaaggugaguauuguauuuauggucuuauucaugcuacuuagccugcuucaccccugauaacaugaagcccuuugaagcccauuaccuaguugcuuuuuuacuuguaugguuguauauauaagguucuucagaacuccucucuauuuucuuccuguuguguaaucaacuagaagucuuaggagucaacaaaauauuugucaguuuccauguuucuuuucuauuucugauacuaaaguuuuaccuguuggaauuuucaggacaaguaaugccauaauugucuuguauucucagacugaaaaacuuuucuuuuccuacacaaauagaaaauauacuaguuuguuugaugcugacuuuuaaugucaccucauucugggucaggguguucauguauaugugggucguuuacuuaacaucuugucacagcugucugcauguugggaauauagguacaucacuucuaugcccugguuuuuaaauuuuccuuucaagggagauggagcacauuugaagugacaaaaucagaacugcugcuuaaacuaccccuccgugccaaauaagguucuucuguguagaccuggcuguccuggaacacgcuguagauucuugccucugacuucugaguucugggguuaacauugugccaucacaucuaacuaaucugaacugcuuuuaauaaaauuucauaaaguucagcauagagaaacuuaaaauuugaguuccaauaauaauuuaauaaggugagcuuaugaucucaacaucaggaccauuaaacuaaaaauaccauucagcucaacccaaagaagugaaggggguguuuggaacaauugucgucuucagcuggguauaguggaguauuucuccagcccuaguaugcaggagucugaaacagaggcagggcuacaaagugaaaucugggggugggguguguguguguguguggcugucugucugucugucuguugacgggcagaaaacuuucuaacuugcuuuguuguuuugaguuugguuuuuaucuuauuuucugugggggcagagauguuuuuuaauuguuuggcuuuguucugagcuagggucucucauaaauccaggaggcuccgauucucuagccuuggauuccugcucuuccuguugcaccugcuaagcacuagcgacauggcauuuuccaccccauaugauuguuguugauuuaaauuuuguucuggccauuucuuacuugauauuucuuccucucuuucucuugcaggagagugagugcaaagccuauaacccuaggccuuucuguaaaacuuacacuauggacaagcagccucucaacacuggggagcagaaagacaugacagaguucuuuacagaucucauuacuaaaguggaagaaaugucgccagaacugguuaguacuagaauacugaaaauuugucugaaauuuauauaacuuugaauuucaaucacugacuuugauuuguuuuauauuauagaaaaauacugucaaaagccuguuuggaggugucauuacaaacaauguuguuucguugguaaguauaucucuuuguuguuuuauaaggguuuuugggaggggcuuauacuuaauugcuaauuuuugcuuguugaucauccaggauugugaacauguuagucaaacugcugaagaauuuuauacugugaggugccagguggcagauaugaagaauauuuaugugagugauacuguacauaacuuggacuuguuuaugcuuuauacacacacacacacacacacacacacacacacacacacacacacacaugcacgaacacacacacaacaaauuuguggucaugcgaagaaauagcuguuuucauguauuuucuuucaugcuuuacucuuuuaauacuaaaaauagacuacauaauugguuauuucccaguaaaaguguaaauaucuuuuaaagguuagauuucuuuuuucuuuuugaauaucgcaaauaaaaaguuuaauuucagaauccagguucgucauuuauaaauacacuaaagcauaguccacgcaaacucagacaaaaguuagauuucauaugagaaaaaaauauaauuuaauuugaaauuccuucuuauuaaaaaagaaauugauuuucuuuaugcauucugacuaauugcauguuguaaaucaugucaucuucucaauguugguuugcccauaggagucucuggaugaaguuacuauuaaagacaccuuagaaggggacaacauguacaccuguucucacugugggaagaaaguccgagcugaaaagagguaugcuggcuuccauguaacuuuuaucauuugcuuacccaaugaagugaaaagacaaacucagcauagucuagaggccuuugauaaugacagcuguaugucaaugugauauaauuaacauguacacauaguacacucuagugauucacguaauauuagcuguuuggaacucaacaucacucaguaacuuguaguagucagugaaguuuaauuuagcauacacaguaggauagaaaguggggauuucuaaacuugggagcugucuggguuuucucaggagagacaugacagauacagguagugaucauacuugucugucugcacugacucccuugucuagauucagugacugguuucuagauaauaauacagauuuuuuuaguuuggaaguacuuuuauaucacuaaauuuagucaguacaacaucuuguaguaaauuauuuucacuauuauuaauaucaaaguuguuuuccauucaacaauugaagaugugguuucacagaaagaucagaguuacuugucuaauguuggucucuaagacaggagauucagauguauagauucuguggaacagguaacgucugcugacccugaguucucucugccuggaacuguuuuguaagcaguugccucuugacuggaucuugaaaggggaucugaguggaaguuagauuugggaguuaaauuuuuaguuuuaaaguaguaaguuucuguagaacuuugaaagugguucuuucccuugcaccacagguguugauacuguuuuagauacuucuguuuugaugcauucaucauaaacacuucuucuuggguuauaguucuuagagaauuucuuggaaaaucauaguuuaguguucuucaaguguaaaacaagaaacauaacugggccugcggagauggcuuaguaagcaguucacaaccaucuguaacucuagcuccagggagcuucuguggacacuuucauucacacacacacacacacacacacacacacacacacacacacacacacacacacaagcaaacuauuaaaaaaaaaaaaaguaaaaguaaggccugaagaggcagcucaguauucaagagcacuuuguucuucuagaggacuugacuucacuuuuuaucaccuacauccuauggcuuauaacugccuguaaguaacucuagcuugggggugccuaguguaguaacauaugucuuaaacccagcacccaggaggcagaggcagauggaucucugagaauuucaugacagcaagggcuacauguccuguguccaaaaucaaacagacaaacaacaacagaaaacauaacuccaguuacagguuuucaaggcccuucuggucccauagauacccccacauauggcuugcauauauacagacacacagaaauacauauaaaugaaaaugaaccuuuaaaaaauaauaauaauccaaggcuagccugguauacacagugaguuccaggacauucaaggcuaaccugacucaaaaagaaaaaaaaaauaacauuacuacuaccaauuuauacaaccaauuuuauaauuucuaucaguuuguauuuuuaugguauauuuuacaugugugcagggauauacacauaggcauguaugugaguuuauauacaaaccacaagucaauguuacauaucucucuaucuuggguuuucuguuguuguugauauuguuuuguggguuguuuguuuguuuguuuguuugggguuuuuuggcucuuugagauaggguuuucugugcacaaaccuaacuagaacccacacaaaacucugaaugugguaguaugcaucugucaucucaguacaccuaaagcaagauaggagauggagacaaaucacuuggaagcugacaggcugucuauucuguaauauacagugcaguagaaacaaggccuuuacaucaacaagggaagaagagaaaacagacgccuaaaaaguugucucugacuuucacacauguaugcauacauacacauaaaaaacaaauuuuaaaaacugagcugggaagauggcucagugaacaaagugauuauuguguaaguaaguauaccuaaguuuggaccaccagcacccacaugaaaaccagcaugaguauauguaucugcuucucaagugcuauaaaucugaaguaagaagaugccaacaguaaaaaugcaagcucuagguucaucgagagacccuuucuuuuaacaaaccaaaaaagguaaagggacucucuucccaagaccuacugcccacauuugauaguugagaugcacauuguggaagucggagaccuccucugacugacugccacacccaugccaugacaaaugcucaccacacacauaaacaagagugugcacacaugugcagaaacacuaauaaaacuaguuaauaaaacauuauaacuauuagauaggagaacaauagauguugccuaacaucaaccccuggccucccauagguaccuacaugggugaacacucuccuccccaccccaccccaguagaaaauuacgugacuuaacaguauugcuacuuuaaguugauuauuaaaauagauguagcacaaauacaaauagaacuaagguauuuuugaaauaaaguauguaauaaauuugucucucuacucaccuuucagggcuuguuuuaagaaauuaccucguauucugaguuucaauacuaugagauauacauuuaauauggucacgaugaugaaagagaaagugaauacacacuuuucuuucccuuuacguuuggauaugacgcccuauacagaagauuuucuaauggggaagagcgacaggaaagaagguaaguucauuuucucaggucucugucaacaaggaaauugcaugaauggagaaaaguuaaugcuacuuuucaacuacauggugcuaggaaucaaauaaaaucuuagugaaaguauuuuauaugugugcaugcucucucugcauauaugugcauguagcauauacuuacagugcccacaaaggccagaagagggcauuagauuccucucaacuggaguuacagaugguugugauccacgauuugguuguugggaauucaaccaggucuuguggaaaagcagguaguguucugcugagccgucuuuucauucuagaaaggaaaauauuuuuagagaaaauguaacauauuuacucacuuagcuaauauuuagacucuuuuuuuuccccugacaaauacaggaauaauaaauuuauuauaagaaucauaugacagacuagugcacauauaaaacggggaguuuauuuucaccagagugcuccccauugcugcccaguguggcgagugccaucugcagcauucugaaggaaacccacacgcuugguggugauacagagaauaagagaauaugguguugaggcuggugggucccagugacaguaucugccuaucuguuuguguaucucagcacugacagcccuucacccaagauuggcgcaggaaugucagggacagcccccugccccagcugguucuccuccucacaugacugaggaggcccauacauaaaguucuggcagagaaccugcagaugcccuauuggccuuucuuccaaacugaaaugugugcccuggauucagacauguuccugugacguguccauaugccuuaggaggcacggcugagccccaguuugacuggagaccuguguauauagugaggguuuccuauguccugcacauucuccacauaugaguacaauguauugcaacacagagaugcuuugaugaggcccugcguucucaugcugcugaguggucuuagacucuucaagaaccauggucuggguauuuuuucccagugauuauuuaugcccuuggaaaacugaggucgugguaagucuuacuauaaacuugaaauuguaauauauugucaaauacaaugauugucacaggucuugaggaauuaagacuuuugugagaaaguaauauuucagcugagauguggaguaagaccuuaagaggaaggaauacuauguucuugaguacgaggguagcagaaugauuaaugagacaaaaaugucauaauaguuuuuuugcuuuggaccauauuagcaauuuuguccuuugcuuauuauuuguuauuguuugacuguuagauugguuuguuuuguuuguuuuuuuuuuuuaagacaguguuucuguguguagcccugguuguccuggaacucaacucacucuguagacuaggcuguccucgaacucagaaucugccugcuucugccuucugaaugcugggaucaaaaguguagguuagaguuuuaauucgggaaguucuacaauaaaggcucuuaagaaggaaaagguuauuuucagauugggugaagaauaauggacagugugaagggugacuguucuuguaaaccacacugaagacggcgggacagcaauaggcagaacugauagaguuuucuucuguuuuggacacgggauuuugugcaugcuagcauucuaccaauacauccccagaccuuagaauucuuaauugggugaauaagugaauuauugaauugucccuuuguaguauagacuauucuuacagcaauagcaguaaaacagugacaaugccacacagcuuuugguuccccacacauuuuacuucaucacugcuuacuagagacaggaugagaagccaugaaaaauugauuuuuaacuugagcaauggugaagaggaguuugaaucagucuccacaaacaaacagucccaggaaaaggaggucuaaaauaauugguaggucuuugguuauguuuauuagagcaguuugauuuaaaaguagaagugggaaccagacaugguggugguacaaucuuuaaucucagcauucaggagggagaggcacagacaggcagagcucugaguuugaggccaggucuacaaaaugacuuucaggacagccagggcuucacagagaagaacugucuuggaaaaaaaaaaguugaaggaggacgccagauuuuagugaauuaaguaacaaugaccacuaaacucuuucaaguuaauuaguguguaucucaaggaccacaggguuuuuguguuuguuuuuuauguuuguuuuguucucguggaguuuuuuaguuuguucuuuguuuuguuuugauauuuuuguuuuguuuguuuguuaguauguuugagacagggucguacuguauauagcccuggcuacauuugcuguguagacuagguuggccuaaaacagauucaccugccucugccucccuagugcugggauuaaaggcaccauauccggcccagcacaggacucuuuaagugugugggagagagccuauaaaaauaggguuucucuguauaguccuggcuguguuggaacucacuuuguagaccaggcuggccucgaacucagaaauccgccuagcucugccucccaagugcugggauuaaaggcgugcaccaccaccgcccggcugcaaauaguuuuuauaugcauauuuuauauauaaaguuuuguuccuuuuucuguugauaaaauaccuuauaaaacauaaucuuaaagcgacauuguuacuacauguuuucaaaauggcugucguuaugucauguaaauuauuuuagguuucaaagauguuggugaucguucgaaagacacagagagcuaugaguaugacuugauuggagugacuguucacacaggaacagcagacggugggcacuauuacaguuucaucagagacauagucaauccacaugccuauaagaacaauaaguggugaguuuuuaguguuuuucuuuaaaaacauuucccagauuuaaagauauaaauuuaugguaguucuucggaugaauucuugauuucauggaaacuuucuaugaaguuaggcagaauauuaaauccuuuuuucuuuauauaugugucuugucuguauagguaggcagacagaucaguggaagucagacuuucuuucauguugguucagguugucauacuugauagcaguuaucugcugagccaucuuggugcuccacaaaaagaagcuuuuucauucaaggcaacuuucagacacaccagaagagggcaccggaucccaucacagaugguugugagccaccaugugguugcugggaauugaacucaggaccuuuggaagagcaaucagugcucuuaaccacugagccaucucuccagcccucaaggcaacuuucuuuuuuuuuuuuuuuuuuuuuauuuuuuuuauuuauuuauuuauuuauuauauguaaauacacuguagcugucuucagacacaccagaagagggagucagaucuuguuacggaugguugugagccaccaugugguugcugggauuugaacucuggaccuucggaagagcagucgggugcuccuacccacugagccaucucaccagcccucaaggcaacuuucaaacgaauagaagucaguucuuaaguuuauggaugggucuaaaauauugagaauauaugcguuucuuugaaagauuagcuuuuuguuaacaaucauaggaaauucacaggaaaaauuguuccuugcaaaucuuguucacucuuucaggagcuguuuacagaacaccuucuguugaguggcuacagagugcuugcuuugugugcuguguagaaguugccugcaucuauucuguuucuuuuccuuacuuuacuccuuccacauguuuuguuuugcuuuuuuuaaaugaagugaggaucagucacuugaggacagugacuguuuuuggucuucagaugucuauaggaaguacccuguauaaagggacuguacguaugauuagaccuucuuccaauuguuggaaauacugcuuuggacaaaacacacagcugcucucauugaucugcaugcaguuuuuagaauaguucuguuuagcucuugaucugauucuuucaggcaucauugcuaaaagugucccuuuuuaaaaauacgucaucccacuuuucuccuuccaaccucucccaugugcuuuuucaucuauuuggauuuauguccaugagaauauugaauugcucugcucacauuuuuuuuucauuuuuuauuagauauuuagcucauuuacauuucuaaugcuauaccaaaagucccccauacccacccacccccacuccccuacccacccacucccccuuuuuggcccuggcguuccccuguacuggggcauauaaaguuugcguguccaaugggccucucuuuccagugauggccgacuaggccaucuuuugauacauaugcagcuagagucaagagcuccaggguacugguuaguucauaauguuguuccaccuauaggguugcagaucccuuuagcuccuuggguacuuucucuagcuccuccauugggagcccugugauccauccauuagcugacugcucacauuuuuaaaugaugccuauaucauaucauguugcuuaaucuuucuucauuacuuuauauguuugauuuuaagcacacuuauuuuugguaauauccaguaauuauugacucuguaagauugugagagugcaugugcccuagggauagaucccagugucucacauaugugaagcaaauguucuauuauugagcuauaguccccaaaucagaugugcuagauuuuuaaagugguuuugauuguuaaaaauuacacucccaauucuagauuagaguuacaaaaacaagaaucuacugaaauuuaccuuaucaaauaauuugacuaggacacuuaagucuuuauuuuaaauaauaaauacuguguauauacagggauccccagugcacacgcguuugaucaguacugccugcucuauuguagguauuugaucaguacugccugcucuauuguagguaccuuuuuaaugaugcugaggugaagcccuuugauucugcucaacuugcuucugaaugcuuugguggugagaugaccguaaguuugauuuagaaacuuuaaaugguuuuugacuuucuagugaauuauaaauucagcaacauacucaacucauuacaccugcuaucaauucaaucuaauauuuguuuguuauauguuugauguauauacugggcacuaagaaauguuuaaaaguuguuauuucuaccuucaacugcauagauuuauuuuauuuauuuauuuauuuagguuauuuauuuauuuaggcuuuuuucgagacaggguuucucuuuauagcccugguuguccuggagcucacuuuguaaaccaggcuggccuggaacucagaaauccgccugccucugccucccgagugcuggaauuaaaggcgugcgccaccacguccggcuagauuuauuuuuaaaaugaugaaaaaaaguaaaccauaacauaaaaaucggauuacagaggaagaauaauuaugauuaaacauacugguuauucaaaaagucugugagcuugggaggcagaagcagguggauuucugaguucaaggccagccugguguacagagugaguuccaggacagccagggcuacacagagaaacccugucuuccccaccccaagacaacaacagaagucugugagauuagaacaaaaagaauuuacccuuuacugcaauaaucuguaaaaccuaguacaaggaaguugauuuccaauuuuuugaaacaauuguuuuuuuuacugcccagcaaccugggcuccaccaguuuuauaauaaaagaacaaugucuuuguuaagucacuggcuaguguuacuggagucuaccucagugguagugcaacugcuuaggacaugcgaggacuugggguuugaucuuaguucacuccugggccuggacaugacgacggacacauuucaucccaggcauagguauuugaguucagggccaaccugguuuaaacugaguuccagugagauccuauguacaaaaaaguacaauaaaauaaacaauaaaauguugacuuuucaaaggaaauauuaggaaucaguuucaauucauaaauaagccauaggauuuuuuaaaaaaaucaaaaccaugauuauuaugaaauaacuucguacauaggaucuuuuuaacaaaggcuuucuuucuuuuucuuuuuuuuuuuuuuuuaagauuuauuuuauguaugugaguacacuguugcugucuacagacacgccagaaaagggugucagaucccauuacagauggcugugagccgccaugugguugccaggaauugaauuugggaaccucuggaaaagcauucagugcucucaaccgcugggccaucucuccagcccaacaaaggcucucuuacuacuucuugucuaaaaucugagagcaauaauaugcuuauaauuuggaaauauguuagaaagagaacacuguuugaauaggauucuaugucuaaaacagacacaucucuagauguuauaucaauuuaugcauacuacaaaaggcugauucccuuuaaaauuucuuuuuauuucuugugucacauacaccuccaguuguccagacccuucccuacgcacuuagagguagccuuaaugcucucagaagcccugcaguguccucugcaaauauuucauguacagcugucuuuauuuuacagggcuagcuauccucucuuugucucauaguccaucuuggccuucuccagucuguuuccuaagcugucccugucucucuucuguuuuucacuguugcuuuuuuuuuuuuuucagucucugcugugguauuucuuguccagucccuuugguugacuaaugccucaaagccuccuuuuuuuucugucagucaugaguugcauucuucguguauauacugacaugucuauuuuaucugcaaaaacuuagaguuuucagacucggauuugauuuuuaaagauugagguacaucaauaaguauccugggaauuuuuuuuuuuugaccuggaucauuuuauuuaguuuugagagacuaggcaguaggcaaacuauaauucuuggcagcuagcugcaagaagaaagguccagaugacagaaagucaugccuuuugaauuagggucagcaguagggagaugcuguuuagaggaaacagggcagggcaaacauucuuaacauuuuggcuaauauccaaagucuagauaccauggagaaaaugcauucuuuuaugucaaaagacauauuuaugaauuacuuuagcuaucuuaucuauauuguuguuuaauauauacauacuugauuuguauuuuuauuuaaccauauucagaaaaauuugacccauaccaacugucuucuugccauuuucuuauuuguuuuguuuuguuuuucuucuuguuaauuuuuuuuucacaauuuuauaguguucagcaucuuaaaagauuugcacaaugaugcuaggauauauuagcuaaauuuaugaaguauauaggacuuuguuagaacaggugcugugccccaauaacuuuuguauaugcuggguaaacacccuuuuuuuuuugguuuugguuuuguuguuuuuguuguuguuguuguuguuuugagacaggguuucucuguguagcccuggcuguccuggaacuuacucuagaccaggcuggucuccaacucagaaauccaccugccucugccucccaagugcugaguuuaaaggcgugugccaccacuggccagcuuacuggguaaacacuuuuuuaauacugugauauaccuguacugaacuuggguccucuguuuuguuacuguugcaugcgugcgcgagcguguacguguauacacaugcacauguguacuacugagcaucaaaugggccuuauacauauuaggaaggaagugcucuuccacugaacuacauucccuauacaucuauauaggaauguacugguauuuugaaguuauuuacaagguugcuuugaaguuuuacauaaguguuuuaugaauugauguuuguacuuuuuuuuuucccuacagacaaaaaccuaugauucgguuacagauaaauucauggacuuuuccuuugaaaaggugauaauucuuuucauauguaauaauuuaacaaucuucuauauuauuuaauuuuauauuauacuuugucaaaaauuaaaauacguuucuccuugcuucauaaagacacauagugcauauaugcuguuuuacaaacgcauggaaccagaagaagaaaauggcagagaauacaaauuugauguuucaucagaguuacuagagguaaacauuacuuugauuuuaacaguaguuuaaauugcauuagguguuugugcaagaaauacuucaguauaaaagcagucccaauuagaucuuagcauacuuagaaaaaaaugauaacaauacugucccucaauaagugagugaaauacaugugagguauuaggacgugcuucagcagggaagaguacuugcuugcugcuuuuucaggcacaugcgugcgcaugugcaccugugaacacauacacacucauacacacacauauacacaccugccccucaaauucuguaaacaaaauagugcuuauagauauauuuaguaauuaaaugaagauauauuguugugauguagagugacuagaggaagaaaagccgaacaugagguuaaacaaucagagcagauuugaaaauacaguauaguaguuuaacauuuaaauauacauccaguuuauuuuaaaguaccaaaagaccuguaugagaaacaagcugaccuacucuggaaauagaacuacaagcauugacucuacuaugagacauacuaugcuuaggucuaaagcaaagacuagagccugggucucacuagauaaccagaaauacaagugaaucuagaaauaagaccacgacugaagguaagguuugggagagggcuaagcugaaugcucuaaugccuuuuuaguauuguagacaucaauggucuagaaauaaaaacagugaagcacuaggcauuuagggacuaagccuguaauuucccagcuacccugaaauacaccuuaauacagcagacuagaaaggcaaguuagcgguaguugaauacuuuuaauggagacuagaagugguccuaucaguugcaaaugaacacacuuacugccuagaacacuaagugugugcagaggacugcugugauuuuaaggcugcuuacagugucagcucuucuuuuaaaaguaaaagaaaggaaacauuuuuuccauuuugaaaucuuaaauuucaaaauguuuggcuagucaaauuagcaauggcaauauuucaaguuuguuuuuauaauuuagugaguuuagggaacauguuuaugauacucaaggcacccacuaccaaaagauaauauaugacaaaggcuggaagcaugguuugcguuuucuaaggaauaacgggacagaaaaauagcagcauuguuuuacuugaguucaaaaaaguguuuguuuagggucuaauugaaaucaucacaaaauuuuuauuuccaaauuuuaaauucugucuucaucaaaauauagcaugacuuuucuuaugcucuuuagacaugauuucagagcuuauacuucaaaaucuuuaugaaaaauguuaaaugcuugugacuacugagguauuugagauaaauaaccaauuuuaaagggcagguuguggggcugaagcaugacuaagugguugagagcaugugcugcucuuacagaagaccuggguuggcugucugcacccuuuugguagcucacagcccccaguaacucuacuugguaagaguuccaacccuucuucuguccuccagagacaggacgugcacuacuguuauacauauguguauacagguacacucauacucaucaaauaaaaacuguuuuuuuaaaaaggggguggaguuaggagccaccuuucuuuucagauuaauauauauuuuuaaauuucacgugugugcuuugccugcauuugugugucuggugccauggaggucagaaggccauauuggcuucguggaacuugauuuguggaugcuuaugagccaguagguaggaguugaaaacugaaccaguuccucacaagaauagcaagugcucuuaauggcugagccaugucucaaacucuaguaacuacuuuuauauuaauuauauuuggaagaaaaaaaaucaacaugaauuuuaaugcauauauuuugauuugguaaauuuguaaguuuuuaggcuauaccuuuucuugucaaaaaaaaaaguauugguaaaauauauuaaacugcuuucugauaaaugccaacauuuuuuuuucuccaguggauuuggcaugauaacaugcaauuuuuacaagacaaaaacauuuuugaacacacuuauuuuggguaaguuugguauuuuuaguauuuuuuuuucuuuucccuuaagucuuguguaagaauuuaaugaacucuuuuuaaauuccagguuuauguggcagcugugcaguuguauuccaaguacauuaccagauccuaaagcugugucccucaugacagcaaaggugaugaugagcucggauagcuuugucagauuuauugcuauacaauaauugagucuuucaugcuuaauuguaucuuuuuuuuuuaacaguuaaguacuuccuuuguuuuagagacauucauucauucaaaagagaagguauguguguuuuuccuauagauuuauaugccaucaucaucaucaacaucauuuuaauuauguuuagguguuguuaucauugacauaaaguccauaucuugaauauuuuuuauuuuccuuuuuaagccaacaaugcuucaguggauugaacuacugaccaaacaauuuaauaauagucaagcagccugugagguaagguuacaaccaacauugcacagcuuaaaauucucuaauucgaaggcuguuuuuuuuggggggggguuguuuuuguuuuuuaauuaaaugaagccaaaaaaauguuuuuaucuguuaugaaucucauguaaguuguuccuaauauuuguucacuuagaaaguuacagcuuauauuucaaaccuguuauaaagauuaaguuaauacuuaauucauuucauaaucuuugaccugcccucuaguguuacacaaguauaaaaacaaauuucaguuucgaugucauccuguagaacuauaauccauguacacaggugggagaaacagaaaaaucaugagucaagggcagucugggauggagauggggacacacacacacacacacacacacacacacacacacacacagagagagagaaugaauaugaaugaaugaauauauuagaguaagguagaggucaagguuagccugaguugugcagugagaccuggccuugcaauggaggucagugauaguucuucacauacauucauagauccccuccccucccuucccccccaccccccuccccuccucuccccuccucucccuccuccucugcccuuucagucuucaguacugggauuacaggugugcagcaccaugccuaacuaaugcuuguauuuuaaaucuagggcuaaacucccauccucggauacuucuuuacccuuuuucuuauuauuuugauuugaacuaaagguaaucaucuugucuccaguuugugaaugcuggaauuacaggugugcaccaccauacccagcucuuaacuaauuuuuauuugcauauaaagaaaauacacuuaggagcuagcaagaagucuaauggcacuuggugcacaagccucaaggccugaauucaaucccuagagaucauuuaaugaugggagaagucaguugucuuuugagccuaucugucccacaugucugaacauauauuccauacacacauauauacagaaugguaacacacauaccaaauuuuauuuuuugaauggggaggggauagcccuggcuauccuggaacgcacucuguagaccaggcuggccucgaacucagaaauuggccugccucugccucccaagugcugggauuaaaggcgugcgccaccacugcccagucuuacacgugagacuuuuuaaaaggcucauauguauccugguagaucgauuuaugcccacuuuuauuuccuccuuguuauaagaaaacugucccuauagauaauuuacuaauggguaaugacaacugaaguacuaucuuaaaauaaucauugauuaaaaacaaaaagguauaauucuuccuaguaaugcaagauuuuggauuuuuuuuaagacagggaacaugguggcacaguggcuaaaagaugaaauuagaguuuuugcucucuuauauccuguaauuuuagcuuguggcauuguaaaaagaaaauccguucaguagaaguugcauaaaauuuuuaaguaacaugggaaaaagccaaagugaaauguugcuuugcuugcuacacagcuuccacaaagagaaauauucaguuccuaagcucuggcucuggcuuucagagcauacuaagaaauaccaugugguuugguuugguuugguuuugguguuuugagacaggguuucucugugucguccuggcucucuuugacuuauuagcauagaucagcauggcccugagcgcagcgaccugccggccucugcugcugccucucaggugcagggauuaaggauggcugcuucauaguuuuaauaauaaauauucaggauauauguuuuaccgaugagaacuuuaaaaaauuguaaccacaguuaaguuucuacaaauaaaauuaagcagugugguuaguguucucuguugccaacaagcuguuuucaguugguuugaaugucuguuuggacaaggucuacuuuuugcauuuaaguuucucuauauugucauaguuuauuucugucuccaugccacuuucuguuccuuuaaguaccucagauugucuucuuguacaguaaugggguuaugucucugggugauguccuauaaugaagauuuaagauuuuuguagcaauuagacaagccauuuuagucaaaugaagcgaaaguaauggaaguaaaaaguaaauauccuuaucucuggcucaucucauuuaacuuaagaaguauuguuugaauauuaaauuauguucuauuuucuuacagugguuuuuagaccgcauggcugaugaugacugguggccaaugcagauacuaauuaagugucccaaucagauugugagacagguaagaaaagauuucugaaaagagaaggggcuuucacuauauuuuaaauuggccuauaaauggcauugaaaauaauuugcaaagcucugucuccuaucugucuccuuuguuuuugucagcucuuuuaacacaacugccaguaugaagugacgggaacuguuuuucauuauaaaauaaauaaaaccagauguuauugcugguucauuucuuguccuuauagagucuaccuugaguauuguaauacagcauuacacguauaggguaaauucuuucuugugccaaauggauccauuuguuuuccuuaaauuagaaaaguuauccagggacuguuuaaacauuauuuaaaagucauguuucauauaucaaaaauuuaaucugagguagagagauggcucagugguuaagagcacugacugcucuuccagagguccugaguucaauucccagcaccuacaugguggcucacgaccaucuguaauggcacccagugcccucuuuuggugugucgaaagacagugacaucauacucauaugcauaaagcaaauaaauaaaucuuuaaaaaaacaaccaccuuaaucuggguuaugccacuuacaaguuguuauugaaggacaauucucuuguuggggguauuaucaauauucuacauagagaaacuuuucuaaaugagccuuuuagcaagcauaguauauucacagaaucaauagccacuguguaaucuugagacauccauuaccuccuaaagagucucuagugguuuucccuauguuagccucuuaacugcuauucugcucuucaucucuauggauuguuguguucuuaacauuuguauugugucauggugaucucuuuugugaauggcuucuuugacuuaauccuuuaagauuuguccauguuagagguaugucuggaacuggauauggugucuuaugccucuaauccugaccuucaggagacguagggaggaaccaucaguuugagagcagcuugggcuaaaacagugagaccuguucuuaacaaacaggacaauggaauaacccguucauacuuuauuucucccuccccucccccucccccagcuaauacucuauugacuagauuaaaacauuuuauugauucacuaguugaacauuugagguuucuaguuuuccuuuacugaagcagagucugacuguauaacuacccuuccuggaacucacuagguaaauaaaccaggcuggcuugguacuugagcaguccuccugucucagacuacagaacaccaguguugugguguguggcccuccauccggcuuuauuucuacuuucugacuguuuggaugcagauauggccaccugcccauaagauuuuguucugaucucuauuuuaauuuuguuuugguauauauuuaaaaggggaauuugguauauauuuaaaacagguuguauagucauuuuuguauuuaaaauuuucauucuaccagagucugcagcaccacauuucucuuaauauauguggguuucaguuucauuauaucuucuccaacacauauguaccaacugaggagguuucguaggauuuagaguuugauaucuauguuacugaaaccaguaguuugaguuuccucucuuagcauaaagcugaauuuuuaaaaauaauuuucuacggcuggggauuauacucaagaccuucgugcaugcugaaguucacgccauuguugaucuaugucccuggcuggugcuuuuuuuuguuuuguuuuuuugguuuuuugguuuuuuuuuuuuuuuuuuuuucgagacaggguuucucuguguagcccuggcuguccuggaacucacuuuguagaccaggcuggccucgaacucagaggccugccucucugccucccgagugcugggauuaaaggugugcgccacuacgccuggcgacugacugauacuuuuuaaauagggucuuaacucuauuugaauacaucccagaauugcuucaacugugguccgcaugucccugcuuccuguguacuacacuguguguguacuacacuguguguguacuauacuguguguguacuauacuguguacuacacuguguguguacuauacuguguguguacuauacugugugugugcuauacugugugugugcuauacuguguguguacuauacuguguguguacuauacugugugugugcuauacuguguguguacuauacuguguguguacuacacuguguguguacuauacugugugugugcuauacuguguguguacuauacuguguacuauacuguguguguacuauacuguguguguacuauacuguguguguacuacacuguguguguacuauacuguguacugcacugugugugugcuauacuguguguguacuauacuguguguguacuacacuguguguguauuauacacuacacuguguguguacuacacuguguguguacuauacuguguguguacuauacuguguacugcacugugugugugcuauacuguguguguacuauacuguguguguacuacacuguguguguacuauacugugugugugcuauacuguguguguacuacacugugugugugcuacacuguguguguacuacacugugugugugcuauacuguguacuacacugugugugugccauacaccucuacaucugcuaugucuguuacugacugugaguuucuccuuuuaaagauguuccagcguuuauguauccaugugauucagagacugagaccugugcacgcucaucucuaucuacaaccaggaauggaagauggguaagaagagcuuuacaaccaagucuucugaaguaucuaugaguagauauuuagaauauaaaaauuagucucuaauaagauaugucucaagaaaggaagacuuuuuaaauuuuuaacuaagugcaucuuuaagauauugaaccaacuaacuuuuuguuuggauugauuuaguuccaguaaugagaggauaacuacuuacauuauugaaauugguauuuguuuuacagaauuaaaggauuggauuuuuaaaaauuguucuaguauguuggcauacaccuuuaaucccaagccaucuagggccacacagccagacucugucacaaaauaaauaaauaaacaaacaaacaaacaaaaaccaaaaaaacaguuuucauacaagacaauauaugucugcauauuuauuguguucucugagguauauuuguuuuuauuuucaggucagaugauauggaugccucaguagaagauauugguggucguucaugugugacucgauuuguuagaacacuguuguuaauuauggaacacgguguaaaaccucacagcaaacaucuuacugaguauuuugcuuuccuuuacgaauuugccaaaaugggugaagaagagguaaggcuaauucuuguuugcuuguuuuuaguuuugaauuauaaacccuuuuaagauuuccaauuuguuuuuuauuuaaaauuuuaacuugcuuguuuuuuagagccaguuucugcuuucauugcaagccauaucuacaaugguacauuucuauaugggaaccaaaggaccugaaaauguaaguccaguuguguccuguaucagugcaguagggccauucuucuaaugguucacaucauguagaaucaugacaaguccuagaaacuuaaagucccuuuuucuuuuuguauuugguagcauuaaggguccuagauuuguuggucuguuauuauaguguauauauagaguaguaaaucaaauuaaguguuaaguuguuucauuggaaagucugaaacaaagcagacuuuguuuucauacuaguagccacagcuuaacuacagggucugcaaaggaauguguuguuucaauuugugguuuggauugucacauuuuaaaguuuuuuuuagagucucugaacauuucuguaguuaauaaauuuaauaauauuuuaacauauagauggauuuagagugugcaaguacauuucaugaucugugugcaacauuucauucaacccugcucauaucccugagaaguauaguuuuuauguuuauaauacagaugaagcagcugaaacuuagagaaguucacuuguuuuagaucauugaaacucgagacuacugauugaaaacugucucuuaaauuugaguugguuuuaaucuaauuccauccuauguagcuguuggguuaacaacagugauagcugaugcuguuucucuccucucccugccuauguucuuuccuccuuucauugagacagaaucuuauguauucuagacuaaacucaaacuuaauaaucucuugccuuagccaauugaguaccaccauuccuaacagucucuugaguuucagagcccauaagaguaucuuugaaaauaacuacuuaaauuaucuagauuacaaauuaagaugucuuuuguggggcuggagaaauggcucagggguuguccugaguucaauuccuaccaaccacaugguggcucacaaccaucuguaaugagaucuggaguaucuaaagacaguuacaguguacuuauauauaauaaauaaauauuuuuuuaaaaaagaugucuuuaguaugugcaacugacauuuuuacucacaggaaauaguuuuaucauaauuuuuucaucucaauuauccaaagagcuugauuccaguaaaacaaaaguuauuaaagggucugucuuagaguucuacugcuaugaauagauaccaugaccaaaccaacucuacaagaacaacauuuaauuggggcuggcuuacagguuaagagauucaguucauuaucaucaaggugggagcauggcagcauccaggcagugguagcacuggaguagcuaagaguucuacuucaucugaaggcugcuaggagaagacuggcuuccaggaagucaggacaagggucuuauagcccacacccacaguaacacaccuacuccaacaaggccacaucucccuauagugccacuccccaggccaagcauauacaaaccaucacagggucuaucuaacauaaauacuuuugagaacuauugcuuugcauaguccuccugcuuaccuaacacuguccugauugucauccaggcaguaucagguuaaggucuaaccuuugagugauuuuacuuaguacauacuccugccauguuuuucugauaguuauacuaaaacaagucagcuguuuucguuaugcuauuagaacuaaucacacauuaaaauugaauuuuguucugauuagccucaaguugaaguauugucagaggaagaaggggaagaagaggaggaagaagaagacauccucucucuggcagaagaaaaauacagaccugcugcccuugaaaagaugauagcuuuaguugcucuuuugguugaacagucucgcucagaaaggugaaauguuucaacauucaaaaugcuuacagcguguuuggcuuuauuuuuuauacauaauuguucuaucacuauucguuuuuauuacauaaaucuuuuaaaauaauaauuuugcuucaacucuuguggcucacgaauuucaguccuuucuauauaacucgucugagucgugcuagaagcaauuauugaagaaaucuaaguaaaauaucuggcaaaauuaaauggacauucauucuuuaccccagcaacuauacuuccagggauuugcccccaaaacagaaagauauuuauggggagguaauuauuaaaauaccauuucuaguaucuaaaaguuggagacagccaaauguucuucagaaggggacuagucauugacaaauuaaggaacccauucaguccccaguaguuguguguuugccuguuuguuugguugguugguugguuuuuguuuuuuggguuauuuuuguuuguuugguugguuuuuuuuuuuuaugaaauguggaauucaucuguguuaccauauagaaaucuuuauuauacacacacauccucucuuuuccucuucuccuuucaaaagacaagguagagaagauuauauauauuugcaacuuuuaggcaaagggaaguuaagaaagagaauguauguguguauagccaauccucaucaugaguuuccugcuuacaaagucacacacuugcucaauuuaucuguaaugcuagaaagucaaucccugaggagcuuucacaguuacuaucugcagacacguauauauucagaauggugaaaaauuggaguuuccuggcaccugcuuucccagcugaggucaaacaaggcagugugaucugcugucuuguguugcuuuucauguuguaaacaaauguacuuuuuaugauguaugccacauuuaaaaaauauuugugcuuuuccuuugguuaugucacuguuuaaaugguuccuaagaauaguacuaaagugcuauuuaguguugcugagcuuaaggaaggcugugauguccuucagagugggaaugaauauaguagauacauuucauucaggcaugaguuucaaugcuguuuggcuguaaguucaauuuuaauuaaucauagauauuaacuaagguguuauuaagcagaaucaccuguaaaauaugguaauguauuauuacucagcugauaaauaugugucaacauguccacagggaccuaauucuuuguuuuauuuccauaccaaugaugauuugguuuuugguaauucauuguaccauuuuauagaaugugacuacucaaauaucaagaauucgcuauaaaucaaaucaucaguuaguauggucuugagagaacaaggugaaaggcacagaaauggaggcuugauaaaaccaaauguuuuuguuuuguagcuuuaguuuugaauccuguaaauguuuuguauaauuuauauaagaagcaguauuuuaaagucaaaguggaggugauacaguaucgcagaggaauuaaagaacauguuaacugucaguuuucaacaggauguacauaaaggagaagacguaauugcaaaauauuuuaagcugucuuaauaaucguguuguuauuaauauaauuagaauuauucuggaaguauuauguguucagguacugggcaagaagugaguaagauucuuggaauggucuuauuuauuuauuuauuuuguuuuugagaagcauggagacuaaacagacuauucugggguucauguuuaaaggacucaacaguguacuguaggaguuucuguugcuuuuguguuggacaagguacacaucaaaauuaagaauaacugugcuggaauguaaaacacaucaagaugcuuacauugauaaucccagaaugguaccagaaaagaaaacuugaaaaacuuguuggcaacguuugaaauauacugagacaugaaaucuuucuuuugaaaacugauaaaaggaaaugguguaaaggauauguuuaucuuacugcaaaaaauaaacguucaugucaacugaguggcgaaugauacaucgauaacagauguuucaacuaauaaaugagcaaggaguguuggaauuagaaaaaucacuauuuugugacccuaaaugagauaaugcuuccaaggucaucacggguggaaccccuucuuuauguguuucccugaggaaaguccacaucacagccuacaaaauaucccugauuaaaaagugaagccuaaaucugaucaagucuuuagaucugucuacuauuuuacaggaacagaggaaugugcuaaaacaucaccaucaggauucacuuagcaaaccauaaauauuggaauugcuacaggacaaacaagcugcuuucuucaaaggauaaauugcaguaaaguuccaagggaacccaguagauuaaacauuuuaaagacauuaaaagcaauuguaacaacagacuuugauucagguccagacugaaacaaauuaacuauaaaguuuuuuagacaguuuaggaaauguguacaccuaauaauacaagguagaaaagauuggcuacguuaggcgugaauaaugguauugcgguuacauuuuuuugaaauuuaccugagaugauguauugagauuuauggauuaaaugguaaaaacaaccaaacaccuggaauuugccucagcauaauguauauugaaugacuggugguaaaagugaaauaggauugcuucaggggaauuugaacuugagugauagaauacuugacauucccuuauuuuuuaaaaaauauaccugaauuuuuauauagguuaaacauacuuccuuuaaauuauacaguaaaacuaauauuucuuagaauuucagaaaaaauagcugucaaaauaaaauaacacccauuuuagcauuuuaauauauuaauuuuauugauuuaaugaaauagaaauaagguaaacucaguguuccauggugcagucuuggaaaauugccuaagaugcuuaguaagaaaaucuagcaaucaaacacuucuccuguccccaaauuuuaugguggcagguugauaugguuauaauagacuugacagguuucaugcaugucaugcuguuaauagcuaaaagcuaguccacaugggaaagauuuauuuccacuaauauuuucuuuuaggcauuugacauugucacagacugacauggcugcauuaacaggaggaaagguaauaccuuuacuaagauuaaacaauucagucauucuaaaaaugauauaguaguucucaaacgaacaacuuguguuuuuaacagggauuucccuucuuauuucaacacauucgugauggcaucaauauaagacaaacuuguaaucuaauuuuuagccugugucgguacaacaaucgacuugcagaacauguaaguacugaaaggagucuucaacuuuuuuaaauguuuuaaaaauaguauucuaaaauccuacuuuuucuguuucagauuguaucuaugcuuuucacuucaauagcaaaguugacaccugagguauguaaggguuugcuaauagguauauaauuuuaacuaacaguuaauucucccuuuauugcaaauauaguuuuccaacuuaauaugaauacauacauauaaauucuauauaucagagugcuacuucuauaccauacuucaguguuuacagcauguaucauaaacucuccagaguuugguguauuuggagugguaauggaagguggagcacagugucaugcaugucugauuuagguagaaaccauuucacaaucccaggauucaggaggcagacaaaggccagucugguuuacauagugaauuucaggagagccggggcuauguagagagacacuaucuuauccuccaugccaaagaaagaaaaggucauuuuucauaaaacagaagcaucuuuaguacauuuuuaaaaaaucaaaguaagugauuuggggguucagagauugcaaaagaaauaauacaaaguuuucaauagaacauacuuguuuuauugccauaauuuacugaauuuuuucuauuagacaggaaaaaugaauuccagauauugcuuuuauagcauucaacuguagugaauaacauacuguguacuugagaaaugcuaugggaauagauaguauuuuuauuacaaaacaagauaaauaaaugagauagcacauguuaauuagcuauauuuagccaucgaaugcagagagacggauucaaaauauaaagaacauuuaauugucaauuuauaaacaaaagccuugaauuacuuuuuugcuaaguacaaaugacauccaaaaaaaguauucaguguugcuucuguguaauugguuguauguucuaacugaucuguuaacaguuuugugguaguucaaguuuauagguaggagugcuaucuaagcuaugccaucucagauuuaaagcagagcagauuuaaaugaggcuaauagaggugugucucaauaaagauaccuguguuuuacaggcagccaauccuuucuuuaaauuguugaccauguuaauggaauuugcuggugggccuccaggaaugccucccuuugcaucuuacauucugcagaggauaugggaggugagucuugaaguacauguuuccaauauugccaggauuuaccuuuguuucucucucucucucucucucucucucucucucucucucucucucucuguuuuucuuccuuuuuuaaauuaaggauaauuuuacuuacaacaaaacaaaauacagcaaaauugaguggaagguucagauaccucccaccgaccccuauccucauggaguuuguuuuuuuauacuguuuccaccaucuuagauuucucuucuuacuugaaucaguggcuucaaacaguaggaaguuguccuaaagaguaauuuuccucaaggaaaauuccauaaagcaacuagaaucccuagaaauaaaaaccagguguuuuuagcaguugacaaagauaguagaagaaacaccaaaaccacuuguucuagagucauuucugugcuaacagauuuuuugugaugauuagaaaagcucaaggccugggcuaaggaaacuuuuugccaaagggccaaaugccaucacacguucugucugaaacaguucaccugugcuguuguaaccuaaugaccgaccauucaugggcaauaaauaauaagcuuguccagaucaaaugacagaguuuggccuacaguccaaagaucaccaaccacuacccucccaugaaaagaaucuucauagcaauccauuuacauucucauguaauaguauuaguuuggacauagaauaaggaaaagacagauggagaaacucuagaaaauuaaaaggguuuucucuguaaaauaaaauucagaauuuaguuaugcuauucaaguguucucucacagagccauaucaccaaccaagguauguuuaaguaaaucaauagucucagaaguccacuggaaucuuguuuucgucugcacuauuuuaaauuuuguaaacuagcaacagauuuuuuuuucugagcuuuucuuacuacuuacaaguaaauauauucaguauaguaggaaaacauggguaaaacuuuugugaagauucuaguuuaaaggaaaagaaaaaauauggucuggagaaauagcccaagagcauuuuauuuuuggagaggacccagguucaaaucccagcaccuaugcacccacauggcagcuuacagccacucauauaacuguaguuucaggggagcugacacccucuucuaacuuccucuggaacgggcacacauguggaacacauuuaugaauguagcaaauauacaaauaaaaucaauaaggaaaaaguuaacuaaauaaauacuuaguggcauauaccaaaagaaaguaaauuaaauucucauucaguuugcugcaugucauauuuuugucauuucauuuauagguuauugaauacaauccuucucagugucuggacugguuggcagugcagacaccccgaaauaagcuggcacacagcuggguccuccagaauauggaaaauuggguggagcgguuucuuuuggcucacaauuauccuagagucaggacuuguaagucaaauguuuaaaauuuagcuaauuauuuauuguucaaauuuuuaggauuguuuuacuguuuguugguucgauuuuuaggguuuugggagagugggggguaacccaaugauaaugccuguuauuauguaaagcucgaaguggugucauaaaagacccaggugugugugugugugugugugugugugugugugugugugugugugugugugugugcgcgcgcgcgcgcuuuaauacuuguaaaucuugacacugaguaucuaugguauuuugugugugugugugugugugugugugugugcgcgcgcgcgcacuuuaauacuuguaaaucuugacacugaguaucuaugguauuuuguguuuuguuuuugaguguuacuaaagaaaguaaaagaugagaaacuuuucuuaaaaguaacucuugauucuaggauagccaaagcuacagaguaagaucuugucuugaaaaauaaacgauaaaauuaacucuuuaagaauguuaagaucaaaagaguaauuaagacagaaaucauggauauaauuaugagaguuaaguaaucaucuuuugugauuaauccauuggagaaagaacugacaggguuuuugguuugguuugguuugguuugguuugguuugguuugguuugguuugguuugguuuugguuuuucgagacaggguuucucuguguagcccuggcuguccuggaacucacucuguagaucaggcuggccucgaacuaagaaauccaccugccucugccucccaagugcugggauuaaaggugugcaccaccacugcccagcacgagccaauacucuuagaagacaauugcaaauauagaaaacagacauuauaugagacaggaaauuguuaguaaacauaauguauuuacuuuuucauaguucaaacaaaugaaaaucaaaauuaauuuuuagaaugucuucagucagcaacaugcuguuuuucugcugagagguuuaccucagugacaaacacaacuaguguacauauauuguuucuaaacaucauuucucaauacagauugaugguucugugagaaaagacagauuuuaaggacaggcaauaaucagaauaaacuggugcuuuaaggaucagugcagugccuuaaagugaagaaauacucaauacacuaaaugauguggcugugucagagguacacaguugggaaagccuaagcaauuuccguaacacguaaauaauacucugugucuuaccccagagugcauuggcauuacuccucugcccaggaucuugcuucccccauacacauuuuauuaaccccacaaucccuuugaguuuuuuagccagauguuacacugauguucacgauaguacuguggaaaugacauaacaauacuguaauguuacucucacaaaagggcauggccguuuguuccaagauauuuuuuaaaaauaugcucccucccucuaauguuuguaugccauuucaguauuugcauguaagucuuuuauccauuaucuagugacauuacuuuaacuuguucauugaagauucugacauggguggauguaccuguaguccuuuaaucucagugacaggggcagaauuagucuuaaaauaccaguugagcagcuuagcaaauaucauggcucauaacaaaaacaaaaauccuuuggugagaaagcaauuuguuaguuaccauuuaaauaguuuuaucauuuaaaguguuuuaauauuagggucuaaauauuugaaaaguuugaauauauuuuaaaguaacaauucauauaacagaaaugaaaaacuaaaggacuuauaaaaacuauaaaauaacaaacagcugaauuuuauaaaacaaaaauugacagccaggcgugguggcgcacaccuuuaaucccagcacucgggaggcagaggcaggcggauuucugaguuccaggccauccuggucuacaaagugagcuccaggacagccagggcuauacagagaaacccugucucgaaaaaaccaaaaaacaaacaaaaaacaaaaauugacuuaccaaauauuaaaauaguuaaggacuugggcauggcauggagggacacacugucaguaucaaccuuugggaaucagaggcaggcagaggucuaaauucaaggaaacccugauuacauagugauuucaggccagccagaacuccauagugagauccugucucaaaauaaaacaccacauguugcucacaaccaucuaaaaaugguaucuggugaccucuucuggcaugcagacagggcacucauacauaauauauauaaauaaaaaaaauuuuuuuaauuagauauauuuuagccagcugugguagugcacaccuuuaaucucaccacuugagaagcagaggcaggugaaucucuaaguuugaagccagucuggucuacacaaugaguuccagagcugccagggauacauggagaaacccucucaaaaagcagaaaacuaacugcucgugcccacccaccaaaauucagaggcuuauuguguagcaguagaaguagauuucuuccaaguuucauaguauaaaacaagaccugguaucaagcccaguuuuuagcuaaugaacucaccuaauaaguuacuaguagcagacuaguaauaacaagcuuaauggcaugcaaaaggcagacucucuuagaauagcuuuagaagauuuggggguggggagcaaggaagaagggcaaacaaagcaguuccccaaagcagacaagaaucuugagugaguugccuuagacuuuuaaaaggcuucuagcuaguagugccuuuaaucccagaacuugaugucccauggggagaucagaaacagccugggcuacacauggcaacauaucuccuuccaaaaaggaaggggacucucaaaaauuacauauucuguuggugauauauucguauuuguauuuuugucuucauaacuuguguauguuauauggcccuaucuuuuaauuacuacaaaauaauaaacuguuuuaaaaugauguuuuaaaguaauaccuaacugaaaagaccuaaacaauuaaaggacucagugcuaucaagugcuuguugguaggccuuuuuauucuaaauguuauuuuucucuuuauugacucauacuguuucuucagaaaaauuaaauucugaggugggaaaauucuacauuguggaaaacugaacaucauaggcuugaaaacucguggugauaccuagugcuugggaggagagaauuagaaagaguucaaggcuagcuaguguagcaguuucuguaauugugauuauuguugccacuuaaauacagcaaugguagaauggaaaguucuaccccuacuccccuuugggaaucuuucuuuuggacaaaagguaaaucagagggauauguaaaagaugucaugucccuuaauuuuuauucauuuuuauuaauaaagggaagagugguuuuguguuuaauaacugcucuucagucuacuaaaaucguucaaggaucugacaguuuuguuuuacauuuuauagcugcagcuuaucuucuggugucccuuauaccaagcaauucauuccgccagauguuccggucaacaaggucuuugcacaucccaacccgugaccuuccacucaguccagacacaacaguaguccuacaucaggucuacaacgugcuccuugguuugcucucaagagccaaacuuuauguugaugcugcuguucauggcacuacaaagcuagugcccuaucugagcuuuaugacuuacuguuuaauuuccaaaacugagaagcugauguuuuccacauauuucauggauuuguggaaccuuuuccagccuaaacuuucugagccagcaauagcuacaaaucacaauaaacaggcuuugcuuucauuuugguacaaugugugugcugacuguccagagaauauccgccuuauuguucagaacccagugguaaccaagaacauugccuucaauuacauccuugcugaccaugaugaucaggauguggugcuuuuuaaccgcgggaugcugccugccuacuauggcauucugaggcucugcugugagcaaucaccugcauuuacucgacagcuagcuucucaucagaacauccagugggccuuuaagaaucuuacaccacaugccagccaguacccuggaguaaguacaguuuacacuuuuaauaucuguuuccuguauuugguuagcaauauauuuucuuuauuaagaaauggcaaaauguagaauagucuuuucaucuuuaaucauucaccuguuuugucuuccgugcugggagugggacccaggcucacauccaugcuaggcaugcgcuuggcaacugagcuacauuccaccccccucuucguuuuuuauuucuaaauauuuuccuuuaaaauuuuauguguguggguguuuggucugugcaacacauguaauccugauauccacugaggucagagagggcagaauuuccugguacaggaguuguagaugaucacaagcugccauggggaugcugggggucaaaccuagugcccuaaccucugccgucuccccagacccaucuccgucguuuauaaggauuuaaaauguuugcuuucuuagauacccucauauaaugcguuauguaaucuacaaaauaagugauuauauuuucuuaugcugauguuaaaauuuuguuaccagugguacauacaauauauuguuuucuuguuuuaacuuuuguuucgcaaugcuggggaacauacccagggccuuggccaugcuaagcaaauacugccaacccaaauuccuguucuguaaaugcauuucuaauguauaccuacugaaaacaucaauacagcuuuauggaguauuauuuuauaauuggguauugagggguuccacaguaauuauaauuggguauuacauggcuccacaguaacuccagcuccagggaguuguaucugacaggaagucaguaauaaaaucuacuuaaauuugaauauauacuaucacgugucuaaccuuuaaugguauugcaugauacugucaucaauauuauacuguugcccuccacaggaacucccucacacaugcauaaagauacacauaauuaaacaauuuuaaaauguuagauauuuguuaucaaggucugcauauuuugcuaaggugugagcugcacaauguuuuauagaaguauuccauaguguuauuucucuucccuaucucagaugcaugaagcauuagcuuacauacacauacaguuccaaucugaucuccuuuucagaauauuuguaaauuuuucauuacauuucucuguaugcaauauuauaauuccuaguuugcauuugcuacaucccacuuuuguuucuuccuguuaaacuguccuuuguuagcuuaaacuguucuuguuggcuguauaguacauuuagauuuuuuuuuuuuuugguuuuuuuuuuuuuuuuuuuuuuuuuuuuuuuuuuuugauacaggguuucucuguguagcccuggcuguccuggcacucacuuuguaaaccaggcugaccucaaacucagaaauccgccugccucugccucccgagugcuggaauuaaaggugugcgccaccacgccuggcaacaacuaaagauuuuauuaacuauuauuucauauauuuuaucacuaaccauuaauuuagaauaauguucuaaauguugguacaaguuguaucucagaaacugcauuaauucaagcuucauuuaaguguucaaaauccuuaagacaaagugagugagauacuuucaaggguaaagccauuugccaaacugacaaaugaccugggauccacguaguggaaggaaggaaggaaggaaggaaggaagcaagcaagcaagcaagcaagcaagcgacuucugaaagcuguccuuugaccuccauauuuuauauuuuaaaauaaacugaugguuucucauuuauugaaggauuggaacagagaauaaguauagccugucacuagaugcaccuuugaauuaaaaauucuaguauuuuaagcagcauuaagacuuuuaucuauuuagaaucuuggugaauauuaauuuucaugauuauacagacauauccagcauccagccaacugcaacuugcauucgccccaggauauagucuugagaacugcccaguauaaaaucaugaacaaguucaaaauacaauguuuuuauuugguuaacuugauuacauggcucugagauagaagagcuuuauugaugacaauaucaugcaauacuauuaaagguuagacaugugguaguauauauucagaauaaauuuaaguagauuuuauuacucacuuccugaucauugguuucuguaguaaugagauuaauuuaugauuuuaguaguugacuaaugaauauucacuuagaaauggggaacagacauucuaaaauguugaaagguuaaaagaucaccauuuuacauauuuuccucuuuuaggcuguggaagaacuguuuaacuugaugcagcuauuuauagcucaaaggccagacaugcgagaagaagaauuagaagauauuaaacaguuuaagaaaacaaccauaagcuguuacuuacguugcuuagauggccgcucuuguuggacuacuuuaauaaggugaaaaagauacucuuugaccuuuuuuugguuaguuuuccaaguuagaacaugaaaccuucccuuuugacacuaaaggagaaauaauuuauauuauuuauaacuaaagguuuguucuuuuaaaaauuuuauuauuauuuuaaauauagucuuauguagccuuuauggcuuuuuacugugcacuguguagcuaaggaugaccuugaacuuugauccuugugccucuacauccuauguucuggcaugccacugugccacauuuaugcaguguuggaccaaagcuaaaguuugaaagucgugccuggcaguucauucagauucguauuugggucuaaagaccuuaggaaauagcuuuuucaucuuaagaugagucugauuauuaacaucucuuccauuuuucacagaucuauuuggcuuuauaggaauuagcaaaaauaauagaaccaucuaugcaaugaaccguuccuagcuauagaacugacugaaggacuuagacagugucugcugcaaauuucauuuuccuuucuuuaccuauggaaauuaauuuugcccaacauguuguagugcugagaagauauagaagaauguaggccuaggggaguccuucacugagcacaguucggugugugauuucauuguaauacuaaacuaaugaacccaagaaaaauagauucucucuuccagaaagcuuuuguauuugaaucuucgguggucuacaaaaugaaauaagcacuuuugccaaauccauuuaaaggaacuuuuguagaugcuuggccuucgguucaguaaaguugauuguuugcagcuuuuuccauuuuaaguucuagaguuuugcuguuaaguaaagacaggaagcacccaguggaagugaaaggcucugcauuucucucuguaguaacacuuugcuaccuaacagaaugagcugagcacagcaguaacucaguguagucaugacuuauuuuuaagguuuucagguuuguucauguuucugucccauacccccuucauguuacucucucuucccaaaacugaugcuuuuggaaaauaguauaauuuacuauuauccagaacuucacccagaguacuuagaaguagaaauguuuguguuuucagaggauuuuuuuaaaccuuggcaaauuugcacaacuuauuagcugcacaucauaaucuggaaaugugaagugucccauaacugagugccaacugcugggucaauaaucuugaaauuucagagucuuuuagauuucagauuuggguugcucauuuuauccuguauugccaagaaauaguguacaugccacuuugggaagucaaugcaggaggacugccacaaaauagaggcuacauaauaaaaucucucaaaaauuagaaaaacaauauauguagccaguuuauuuuauauggguaggaaagccagacgcuuaagccaguuagacuucugugucuuugucaacaccagacuguucuggucuauucaauuggacuuucucucuucuucuagugccuucagaauacuauuagaaucugaugaagauagacuucucguaguauuuaaucgaggguuaauccugaugacugagguaaauacuaauugccuuucacugugaauguaucucauuuccaagaguuccuacugcauguauauaaagaauuuaugcuaaacuguuucauagguugcaggauuuuaguuagucuucacuuuauauuuagguuuauuuggcuaguuuuauuuauuuacguaguaaauaaaaaugaaauucuuguguuuugugaucaagaauacauguuauuucccaaaaguuuauuuggcgguauaaaaacaaaagucauugcgaugguugcacaagacugaugccugcaguuacuucuucccaugauucuuaguucacaagggugagauggcuuaaagcuaccagaaguacauuguauuuuuuagucuugugcugggagugauaaaauugaacacucagcacuauaugaauuaagauauacuguugauuuuuuuuuuaguuaguuaaugguauuauagaguaggaacagaauuuuaaaaacuacaauuugcagugguucauggggaacauucaaauagauuacuuccugagcccaaaggcaagggcucugauugaaaugucuacucuuugccugguauugcacagggcaaaagaauguagcaguuaauaaaacguacgauuccugcucuaucggguuacagguuaaauagugaaauaagugaaauuaaaaaaaaugacuaaauuaucuuuacacuaaaauauuuacauaaaauacagcucugaagguaaaggaccuuuaaaauaaaggucccagcacccacaucaaaccaggcagcaugccccuuaccccagcacggggaaacuggagaaaagaagagccuuggaguuagcuguuuagccagucuagcugaacaugcaagcuccaggggucugugagagacucuauccaaaauaacagggguaaacagccaaacaagcaagcaagcacaaaagcaaaauagaaagaaagaauguaaguaagcaagucaguaagcacaaggcuauggagugucucaguugguaaagguacuuuccacaagccacuaaggacaguggugggaaagaacccugcucugcaaauuguccuguucccuuccuaggcacacuggguaagcaugcgcauguguacgugcacguauacacacacacacacacuuugaagauuuauuuauaaagauagagaaugauugaggauaaugccuggcaugcacacaaauacgugcacuuuucauaccauacauaguccauacacauacuacacauacagaguagcuaaauggagaaaccuaacucagaaaacaagaaacauuugcuugguauacacacauaauaucugagucugaaaaugccuuuuagaagauaagaauuucauuuuugucuaaaguaaaaaugaaauuaaagguuuuuaauuuuuuauuuucuaaaucacuuguagucuuucaacacauugcacaugauguaucaugaagcuacagcuugccauguuacuggagacuuaguagagcugcugucaauauuccuuucgguuuugaagucuacacgcccauaucuucagagaaaagguuuggucauauguacuuuuuguuuuuuuaccauuuugcuaccauuuaagaacuuguauuucaaaugagaggccucagaaaaguugacauucuaguuugugugccaaugguuccugagcuaguuaguauuguacaauguuuaucaucucauaauguagagagggaaugaaauguuuguacauacuuuacuuauaccuacuuaaaaacaguaggcaagcauaguaugagaaucaagauuuaggagguuggaaaacuuccacacacaauaaguuggauuguuguuguuguuguuuuaaucuucauggcucaaaauacaucauuuuuagugucaguagaaguaaguuuaaaaauauuuguuaguaucucagucuauaaacacugaaccucaugguucuagaaaaugcaguguauuacugcccuauauaccaccugcagucuuggugaugugaaaagccgaggcagaaaaucccucgagcuucagagcuuaagacaaaccuggagaagcucacaaaaccauguucuuuaggaagucacaugcuucaugucauugacauggauuaauguggguaaaggugcuuuccaccaagucuugaugaguuaagucugguuucugaaacccacagaaaggugggaggagagacccaguuccacggauuguucugugacuuuuacacaugcaccgugccaugugucguccaguucucuuacacccucaccgugcacacacacaaauaauaguaauuuuguacaauagaaaagauguaacauguuuagcacacaccugcaauccucaccccagaaaaacugaaauuuccaggccaaccugggcuguuuauagcaagacccagucucuucuucuugcuacacccucacccugcuccuaccaagaagagcaaauuuaaugugguaaucuaauaaucucaugaaauuaauaaguuuucaccaaaacauguguuugauauaauuaauuugaaacucuugauguuaguaucacaacaauagaagaaaaacuaggaggaacugugauuauuugaaagccuauuuauauaugccuuuauauuugcagaugugaaacaggcauuaauccaguggcaggagagaauugaauuugcccauaaacuucuaacccuucuuaauucuuauagcccuccagaauuaagaaaugcuugcauagguaaguuacuugaaaaauaaaaacuguagaccaauauuucugauuuuuguuuguuuggcuuuuuguuuuguuuuauauauguuguguuauuagauuuauaauguuaggaagauagugauacuugucuguguaacucacacugacuagcaggacccaagaaaaacaagucaauuuuucuuaugcuaguguugacacacuugugugcugaguaucuggggucucuuucaguugucuguaggcuucuugcaacucuaaucuucugaucccauaugaaaaagguagaaucaugccaauauuuacaaaguggagcucaccuguaaaggauaagguuaguucuuucacuguggggguuuuggccuuaaaaauauuucucaguacaugaaaaauagcagugagaguaugcugcuuacagguggaggccaggaaagcagaaauaaaggucagacaguaacuuacucuguggaccaggaacuagagugggguggaagauggaggcagggguugcuuguuuugucuuacugauuuuuuuucuuuuguuuuguuuuuguuuuuuagagacaggguuucucuguguagcccuggcuguccuggaacucacucuguagacuaggcuggccucgaacucagaaaucccaccugccucuugcuucccaagugcugggaucaaaagcgugcgccaccacugccuggcuuacucaauuuuuuaaauugacaauuuuaaauacuucaccuguccaaaauuuuuuucucaguaaccauagacucuuaaauucguaacaccuuugugagcauuuauuuauagagugauaauguauaacuguuuaaagaaucuucuuuuuaaauacagaguuuuuuacuaccugaggaaccacuugaaguagugaucauugggcuguuaagugauaguaauuucucaaaauagcaaaaccaaguaacugcccaucaugagauuuacucuugugugguuccuggaugagaaucauuccagccaauaucccaaaacucugaauaguagacugcagauuaucagcuaucucucggacccaagcuguugagauggacuuuauaaugaaaaauaaucauggaacauugcuguuugacuagacuaugucuacauggaagcaaggagaaugggggaacagggauaguguuguaaauguuugucucaaguaacgucucuucacugugguuaucauagcuggugauccagaguugagcaucagagcuucucuucccauguuaggagcucugccacuguguaauacucacaacauuagaaccucaucagaauuuaugaguucaaaagccauagguaaaucuaaccccaguguuuuaauacucaaauuguuuuaauuuucagauguccucaaggaacucguucuuuugaguccccaugauuuucugcauacucugguucccuuccuacaacacaaccauuguacuuaccaucacaguaauauaccaaguacguauuuauuuagcauaauacuugaauaugguuggcauguaucauucugcacucugaagcuuggagauuuauuuuuuccguuuauucuuauuguacacuuuuaaugucuuagugucucuuggaccuuauuucccuugucgagaaaauaucaagcuaauaggagggaaaagcaauauucggccuccgcgcccugaacucaauaugugccucuugcccacaaugguggaaaccaguaagguauguugggaugccaggaaaaucguauuucuauaguacaagguaaucugagauuuucccccuggcgguugaguccauuagauuuacgugaacguuuuaugaaggcuaauauuagauucauuuggacuuuuuccuuuaagugcucucaaauguugauugauauuugcaaaaucaacaguaagcacuagucguuaagauuuuuuucuucuucuaaaaaaauagcuuaauaguaaaccucaguuuguuaauaggcuaaauuguagccauguccuguauuuaaaucuacaaaguuuaguuaggugcuugaaguguuuuuaauuuggccauauaauuaagaccugcuuacugucccuacagucacauucuucuuaaccuacgcauaauuucacugagugauagauuuaccaucuggcuucuguuuucuacugcuuauucuaaaauagugccaauccuaaauuauagagacaaguuauguuaccacaggauaauuuaccuuaaguuuuaacauuuuuuuuaaaaauauuuuuccccuuuagcuuucuuuacccacaccuucauucacacucucuugccuacuauuuuuggaucuuaaguauauuugagcaauuuuccuaugauaaaaauauaaaaaauaauuagcauaguuacccuuauagaaauaccuucaaaucuuucaaaaagucaaauauaacucauucuucucgauauguuuauagccgugcuaaagucucagugcuguuacucuguagaguauagagaugauggguaauuacagccgguagcaccugcacacugaagcaauccuaggacaguuaugaucuuaauaacacuaggaauuuggaauuuaaaacuagauucuuauagaaguuaaagauuuaauuagcuuuuuacuuaaucuuauuacauuugcacaaaauaugcucuuuauuauacaauuuaagugcaaccauuuuaucaucuuuaaccuucagggcaaagaugacguuuaugaucguaugcugcuagacuacuucuuuucuuaucaucaguucauccaucuauuaugccgaguugcaaucaacugugaaaaauuuacugaaacauuaguuaagcugaguaaguauaaaagaugagcaguaaacgccacugaauuauuuuaagccccuagccauucaggaaggggaaaaaauacauaacaagcccuuuuuuguuuucucuuuuuuuguuguuuuguuuuuuuuuuuuaagugaauguuuaaaaauauuaauuagcauucuugggaauauuuuaacuuuuauuaagaaaauaccaacuuacugguuuccauugaauaguucugcuccaaguuuccgcugauuuaugaaggaguguggagcagggcuggucagcacuuuguagucaguggccuauguccaccaucuucacagcagaauuaaaaaacaaacaaacaaacaaacugccuugcuugagggaaagccuagggacagacuucucuggcccuuaccucagggugaguugaguucuuuagugccagcuccuuuggagccaaaaaagcugagugggcuuggcagcgugaagcauuggugcaccuaugaguaacuaggagguaaguuuuauaaaaugagaagacaaauuugaaaggagccauauaagcacuagaaaacaaauccuucagugaauuacguaggggagaaaaaaauccucagagaaugucuaauaucucucuucaaggucagcaccuagaaguucugagccucuguaugcccugccuucuaauuuuaucaaggaugggccaggauucauuucagaguguggggaaugauaccuaggaaacugcuuagaucaagaaauaggcuauuaccaugccccagaaguccuccuugugcuccaucucagcauagcuccuuuccuauggaaaagauuuugagcauuccagguagggcaaaagaugugauccagucauagauuucauuauccaggaagaaggaaaugguuaccgcugucagggauaaccccucuucagaaaagucaucuuauugguaagugauuagagcaucuucaauuuugaaggcugauacuucuaccuauucaauuagcugauuauaccuacguguaucuauggcugaugccaagauauggggcgguaaagauauaugcagauuagcuguuucagaauuaggcaucuggguuauaacacuugguaaaagucuaaaacuuuagcaauagcaaugauuagguguaagagaauccucaggagccuuugugcucagauaggagguguuuccaaagaugcugaccuuuggacgacuuccagguaacuguguuuauauaaguuauaacaaaguaaugugaagagcugacaguguugaccaagugaugaguguacuaccauuuucgacugucucuuucaucaacacaaaaauuucauggaaauuaaaaauggauauggguagcuugauaugauaccuuaugucugaauucccacacuuguaaucucaacucucaggggccugugguaggaagaugaccaugaguuaagaccuaucugggcuccguagagaaacuguccaucaggacaagcagaacuaaguacagggagagaaaggaucacgccugacagcugcaugccaagucagucuucaugauaaguaacugugaagcaguguugauucugcauuguuuaguuccuuguagcuacacuguauucugcaggguucuacagugaugcacauccugucaguuguucuguauuaccacaggaugcuagcuacuagccaugcccacuuaaaaauuugaagugugaccaaauuccuuugaaacuaaauuuaaauagccagaaucugacuguuaggaaagcacuagauccaaacccaauccauagagcaaaggccugaaagucucucuguccauuccuggcuaaugugcaaagcuggaaauccucuugggaauuuagauacagacuuuagaagagugguauccuaccuaugugaaaauauuauaccgcagaguuugacguuaauucuucuucuagcugacacaacuauuuccaaagaaaggcaccugagaaagggcuuaagaaaacaaaacuuaggcuaaugacagcagugcugaggagcauugguaauaccaaguguugauuucuaugacugucaggaaaaagugauagggguaaguuuaaacugauaaucuuacucauuucauccuugaauuuagauagugcauagauuaccauaggaaagauugucucaaaaacuguauugggccgggugugguggcgcacgccuuuaaacccagcacucgggaggcagaggcaggcagauuucugaguucgaggccagccugcucuacaaagugaguuccaggacagccagggcuauacagagaaacccugucucgaaaaaccaaaaaaacaaaacaaaacaaaaaaaaaccuguauuggguugccaaauuggaagauaagucuuuguuguuuuuauaugggcaacugggcaaaacaugugguugcucaugccugugcucaugcuagagcuccugcuaaggcaagagaauugggcauucccugccuucuugggcuacauaggaacccaccaacaaaaaacaguuaucccucacauucuugaauaccaucauaauuucaucucuuuaucuuuuuacuuucaguuuuuaaauauauuuccuuucacaaaaguaaacuaggaugguucaaaccauggaaaaaagaccaaacacacauauuuaguagauauuaaagauaauauccaguugguagaguagaggugguauuaccaccauacacuugggggaaaugcaaaaagaucaagaacucaaucaagauaguuguugauuacauaaugaguuugaggccaggcugggcugcuugagaccuugccccuguuccagggauggcaagagauagcaauggauagaaaaggacaccuagcagccuccucacaagcacaugcacguguaccacacacgagaccauauuuaucagguuaucaacaucagaagcaagggcuggagagauggcucagcgguuaagagcacugacugcucuuccagagguccugaguucaguccccagcauccacaugguggcucacaaccaucuguaaugggaucugaugccgucuucuuguaugucugaagacagcuacaguguacucacauauaugaaauaaauuuaaaaaaaaaucagaagcaauaaacuuaagaaaauuuugguuacauaaaaauugaaauuauuaaauugugaaaacaucauaaaguauaaacuaguggucuauugugaucucugugaguugaaggcaauccagaauuacauaguaaaacccugccaaaaaaacaagaaaaacaaaaacaaaaaucacaaaguagcuaugggauaguguugucagacuaaacaaauaaauagcuaccaauacaaaaaaguuuuuaggcuuugauuaaaugaaaacuaagcaaaauuacuacauaaauaguuaaugucauccccacacaaaaguauucauuaaccauaugagaaguugccucauuaauaaaaaaauaaaugaugauuuaaccugagagagucgguuagggaaagaacacauuuagcuauacccacucuugagagauuaaggaaagaagagcuagugaauuuugggagacaguuuggcauugucaguuaaaacuuugcauauuccuuacucuguucucauaaaaguggaagauaacacacaggauguuuauuuucacuuuauucauaauguaugaauuggaaacaaaauuguccaccaaugagaacauuucauuguuauuauauaguccucaaaacaaacaagguagcauuucaugaguuaauauggggaagaagaacagcccagaaaaaaugcagcucaaugauccaguaggguuugaguucagucccuagaacuugagggugagagagcaauacaaauguaacuacauucaaaggggugacuuguuacucuuaauaccaaguauaaggccaggugugguugugcacaccuuuaaucccagcacuugggaaacagucugaucucugaguuuaaauuaaaggcagccuagucuacauagugaguuccaggauagccagggcuacacagugagacccugucucaaaacgagcaaagaaacagccaagaaaauacuaucauugcaugaaguaagaucaugggaugcuuuuauauaacuguauuggugaaauuauuuguagugaccgugcacuguggcuggcuguugauuuugagacaggguaucucuguguagccuuguccaccuuagcacuguagaccagauuggccucuaacuuaagagaucugcuuuccauugcuucuuucgugcagggguuaaccuugaccauguccagcuuaugauugcgauuucuuagagaaauacagaaaauuauauugcgaacuauaauuaaucaucccccccccaaaugaauagaauggucagauacaaguuaaauccuuaaauuucaccuucuucauuuaaaauuuauuuuuuccuuuuaaaaaauugauuauuuacauaccaaauguugaccucccuccauucgcaguguucuucaugccauccccuucccuucaccucaccucugaaagagugccuuccaucccaaccccugggcaucgcccuucucuggggcaucaagucuauacaggauuaggcacauccucucccacuagggccagauuaggcugucaguccuuagcuauguaugugcugggagccuuagaccagccagugcaugcucuuuguugguggcuuagucccugggguccagguuaguuggcccuguuggucuuccugugggauugcaauccccuucaguuccuucagccuuuccccuaacucuuccauagggaucccuaacccuaacccaauaguuggcuguggguaucugcaucucucucagucagcuucugguagagccucucagaggacagccaugcuaggcuccugucugcaaauacagcacaacaucaguaauagugucaggguuuggggccugcccaugggacagaucccaauuuggacccauuacuguucggacauucuuuuagucucugcuccauuuuauuuauuuauuuauuuuauuaaguauuuucuucauuuacauuuccaaugcuaucccaaaagucccccauacccuccccugacuccccuacccacccacucccacuucuuggcccugccguuccccuguacugaggcauauaaaguuugcaagaccaaugggccucucuucccagugauagccgaguaggccaucuucugauaaaaauauggaacuuuacgaauuugggugucauccuugcacaggggccaugcuaaucuccucuguuuuguuccaguuuuaguauaugugcugccgaagcgagcacucucugcuccaucuuuguccugcauuucuuuuagaucauuuacauuuuaauuuucaaugacaaaaccagagucuugugccuuuagcauuuaacauuugugaaaauuuucuggauguguuaaagaaaagguuuuugggggcuggagagaugacucagcaguuaagagcaccgacugcucuuccaaagguccuuaguucaaaucccagcaaccacaugguggcuuacaaccauccguaacaaaaucugacgcccucuucuggagugucugaagacagcuacagugaucuuuaaaaaagaaagaaagaaaagaaaagaaaagguuuuuggcaaguaacauauacuuauaaaacaaaaauauuuuuaagacagagucucuauauauaucucuggcuaucugggaacuuacaguguagaccaggcuggcuucucagagacgcacuugaugcugcuacuuaaugcugcaauuauaggagugugccaucacacccagcuaagacuuguuuguuuaaaagcuaggugcggugcuauacacuuuuuaaagauuuauuuauugcauugauguguaugaguauuugucugcguauguuucuguacaccguguuuuucugcugucuggaggagacagcagaaaacagaagacaacccugggacuagagcuacaggugcuccuaagccuccauguuuguacugagaauuaaaccugagcccuuuguaagagcagcaaguguuuugaacugcuaagccaucucucuccccuaugaagaguuuucuguaaugaacauauacgauuucaugguaugcauguacagauccaugauauggaaagcacacuuugauuugugcuucucuuuaggguguaguguuauugacuggaaaauggcugguuuuccuaaaggcuucaaaggguauuucagacauuucagaccccugacauuuaaugcagauauaaagcuagcuuuaccaguccagcaggaggaaauccacauacgcuacacaguuagacaaaguuaacuccuugccaguugguucaacuuuagaggaacugaugugggugccugauuauuccacagucaguagccuacaaggagagcugcaguagguuacuuaguggguaugaaguuagaagaggaauucugucagauaauggguauuuuucgccuaaggugucuugauuuuuuuauccacuagcugaugccacuacuucccuaagauaacaauggguaggaaugacacugcuauagaagaaauuguaacugugaaauauuuuauccucacaacaguaauaccauuuucccuacaaaagcaacuugaaagguuuuacugacaaaccacauagcagcuucuacagucucagguguucugacaaagaaaggcuguauuuaugguuguuuuggggugaggaagggacacaguaugcaacuugcuuaagaaugccuacagaauaaagaaagauauguuauacagaauacaguuuauuuuauaccuaccauucuauuuacugagggaaagccuagacaugcacuugaggcuaaagaaguggcucagcaguuagaaguacauacuguucuugcagaaggcugguugguguugauuccuaauacccaccaaccaccauguuaggcagcucacaaccaccugugcgacuccuucuccaagagaucugaugcccacuuagaacucugcacaugauaaagacauguaccugaggguuuggugacuguguguuguacccagucaaugagacaguuaucaaggaggaguauguagaguuaagagaacauugguuucucacccauccccagggcuuugugaaaauuugagaaguuguaaaaauccuguugcuuugaaggagcaaccuucuuuucagaggaagcagcuugagagggaauuaaaagaacuagaaggugacuuugugucccaacacuggcuggcauaguguugucacugaaugagcuguuaagccugagaagaagcucagugggagagcaugccacugagcaugccucagguccuggguugaucccuguacauagcaugguggggaagguauuaaguaaacagugaugcagacaaaugcaaagaucaugcagugguaccagaggaugggagugagugcauaaauguagauuauuggaaagguauggguauuagaauuagauaacuguaggauacuuguaacuaauagguguggaggugaaucuugagacuauuaccaucccacucugagccuaaaagaucuuccuucauucaagaaaaggaaacaagcugagcaggguguugugugucuguaaaucuaacacuuaggaguuggaggcaagagcaucaggcagccagggccaacuuugguuguacuagaaccuguuucaggagaaagaacagaaaccauccccuucucucacccuaccacaaacacauauacauauaauauauaaauaaguggaguaaauaaggauuacaauaaugcuccccaaagcugugagguuuuaauaaaguagguaccaauaaauguuccuuuccuccuuguuuuaaaaaggugguuuuagaucauaaaagacaucugcagaguuuguuugauaugguaauuaaugcugacuuuuuguagcuguugaaaaguauaaggauuguuuuacuuugaggaauuauugaggaaagaaaaaaauuaauaaaaacaucagugauagugcagacuuucuaugagaguuuauaucugagcagcagucugggcaccgacugaaaacccagauacuaguaacaggcucuguaagccacauggucaaggucacauguucuuuggcuuguuguugucauuauuguuuauuuuaauguuuuuauuuuuacugauccuuuaaaauauaaaagcucccaggucuaggaguucaacaccuauaaucccacaucuuugaggcagagacaagaggacugugauacaaagaccagcuugggcuuuguaucaagagaccaugaugucauaguuaaauauaaaguaaaggcuauucuuaauucacccagucauaaaacagguagcaugaggcuuggcccaagggucauauuuugccaacccuuauuucauggucaguaacaacuaaagaauaugugacuaucaaaaccaaucccuguagccacuaguuugauaguuauaaauagacacucauuuacacaugcuauuguggauaaaugcuuccagccucauccaaauuagaauaaaagaugagaaaugccuuuacaggggacuaauaaauagacuuaauucugaaagagcucucuaaguaugugaucugcuguuuaaagaucucaaaggcuuggucccaccuacuuggaguucuuaaaaagcuaguagccaucugcuaagaguaggauucauauuuauauauuaggaaaaucagaauacgauguuuuguaacacaugaaaauugugauucaaauuuuaguuuugguuaaguucuaauuggaacuggccaucuuuggucauuuugcugccuucuuugccauugguacugucuucauagacuugaguaucugcaguaggcauccuauggccacaaagccuagacuuaguguuugcucuccaccaaaaaccuacucaacucacaauccagcccauucuuuuuaacuagaagauaguuuauauucuacuucuucuugugguuauaguuuucuugagggugaagaaacuuuuauggagggcgcugacauugcagcuuuuguaagagaggcaagaggauagaggggagaaggaacauacugaauguuuaauaucuacaaguuaaaaaauuggaggcuccaggacuugggcagucuugagugugccugagcuccugguuucaaaccccaggaaaauagacucauacacacucacaugcacgcacacgcaaggaggaggguccuaagagcagucauugacaguccuaaaccugaucuacccagaacauccugaggacaaagcaagaagacaguaguagauucagagcaguguuuacuuaaguacacauaggaaacaaaagaggaagaaauguaauucucuggaauguaguucuccuuaccuucucucuggcccuucugaauguaacaacucacaaacuuucuaacacacagaguguuuccuuuccaagaagcuuugaaaaccacuguuacuuuaaucuuccccgauaaauaccaguacucagaaacaaacagaugguugaaguugucuuagaugccucugggaaugagguucaaggguauaugaauaaaaucaaaauuccacauuuuaaauuauugcacugcuuaaaacacugaaaugaguuauccuguauuguuacguauauucuaagaaugcaagcaaggugcaauucaaaccaaauacagagacaguuaacaguauuauaucugcaguuuaguaacucagcaguauaacuuauaaccuauuaugaucuuuuuguauuucucaaauauuagguguccugguugccuaugaaggcuugccacuucaucuugcacuguuccccaaacuuuggacugagcuaugccagacucagguaaaagcaaaugauuuuuuaaaugacugauuucucauccauagcucagaagcaacaagcauaagaugcagagauaugggagaaagcaagcucauggcccacacccacgugucucucucucucaccacugaaaccccuagcagaagcaguguugcuuggccuuuagcucugccugggacaagguuuucagggaucucauacccuuauuuucuuauugagaacaggaacauuuuagcuaaaaccaaauagaacagaaaaggcuaccuuacccacuuuaagcuucaaagagucaacuccuagccagguaugguaugcaucccuguaacugcaacccagcacaugcuggagcaggagagucauagacucaagguuagccugggcuacauaacaggaucccaccucagggggggggaaaguaaaguucuuaaagcuggccuauaaauaaauaaguaaucuggaaggcagauuaaucuaauguaacguuugucucaugcuuugcaucuggccuagagccuuuucuauauaaaacucuuuagugcccuguacuugaugaagcacugccccuuucuccuaugggcagugguggagacaucucuuuacauggucaaacuacaagacuguauaucacaucaccuguuccuggagaauguuaguuucucucuuucuuuccuuccuucccuucccucccuuccuuccuuccuuccuuccuuccuuccuuucuuuuuuuuuugguuuuucgagacaggguuucucuguguagcccuggcuaucccggaacucacucuguagaccaggcuggccucucgaacucagaaauccaccugccucugccucccaagugcuggaauuaaaggugugugccaccacugccugggagaauguuauuuucuauaguaguguuuauuauaacuacuaagcaaacguuggaacuauuacuacgaguguuaguuacagggacguguguuacgaaucuuuagaagguauugagccuaauuagcuaaaguaauuggcacacagaaaauaacuuacuaguuuauuuuuugagucagagucucuauuuguaccucucacuguauugaccugacuggccucaaacucagaucuucuagccuuugccucaggaauucugggauuaagagugugccacaaugcacuaguugacuugaacugaguugucucuucaguaaauuggagcagauuucugcuuuccccuuucugcugcuacuguugcuauuuucauagauaucaauaguggccuaaauuuuuaaauuuuauauaauugggcauuuuaccuaccuacccugugcauacaguacucuuagagacuagaagagaagucucugaaacuggagaguuacagaugauuguggccuguccucuggaugccuggaauugugaacccauguccucuggcaaagcagccagugaagacuuuuaacugugaagccaucuccacagccuccagcacuaaggaucuaaaaaagagccuacccuauucuauucuuaaauucuugaguggccuugaacaacugacuuacucauuaaaauaugcugauaaaugcauauaucuaaauucauguuuacuuauauaauauguacccauauaaauaauguagauggagugucuguuaaaagacauacuacuuguauuuaagaguuacccacauggaucacagggcccccaauggaggagcuagagaaaguauccaaggagcuaaagagaucugcaacccuguaggugcaacaacauuaugaacuaaccaguacccuggagcucuugacucuagcuacauauguaucaaaagauggccuagucggccaucacuggaaagagaggcccaucggacacacaaacuuuauaugccccaguacaggggaacgccagggccaaaaaaaugagaauggguggguagggaaguggggggggaggguaugggggacuuuugggauagcauuggaaaugucauugaggaaaauacguaauaaaaaaaaaaaaaaaaaaaaaaaaaaguuccccacaugaaaacagaaaagccagguuuuaguaaaauucccaaacauugggauccccaaauucuaugugaaacaaauagaaaaaugagaucaaaugguaaaccuuacuuaacuuucuagcaaauguauuuuaauucucagaauuuuucuuuucuugguauauuuauaguuuggucaucuauuaguuuauccauugguuguccccuuaaaacauucguauccuaugccguaaggcuuguuuuuauccuuguuaacucuaugcuggguaauaaagguacauuucuuuuaaaguguguguugacagggcuguagggauggccaguguuuagggcacuggcugcucuuccagaggacccaaguuugauucccagcacccauguggcugcuaacaacuaucugcaacucuaauuaaugggguaucuaacacucucuucugaccucuguggacaugggauagacacauauguauacaggugcaggcaaacacccaccuacccacacaacacauggacuggguuuugccauugccuuccucuagcaaacugcuauagauccaccuguaacugaacaucacccaaagacccccagcugcuaacuacagugcuuccucuccccugcuuuagucagcuaugucgaaaaacugcaucaagcuucugugugaagacccuguuuuugcagaguacauuaaauguauccuaauggacgaaagaacuuuucuaaauaacaauauugucuacacauucaugacacauuuccuucuaaagguauguauagcucuucugaaaugucauuucugcuuaauugugugugcuuauuguguuggucuugaguuuuaggauuuguuuugugcauguacacacucauggaugugaguucuuuuccagguucaaagucaaguguucucagaagcaaacugugccaguuugaucaguacccuuaucacaaaccugauaaaucaguaucaaaaccuacaaucugauuucaccaaccgaguugaaauuucaaaagcaagugcugcuuuaaaugggguaagaacugugccaaaaagauugaagcucaccuuauuucaacucuuaguuggccuuuguauaacuuuguugucaugaguuuaauuacuauuuuauggaucauguaugaugagaagcacuguuuuaauuaaguguugucacacuuaaagcacauauuuuccaguacugagaacguaagacugagugagauacaauauguuaaggguauugagaccacuaagaccugagacgguggcauauacuuguaauccuagcacuugagaggcagaggcaggaagaucaguggcacuuugagacuggcuugguacacgaauucuaagccugccagggcuagaggucuuagucuauaaaaaacagaauauauauuuuaaacuuguuaucauuguauuguuuucuauugauaaguaauccaagcauucacacuaugauuauaaaggcaguuaaaacuagagaguguugauuuacauacauucgccuauagacuggaacaugccuggaaauaccgacugucauucagcacagcuuccuuauaucaaggugcuuacgagccaaaauuggcuaacagcagccaaaccaagcuaagcagggaguuccuuacugagacauccaccauaacugaccuagagaaacuaacuucuaugaaauaaaacccacauuucugaugcaccaagggagguuuaauuuugaaauuacuauuuaaguguaagcugcauuauuugguuucugacuuacgucuuuacucugaccuacucaacauagacacacaacaacuguuauucagcagcaccccuaacuaacaagauguuuaugagccacuugaaucacucaacuaguggaauaccacgucuuaaugcuggcuguagcguuacuccacauuaccagagaaaccaaaauagauuccugggaaauaaacaucuucauuuaaaugaaguuuuauccaaauguugccuucaggauuugaacucuuccuaucuggguuuuuguaggaccugagggcacuugcuuugcuccugucaguacacacucccaaacaguuaaacccagcucugaucccaacucugcaagagcuuuuaaacaaguguaggacuugucugcagcagagaaacucacuccaagagcaagaagccaaagaaagaaaaacuaaagguuagcuguaucaacuaagucuugccugggauuugggcugagggguggcugggaggaugaagacaagcuuggagguguggcauguugcucuugccuaguagugcaaguccuuaauguugaccucuaacaacaaaauugucuucccucauaaucacccccaauaggauuucagugcccucuguuucagguuauuuuauuguauuuuccccccacagaugacgaaggagcaacuccuguuaaaagacggcgagugagcagugaugaggagcacacuguagacaguugcauuggugacauaaaaacagagaccagggagguccugacccccacuagcaccucagacaaugagacaagagacucaucgauuauugacccagggacagagcaagaucuuccgucuccugaaaacagcucugucaaagaguaucgaauggaaggcccaucuucauuuucagaagaugguucacauauccggucacagcaugcagaggaacagucuaacaauggcagguuugacgacuguaaagaguuuaaagaccacuguuccaaggauacuacacuagcugaagaugaauccgaauucccuucaacguccaucuccgcaguucugucugacuuagcugaucugagaagcugugauggucaagcuuuguccucccaggacccugaagcugcugugucccucaguuguggccauuccagaggccucauuagucauaugcagcaacacgacauuuuagauacccuguguaggaccauugaaucaacaauccauguggucacaaggauaucuggcaaaggaaaccaagcugcuucuugacauuagacguggcaugucuauucucacgugcccuccccuaugcuguuugucaaguuugcuccuuuguuuugugcuucaguuuguccagugcucucugcuugaauggcaagauagauuuauaggcuucaauucuuggucaggcagaauuccagaugaaaaaaaaaaugugcaucuucuguauacuuucuaaagggcaaucagauaauggauauguuuuauguaauuaagaguucacuguaguggcuuucauuuaauauggcuuucugggagaagcagggcucugacccuguaugauguaauuuaaacuuacagcauuuuuacuguguauaauaugguguccucugugccaguuuuguaccuuaaaauaagagaggcagauugccucugaucgcugugguucuuauuaucaaaauuaaguuuacuuguauacggaacaaccacaagaaauuugauucuguaaagaauccucuuuagcuguggccuggcaguauauaaauggugcuuuauuuaacagaauaccuguggaggaaauaaagcacacuugauguaaaaauaaugguuuuauuuuuauugacaugacugcuguucuguguacuuauaaacugacugugaucacuuuuccuuuguuacauaagucguuuguuucuucaaaugacagcaguaaggagacugaaagggaaccacguggccuuucugcuauuugagaaguccucuugcauccaaaacaguuaauuuaccauacagaugucucaucccuccaaucccgaaguguguggcuauuuggaagacaucaaggagagccagagaaguguaacagaaugcagccaccuagcccucacagcaacacucuggaaacaccuuggaaacuggcuuagaauaaaggaauaguauagcaugccauuuauuugucuuaagcuuaaaucaauuguagcaaucaaguagcagccuaugaccagccuuagcucagccuaccuacuuaucucagaggaacacccauggaaggugagauaugacacccgauuucacucaaugcagcaucuagaauauuucaaacaaugcuuuuaaauuguguuguuucaugaauuucauccaauacaaaauaaauuaagggccuugagggaaaggacuuuuuaaggaagaaaaaaagaggugaguaaacaggacagguuucuauuuuaaaaaggauguccuuauaaaaaccuaacuaauucaagcauucugggcgguaagcucaaguaaaccuuuuauuucuucgaagugcugcuucugccaacagaauuucauauuuuccucuuuacagacaggaacucccuugcaguccaauuguaauuccguuugcccuggagcaggcacaaaauucaguucaacuguug

SEQ ID NO: 5910 - RNA, 5168 nt, Mus musculus
auugcauucagugaaagcccccagguguacccucccccagccuugagcaggcugacucagaccugcucugccacugccagcuagcccaccuaggguggaaucuucugaccuaaauaagguuuauaguucugccacaucugugguuuucuccaagacaacacuaccugcugagaagcugaaccugucuuccggaggcgaucuagacaaagcaacagccuggcaacagagugaugagagccuggcaacaaagcaaggagagccuggcguggugggggaugggcuuuccccuuuuuaaguucagacucaaaaaguaaacuuugggccuugaucaguacuuguuuuggucucauucuucucucaucucucucaugcagccccagccuuccuuucaggaacucaguucauguagcugcuggcggcuacacccagggacaggcuuacccugucugucuguaguguuuguuaaucuggaaacaggagcagcucacagaaguccacccgccuccaccacugcugucugccucauacucacaguaaggcuugaaaauggcccauuccccuucauacugagauacaguguccacaaggaggacagaguauacuggguuugcauauguaucuacuuggacaaccauuaguagauccaaauaaaucuuuucuaucuucucagaagcaaccuuuauguguagaaagacaggaacagacucaggcccacaaccacaggaucagggaguguggggaaagcuguguaccuucaucgaggagcccaccaggauuguuacaacucugcuaggugcuagucaccaauguccucaguuugaccuccagucccccucccccuccacaaagauggagaaggugaagcccuucuggaugaggcaaaaaaggucuggccaaagaccuuuucugugauaugaaaguaucucucuaaaauucacuuuugacacucuguccccagagcagcaggguggggccuuuguggauggucauaaacaaggucuguagaggagagucugucgucugucacaggauguggagcacacagcauggagcacuccuuccuuagggaagacguugcaaggcagugacuggcagaaaggggcccaucccaucccaucacuaaccuguagacuccuugaucucaagcuucucccuuccagaggugaggaauaaauuucugcucaguacaaaguauccaucuaugguccuuggaaguaacaacgcagaguggaccgagugcccugaccagccucaccuuggacucuuucgaguuggcagaagcuacccuguguuuuguuuugaagcaggguuuugauaagcgauauuuuaagcauaauccuccugccugagccugcaucaccccaguagcaggccugugccaccacgcccgguauuguuacauccuuucuuaaacugcuuucaucuaggaaaaugcagcgcugcccuuucugccauggguuuacccccuaccuaccugguuaggucaggccugccuuuaucuucugacuuaucaucuuguucuacuccugcuuccuggagcuguggccuucacagcaccugguugugacucuaggaagccagcacggugagauggaauaaagagcguaggccacuccuccuggagagaagcccuuagauacccucauccagcugaucgaggugaguuucauaaaaaaaaaaaaaaaagcgggucaguuaaucucaccuguggaaaggaugaucaaugggguuugagucaggagaagaaagcuacaaucuggaaaauacuugucuaaaaacugacuaagauaaugccaaaugcccucugccuacaagagaauggccauaguccacagccccagagaaguugguggccuuccugcccucaggccacggucuggagcucagcaguuccaugguucugugaggucacugagagaagaaucaggacuugggucugucuccagcugcuccaaguccucacuccuuuggguuuuggcaauuuugggaugaggggggagucagccugaguaagcaguggguccaaguucagucuccccuccagccaccacagccucuuacugccuuuaugaagagaaauuaggcagcgugagucacuuccaccaaaguaagcugagacucugaagcuccucagugggagaacaacacugaaaacggccucuuuguucuucuguuucuagaaaacauaaagaacaagaaaucugcauucaaacuaggcugaacaaaaauguuuacgcaaagugacacugggaaaauagaggagauuuucacaacgaacaccauggccuucgagaccacagcgaucacauucuucuucauccugcucaucugcuucauuuguauccuccucuuacuggcaauuuuucuauauaaaugguauaagcccauguuaauacucaaaguagaucucaaggcacguagcaaguauauauagaaauaauauauaauaauuuuagauagcugguggcacacagauauaaacagguggcacacaccuguaauccuagaauucuggaggaagaggcaggacgauuaguaauucaaggucauuauuacacagagauuucuaggucaaucuaggcuaugggagacgcugucucaaaacccaaauugaaauagaauaaguauuguaguaaguauuccacuuccacuuguuuuauuuauuuauuuauuuauuuauuuauuuauuauuuauuuauuuauuuauuuauuauuuauuuauuuauuuauuuauuuauuuauuuauuuauuuauuauauguaaguacacuguagcugucuucagaugcaccagaagagggcaucagaucucauuacagaugguugugaaccaccaugugguugcugggauuugaacuucagaccuucggaagagcagucgggugcucuuacccgcugagccaucucaccagccccaacuucggaguuuuaaaagugccuguuuccuguuuaaaagugaaagucccauaccaugccuuagagucuucuuuuuugaaguuuuucuuguuauuucaguuacagaggucacaaccaugaagagccacugaagacccucuguacaggcgaaggcugcguagcugcuaaugcagagauggacaaacccgaagaucaagacaaguaagucuagggacuggggagagggcuugcugcuaagguaugacaccccaaguuuggcucccagcgccuacauaaaaugguaaguaugauagcaaugucuguaaccccagcugggggcaaagacagacagucccuagcccaggggagcuguguacuucagguucagcaacugaucccauccacuccccaaaaacaacaaagaaaugacauccaguuggcaacaaauagucucugaacucuauacacacccagucagauaagagacuguauauuuauauaccacacacacacacacacacaacacacacacacacguuacacauacacacagucauacacauacacacacagacauuuauacacagauacacaguuacacacauagucacacauauaauacacacuuagacauauacacauauacacacagacacacagaucuacacacagucauacacacauauacaacacacacagcauuauacacacagucauacacacagucacacacacagaguuacacacauacaaaguuucacacacacacacaccaacauaaagugaugaggauguccuagccauuauuauuugugguaaugucgacuaagauguauggauuuaaaaaaaaaaaaaaaaaaaaaacucuugaugauuuuccaggguccuaaugcacuuuuuaaacaugggcuugccgaugaagccuagcauucuugugcaaaagcagaguaaggaagagauggccacauccuuaggagacaacaucaaggcagaagacuaccaaaagaaacagacauaugagccugugaaugcuagagaaaccaaccaugaggugacauguucucuuucagggguugcucaggguuuaaguuugaucggggaggagagucgccaugugggcguaauuagaucauaaugguuccaugaggcacugucagucugcaggcuuccacuguuagcuuucauucuuacauuccuguucaucuuacuauuucuccuuuguuguuuuucuuauacuccugggaucuuagaucuauaaaaguucuugccacuuaucuagggccuaaacuuuugucccauggaaaacuaaagugacuugugaccuuccuauggccgcuaaacaagcacuguguccuuaccguaggccugcgaaccuuccacaucugcacacaaucacuuccagaacuuucgagagcuccucccauuccucuguagccuaagaugggauacuaggccauauugcucucagcuuugauuacaugccucaaauaauguuaguccgugucaauguagggagucaaguaugguugauuaucacugcugaaaacucuuuucuauuucuuguucucaauguacauauuaauaaugcuuuaaaacacgggacuccuugcuguucauagguuggucauuuguuugucccguucucucugcagggugagcuugcugagaaaaugcccauacauguccacagaucuucagauacaggaagccaaaaaagaccuuuaaaaggagugacauuuucuaaggaggugauuguuguggaccuuggaaacgaauacccuacaccucgaagcuaugcucgagaacauaaggagaggaaaugaaguguagaaaaagcugugcggaaaguguaaccuuugaccagcuuggaucgacugaggguacugggucgugucaaggcggcaggaggaugggaagugaacaaauacagacaggauucuaccuucguggaagaagagaacugugcaaaauucuguacguaaaauacugagcucgaauauaguuuuuaacaaacaaaucugaguuugguaaguugacuauaauaaauauccuuaaaugucugucuagcauaaccguaaguauaauguuuguucagguguucuagaaaagccacacuugccgggugugguggcgcaagccuuuaaucccagcacuggggaggcagaggcaggcggauuucugaguucgaggccagccuggucuacaaagugaguuccaggacagccaagacuauacagagaaacccugucucgaaaaaacgaaaaaaaaaaaaaa

SEQ ID NO: 5911 - RNA, 4199 nt, Mus musculus
auuuuuagaaaauggucuauuuauuacaucaacaaaaaucacaguauacaaagauauuacaaaaguaacacaauaugcuauauaauaaaaggcaucuugacauuaaaaaaauauuucaucuugauacaaagcuuaacuucuuaaguaccaguaucuugagaacuuaaaaaaaaauaauuucaucagagccuugaaauucauucaucaucaagcauauaaaaucaguuugaaaugcagacaacuuagugguagagagcuaacaccaaccauaacuuguaugagacccuggguucaaucccagcaugaugcuccccuccucucugaaaucuaaauauuuuacauuaggugagguguggugacauaugccuacaauccuaguacucagaagggagaggcaggucaauauucaauuuaaggucaaaacaacagcaaagauuccccuguuuuguaggggucuauuaaccauagccaauaguguuuuaaaguucucuggugacugacuagcugaggucucccucaagcaucccuccugccucauccuuccaaguauuggagcuacaggauauaucacuauggcugcuucacuaagagcagugaagucauaguuaucccaagaugccucagccuuacuuuacuccagcucaugagaaguuacauuuuggcuaaagaagcuuagaaaaaaauuaccauagguaaauuugguauuuuaccaaaaauuauaaagcugcuaaaaacucaauuuguugaggagucaacauuucuuuuuauuuuguuugugauucuuuuguuguuguauugguuuguuuuuggguuuguuguuuuuugagacaaguuuucucuguguauccccaucuggccugacacuuacuacagaguaaguguccagcccaaacuaacagaaaucugccugccucugcccccugggugcugguuuuaaaggaguguguuagugccaccuggcuuguuugugauucuuuaaaguucugaaagcuaaaaaaaauaaauaaagucugggaggcagaagcagacuuccaugaguuccaggacagccagggcaacacggagaaacccuguuugggaaaaaaaccaaaccaaaccaaaccaaaccaaaccaaaccaaaccaaaccaaaccaaaccaaaccaaacccaaccuccccaaagccaaccaaaaagacaaaagaugaugaggacaugcguggguuucggccuuucuacagacaugaaaacaaucagaccugaucacuuuugagauuugaucucauccacuguugaccuugagguuuaaauucugccaugauguucggcuuaaauauucaagggaugaaacuggauagacuuggguggcaccuucaugccuauggcccacugcugggcuuccaagaauagcgugggcuuuccauuccuagacacaaaagcauucuauccucuuccgugcacauccaaccucugaacagaccugaaacccugcaguggcaacgucacaggaguuaaaguacucccaaagacucucaacuuacacaaagaaaucaagucacaaaauaccaaaaguaaagccaguaacugacuucccuugauaagaaaguguccucggagagagccagguccauauggggcaacuuaaagacguuugucuaaagagaaaccugcuuuucucauaggucucccaaaguguuuauccacccugugauuuuucucucuggguaucaagugguuaagaauguuuggauaauagacuaaucagggcccaugagaaacacaaucuuuaacucgguguuucuauucagacauuucuuagcacaaaccacacccuaggaaguaggaaggccagguuuuuaguucuuuggaguuaggcaccgagucuuuagcuguacaugcuaggugcucuaucacugaacuauagcucaggacgcccuuuuuuccacuuuauauuuugagauaggagcucacaaaguuguucccuugaagucacucugcagacugugcaggccuuaaacuugugauuuucugccugaguuucugaagaccagcagguccauuuaggcuaacugacuaaaaucagucucucuucuuuaucuuguugcaugcugucugacagcuuaugguaaacuuucaauauuccaacuuaugauuaaaacuugauaugguacaauuagacaaccuggaucaccaauuuuaagucucuccacaaaaauauaguuuuucugagacuguggaaacacgacacagcauaguaaaacaaacugacuuacucuacacuaagguuuuccaaauggagaacuaauuagcaaaagaaaaggauaggaagucagcaggcucucaaaaaucagaacagugguuuggaggugcggagaacuucuggggucccaagcauagugguugcauuguuuuaauauaaucaaaaauucuucaaauuauaccuuaaaguuuguccauguuucugugguugacuauauaugugauucuucauaagaaaagaaacauaucuuugagaacaaaaguugaauaccauuccccucuuauuuucuacauggaacaggguacauuguacaauauacaguuacaaaaauguuaugaauacaggcuacuuacaugucuaugcaugguaaacugucaagggguaccgcugggguauguaggauauaaccuuccauacagaggcaggauuucuaccugauacuauacuggugguacuacgauuuccaagagaacagcuuuggguaucaaagagccucaggguaguuuuuauacuuuuguuuuauaauuuuguuguuguuguugcaauucuggguaucaaacacagggccaugcucuaccaugaagcaugugccagugucuguauaguuuuuugaaggaggaggaaagaggaagaagaaggaggagggggaagaagaggaggaggaagagcagcagucgaccagaagagaaguaugucucacaggacagguuaucuuggcaucauuacuuuuccugcagggugaagcaccuuucccauuaaaaacuauauccucaaauaugauuuuauaauuaucccccuuuucuaauaaauagcuacuauuuauacagcaccaguuaggccagaguguacgucaaaugcuagagucccagagauaagugagaagcacuuaacugacuaccauccgcugaaggucuguaauauaggagcagagagaggcagagcugcaccucucagcuguagcagcaggaccaagccuugcagagaagccugcuguuaaaagcuaaguguugggagcacaggcagaauagguuacaucuauagacaccugugggaauaaauucaacauguuccaacuacaacgucuaagaggaauaagguaucaaaaaaaaaaaaaccuuaaacauauggaaaagauauucacugaagaaaaagaauaaagauuuccaguaacagaaugggcagacacaggacacugaguaggcagacucaaaaggacaauauaugacuggaggacaaucagauaugacuuugaggucucuauuaaauuauccccgugacagcaguaaugccaugagggaagcagagcugagggaaggcagcugcuuaccaagagcaucccacagcaggagaagcugcggugcugaggagagugcagacaacacagccccgucccacaggauccuguccuucaggaggugccaggcuauggacagcacagacaaggaggguaaaggcugacaggaagacaaggaacugggaaaacuaaagacagagauggaaggugaaggagcgagcgagaggugagaagauggaagaggcaaaauguggaggacagggcacugugggggaagggcucuugguauuuagaggggaaauuuuuuaaccuuuccuuuuaagcucaagaagauacuuacucuguuuaugcaaaggaagcaagaacuaacuggugacauggggacaggaggagagacgcugugcacaagcagaaucuggaaaagaaggccaauucuuucaaaaccaugugaaauacaaacgcagccauagagaaaggaaaaacauguugcuaaaugcauuguaagguauaaacugaaugaugugaucaguaagaggcacuggaaaauaaaacgucaauugaaaauacucuaaaugcagauguagacagaccuuaguucaacuuagaggaaaaacugugaaauaagucacugugugaguaccaucuguugagcucucuaauagcugcgu

SEQ ID NO: 5912 - RNA, 1301 nt, Mus musculus
cagaguaucggcgcuacuucuccaggcucugcuacacucucccagccaggcagccggagacgccgcggucaggcuuugccacgagugacaggcucucgcgcgacagaacgaccccucaggguaccugagccgaaaugaaucccucauacacaguuuucucccgguucugaggaaguagcagcgggaaauggcgcaacaggcuugcuucugcuucguccauggcgcacaggaauggccgccgcacaugcgcagucugcaaagggacggggcggaaacccgcuucggcgggaaaaacuaacugguggguacgcugcccugaccuggacaaugaacugggccaacuggucugcuuaguagcaggagaaagcaggagaaaggaagaucacucacaaguccacaggccugacgguucaggauuauucugaccuugacugucaaaaaauaaaacuagcaaaauccucuuguugauuucauugaagacugaugcaacuccaaagcugacuuuccuacuuugacagggcauuuacagugugcccauagcauacuguuuuuacccugaaccugccccaucaccucuccuguucuugcguuugcucuggacuagaucuccuguauacucccaguauacccuucaaccaaaugcauauguaaauaaauuguacauucaauacaucauguauauuguaugcugauucaguguuguacuguuuuuaauuagauauauuuaaaggaagcccauagaaauugugagagauucaauuuauucuugaggugguagacugacaaaauuuccuauacauucugguaacuuagaaaugguuacucauucacucauuucuaaauauagauuuaagaaaacguggggggaggggguguugauuguguaagaaacuuguuaauaguuaccauaugauaauuuggcauuagaauaagucacuuuugauucuacuauuuuuaagaucacuguaauauguuaguaaguaagauugugcaaagaugaauaagauauucuuccuauucuuauugcccucauugaagauuggauuuuaaaagauuaauagauuggcagaauuugucacaauauucugaaugcuugaagaacacaagaauguuguacuuguuacacuaagacugugguucgcaaccuucuuagugaccccccccaaccauaaaauuauguuguugcuucuuuguaaccguaauuuugcuacuguuaugaaucacaauuuaaguguuuuuggagaaccaguaugauaagacuuucucaaaaugugacucagauugcaguguugucagcacua

SEQ ID NO: 5913 - RNA, 2752 nt, Mus musculus
aucuuuuuuaaaaauguguggcauuuguauuguaauauaacuauauaaaguauuauaguaauauaauccaaaaaugauacaaauuauucugcaggaccuuauagguuauaagcaaaacauaugccauuuuauaugaaagacuucaucauacagauauugggauggauuugaguccuggaaacagucauuuaaaucaucaaaagacaacuacaguauauuuacacacacauuugcacaugcuaaacuauuucuaaaacaaaauacagcauaaaaccuaguggaaagaaaacaauguucaaaaauuacuuaacauuuuuagaugaugauagcagcauuaaaucaaauguacaaauguauaggacacacaccaaggaacugcccccagucuaaccucacacacagugagaaugagaggggaucuaguggggagugauauagucacuguuuucuggagaauagcgggaagcgggagcugaagagacuuaccuugcauugcagaaguucuuugccauuuuaauuuuuucacauauaaagguauuacuuguaaagaucaaggacaucaggggcucauuugggcuacaaccuuuuggaguuguaguuuccuuguaaaagacucugggggaagguauggcuauggcacagugaugcuuccagacuacagcauaagcuggauggacccugaccaaaacauucuacagagaaugcucugggcaccugaaauuucuguccuaaaggcugagugggcuuccaggaucuauccagugcucuugccaacguucuuuucuccuuuagagugggcaaugaaaaggaugcuuagacaaauccuuggguguccucuaacauugggcuaaaacacugacucuggaaagcuuucuauggccuuccccaaacaagucauauuuucccugguucaaaguacauuuuguccauaucagucacagauuaucagggacuuauguauagugauucacguccuuuuaucauaggcagaauccuguuacauaccauaggcugcaauuuccauaugcagucguuacaggcaaaugacagcagaccaggcuaauuuucuuggucccucauacauuuaaagaaucgcaaugauaguucaaauuuugaaauccuuuucaaucaagcgacuauguacauaagacacccuuuuaaacaugaguugccgccuaaccucgucaaaucauaagcacacuuugacaagcauggugaugacuacaacucccgaaauacaccgcgggaucaacaugugcaccugccccguguucaccuuucagguuagagccaagaguugagggaccauauaagagaacggagaggcggcagaacuacgcugggagcggaugccuucgggcgagcgucacgcucugagcgacguuaacuucacgcuggaaaccguucuugcggcacaugaagcugagagcuccccgaggauugugaggcuguacgccugugcuugccucgucgcugccgccggucucucugaaccuuuuaaugguccgugguacccggcuaacggaagaacgcuucggcgggaaauaggaacugucaacgcguuuguggaacauuagaucgcccacugcucaucguggccauggaacaccuucccggcagaagccucgcagauucuauaacggauuuuagugggugaaggcucgaccucccaucgucuucacgaaugacucgaacacccucaccccgucucaguccuuuucgggcugucagccugagucccuacacuuggcuucacucuaguccugugcacgcauucggacuucucagccuggcucuguucugcugagagcaaguccagaguugacaacccgccacaugaccaacaucagcccuacaaaucccgaagaacaacucggcaacuccaucgccaaggcaaccuucuacacacgcuuccucccggcgcagguagaaaagcucgcgggacuuccccgcccaacugagauucccgaaucaggaagcggggccgaaagaggaggaagucccuccuuggccggcucaccucggcggcgcacuccucgcgagaucgccgaggucugacucuccggaaguguguucggagguaaagguacugugcguugggcucgucggccgccguagccccugcuagggcagcccguacgaaccugcuggaagaggaagagaaaggcagagagucggguuacaagauggcggaucuguaguaguaaccgcggcgggcggcggcagcgggagagcgagcgagcuccgggacgcaaaaggaagggagagugguugugcgccgcggugaagggagggguagcggagaccacgagcggagggcucucgguggcucuggucaccccuucucgcggcuaaaccuuuagagccaugguaaacucgggccucuccagagucgcugccaccaccgccgcugccgccacuaccggcucucaagagugagggauaccggcgaggugagcgaggagguggcggcuggaacgguggggccagaagccaccaugucggauacacggaggcgagugaaggucuauacccuuaacgaagaccggcaaugggacgaccgaggcaccgggcacgucuccuccacuuacguagaggagcucaaggggaugucgcugcugguucgugccgaguccgacgguaaggguauuggaacggugggguaggggauagugcaucgguugcggcacaaccugaggguuaagcgcugcgcuccgguacuguauucugacuagcaccacuagggacagcg

SEQ ID NO: 5914 - RNA, 2328 nt, Mus musculus
caucacaguuccuggagcuggaguuaccaugguaacacacugggcaugaguacuuggaaaugaacucaagucaucugcaagagcaguaugugugcuuaaguucugugccaucucucuagucuaucagggagacauauuuuauaaauaaaguuuauauuugguaguuuggaagucaucuguuggaccuuacuauuaguguuguaaucuaccauguccagacagcuuuccugagcuugagcuuuuaacagggcuugaucugggaagcccaacuccuaaaccuucuaccuaaggaaucucacaaaauccuugacaaaauuauaaguucaacuuccucucuccagauacaaccugcucugccagcaccugggauuccuagagugucucuccaugcaaaugaggcauucccaguaugcuaagcuccagccaaugauuuacagucacccuaaaaaucccuuccuacucuccaagguuuauauagcucuuguucaccccaaauaaagagcacaagcaguuucacuuaauaucaucuaaaagagcuguaacauugaaauccucagaaaagacacccccacucccacccaacuccccagcucucacugcuugaaccaagaucugccugaacuccaagaaaagaagcagaacucggaaccauagucaucuuuaaagaucuucuucccugaccuccaaccccagacagagacucucugugucccugguuguccuggaacucuauagaccagacuggccucaaacucagagaccuaccugccucugccuucgagugcuggaauuaaaggugugugccaccaugccuggcuaucuuuaaagaucuuuaagaauuaucuguacucuuaucuggcugguugguuaaggcaaaugugguccuccaagugaaggaaugaccuauucagcuccugugcucugauggcacaugcuguggcagugagugauauaacauccagcuacauucucuaaagauagaaguugucugaccaggaccagcagguaaagaucucucaaugguuagugguacucuguuguagccaccuggggccacacgaacuggguuuuugagugugaggcuggagcuguaaaggagggaauggcaagagaaauaaagagaccaagacaaauuuuuugaucauggcccaauguuuacuaucagucugugcuuauaaaaggggaagcccaucuccugccaugccagguuucuuggcuuuguugcuaaguuguuaggacuagucugucagaguuauuagcauuaggucaccaauuccacagguugucagcuaucucaggaauaucucagaaagacaguucagccucucagugguagcggagucuuggagaagagcagcagugggugacagaacaauagaagcauugaccagguugucucauucacaguggcagcaaggucugaaucagccugcucaaggcugugggaggcuacaauuccucucuaaauauauaauaaaaauuaguuggacuggggcauaaaauuuauuuaugcuccauaauccugccugggaauuaugguggcuggcggcugugccuggcuugggaacuuagauuuucuaugaacuauucuauccaucaaggagaguauguguagcuugcuuguguuuauuuugcacaaacauggcucugugguguauuauugauaaaucauggccucuuggcacauacuucugucuuagaauuugaaauaguccagaaaucucaguggcccgugaucauagcacaccuuauucccaaucagaccaaagucacaauauauauauucaauauguuucuuccaauugaugaauuucugccaccucugcuugcugaaaggaagccugcacacuuguugaagaggagccuguaggguguugacugaccugcuugaaauacaaagucaagagaguucaaaagcaacaggauaaaggcugucuuuggggaaguccagguacucuauucaguugcaaauuagcaaugaucaagcucaaacucuggcuuccagguggcuuugaguaucaacagaaaggcuguuucucauguaaauaggcuaagcuccaaguuaacucugcuagcuaaugaagauguuuagcuaucuucauaauagaaaucucugauauugggauuauuacuaaaccaguccaagauugaguuagaguaacuggucacauuaaaggaaagagaagccaggcgugguggcgcaugccuuuaaucccagcacucgggaggcagaggcagguggauuucugaguucgaggccagccuggucuacaaagugagguccaggacagccagggcuauacagagaaacccugucucgaaaaacca
